United States Patent 7,314,974 (EXPRESSION OF MICROBIAL PROTEINS IN PLANTS FOR PRODUCTION OF PLANTS WITH IMPROVED PROPERTIES) - sequence listing, part 13

SEQ ID NO: 37713 - DNA, 1476 bp, Pseudomonas fluorescens
atgaccaccgtccgcactcgcatcgcgccatcgcctaccggggatccccacgtaggtaccgcttacatcgcactgttcaactactgctttgccaagcagcacggcggtgagttcatcctgcggatcgaagacaccgatcaattgcgttcgacccgcgagtccgaacagcagatcttcgacgccctgcgctggctgggtatcgactggagcgaaggcccggacgtcggcggcccgcacggcccgtaccgtcagagcgagcgcggcgatatctatcagaagtattgccagcaactggtcgacatgggccacgccttcccgtgcttctgcaccgctgaagagctggaccagatgcgcgccgagcaaatggcgcgcggcgaaaccccgcgttacgacggccgtgcactgttgctgtccaaggaagaagtcgcccggcgcctggctgccggcgagccgcacgtgatccgcatgaaggtgccgagcgaaggcgtctgcgtggtgccggacatgctgcgtggcgatgtcgagatcccgtgggatcgcatggacatgcaagtgctgatgaagaccgacggcctgccgacgtacttcctggccaacgtggtcgacgatcacctgatgggcatcactcacgtgctgcgcggcgaagaatggttgccgtcggcgccgaaactgatcctgctttacgagtatttcggctgggaacaaccggagctgtgctacatgccgctgctgcgtaacccggacaagagcaagctgtccaagcgcaagaacccgacttcggtgacgttctacgagcgcatgggtttcatgcctgaggcgatgcttaactacctgggccgcatgggctggtcgatgccggacgagcgcgagaagttctcgctgcaggaaatggtcgacaacttcgacctcaagcgcgtgtcgctgggtgggccgattttcgatatcgagaagctgtcgtggctcaacggccagtggctgcgtgatctgccggtggaagagttcgccgctcgcgttcagaagtgggcgttcaactccgagtacatgatgaagatcgcgccgcatgttcagggccgtgtcgaaaccttcagccaggttgcaccgctggccgggttcttcttcgccggtggcgtgaacccggatgccaagctgttcgaatcgaaaaagctttcgggcgatcaggttcgtcagttgatgcaattgatcctgtggaagctggaaagcctgcgtcagtgggagaaggacagcatcaccgcgacgattcaggcggtggtcgaatccctcgagctcaagctgcgtgatgcgatgccgctgatgtttgccgcgattaccgggcaggcgagttcggtgtcggtgctcgatgcgatggaaatcctcgggccggacctgacccgtttccgtctgcgccaggcgattgacctgctgggcggcgtgtcgaagaaagaaaacaaagagtgggaaaagctgttgggcgccatc

SEQ ID NO: 37714 - DNA, 1434 bp, Pseudomonas fluorescens
ctgctgggcattgaccttggcaccaccaacagtttgatcgccgtgtggcaggacggtcaggcccgattgatccccaacgccctcggcgaggtactgaccccgtcggtggtcagcctcgatgaagacgagaccattttggtcggcaaagccgcacgcgcacgcctcacgacccacccggaacgcacagccgccgcgttcaagcgattcatgggcagcgaccggcagatcgaactcggcaccaaaaccttcagccccgaagagttatcggcactggtgctgggctcactcaagcaggacgccgaagcctttctcggccacccggtggctgaagcggtgatttccgtgccggcgtatttcagtgacgagcaacgcaaacgcacactgttcgccgccgaactggcgggcctgaaggtctcccgactgatcaacgagccaaccgccgctgcaatggcgtatggcctgcacgagcagaaattcgaacgcacgctgatcttcgatctgggcggcgggacgttcgatgtcacggtgctggaatatgcgttgccgctgattgaagtgcatgcgtccaccggggacaactttttgggtggtgaggactttaccgctgcactgctgaatgcctgtctgaaaaactggcgactgaccccgtcgatgattgatccgcaaggcatggccagcctgggcgatgccctggaacaactcaaatgcgaactcggcgaaggacctcaatcgctgagctggcaccatgccgacaaactgtacgaatggtcgctggatgaagccgctgccgtgaagatctgggaaccgttgctggtacgattgcgcgcgccgatcgaacaggccctgcgcgatgcgcgcttgaaaccacgggatctcgacagtctggtgctggtcggtggggcaacgcgaatgcctgcggtacaacagttggtcgccacactgttcggacgcctgccctaccggcatcttgatcccgacaccctcgttgcattgggcgcggccacgcaagcggcctgcaaggcgcgcgatggcgcgatcgaagaactgattctgaccgatgtctgcccgtatacactgggcatcgcaaccatgcgtggcaaaggcatcgacggcgccttttcgccgatcatcgaacgcaacaccatcatcccgacgtcacgggtagagcgctaccacacaacccatccccggcaggagctgctgcgcattgccgtttatcagggtgagcggccgtgggtacgtgacaacatcctcattgacgctttcgatgtcaccttgacgcccaccgataacattcaggagctggacgtacgcttcagttacgacatcaacggtttactcgaggtcgacgtcacgctgctccagaccggcgaacgccacagccacagcatcgaccgcagtcccaccgggctgaatgaacaagcacgcagagac

SEQ ID NO: 37715 - DNA, 1110 bp, Pseudomonas fluorescens
atgaaacgtgtaggtctgatcggttggcgcggcatggtcggttccgtgctcatgcagcggatgctggaagagcaggatttcgatcttatcgagccggtgtttttcaccacttccaatgtcggtggccaaggcccgtccgtgggcaaggacattgctccgctcaaggacgcttacagcattgaagagctgaagaccctcgacgtgatcctgacctgccagggcggcgactacaccagcgaagtgttcccgaagctgcgcgaagccggctggcagggttactggatcgacgcggcctcgagcctgcggatgaacgacgacgccgtcatcattctcgacccggtcaaccgcaaggtcatcgaccagcagctcgatgcgggcaccaagaactacatcggcggcaactgcaccgtcagcctgatgctgatgggcctgggcggtctgttcgaggccggtctggtcgagtggatgagcgccatgacctatcaggcggcctccggcgccggcgcgcagaacatgcgtgaactgatcaagcagatgggcgcgacccacgccgctgtcgctgatcaactggccgatcctgccagcgcgatcctcgatatcgaccgtcgtgtggccgaagccatgcgcagcgacgcttacccgaccgaaaacttcggtgtaccgctggccggcagcctgatcccttggatcgacaaggaactgccgaacggccagagccgcgaagagtggaaggcccaggccgagaccaacaagatcctcggtcgcttcaagagcccgatcccggtcgacggcatctgcgtgcgcatcggcgccatgcgttgccacagccaggcactgaccatcaagctgaacaaagacgtgccgatcgccgacatcgaagggctgatcagccagcacaacccttgggtcaaactggtgccgaacaaccgcgaaatcagcatgcaggagctgagcccgacgaaagtcaccggcaccctgaacgttccggtcggtcgtctgcgcaagctgaacatggggtcgcagttcgtcggtgctttcaccgtcggcgaccaactgctgtggggcgcggccgaaccgctgcgtcgcatgctgcggatcctgcttgagcgt

SEQ ID NO: 37716 - DNA, 999 bp, Pseudomonas fluorescens
atgacccagacccttgatattgccgtgatcggcgccaccggtactgtcggcgaaaccctcgtgcagattctcgaggagcgcgacttcccggtcggcaccttgcacctgttggccagcagcgaatccgccggcagctcggtgctgtttcgcaacaagaacgtgcgcgtgcgcgaagtcgacgagttcgatttcagcaaggtcaaactggcgttcttcgccgccggcccggccatcaccctgagttacgccgcccgcgctcacgcggcgggttgctcgctggtcgatttgtctggcgccttgccggcggatcaggcgccgcaagtggtgccggaagccaatgccgatgtgctggccggtttgaaagcaccgttccaggtctgcagcccgagcccgtcggccaccacattggccgtggtgctggcgccgctgctcgatctgatcgagctgcactatgtgcatgtcaccgccaatctggcggtttccgcccaaggccgcgaagccgtgaccgagctggcacgtcagaccgccgagctgctgaacatgcgtccgctggagccgacattcttcgaccggcagatggctttcaacctgctggcccaggtcggtacgcccgacgcgcaaggtcacacgctgctggaaaaacgtctggtgcgcgagctgcgtcaggtgctggccaagcctttattaaagatttccgcaacttgcgttcaagccccggtgttttttggcgatagctttagcgtgaccttgcagtcagcgagcgcggtcgacctggaaaaggtcaacgccgcgcttgaagaggccgagggtatcgagctggtcgaggccggcgattatccgaccgccgtcggtgacgcggtcgggcaggacgtggtctacgtcgggcgggtgcgcgccggtgtcgacgagccgtcggaacttaatctgtggctgacgtcagataacgtacgcaaaggtgcggccctcaacgccgtgcaggtcgccgagttgttgataaaa

SEQ ID NO: 37717 - DNA, 612 bp, Pseudomonas fluorescens
atgtcagccgttcgcagcaagatttgcgggattacccgcatagaagatgcgttggcagccgtcgaggccggggccgatgccattggttttgtgttctacgctaaaagtccccgggccgtgaccgtgcagcaggcgcggtcgatcatcgccgccttgccaccgttcgtgaccacggtcgggctgttcgtcaatgccagccgttgcgagctcggggaaatcctcgatgccgtgccgctggatctgctgcagttccatggcgacgaaaccgccgccgagtgtgagggctggcaccggccgtacatcaaggccttgcgggtcaaggcgggcgataacattgccgctgcctgcgatgcctacccgagcgccagcggcgtgctgctcgacacttatgtcgaaggcgtgcccggcggaaccggcgaagcgttcgactggtcattgattccgcaaggcttgagcaaaccgttgattctggccggcggcctgacgccggagaacgtcgccgatgcgatagcccgggtgcggccgtatgccgtggatgtcagcggcggggtagaggcgagcaagggcatcaaggatcacgcaaagattcgtgcattcatcaacgccgtacgc

SEQ ID NO: 37718 - DNA, 1173 bp, Pseudomonas fluorescens
gacctcgaaggcgtagcgttcgataccctggccgtacgtgccggtcagcaccgtacgccggaaggcgagcacggtgatccgatgttcttcacttccagctatgtgtttcgcaccgccgccgatgcggctgcgcggtttgccggggaagtgccgggcaacgtctactcgcgttacaccaacccgaccgttcgcgccttcgaagagcgcattgccgcgctggaaagcgccgagcaggcggtggccacggccaccggcatggccgcgatcatggctgtggtgatgagcctgtgcagcgccggcgaccatgtgctggtgtcgcgcagtgtgttcggttcgaccatcagcctgttcgagaagtatttcaagcgttttggcgtggaagtcgattacgtgccgctggccgatctgtcggcctggggcgcagcgatcaagtccaacaccaaattgctgttcgtcgagtcgccgtccaatccgttggctgaactggtggatatcaccgctctgtcggaaatcgcgcacgccaagggtgcgatgctggtagtcgacaactgcttctgcacgcctgccttgcagcagccgctgaagctgggcgcagacatcgttgtgcattcggccaccaagttcatcgatggccagggccgttgcatgggcggcgtggttgccggtcgcagcgaacagatgaaagaagtcgtcggcttcctgcgtaccgccgggccgaccctcagcccgttcaacgcctggatcttcctcaaggggctggaaaccctgaacctgcggatgaaggcgcactgcgccaatgcccaacaactggctgagtggctggagcagcaggatggcatcgagaaggtgcattacgccggtctcaagagccatccgcagcacgaactggctcagcgtcagcagaagggcttcggcgcggtggtgagctttgaggtcaagggcggcaaagagggtgcctggcgtttcatcgatgcgacccgtttgatctcgattactgccaacctcggtgacagcaaaaccaccatcacccacccgagcaccacgtcccatggccgtctggcgccgcaggagcgtgaggcagccggcattcgtgacagcctgatccgcatcgcggtcggtctggaagacgtggctgacctgcaagccgacctgtcgcgcggtctggcggcgttg

SEQ ID NO: 37719 - DNA, 756 bp, Pseudomonas fluorescens
ccaaagatcggcacccatggccgcgttgcattggtcacgggtgccgcgcgcgggatcggcttgggcatcgcggcatggctgatcagcgaaggctggcaggtggtgctgactgacctggatcgtgtgcgaggttcgaaagtggcgaaggtgctcggcgaaaacgcctggttcattgccatggacgtcgcggacgaaagtcaggtggcgctcggtgtcgctgaggtgctggggcaattcggtcgtctggatgcgctggtgtgcaacgctgccgtggccgatccgcacaacatcacgctggaaagcctcgatctggcttactggaatcgggtgcttgcggtgaacctcggtgggccgatgttgctggccaaacactgcgcgccgtatctgcgtgcgcacaacggggcgatcgtcaatctggcctcgacccgtgcggcgcagtcagaaccggataccgaagcctatgcggcgagcaagggtggtttgctggcgctgactcacgcgctggcgatcagtctcgggccggagattcgcgtcaatgcggtcagcccgggctggatcgatgcgcgggatccatccgcgcggcgcgcggaaccgctgaccgataccgatcatgcccagcatccggcgggcagggtggggacggtcgaggatgtggcggcgatggtggcgtggttgctgtcgaagaatgcggggtttgtgacggggcaggaattcgtggtcgatggcggcatgaccaagaagatgatttatacggaa

SEQ ID NO: 37720 - DNA, 1477 bp, Pseudomonas fluorescens
aacgactgggaacaacgcttccagtccctgaccctcgaatcccgcgccttcatcaatggcgaataccgcccggccatcagcggcgagaccttcgaatgcctgagccccgtcgacggccgtttcctggcctccgtggccagcaccgatgaagccgacgccaacctcgccgttgaagctgcgcgccaatccttcaacgccggcgtgtgggccaacaaggccccggccgagcgcaagcgcatcctgattcgcttcgccgatctgatcctgcaacaccaggaagaactggcgctgctcgaaaccctcgacatgggcaaaccgatcagcgactcgatgagcatcgacatcccggcgaccgccaacgcgatccgctggagcgccgaagcgatcgacaagatctacgacgaagtcgccgccaccccgcacgaccaactcggtctggtcactcgcgaaccatcgggcgtggttgctgcgatcgtgccgtggaacttcccgctgatcatggccagctggaaattcgccccggcgctggcggcgggtaactcgttcatcctcaagccttcggaaaaatccccgctgaccgcgatccgcatcgcgcaactggcgctggacgcgggcattccgaaaggcgtgttcaacgtcctgccaggcttcggccacaccgtcggcaaggcgctggcgctgcacatggacgtcgacgtgctggccttcaccggctccaccgcgattgccaagcaactgatgatttatgccggccaaagcaatatgaaacgcgtctggctcgaagcagggggcaagagcccgaacgtggtgtttgccgacgctccggacttgcgcgcggcagcacaagcggcggccggcgccattgcgttcaaccagggcgaagtctgcaccgccggctcgcgcctgctggtggagcgttcgatccgcgagcaatttatcccgctgctggtggaagcgctgccaagcgtggaaaccggggcacgccctggatccggcgaccaccgtcggcgccgtggtcgatcagcgtcaactggacaacgtgctgcgctatatcagcatcggtcgggagcagggtgccgagctgatcgccggcggccgacgcaccctcgaagacaccggcggcacctacatcgagccgacgatttttgacggcgtgaccaacgccatgaccatcgccaaggaagaaatcttcggcccggtgctgtcgctgatcaccttcgacaccgtcgaggaagcgctgcacatcgccaacgacagcatcttcggcctggccgccggggtctggaccagcaatctgagcaaggcccacaccttcgcccgtggcctgcgcgccggcagcgtgtgggtcaaccagtacgacggcggcgacatgaccgcgccgttcggtggcttcaaacagtcgggcaacggtcgcgacaaatcgctgcacgcgttcgacaagtacaccgagctgaaagcgacctggatcaagctctaa

SEQ ID NO: 37721 - DNA, 1176 bp, Pseudomonas fluorescens
atgcaagacgtcgtcattgttgccgccacgcgtaccgcgatcggcagtttccagggatcgctggccagcgtctccgccgtggatctgggcgcagcggtcatccgccagttgcttgagcagaccggtctggacggtgctcaggtcgatgaagtgatcatgggccaggtgctgaccgccggcgccggccagaacccggcgcgccaatcggcgatcaaggccggcctgccccacgccgtgccggccatgaccctgaacaaggtctgcggctcgggcctcaaggccctgcacctcggtgcacaggcgatccgttgcggcgacgcagacgtaatcatcgccggcggccaggaaaacatgagcctggccaactacgtcatgccgggcgcacgcaccggtctgcgcatggggcacgcgcaaatcgtcgacaccatgatcagcgacggcctgtgggatgcgttcaacgattaccacatgggtatcaccgccgaaaatctggtcgagaaatacgagatcagccgcgagcagcaagacgccttcgctgccgcgtcgcaacaaaaagccgccgcagccatcgaggccggtcgctttgtcgatgaaatcaccccgatcctgatcccgcagcgcaaaggcgatccggtggcgttcaaggtcgacgaacaaccacgtggcgataccaccgccgattccctggccaaactgcgtccggccttcaagaaggacggcagcgtcactgccggcaacgcttcgtcactgaacgacggcgcggctgcggtcattctgatgagcgccgaaaaagccaaagccctgggcctgccggtgctggcgaagatcgccgcttatgccaacgccggcgtcgacccggcgatcatgggcatcggcccggtgtccgccactcgccgctgcctggacaaggctggctggaacatcggccagctggatctgatcgaagccaacgaagccttcgccgcgcaatcgctggcggtggccaaggatctgcaatgggatctggacaaggttaacgtcaacggcggcgccatcgccctcggtcacccgatcggtgcatcgggctgccgtgtgctggtgaccctgctgcacgaaatgatcaagcgtgatgcgaaaaagggtctggcgaccctgtgcatcggcggcggtcagggcgtggccctggcgctggaacgc

SEQ ID NO: 37722 - DNA, 1347 bp, Pseudomonas fluorescens
tcgatcaaccccgccaacggcgagcagatcggtcactacgcgttcgaatccgccgaagcccttgacgctgcactgacccgcgccgcattcggcttcaacaagtggaaacgcaaaccgctgcaggatcgctcccgcgccctgaccgcactggccggcgccctgcgtgacagcagcgaagccatggccaccatgatcactcgggaaatgggcaagccgatcgcccaggcccgtggcgaaatcgagaaatgcgccaagctctgcgagtggtacgccgaacacggcccggccatgctcaacgccgaagcgacgctggtcgaaggcggcaaggcgcgcatcgagtatcgtccgctcggaccgatcctcgccgtgatgccgtggaacttcccgatctggcaggtgctgcgcggcgccgtcccggcgctgatcgccggcaacacctacgtgctcaagcatgcgccgaacgtgatgggcagcgcctatctgttgcgcgatgccttcacccgcgccggtttcgccgatggcgtttttgaagtgatcaacgtcaccccggaaggcgtgtccagcgccattgctgatccgcgcattgccgccgtaaccctgaccggcagcgtccgcgccggcatggccattggcgcacaggccggtgccgcgctgaagaaatgtgtactggaactgggcggctccgatccgttcatcgtgctcaatgacgccgatatcgacgaagctgtgcaagcagccgtcatcggtcgttaccagaactcagggcaagtctgcgccgccgccaaacgcctgatcatcgaagaaggcgtggtcgaagaattcacccgcaaattcgtcgacgccacccgtcagttgaagatgggtgacccgttgtccgccgacaactacatcggcccgatggcccgtttcgacctgcgcgacgaactcgaccaacaagtgcgcgacaccctcgaagaaggcgccaccctactgctcggtggcggcaaggccgaaggccccggcaattactacgagccgaccgtgctggccgatgtcaccgaccgcatgacctcgttcaaacaggaactgttcggcccggtggcctcgatcatcaccgcccgcgattgcgctcacgccgtggccctggccaacgacagcgagttcggtctgaccgccacgatctacaccgccaacgtcgccctggctcagcaactgaccagcgaactggaaaccggcggcgtgttcatcaacggctactccgccagcgacccgcgcgtgaccttcggcggcgtgaagaaaagcggtttcggccgcgagctgtcgcacttcggcgtgcgcgagttctgcaacgcgcagacggtgtggctg

SEQ ID NO: 37723 - DNA, 1560 bp, Pseudomonas fluorescens
actctgaccggccacctgctgattggcgccgctgacgtccccgctaccgagggcacgatgaaggcgctgaacccggcaaccaaccaattgctcgaaccggaattcgccctcggcggtgcgtcgcagatcgatcaggcggcaaccctcgctgatgcggccttcgacagctacagccacacctcgctggccgagcgtgcggcgtttctggaaagcatcgccgacaacctcgacgccgtccgtgaggagctggccgcccgcgccgcactggaaaccggcctgccccaggcacaactggagggcgaagccgccaaggccgccacccagttccgccagttcgccgacgtggtgcgcaagggtcgcttcctgcaattggcgatcgacccggcgcaacccgatcgccagccgcggccacggatggatcatcgcctgcaaaaagtcgccatcggcccggtggcgatcttcggagcaagcaattttccgatctcctattcagtggccggcggtgacaccgcgtcggcactcgcggccggtgcaacggtgattctcaaggcgcataacgcgcatcccggtgcctcggaaatccaggcgcgcgccatccgtaaagcggtgcaaatgcacggtctgcacgaaggggttttctccatggtgcgcggtggtggcaatgccatcggtgaggcgctggtcgatcatcctttgattaaagcggtgacgttcaccggttcagaggtgggcggcatggcgctttatcgtcgcgcgcaattacggcctgatccgatcccggtgttcaccgaaatgaccagcgtcaacccgacgttcattctgcccgcagcgctgtccgcgcgtggcggtgaaatcggcgatggctttgtcgagcggatgctggtgaatgtcgggcaggcctgtctgtgtccgtcgatcctgatcgcggtcgagggcgaaggtctgcaagcgttgcgcagcgccatgatcaagcgggtcagtgcagcgtcggcgcgtacgatgctgacgccggggattcacggttcatacgtcaaagggctggtggcaatggaaagcgtgggggccaatctggtggcggtcggcgcgccggcggatggtcagtttgagggacgctcggcgttgttggaagttgacggccaaggcctgctcagcgaaccggcgctggcccatgaagtgttcggtccggcggcgctgttggtaacggtcagggatgatgaagagttgctggcggtcgcccgttcgttcaagggtcaactgagcgcagccattcaccttgaagaccgcgatctggatctggcccggcgtctgctaccgatcctcgagcgccgcaccggacgcatcgtggtcaacgctttcgcccatccgcaggaagtgaccttcgccaccgtacacggcgggccgttcccggccacctcggacagccgtttcacctcggtcggcatgacctcgatcgagcgctttttgcggccggtggcgtatcagggctttcccgatgcattactgccggaggtgttgcgcgacgccaatccactcgatctgccccgcagcatcgacggccaa

SEQ ID NO: 37724 - DNA, 1053 bp, Pseudomonas fluorescens
tccacgtacctgcaagacagccctggcgtgcacaagggtttcgactatggccgctcgcacaacccgacgcgttttgccctggagcgctgcgtggcggatctggagggcggcacccaggcgttcgccttcgcgtctgggctggcgacgatttccaccgtactcgaactgatcgatgccggctcgcacatcgtgtccggcaatgacctgtacggcggcacgttccgcctgttcgacaaggtgcgccagcgcagtgccgggcatcgtttcagctacgtcgatctggccgatctgtcagcgttcgaagcctcgctgcaggacgacacgcgcatggtcatggtcgagactccgaccaacccgctgctgagcctgtccgacctcgccgccattgcgcgcatctgcaaggcccgcgggatcatctgcgtggccgacaacacctttgccagcccatggattcagcgtcctctggaactgggcttcgacatcgtgctgcactcgaccaccaagtacctgaacggtcactccgacgtgatcggcgggatcgcggtcgttggcgacaatcctgcgctggccgaacgtctgggctttctgcagaacgccgtcggcgccatctccggcccgttcgacgcgttcctcaccctgcgcggcgtgaaaaccctggcgctgcgtatggagcgtcactgcagcaacgcgctggagctggcgcgctggctggagcagcagccgcaggtcaaacgcgtctactacccgggtctggaatcccacccgcaacacgaactggccaagcgtcagatgcgtggtttcggcggaatgatttccctggatctgaacagtgatctggcaggcgcccggcgtttcctggagaacgtgcagatcttcgccctggccgaaagcctcggtggtgtggaaagcctgatcgagcacccggcgatcatgactcacgcgaccattccggcggaaacccgcgccaaacttggcatcggtgacagcctggtgcgtctgtcggtgggcgtcgaggacatcgaggacctgcgtgcggatctggcgcaggcgttg

SEQ ID NO: 37725 - DNA, 1404 bp, Pseudomonas fluorescens
atcggcggagaatgggtcgacgccctctccggcaagactttcgaaagcctcaacccggcgctggccgaaccctgggccgaattgcccgacgctgacgaggccgacgtcgagcgcgccgtgcaagccgcgcagaccgccttcgacagcccggcctggcgtggtttgaccgcaaccgcgcgcggcaaactgttacgtcggctcggtgacctgatcgccgaaaacaaggaacaactggcgcaactggaaagccgtgacaacggcaaactgatccgcgaaacccgcggtcaggtcggttatctgccggagtttttccactacaccgccggcctcgccgacaagctcgaaggcggcaccctgccgctggataagcccgatctgttcgcctacaccgtgcacgaagccatgggtgtggtcgccgcgattattccctggaacagcccgctttacctgaccgcgatcaaactggcaccggcgctggctgccggcaataccattgtgatcaagccgtccgagcatgcctcggcaaccattctggaactggcgcgcctggccctcgaagccgggattccgccgggcgtggtcaacgtcgtcaccggctacggcccgagcaccggcgccgccctcacccgtcatccgctggtccgcaagatcgccttcaccggcggcgcggccacggcccggcacgttgtgcgcagcagcgccgagaacttcgccaagctgtcgctggaactgggcggcaaatcgccgaacatcatcttcgccgacgccgatctcgacagcgcgatcaacggcgccatcgccgggatctatgccgcatccgggcagagctgcgtatccggttcgcgactgctggtgcaggacgacatctacgacgagttcgtcagccgactggtggagcgcgcccagcgcatccgcatcggcaacccgcaggacgacagcagcgaaatgggcccgatggccaccgcgcaacaactggcagtggttgaaggtctggtggctgatgccatcgctgaaggcgcacgcctgcgcctgggtggcaagcgtccgagtggcgtcggtgacggttggttctacgaaccgacgctgttcgaatgcgaccgcaattcgatgaagatcatgcaggaagaagtgttcggcccggtggcctcggtgatccgtttcaaggatgaagccgaagcgctggcgattgccaacgactcgcagttcggcctcgccgccggcatctggacccgcgatctgggccgcgcccatcgcctggcccgggacgtgcgttcggggatcatctgggtcaacacctaccgcgcggtgtcggccatggcaccgatcggcggcttcaagaacagtggctatggacgcgaaagcggcatcgattcggtgctggcctacaccgaactgaaaacggtg

SEQ ID NO: 37726 - DNA, 1413 bp, Pseudomonas fluorescens
tggatcgacggcctgtggctggattccggtgactacaaagactccatcgacccagcgacttatgagctgatcggtcgctacgccgaaggcggactggccgaagcgcagcaaggcatcgaagctgcacaacgagccttcacgcagaccccatggaaagacgacagtcaactgcgtgcccaagtgctgctggaactggcggacgtctttgaactcaacgccgccgagctgatcgacaccctggcgctggagaacggcaagatccgtcccgaggccgcctttgaagtcggcatggtgccgtccaaattgcgctattacgccgcgctggcccgcaccgaatatggccgcgccgcgcaaccccggcccggcaagatctccctggtgatccgccaggccgtcggtgtcgcgggcatcatcgtgccgtggaattcgccggtggtgcttatgatccgctcgctggcgccggccttggccgccggttgcaccacggtgatcaagatgccggggcagaccgcgcagaccaacgcgctggtggcgcggatcatgagtgaagcaccgtcgctgccgcgcggcgtgatcaacctgttcagcgagcagggcgcgaccggttcgattcatctggtggagtcgccaaaggtgccggtcatcagcttcaccggcagcaccggcacagggcgggcgatctcggcagcgggggcgcaacacctcaagcgtttcggcctggaactgggtggcaaaacgccgatgctggtgttcaacgacgccgacctcgacgccgtggcgccgacgctggtcaaggcgctcacggtgttttcgggacagttctgcatgactggttcgcgcctgctggtacagcgcgacatcgcccacgtattgactgagcgccttgccgctcgacttgaagcggtgcgggtcgggccggcggcggatccggacagcgacatgggaccgctaatcgacaaaccgaacgtgcagcgtgtcaatcaggtggtggaagaggcgattgctgccggtgcgcaagtcatcgtgcgcggtgggccggtgactgaagggccgctggccaagggcgcgttctatcggccgacgctgctacgggtcagcgatccggagatggccatcgtccagcgcgaaaccttcggcccggtgctgaccctacaggtgttcgatagcgaagccgaggccattgaactggccaacaacagcgaattcggtctggccgccagcgtctggacccgcgacatcgaccgctcgctgcgggtcgcccgtgagctggaggccggcacggtgtgggtcaacgactgggcggtggtctacgacgagttcgaggagggcggtttcaaacagtcggggcaggggcgtctgaacggtgtggcagcgatggatgattttgtcgagtacaaacacatcgcgctcaat

SEQ ID NO: 37727 - DNA, 1479 bp, Pseudomonas fluorescens
gatgtgatcgtggtgggcggcggttccgccggcgcggtactggcccgtcgcttgagtgaaaacgtccggcgccaggtgctgttgctggaggcgggtcagagttttgccccgggcaagtaccccgaaatcgtcgccagtagcgatgtggtcggtgccaatggcaatcgccagttcgagtggggttacacctcccggccgggctatgtcgaacacccgatcggcgcgttgcgcggcaaagtgctgggcggcagttcggccatcaacggcgcggtggcgattcgcgcccgagccacggacttccagcgctggaatctgccgggctggagctttgaggacttgctgccctcgttcaaaaaactggaaaaccacagcggcggagccagcgcattgcatggccacgacgggccgctgccggtgcgtcagctcggcagcgccgacgtcacaccaatgcagaaagccttcatctacgccacggtcgccaacggttaccggatgatcgacgacttcgacggcgcgaatgccaacggcgtcggcccgtacccgatgaacatcgtcgacggcgtgcgggtcaacaccggcatggcttacctcacggacgaggtgcgcgcccgcgacaatttgcagattcgcgccgacagcctggtggacaaggtgctgttcgacggcaaacgtgcggtgggtgtgcaactggcgaatggcgagcaattacgcgccaacgaagtgattctttcggcgggcagttacggcagcgcggcgatcctgttgcgctccggtatcggccctggcgacgatctgcgcgcactggacattgagccggtcgccgaattgccggtcgggcagaacctggcggatcacccgttctattacaatgcctacgccgccaaacccgacctgatcggtcgccagtcgccggccataggcgccaagctctggacccacagccgcagcgccgagcacggcgatctggatattcacatcaccgcgacccacctgttcccccatgaccagagcccgacccaggtgggcttcgtgctcgcggtggcgctgacccggccgctgtcccgaggcaaggttacgctggccagccgcgatccgtcggtggcgccgaatatcgatctgaattttctcgccgagcccatggaccgccagcgcctgctggacggtattcgtctggcacggcggatcggtgcgaccgcgccgctcaagggtttgattcactcggagctgaatccggggcagggcaacgactccgacgacgccttgctggccagcgtcaaagccacgctcgacacctatcaccacccgacctcgaccgcgccgatgggccggccgggcgatgccatggccgtggtcgacctcgaagcccgagtaatcggcgtgcagggcctgcgggtggtcgacgcttccatcttcccggacgtgccgtccgttgccaccaacctcaccgtgatcgccaccgccgaaaaaatcgccggtctc

SEQ ID NO: 37728 - DNA, 2037 bp, Pseudomonas fluorescens
agaacgctgtaccagaagcacatcgacagtcacaccgtctgcaccctcgacgatcagggccacgtgctgctttacatcgaccgccaggtcgccaacgaatacaccagcccgcaagccttcagcggcctgcgcgaggccgggcgcacggtgtggcggcctgcggcgacgctggcggtggtcgatcatgtgaaccccaccgcaccgaaacgcatcgcgaccatgcccgacgccgggggcgcgcggcaggtgtcgtacttcgaagaaaactgccgcgacttcggcatcgagctgttcgatgtgctggacaagcgccagggcatcgaacacgtcgtagcgccggaacagggtttcattttgccgggcatggtggtcgcggccggtgacagccacaccaccacttacggcgcactgggagcgttcggtttcggcatcggcacctcggaaatcgagcacctgctggcaacccagacgctggtctacaaacgtctgaaaaccctgcgggtgacggtcaacggcgaactgggcgcaggcgtcacctccaaggacatcatcatggcgctgatcgaaaagatcggcgcgtccggcgccaccggttacgccatcgagttcaccggcccggccatcagcgccctcagcgtcgaagcgcgcatgaccatctgcaacatggccgtcgaggccggcgcccggggtgcgttcatggcaccggatgacaaggtgttcgcctacctgcaacacaagccgcgtgcgcccaagggcaagctctgggagcaggccatcgatcactggaaaaccctgcacagcgatgagggcgcagtgttcgatcgcgaagtcatccttgatgtcgccgagctggaaccaatggtgacctggggcaccagccccgatcaggccgcgccgatcaaggcacacgtgccggatccggccgcccagcccgatccgatcctgcgtcagggcctgcagcgcgccctcgactacatggggctgacgcccggcatgccgctgaacgaagtgacgatcagccatgccttcatcggttcctgcaccaatgcgcggatcgaagatttgcgtgatgttgcccgcgtggtgcgcggcaagcgtgtggcggcccacgtgcgggcgatgatcgttcccggctcgacgttggtgcgcaatcaggccgaggacgaaggcctggcgcagatctttctcgacgccggtttcgaatggcggcaatcgggttgctcgatgtgcctggcgatgaacgacgacgtgctcgcgccaggtgatcgctgtgcgtcgagcaccaatcgcaacttcgaaggccgtcagggcgccggtgcgcgcacccacctgatgagcccggcgatggtcgccgccgccatcagcggccatttgactgacgtgcgcaccgtcgcgctggaggcttgaaccatgcaacctttcgacaccgtcagcggcagcgccgcgccgtttcttgcatccaacatcgacaccgacgtgatcatgcccaagcagtttctcaagggcatcgatcgtcaggggctggatcgcgggctgttcttcgatctgcgctttctcgcctccggcgaacccaaccctgaattcgtgctcaaccagccggcctggcaggacgcggcgtttctggtgaccggccccaacttcggttgcggctccagccgcgaacacgcggtatggggcttgaagcaagtgggaatccgggccttgatcggcaccaccttcgccgggattttttacgacaactgccagcgcaatggtgtgttggcgattcagctggacgacgcgcagttcaagcgtgtagccgaggcgatcagcgttccggcgaccgcgcggatcagcgttaacctggcgcagcagaccctcgagctggcggacggtacgctgatcgaattcgagatcgatcagttgcgcaaacagtcgttgctgctcgggctggacgccatcggcaccacgctgcaacgcaccgagcagatccgcgcctttgaggcacggcatctggcggacaatccctggttgggttgatggcaaaaaaacgggcgg

SEQ ID NO: 37729 - DNA, 993 bp, Pseudomonas fluorescens
tgggccgccacctcggccggcgcgccgctggagcgcttcagttacgaccccggcccgctgggagatgaagaggtcgaagtcgccgtggaatattgcggcgtctgtcactccgaccagtcgctgatcgacaacgactggggcatcagccaatacccgttcattcccggccatgaagtggtcggccgcatcgtgcgcacaggcccgcaggtacgtggtctggaagtcggtcagcgcgtggggatcggctggtacaagggcagctgcatgcattgctcgtcctgcatcggcggttcgcatcacctttgcgccaccgccaaaccgacgatcatcggcagccatggcggattcgccgatcgccttcgcacccactgggcctgggcgctgaaactcccggacaacctcgacccggccctcgccggcccgctgttctgcgccggctccacggtcttcaatccgctggtggaattcgacatcaagccgaccgaccgggtcggcgtggtgggcatcggcggcctgggccacctggcgctgcgttttctcaatgcctggggttgcgacgtcacggccttcacctcctctctgagcaaacaggacgaagccaaacgactcggcgcccacaaggtcgtcgcctccaccgacagcgaagcgctgaaagcgattgccggcaccctggactttctgctgatcaccgccaacgccaacctcgactggacggccatgctcgccactctgcgcggcaagggccggctgcacttcgtcggcatcgtgcccgacgcgattccggtgcacgtgttcaacctgatccctcaacagaaatccctgtcagcctccccggtcggatcgcccgccacggcagcgaccatgctggaattctgcgcgcggcatcagatcctgccgcaggtcgaggagtttccgatgagcaaggtcaatgaagccgtcgaccatttgcgcagcggcaaggcgcggtaccggattgtgttgaacgccagcaaa

SEQ ID NO: 37730 - DNA, 981 bp, Pseudomonas fluorescens
ttacccatcctcgacctgtccctgctcgacggcacgccgtcgcaacgccaggcctttcttgatgacctgcgccatgctgcccgcgatgtgggttttttctacctgaccggccatggcatcgacgccggcctgctcgagcaagtgcaggactacgcacgccagttcttcgccttgcccgacagcgagaaaaacgccgtcggcatgatcaattcgccgcactttcgcggctacaaccgcgccgcttccgagatcacccgtggccagcccgatcagcgtgagcaattcgatctgggcgccgagcgcgacgtcttgccgttgaacgctgacagtccgttatgggcgcggctgcaagggccgaatcaatggcccggagcgttgccgcaactcaagccgctgttgctcgactggcagcaggcgatgacccaaatgtcgctgcgcctgctgcgcgcattcgctcaggcgctgtccttgccggaagacgctttcgaccggttgtacggcgacaaacccaacgaacacatcaagctgatgcgctatccggggcaagcctcgaccgcgagcaatcagggcgtcggtgcgcacaaggattcgggttttctcagcttcctgctgcaagaccagcaggccgggctgcaagtggagatcgaagaggggcgctggatcgatgcgctgcctcgggacaatacgctggtggtgaacatcggcgagctgctggagctggccaccaacggttatctgcgcgccacggtgcatcgggtggtgtcgccaccagtgggcagcgagcgattgtccatcgcgtttttcctcggcgcgcaactggatgcggtagtgccgctgtaccccttgccgacggcgctgttgcgtgaggcgcgtggcccggcgagtgatccgctcaatccgctgtttcgcgatgtcggctggaattacctgaagggccgactgcgctcccatcccgatgtcgcgcagcgtttttatgccgat

SEQ ID NO: 37731 - DNA, 759 bp, Pseudomonas fluorescens
atgaacaacagattcgccaacaaggtcgcgctggtcaccggcgcggcgcagggcatcggtcgccgggtgtgcgagcgcttcctggaggagggcgcgcaggtcattgccgtcgaccgctccggactggttcacgaactgcaaggcgagggcgtgctgtcgctgaccgccgaccttgagcaatacgccgattgcgcccgggtgatgagcgccgccgtcgatacgttcgggcgtctggatgtgctggtcaacaacgtcggcggcaccatttgggccaagccgttcgagcactacgaagtcgagcagatcgaggccgaagtgcgccgttcgctgttcccgacgctttggtgctgccacgccgcattgccgtacatgctcaagcaggatcgcggggcgatcgtcaatgtgtcgtcgattgcgacccgcagcctgaaccgtgttccctacggcgcggccaagggcgggatcaatgcactgaccgcctgtctggccttcgagaatgccgagcgcgggatccgggttaacgccaccgcgcccggcggcaccgaagcgccgcctcggcgcatcccgcgcaacgccgccgaacaatccgcgcaggagcaggcctggtatcaggaaatcgtcgcgcaaaccctcgatagcagcctgatgaaacgctacggaaccattgacgaacaggtcggcgcgatcctgtttctcgcctcggacgacgcctcctacatcaccggtgtaaccctgccggtcggtggcggagacctcggt

SEQ ID NO: 37732 - DNA, 521 bp, Pseudomonas fluorescens
atgaccactcaaaccgaaactgcgattctcgccggcggctgcttctggggcatgcaggatctgttgcgccgctaccccggcgtgctgcagacgcgggtcggttacaccggtggcgatgtgccgaacgccacttaccgtaaccatggcaatcacgccgaggccatcgaaatcgtcttcgaccctgctgtgatcagctatcggcagatccttgagtttttctttcagatccacgacccgagcacacccaaccgtcagggcaacgacctcggtccgagctatcgttcggcgatctattacctgaacgagcagcaacgcgatatcgctgaagacactgcggctgatgtcgatgcatcgggcctgtggccaggccgggtggttaccgaaatcgaaccggcagggccgttctgggaagcggagccggagcatcaggattacctcgagcgcattccgaatggctacacctgccacttcattcgcccgaactggaagctgccgaaacgcggttgaaggtccagcggggc

SEQ ID NO: 37733 - DNA, 1344 bp, Pseudomonas fluorescens
ggtcagttggcgcagggtttcaaaccgcgtcatgtcaccatgctttccattgccggcatcatcggtgcggggctgtttgtcggctccggccacgccattgccgccgccggcccggccgtcttgctcgcttatctcttctccggtctgctggtcgtgctggtcatgcgcatgctcggcgaaatggccgtggcccatccggacacgggatcgttttccacctatgccgatcaggccatcggccgttgggcggggttcaccattggctggttgtattggtggttttgggtgctggtgattccgattgaagcgctggccgccgggcatgtcttgaatcagtggtttcctcaggtcgatgcgtggttgttcgcgttgttgtcgatcattttgctggtggtgaccaacctgttcagcgtgtccaagtacggtgagtttgagttctggtttgcgatggccaaagtggtggcgatcatcgggttcatcggtctgggttttgcggtgttgatgggctggattccgggacgcgaggccagcggtttgagccggttgatggaagagcacggcgggtttgcacccaatggtttgtcggcggtggtcggggctttcatcacgatcatgttcagcttcatcgggaccgaagcggtgaccatcgcggccgccgaatcgagcaacccggcgcagaacatcgccaaggcgacgcgctcggtgatctggcgcatcggcgtgttttatctgctgtcgattttcgtggtgatttccgtggtgccctggaacgatccactgctggcgtccgtcggctcatatcagcgggctctggagctgatgaacattcccaacgccaaatttctggtcgatgtggtcgtgctgatcgcggtggccagttgcatgaattcctcgatctacatttcctcgcggatgctgttctcgctgggccgacgcggcgatgctccgcaaccgctgaaagtgacctccgcggcgggcgtgccgagggcggcggtgattgccagcaccgtgatcggtgccggggtgacgttgttcagctatttcatgccgggcgggctgttccagtttttgctcgccagttccggcgcgattgcgttgctggtgtatctggtgatcgcgatttcgcaattgcgcatgcgccggatgctgcgtcggcagaacgtcgagctgacgtttcgcatgtggctgtttccgtggctgacgtggctggtgatcgcgttcatctgcgccgcgctggcggtgatgatggtgacgcccgagcatcgtctggaagtgacgtcgaccatcggccttgcgctgacgatttcctttatcggactggtgaccacgcggcagcatgggcag

SEQ ID NO: 37734 - DNA, 948 bp, Pseudomonas fluorescens
atgagcgacaacatcttcaccggctgcatgcccgccctgatgaccccgtgcaccgccgcgcgcaaaccggacttcgatgcgctggtggccaagggtcgcgagctgatcgacatcggcatgagcgccgtcgtgtactgcggctccatgggcgactggccgcttctcaccgaagccgagcgtcaggaaggcgtggcgcggctggtggccgccgggattccgaccatcgtcggcactggcgcggtcaacacccgtgaagcggtgtcccacgcggcccatgcggcgaaggtcggcgcgcagggtttgatggtgattcctcgggtgctgtcccgtggtgcttcggcggctgcgcaaaaagcccacttcgcggcgattctgcaagccgcgccgaacctgccggcggtgatctacaacagcccttactacggcttcgccacccgcgccgacctgttcttcgaactgcgccgtgaatacccgaacctgatcggcttcaaggagttcggcggtggcgccgacctgcgctacgccgctgaaaacatcacctccaaggacgatgccgtgaccctgatggtgggtgtcgacacccaggtcgtgcacggcttcgtcaactgcaacgccaccggcgccatcaccgggatcggcaacgccctgccccgcgaagtgctgcaactggtggccctgagcaagcaggcggccaagggtgacgccaaggcccgacgtcaggcccgtgagctggaatcggcgctggcggtgctgtcgtccttcgacgaaggcacggatctggtgctgtattacaaacacctgatggtgctcaacggcgacaaggaatacaccctgcatttcaacgaaaccgatgccttgagcgactcgcaacgccgttacgcggaagcccagtacgcgctgttccgtcactggtacgaaaactggtcggcgcagcagaacttcgcctga

SEQ ID NO: 37735 - DNA, 354 bp, Pseudomonas fluorescens
gtggaaatcttcaaggaatttacgttcgaatccgcccaccgcctgccccacgtaccggacggccacaagtgcggacgcctgcacggtcactcgttcaaagtggcgattcacctgagtggcgacctcgatccgcacaccggctggatccgtgatttctccgagatcaaggcgattttcaagccgctgtacgagcgtctggaccacaactacctcaacgacattccgggcctcgagaacccgaccagcgaagtgctggccaaattcatctggaatgaattgaagcccctgctgccggaactcagtgcgatccgcatccacgagacctgcaccagcggttgcatctatcgcggcgag

SEQ ID NO: 37736 - DNA, 633 bp, Pseudomonas fluorescens
attcagctctattccctgccgacccccaacggcgtcaaggtctcgatcatgctcgaagaaatcggcctgccgtacgagccgcaccgcgtgggcttcgacaccaacgaccaaatgtctgcggagttcctgtcgctgaacccgaacaacaagatcccggcgatcatcgacccccacggccccgaggacaaaccgctgccgttgttcgagtccggcgcgatcctgatctacctcgccgacaagagcggccaattgctggcccaggaaggcgcgctgcgctacgaaaccattcagtggctgatgttccagatgggcggcatcggtccgatgttcggccagctcggtttcttcaacaaattcgctggcaaggattacgaagacaagcgtccccgtgaccgctacgtcgaggaaagccgccgcctgctcaacgtcctgaacacccgcctggaagggcgcgactggatcatgggcgagcgctacaccatcgccgacattgccacgttcccgtgggtgcgcaacctgatcggcttctacgaagccggcgatctggtcggcatcaacaacttcccgaacgtcacccgggtgctggagcgcttcctgacacggccggcggttgtgcgcggcttgaccattcct

SEQ ID NO: 37737 - DNA, 936 bp, Pseudomonas fluorescens
cgtccacgccgtctgcgccgcaatgcgagcctgcgcagcctgttccaggaaaccgagttttccctcaacgatctggtgctgccgatcttcgtcgaagaagagatcgacgacttcgtgccgatcaagagcatgcccggcgtgatgcgcattcccgagcgcaaactggccggcgagatcgagcgttacgcccgggccgggatcaagtcggtgatgacgtttggcgtgtctcatcacctggacgccaacggcagcgacacctggcgtgagaacggtctggtgtctcgcatgtcgcggatcgccaaggacgccgtgccggacatgatcgtgatgtcagacacctgcttctgcgagtacaccgaccacggccattgcggcgtgatgcacaaccatgaagtcgacaacgaccagaccctgatcaacctcggcaagcaagcggtggcggcggcgcgtgccggtgccgacgtgatcgcgccatcggcagcgatggacggccaggtgcgggcgattcgccgggcgctggacgatgccggcttctcgcagattccgatcatggcctactcgaccaaattcgcctcggcgctctacggcccgttccgcgaggctggtggcagcgcgctgaagggcgatcgcaaaagctatcagatgaacccgatgaaccgccgcgaagccctgcgcgaatcgttgctcgacgagcaggaaggcgccgacgcactgatggtcaaaccggccggcgcgtacctggacatcatccgcgacatccgcgaagcctcgaccctgccgctggcggcgtatcaggtcagcggcgagtacgcgatgatcaagttcggcgcccaggccggggctatcgacgaagatcgcgtggtgcgcgaaagcctcggtgcgatcaaacgcgcgggtgcggatctgatcttcacctactttgcgatggacctggcc

SEQ ID NO: 37738 - DNA, 819 bp, Pseudomonas fluorescens
atgcgtaccctcgaattggctggcgtgcaggtgccggtgattggccagggcacctggcgcatgggcgaagaccgttcggcgcacaagcgtgaagtggcggccctgcgcagtggcatcgaactggggatgaccttgatcgacactgcggaaatgtacggtgaaggcggtgccgaaaccgtcgtcggcgaagccattgccggcctgcgcgatcaagtgtttctggtgagcaaggtctacccgcacaacgccagccgccaaggcattccccaggcctgcgagcgtagcctgcgccggctcgacaccgattacatcgacctctatctgctgcattggcgcggccagtatccgctggaagaaaccgtcgaggcgttcgaacgtctgcgcgaggacggcaagatcggtcgctggggcgtctcgaacttcgacgtcgacgatctcgaagaactgtcgcattcggcctgcgccaccaatcaggtgctgtacaacctggaagagcgcggtatcgaattcgacctgctgccgtggtgccaacagcagcgcatgccgttgatggcgtactgcccgatcggccagggcggcgcgatgctggccgagccggtgctgaaacagattgccgctcgtcacggcgtgaccccggcgcaggtttcgctggcgtggattctgcgtcaggatgggctgattgcgattcccaaggccgtgcgcccggaacacgtgcagctcaatgcacaagcggcgcagctgccactcgatggcggggatctggcggcgctggaccaggtgtttcatgcgccacaacgcaagcagcggctggccatggtc

SEQ ID NO: 37739 - DNA, 798 bp, Pseudomonas fluorescens
aacaaagacacccaattgtgcatgtccctgtctgggcgtcccgggaatttcggtctgcgttttcataaccatttgtatgaacaactgggcctgaatttctactacaaggcattcagcagccaggacctgcccggtgcggtcggcgggatccgcgcactggggattcgcggttgcggcgtgtcgatgccgttcaaggaagccagcattgcgctggtcgatgagctggatgcgtcggcggcagcgattcagtcgatcaacaccatcgtcaacaccaacggccatctcaaggcctacaacaccgattacattgccatcgcccagttgctggaaacccacgcggtgcccaaggacacgactttcgcgctgcgcggcagcggcggtatggccaaggcggtggccagtgccttgcgcgatgacggttacaaaaacggtttgatcgtcgcccgcaacgagcgcgccggccgtgcgctggcggattctttgggttatcgctggcaggcagaactgggtgacgagcgcccgcagatgctgatcaacgtcacgccggtggggatggacggtggcccggaagcagggcagctttcctttgacgtggatgtgatcaagtctgccgacaccgtgttcgatgtggtggcgatcccctcggaaaccccgctgatcgtgcgcggtcgtgccgaaggcaaaaaagtgatcaccgggctggaagtgatcgcgatccaggcgctggagcagttcgtgctgtacaccggcgtgcggccgacggtcgagcagttcgatgcggcggtggcgtttgcccgc

SEQ ID NO: 37740 - DNA, 849 bp, Pseudomonas fluorescens
atgactgcacaactaatcgacggcaaatcgatcgccgccagcctgcgccagcagatcgcccaacgggttgccgaacgtcgccagcaaggtctgcgcacgccaggcctcgcggtgatcctggtcggcagcgatcctgcctctcaggtttatgtctcgcacaagcgtaaagactgtgaagaggtcggcttcctctctcaagcgtacgacctgccttccgaaaccactcaagaagcgctgaccgatctgatcgatcgactgaacgacgacccggcaatcgacggcgttctgcttcaacttcctctgccagagcacctggacgcttccaaactgctggaacgcatccgcccggacaaggacgtcgacggtttccatccttataacgtcggccgtctggcccagcgcattccattgctgcgcccgtgcaccccgaagggcatcatgaccctgctggaaagcacgggcgccgatctgtacgggatggacgccgtggtcgtcggcgcgtccaacatcgtcggtcgcccgatggcgatggaactgttgctggccggttgcaccgtgaccgtcacccaccgcttcaccaaggatctggccggccatgtcggtcgtgccgacctggtggtcgtggccgccggcaagccgggcctggtcaagggcgaatggatcaaggaaggcgcgatcgtgatcgacgtcggcatcaaccgacaggaagacggcaaactggtcggtgacgtcgtgtacgaaaccgccctgccccgcgccggctggatcactccggtgccgggtggcgtcggtccgatgacccgtgcctgcctgctggaaaacaccctctacgcggcagaaaccctgcac

SEQ ID NO: 37741 - DNA, 978 bp, Pseudomonas fluorescens
atgcacggggcaatatgtagcggggtcgtttcgccgcgagtgctacgcgatgccggtatcgatttaccgaccagcgcggcgcagtgcgcgtcgtcgcgccagacgtggagtaccgcagccatcgcgcagtgttgcgattggcccgacggtcaacgtcccgtcggcagcaaatcccatcgcagcgatggcctgttgatcggcccgtttcaatccgcgccccccttcgacctgctgatcgtcaacaccgacggcacgctggccgagcgcagcggcaacggcctgacgattttctcccgggcgctgcttgaacaagggttgatgccggaggagggggcgacgctgcgggtgcatcacgacaaacaggactcgcaatcgccagtgccgacctcggtgaaaccggcgcaagtagcgggcgtgcacggcttttggctggacctcggccagcccggtttcggcccggtggccgtcggtgcgctcggggttgaaccggtgccgttcaacggtgtggaggtcaaccgtgttcggccgttggcgcaactcgatcccgcctgggcgcacagccagttcgtgcggatcggtaatccacattgcgtgacgctggtgcaggatgaagtcgcactgccgagcaacgcgcagatgcttgaaccgccgctggcggacagtctgaccgctatcgcctatgccatgcccaccggcgccggccagccgtgcccggccggggtcaacctgcaatgggcgacgcgcgccggggatcagcgcattgtggcgcgggtgttcgaacggggcgaggggccgacggcgtcttcgggcaccagcgccagcgcggtggccagcgctgcgtggcgagtgggttgggtgtcggcgggagaggtgcaagtgctgatgccgggcggtacggcgccgattttactggaagagcgcgatggcgagctgctcggcgtgcgtctgttcggcaccgcgcatcggacaaaaaggtga

SEQ ID NO: 37742 - DNA, 2538 bp, Pseudomonas fluorescens
atggaactggccagcctgatcggacgcctcaacccggacaaccgccgcgccctcgaacgtgccgcgcaacggtgcttgcagcgcgggcatcactttgtcgagatcgagcatctgttgctggagttgctggatatcgagggcggcgattttgcttttctgctgccgcgcttcgggctggagcgtgatgcgctgacggcggagatcaacaaggcgctggacctgttcaagaccggcagcacgcgcacgccagcgctgtcctcgcacacgctgggattgctggaagacgccgtggtgcaggccagtgtgctggggatcgacagcattcgttccgggctgcttttattggcgttgatcgaccgtgacgagcgccgcagcctgctgctcaacagtgcatcgtcattgctgcgaattccgaaagaagccttgcgcgcaaacctgctggaatggacggaaaactcccgtgagcacgttggcccgcgctctgtgtcttcggggagtccaacgccacggcaagactcggtgctcgatcaatacacccaggatctgaccgccgatgctcacgccgggcgcatcgacccgatcgtcggtcgcgatggcgaaattcgccagtgcatcgacattcttttgaggcgccggcagaacaacccgattctggtcggtgcgccgggcgtaggcaaaaccgccgtggtcgagggcctggcgctacgcatcgccgccggggatgtgccgccgtcgttgcaggaagtcagtttgcgggtgctcgaccttggtttgctccaggctggggccggggtcaaaggcgaattcgaacagcggctcaaaggtgtgattgacacggttcgcagcgccgacaagccgatcatcctgttcatcgatgaggcccacacgctgatcggcgctggcggtaccgaaggtggcagcgatgcggccaacttgctcaaacccgcgctggcccgaggtgagttgcgcacgctggccgccacgacctggatggaatacaaaaaatatttcgagaaagacccggccctcgcccgccgcttccagctggtgcaggtggaagagccggatgaaatcaccgccgtggaaatgctccgtggcgtcgccgccaaactcgaacagcaccacggcgtgcaagtgctggatgccgcgatccacgaagcggtgaaactctcgcatcgctatatctctggccgccagttgccggacaaggccatcagcgtcctcgacaccgcctgcgcccgggttgccctcggacagcacgacgtgccgccaccgctggagagcctgcgccaccgccagcaaagcctgaaagaagaagtcgaacgcctgcgccgggaacaggccacggggctcgatcaccgcgagcgcatcaccctgctggaaagcgaatcgaagaccaatgtccaggccatccgcgaactggaaacccgttggagtgaagagcgcgtcgccgtgcgcgaactgctcgacacccgtcgcgagttactggcgctgagcgaaagcgccgacagcgacaagcccgacgaagccatcgacagccgcatcgatcacctcgccgccgaactgctgcgcctggaagccggactcgatgcgatccgccaggacgatccgctggtacccgaacaggtcgacggcaaaaccgtcgccgccgtgatcgccggctggaccggcatccccgtcggcaaaatgctcgccgacgaagcccatgccgtgcgcaccctcggtacacgcatgggccagcgcgtgatgggccagagcactgcgctcaacaccatcgcccaacgattgcaggcctatcgtgcgggtctcaccgatccgcaaaaaccggttggcgtgtttctgctggtcggccccacgggcgttggcaaaaccgaaaccgcgtatgcactggcggatgccttgtatggcggcgaacgcaacctgatcagcatcaacctttccgaatatcaggaagcccacaccgtcagccagctcaagggcgcaccgcccggttacgtcggttacggaagcggcggcgtgctgaccgaggccgttcggcgcaagccgtattcggtggtgttgctggatgaaatcgagaaggcgcatccggatgtgctggaagcgttttacaacgtgttcgacaagggcttgatggaagacgggaccgggttggtggtcgacttcaaaaacaccgtgatgctcgccaccagcaatgtcggcgccgaattgctgctcgatacaccgactgcacaactcggctcggaagcgttcaacgaggcgctgcacaaagtcctcctgcaagccttccgcccggcgtttctggcacgcatgacggtggtcgcgtatcggccgctggatgagcagacgcttgaagggatcgtgttggcgaagctggagaaattgcgcggccgttacaaggctgcgacgggcaagcagttcgagttcgattcgggaattgtgaaagcggtgctcgccaaatgcagtgcggcaggcgcgcgggatgtcgagaacgttttgatgacgcaggtgacagggaaattggcggagtgggtgttggaa

SEQ ID NO: 37743 - DNA, 1888 bp, Pseudomonas fluorescens
atgcggctgtacctctgtgaaaaaccctcccaagccaaggacattgcggccgtactcggcgcaaagcgtcggggcgacggctgctggctgggaacggacgtcacggtgacctggtgcatcggccacctgctggaaaccgcgccgccggacgcctacgacgccaaatacaagcgctgggtgctggccgacctgccgatcatccccgacaagtggaaaatgactgtcaagccgcgtaccgccagccagtacaaggcggtcaagcgcctgctcggcgaggccagcgaactgatcatcgccaccgacgccgaccgtgaaggcgagatgatcgcccgtgagctggtcgaacactgtcgctatcgcgggccgatccgccgcttgtggctgtcggcgctggacgaagcctcgattcgcaaggcgttggcggcactcaaaccgggcgccgaaaccttcagcctgtatcactcggcactggggcgctcgcgggcggactggctgatcgggatgaacatgagtcggctgttcaccctgctcggccggcaatcgggctatcaaggcgtgttgccggtgggccgggtacagacgccgacgttgcgactggtggtggatcgcgaccgcagcatcgctgacttcgtgccggtcgcgtactgggccatcgacgtgcaactgctgcacggagacacgccgttcaacgcgcaatggcgtgcaccgaacgatgcctgtgacgatcaggatcgctgcctcaatcaagccctcgcccagcaagcggccgccgcaatcagtagcgctgccagcgcccgggtggtcaagctgcgcaccgaacgcatgcgcgaagtggcgcccctgcccttcgatctgggcaccttgcaggaagtctgttcgaagaagctcggcctcggtgcccaggaaaccctcgacatcgcccaggccctctacgaaacctacaaagtcatcacctacccgcgcagcgactgcggctacctgcccctgagccagcacaacgaggcgccggggattctcgcagcgctgcgtcaggccgacccgagcctggaagcgctgcgcgagcatctggaaccacagcgtcgctcccgcgcctggaacgacgccaaggtcagcgctcaccacggcatcatcccgaccgctgccgcgaaaaacctggagcgcctgaccggcaagcaccgcgcggtctacacgctgattcgcgcgcggtatctggcgcagttcctgcccaatcacgaatacgaccgcacccaggccgatttcgattgcgccggggaagccttgcgcgctgtcggcaaacagatcatcgagccgggctggaaacgcgcgttgcccgaagcgctggccccggccaagggccgtgaagcccccgcgccacaaacactaccgacactgacccagggtgccgaatgcgccgtggcagacgtgaagctcaaggacctgtggacgcaaccgcccaagccctacaccgaaggcgacctgatcaaggcgatgaagaacgtcgccaaactggtggaagatccgctgctcaagcagaaactcaaggacaccaccggcatcggcaccgaagccacccgcgcgtcgatcattcaagggttgctggatcgcggctatctggtgaaaaacggcaaggcgctgtccgccacgcccgccgcgttcagcctgatcgacgccgtaccgcgcgcgattgccgaccccggcaccacggcgatctgggagcaggcgctggacatggtgcagagcggcgaaatgagtctggaagaattcgtcaccaaacaggccgcgtggatgagcaagcaagtgacccgctgcgccggactgagcctgaccatcagcggcccgccacctgccggcaaggccgctgcgccatggaagaacaaacgcaagacca

SEQ ID NO: 37744 - DNA, 1614 bp, Pseudomonas fluorescens
ttcgactacatcgtggtcggcgccggaccggccgggtgtttgctggccaatcggctgtcggccgatccacagcagcgcgtgctgttgctggaagccggcgggcgcgacaactatccgtggattcacatccccgtgggttacctgttctgcatcggcaacccgcgcaccgactggtgcttcaagaccgaagaacaaccgggcctcaatggccgcgcgctgagttatccgcgcggcaaggtgctgggcggctgttcgtcgatcaacggcatgatctacatgcgcggccaggccaacgactacgacggctgggctgcggagggcaatccgggctgggcctggaatgacgtgctgccgctgttcaagcagagcgaaaaccactttgccggcgcggcggactttcatggcgacaagggtgagtggcgagtcgaacgccagcgcctgtcgtggccgattctcgatgccttccgcagcgctgccgaacagagcggcatcgccagcatcgatgacttcaaccagggcgacaacgagggttgcggctactttcaggtcaatcagaaggccggggtgcgctggaatgcggcgaaggcgtttctgaagccgattcgcgatcgggccaatctcacggtgttgaccgacatcgaggtggatcgagtgctgttcgaggacggtcgcgcttcgaaagtcagtgcccgttggcagggtcaacagaagaatttcaaggcgcgcaaggaaatcgtgttgtgcgccggctccgtgggctcgccgagcattctgcaacgctccggaatcgggccgcgtccgctgctggaaaagctcggcatcggcgtggtgcatgaattgccgggcgtcggcggcaacctgcaggatcacctgcaactgcgcctgatctacaaactggaaaacgcccgcaccctcaaccagatcgccggtagcgtgtggggcaagatgggcatgggcctgcgttatctgtatgaccgcagcgggccgttgtcgatggcgccgagtcagctgggcgcgtttgcccgctcggggccggaacagacctccgccaacctcgaatatcacgtgcagccgctgtcgctggagcgctttggcgaaccgttgcacagcttcccggcgttcaccgcatcggtgtgtgatttacggccgcagagccggggccgggtcgagatccgttccgccgatccgcaagcagcgccgctgatccagcccaattacctcagccatcccgaagacctgcgcgtggccgccgatgcgattcgcctgacccggcgcatcgtcagcgccccggccctgcaagctttcaacccggtggagtacctgccgggcgccagcctgcagaccgaagaacaactgcacgcagcggcggcgaagatcggcacgacgatttttcacccggtcggcacctgccgcatgggcaacgatgcggacgcggtggtcgacgcacagttgcgcgtgcacggcgtaccggggctgcggattgccgatgcttcgatcatgccgcgcatcacctccggcaacacttgttcgcctacgctgatgattgccgagaaagcggcacagctgattctcaaccccgcaactataaacacaacccctgtgggagctggcttg

SEQ ID NO: 37745 - DNA, 759 bp, Pseudomonas fluorescens
ctgcatgaagcccgtgtggtgttgaccggtgccagcggcggcatcgggatagcgatcacgcgtgccttgtgcgctgccggtgcgcaggtcctggcggtcgcgcggcatcaggaatcgctgcgcctgttgctcgacctttacccgcagaacctgtgctgggtcgccgccgatctgacgttcctcagcgaccggcgcaaggtgttggccgccgccgaggccatcggcggcatcaacctgctgatcaacgccgccggggtcaatcacttcgcaatgctggaacagctcgacgacagcgacatcaacgccatgctggcggtgaacatcagtgcgccgatctgcctgaccaaactgttgctgccgctgctcaagcaggccgacagtgccatggtggtcaacgtcggctcgacctatggttcgatcggttatcccggttatgccagttactgcgcgaccaagtttgccttgcgcggattttccgaggccttgcgccgagagttggcggatacccgggtcggtgtgttgtacgtggcgccccgcgccacacgcaccgccatgaacagccccgccgcccaggcattgaacgacgcactcaaatccagcgtcgacgacccgcaagccgtcgcgaatgccgtaatccatgcgattgccggcgatcgccgcgacctctatctgggctggccggagcgcttcttcgtacgcctcaacagcctgctgcccaatctggtggatcgcggtctgcgcaagcaattgccgttgatc

SEQ ID NO: 37746 - DNA, 1056 bp, Pseudomonas fluorescens
atgaaagctgccatttttgtcgaaaaaaatcgcatcgtgctggatgacaaaccgatcccggaagtcggcccgctggacgctttgatccggataaccaccacgacaatttgcggtacggatgtgcacatcctgcgcggcgaatacccggtggcgaagggtttgacggtcggtcacgaaccggtggggatcatcgaacgtctgggatcacaggtgcgcgggtttgtagaggggcagcgcgtgattgccggcgccatcactcccagtgggcaaagttatgcgtgcctgtgtggctgtggttcccaggacgggccggacactcgccatggtttccgggccatcggcgggtggaagttcggcaacaccatcgatggctgccaggccgaatacgtactggtgcccgatgccttggccaatctttgtccgattcctgatggcctcagtgatgagcaggtactcatgtgtccggacatcatgtccaccggtttttccggtgccgaacggggcgaggtgagcatcggcgacagcgtcgctgtattcgccctcggccccattggtctgtgtgcagtcgccggtgcccggctcaaaggcgccagcacgatcatcggtgtcgatgcggtggccgagcgcatgacggtagcacgtcgattgggcgccacccatgtcgtcaattttcgcgagggcgacgtggtcgagcagatcatggccctcaccgatgggcgcggtgtcgatgtcgcgatcgaggcactgggcacgcaaggcacctttgaatcggcgttgcgcgtgctgcgtccgggcggccgcttgtcgagcctgggcgtgtattcgagcgacctgcgcattccgctcgacgcctttgcggccgggttgggcgattacagcatcgtcaccaccctgtgccccggcgggaaagagcgtatgcggcgtttgatggcggtcgtgcagagcggcatggttgacctttcaccgttggtgacccaccggttcaaactggatgacattgaagcagcctacgatttgtttgcacaccagcgtgacggtgtgatgaaggtggcgatt

SEQ ID NO: 37747 - DNA, 1152 bp, Pseudomonas fluorescens
ctgatgaacacctatcaaccgctggacttgagcttcatcaaaggcctgggcacccgactctgggatctgtcgggccgcgagtatctggacgcggtggcgggcgtggcggtgaccaatgtcggccactcgcacccacgcatcgtgtcggcgatcagcgagcaggcgggattgctgctgcacacctccaacctctacagcatcgactggcaacagtcgctggcgcggaagctgacgcagctggcggggatggagcgggcgttcttcaacaactccggtgccgaggccaatgaaaccgcgctaaaactggcgcgtctgtacggctggcacaaaggcatcgagcagccgctggtggtggtgatggccaacgcgtttcatggccgtacccttggcaccttgtccgccagcgatggcccggcggtgcgcctgggtttcaatgagttgcccggggattttgtcaaggtgccgttcggcgatcttgaggcgctggagcaagtgcagcgcaagcatggccagcggatcgtggcgattctggtcgagccgatccagggtgaaagcggcgtgcaactggcgcctcccggctacctcaaggccctgcgtgaattgtgcaaccgccacgcctggctgttgatgctcgacgaaattcagaccggcatcggtcgcaccggtcgctggttcgcgtttcagcacgaaggcatcgttcccgacgtcatgaccctcgccaagggcctgggtaatggcgtgccgatcggtgcctgcctggcacggggccgggcggccgatctgttcacccccggcagccatggcagcaccttcggcggtaatccactggcgtgccgggtgggttgcaccgtgctcgagatcatcgaagaacagggcgtgctggaacatgccagggtccagggcgagcgcctgctgacccgcctgcgtgcagagctggcggacaatccgaatgtgctggcgattcgtgggcaagggctgatgatcggcatcgaactcaagcagccgatccgcgacctgacactgattgcggcacgggatcatggactgctgatcaacgtcacgcgcggcaagacgatccggctgctgccgccgctgacgattgatgagcgggaggtggggatgattgtcagaggtgttggccgttccctgagc

SEQ ID NO: 37748 - DNA, 1854 bp, Pseudomonas fluorescens
atggccctactgcagatcgccgaacccggccaaagtcctcaaccacaccagcgtcgtctggctgtgggaatcgacttgggcactaccaattcgctggtcgctgcgttgcgcagtggtctttccgagccgctggccgatgccgaagggcgggtcatcctgccttccgccgtgcgttatcacgccgatcgcgtcgaagtcggcgagtcggccaagctggccgcatcctccgatcccctgaataccgtgctgtcggtcaagcgcctgatgggtcgtggtctgtccgacgtcaagcaattgggcgatcagctgccgtaccgctttgtcggcggcgaatcgcacatgccgttcatcgacaccgtgcagggcccgaaaagcccggtcgaagtgtccgccgatatcctgaaagtattgcgtcagcgcgctgaagccacccttggcggtgagttggtgggcgcggtgatcaccgttccggcgtacttcgacgatgctcagcgccaagctacgaaggacgcggcgaaacttgccggtctgaacgtgttgcgtctgctcaacgagccgaccgctgcggcggtggcatacggtctggatcagcatgccgaaggcctggtcgcgatttatgacctgggcggcggcaccttcgatatttcgattctgcgcctgactggcggtgtcttcgaagtcctggccactggcggcgatagcgcgctgggcggcgatgatttcgatcacgcgattgccggctggatcatcgagagcgccagtttgtccgccgacctcgatccgggcgcacagcgcagcctgctgcaagctgcctgcgcagccaaagaagccctgacggattctgacagtgttgaagttgcttacggcgactggaaggctcagctgactcgcgaagccttcgatgcgctgatcgagccaatggtcgcccgcagcctgaaagcctgtcgccgcgccgttcgtgattccggcgtcgagctggaagatgtgcacgcggtggtcatggtcggtggttcgacccgcgttccacgtgttcgcgaagccgtcgccgaagccttcggtcgtcagccgctgaccgaaatcgacccggatcaagtggtggccattggtgctgcgatccaggccgatacgctggccggcaacaagcgcgatggcggcgaactgctgctgctcgacgtgattccgctgtccctggggctggaaaccatgggcggcctgatggagaaggtgattccgcgcaacaccaccatccccgtcgctcgcgcccaggacttcaccacttataaagacggccagtcggccatggcgatccacgtgttgcaaggcgagcgtgagctgatcagcgattgccgctctctggctcgcttcgagttgcgcggcatcccggcgatggtggccggtgcggcgaaaattcgcgtgaccttccaggtcgatgccgacggtctgctcagcgtctctgcccgtgaattgggttcgggcgttgaagcgagcattcaggtcaagccatcctatggcctgaccgatggcgaaatcgccaagatgctgaaagattcgttccagcacgccaacgatgacaaagtcgcccgcgttcttcgcgagcaacaagtcgatgcccagcgcctgatcgaagcggtgcagggcgctcttgaggcggatggcgagcgcttgctagatgccgaagagcgcatggtcatcgatctgcaggtgcaggaactgaccgaactgatgaaaggcactgatggttatgccatcgagcagcagaccaagcgtctgtcgcaagtgaccgatgcttttgcagcccgtcgtatggatcagacggtgaaagccgctctgtcggggcgcaatctgaatgaaatc

SEQ ID NO: 37749 - DNA, 414 bp, Pseudomonas fluorescens
atggctgttcaacgtactttctccatcatcaagcctgacgccgttgctaaaaacgtgatcggcaagatcaccactcgcttcgaagacgctggcctgcgcgttgtagcttcgaaactgaagcaactgtcgaaagccgaagccgaaggcttctacgctgagcacagcgctcgtggtttcttcggcgaattggttgccttcatgacttcgggtcctgttgtcgttcaggttctggaaggcgaaaacgccatcgctcgcaaccgtgagctgatgggcgctaccaaccctaaagaagctgctccaggcaccatccgtgctgacttcgctgaatcgatcgacgccaacgccgttcacggttcggactccgaagccgctgctgctcgcgaaatcgcttacttcttcgcagctactgaagta

SEQ ID NO: 37750 - DNA, 2376 bp, Pseudomonas fluorescens
gaaaccgacgccgaacacatcgaacaccacgtccccggcaaaggcctggccctgcccggccagaacctgccggacaaggtctacatcatcccgatccacaaccgcccgttcttcccggcccaggtcctgccggttatcgtcaacgaagagccctgggccgaaacccttgaactggtcagcaaatccgaacaccactccctggccctgttcttcatggacacaccccaggaagacccgcgccacttcgacaccaaggcgttgccgcaatacggcaccctggtcaaggtgcatcacgccagccgcgaaaacggcaaactgcaattcgtcgcgcagggcctgagccgcgtacgcatcaagacctggctcaaacaccatcgcccgccgtatctcgttgaagtcgaatacccgcaccagcccaccgagccgaccgacgaggtcaaggcctacggaatggcgctgatcaacgctatcaaggaactgctgccgctcaacccgctgtacagcgaagagctgaagaactacctcaaccgcttcagccccaacgatccgtcgccgctgaccgacttcgccgccgccctcacatcggcgaccggcaatgagctgcaggaagtgctcgactgcgtgccgatgctcaagcgcatggaaaaagtcctgccgatgctgcgcaaggaagtcgaagtcgcgcgtctgcaaaaagaaatctccgccgaagtgaaccgcaagatcggcgagcatcagcgcgagttcttcctcaaggaacagctcaaggtcatccagcaagagctgggcctgaccaaggacgaccgcagcgccgacctcgagcagttcgagcagcgtctggaaggcaaggtcctgccgacgcaggtacaaaagcgcctcgaagaagaaatgaacaaactgtcgatcctcgaaaccggatcgccggagtacgcggtcacccgcaactacctcgactgggcaacctcggtaccgtggggcgtgtatggcgaggacaaactcgacctcaagcacgcgcgcaaggtgctggacaaacaccacgccggcctcgacgacatcaaggaccggattctcgaattcctagcggtcggtgcctataaaggcgagatcagtggctccatcgtgctgctggtgggcccgccgggcgtgggtaaaaccagtgtcggcaaatccatcgccgaatccctcggccggccgttctaccgcttcagcctcggcggcatgcgcgacgaagccgagatcaagggccaccgccgcacctacatcggcgcgcagccgggcaaactcgtgcaggcgttgaaagacgtcgaagtgatgaacccggtgatcatgctcgacgagatcgacaagatgggccagagctaccagggcgaccccgcctcggcgctgctcgaaaccctcgacccggaacagaacgtcgaattcctcgaccactatctggacctgcggatggacctgtcgaaagtcctgttcgtctgcaccgccaacaccctggattcgattcccggcccgttgctggaccggatggaagtgattcgcctgtcgggctacatcaccgaagaaaaagtcgccatcgccaagcgtcacctgtggccgaaactgctggaaaaggctggcgtgtccaaaggcagcctgagcatcagcgacacggcgctcaaggctctgatcgacggttatgcccgtgaagccggcgtgcgccagctggaaaaacagatgggcaaactggtgcgcaaagcggtgatgaagctgatcgacgacccgaaagcggcgatcaagatcggcccgaaagacctcgaagcgtccctcggccatccggtgttccgcaacgagcaagtgctgtccggcactggcgtgatcacgggacttgcctggaccagcatgggcggcgcgacactgccgattgaagcgacgcggattcacacgctcaatcgaggtttcaaactcaccgggcaactgggcgatgtgatgaaggagtcggcggagatcgcctacagctacgtcagctcgcacctgaaacagttcggcggtgacgcgaaattcttcgacgaagctttcgtccacctgcacgtaccggaaggcgccacaccgaaagacggcccaagcgccggcgtgaccatggccagcgccctgctctccctcgcccgtaatcagccgccgaaaaaaggcgtggccatgaccggtgaactgacgctgaccggccatgtgctgccgattggcggggtgcgcgagaaggtgattgcggcgcggcggcagaagattttcgagttgattctgccggaacccaatcggggtaacttcgaggaactgccggattacttgaaggaaggcattaccgtgcacttcgccaagaagttttcggatgtggcgaaggtgcttttc

SEQ ID NO: 37751 - DNA, 2400 bp, Pseudomonas fluorescens
actgaaggtgcttcgagtcgaagccgtcttctgccgaacctgctcggcattctgcttctgctgatgggcctggccatgctggccgggggaatcaagctgagtacgctcggcggctcgctgtattacctgctggccggtatcggcatcacgctgaccggcattctgatgctgatgcgccgtcgcgcagcattgggcctgtacgccatcgtgctgttcgccagcactgtctgggcgctgtgggaagttggtctggactggtggcaactggtgccgcgtctggcgctgtggtttgtcctcggtttcgtgatgctgctgccgtggttccgtcgtccgctgctgctcgcaggccctgcgccgatgggcaccggcggtttgaccgtggctgtgattctggccggcgtcactgccctggccagcctgttcacccacccgggcgaaaccttcggcgaactgggtcgcgacaccgccgacaccaccagcaccgccccgcaaatgccggacggcgactggcaggcctacggccgcaccgaattcggtgaccgctactcgccactgaaacagatcaccccggccaacgtcggcaagctgcaagaagcctggcgcatccagaccggcgacctgccgactgccgacgacccggtcgagctgaccaacgaaaacaccccgctgaaagccaacggcatgctttacgcctgcactgcgcacagcaaagtgctggcactggacccggacaccggcaaggaactatggcgcttcgatccgcagatcaaaagcccggaaggcttcaagggcttcgcccacatgacctgccgtggcgtgtcgtactacgacgaagccgcgtacgccaagtctgaaaacgcggcgtccaccgtgatctccgaggccggcaaagccgtcgcccaggcctgcccgcgtcgcctgtacctgcctaccgccgatgcccgcctgatcgcactgaacgccgacaccggcaagatctgcgaaggcttcggcaccaacggtgtggttgacctgacccagggcatcggcccgttcaccgctggcggttactactccacctctcctgccgcgatcacccgtgatctggtgatcatgggcggtcacgtcaccgacaacgaatcgaccaacgagccgtccggcgtgatccgcgcctacgacgtgcgcgacggccatctggtctggaactgggacagcaacaacccggacgccaccgaacccttggccccgggccagacctacagccgcaactcggccaacatgtggtcgctggccagcgtcgatgaaaaactcggcatggtctatctgccattgggcaaccagacgcctgaccagtggggcggcgatcgcacccccggtgccgagaaattcagcgccggcctggtcgcgctggacctggcgaccggcaaggtgcgctggaactaccagttcacccaccacgacctgtgggacatggacgtcggcagccagccaaccctgctggacatgaaaaccgccgacggcatcaagcctgcgctgatcgccccgaccaagcagggcagcctgtacgtcctcgaccgtcgtgacggcacgccgatcatcccgatccgcgagatcccggtgccgcaaggcgccgtgaaaggcgaccacaccgccccgacccaggcccgttcggacctgaacctgctggccccggaactgaccgaaaaagccatgtggggcgccagcccgttcgaccagatgttgtgccgcatccagttcaaggaactgcgctacgaaggccaatacacgcctccgtcggaacagggcagcctgatctacccgggtaacgtcggcgtgttcaactggggcggtgtttctgtcgacccggttcgccagatgctgttcaccagcccgaactacatggctttcgtctccaagatgatcccacgtgccgacgtacccgccgacagcaagcgcgaaagcgaaacttccggcatccagaaaaacaccggtgcgccgtatgccgtgaccatgcacccgttcatgtcgccactgggcgtaccttgccaggccccggcctggggctacgtcgccggtatcgacctgaccaccggcaaagtcgtctggaaacgcaaaaacggtaccagccgcgacagctcgccaatcccgatcggcttcaccctgggcgtgccaagcatgggcggctcgatcgtcactgccggcggcgtcggcttcctcagcggcacgctggaccagtacctgcgcgcctacgacgtgaacaccggtaaagaactgtggaaatcgcgtctgccggccggcggccaggcgaccccaatgacctacaccggcaaggacggcaagcaatacgtcctgctcgtggtgggtggtcacggctcgctgggcaccaagatgggtgactatgtgattgcctacaaactgccg

SEQ ID NO: 37752 - DNA, 1359 bp, Pseudomonas fluorescens
gaaaccgctcaaggcggtccgctcaaacgcgaactcggtgaacggcatattcgcctgatggcgctcggcgcctgcatcggtgtcggtctgtttctcggttcggccaaggccatcgaaatggccggcccggcgatcatgctgtcttacatcatcggcggtctggcgatcctggtgatcatgcgcgccctcggcgaaatggccgtacacaacccggtcgccggctccttcagccgttacgcacaggattatctcggcccgctggcgggctttctcaccggctggaactactggttcctgtggctggtgacctgcgtcgccgaaatcacggcggtggcggtgtacatgggcatctggttccccgatgtcccgcgctggatctgggcgctggcggcgctggtcagcatgggctcgatcaacctgatcgcggtgaaagccttcggtgagttcgagttctggttcgccctgatcaagatcgtcaccatcatcgccatggtgctcggcggcattggcatcatcgccttcggtttcggcaacgacggtgtggcactggggatttccaacctgtgggcccacggcggcttcatgcccaacggtgtgacgggcgtgctgatgtccctgcaaatggtgatgttcgcctatctgggcgtggagatgatcggcctgaccgccggtgaagcgaagaacccgcagaagaccatcccgaatgcgatcggctcggtgttctggcggatcctgctgttctacgtcggcgcgctgttcgtgatcctgtcgatctacccgtggaacgaaatcggcacccagggcagtccgttcgtgatgacctttgagcgtctgggcatcaagaccgccgccggcatcatcaacttcgtggtgatcactgcagcgctgtcgtcgtgcaacggcggcatcttcagcaccggtcgcatgctctacagcctggcgcaaaacggccaggcgccggccggtttcgctcgcacctcgagcaacggcgtaccgcgtcgggcactgctcctgtcgatcttcgcgctgctgctgggcgtgctgctcaactatctggtaccggaaaaagtcttcgtctgggtgacgtccatcgccaccttcggcgcgatctggacctgggtgatgatcctgctggcccagctgaaattccgcaaaggcctgagcgccagcgaacgggcgggcctgaagtacaagatgtggctgttcccggtcagctcctatctggcgctggcgttcctggtgctggtggtcggcctgatggcgtacttcccggacactcgcgtggcgctgtatgtcggcccggcgttcctggtgctgctgaccgtgttgttctacgtgttcaagctgcaaccgaaggat

SEQ ID NO: 37753 - DNA, 2310 bp, Pseudomonas fluorescens
atggccgtggcacacaccctgggtttcccgcgcatcggcgccgaccgcgaactgaaaaaagccctcgaagcctgttggaaaggtgatcttgatcaggccgccctgaatcaggtcggccgcgaactgcgcgccagacactggcaactgcagaaggacgccggcatcgacttgctgccggtcggcgacttcgcctggtacgaccaggtgctgacccactcgctgaccttcggtgtgatccctgagcgcttcgacgctgtgcgcgacgagcgcggcctgccgaccctcgacaccttgtttgccatggcccgtggcgccacgtcgtcctgctgcggcggtgagcacggcaagactcaatacgcccaagagctgaccaagtggtttgacaccaactaccactacctggtcccggagttcagcgccgaccagcagttcaagctgagctgggaacagctgttcgatgaagtcgaagaggccaaagccctcggtcacaacgtcaaaccggtgatcatcggcccgctgacctacctgtggctgggcaaggcgaaaggcaacgacttcgacaagctcgatctgctcgagcgcctgctgccggtgtacaaccaaatcctcggtcgtctcgcggcacagggcgtggagtgggtgcagatcgatgagccgatcctcaccctcgacctgccgcaagcctggaaaagcgctttcgaacgcgcctatcacatccttcagtactcgccattgaagaaactggtggcgacctatttcagtggcctgcaagacaaccttggtctggccgtcggcctgccggtacaaggtctgcacatcgacgccgtgcgggcgccggatcagctcggtcaggtgctggatcgtctgccgacctacaagattctctcggtcggcctggtcaacgggcgcaacgtctggcgctgcgaactggagcaggcgctggcgcaactgcaaccggcgcaggagcgtttcggcgacaacctgtgggtcagcagttcctgctcgttgctgcacagcccggtggatgtcgagcgtgaagacaagctcgatccggaactgaaaagctggctggcgttcgccgtgcagaagtgcagcgaaatctcggtgttgcgtgatgcactgaacgacccgcaagcgccgaacgtgcaaagcgcactggccgcaagccgcgccattcagcaaagccgcgcccgttcgccgcgcattcacaaggccgaagttcaagcgcggatcgaggcgatcaacgccagcgacagccagcgtcattcgccgttcgccaaacgcatcgccgcgcaacaggctcgcttgaagttgccgacgttcccgaccaccaccatcggctcgttcccgcagaccggttcgatccgcctggcccgtcaggcgtacaagcagggcaagctgtcggccaacgattaccacgatgccatgcgcagcgaaatccgccacgcggtgcaggtgcaggaacgcctgggcctggatgtgctggtgcacggtgaagccgagcgcaacgacatggtcgagtacttcgccgaacagctagacggttacttgctcacccgcttcggctgggtgcagagctatggctcgcgctgtgtgaaaccggcggtgatttatggcgatctgtcccgtcctaacgccatgaccgtggactggatcacttatgcccaaggcctgaccgacaaggtcatgaaaggcatgctgaccggtccggtgaccatgctgatgtggtcgttcccgcgcgaagacgtgtcgcgcaaagtccaggcgcaacaactggcgctggctctgcgggacgaagtggtggacctggaaaacgccgggatcaggatcgtgcagatcgacgaagccgcgttccgggaaggcctgccgctgcgccgtgaacaatggcaggaatacctcgactgggccgtggaggcgttccgcctgacagcctcgggggtgaaggatgaaacgcagattcatacccacatgtgctacagcgaattcaatgacgtgatcaaggcgatcgccgacatggacgccgacgtcatcaccatcgaaacctcgcgttcggacatggaattgctcgaggctttcgaagcgttcgactacccgaacgacatcggcccgggtgtctacgacatccactcgccgcgggtgccggacactgccgagatggtcaagttgatgagcaaagcggtaaaacggattccggcccagcgcctgtgggtcaaccccgactgcgggctgaaaacccgggcctggccggagaccgaagcagcactggtcaacatggtcgcggcggcgcggcagttgcgcagtcagttggcg

SEQ ID NO: 37754 - DNA, 1536 bp, Pseudomonas fluorescens
atgtccacatctaccttgcgtacgccccctatctccgagatctacgacatcgctgtcatcggcggcgggatcaatggcgttgggatcgcagcggatgccgccggtcgcggtctttcggtgttcctttgcgaaaaggacgacctggccagccacacttcgtcagccagcagcaagttgatccacggtggcctgcgctacctcgaacattacgaattccgtctggtgcgcgaagcattggccgaacgcgaagtgctactggccaaagccccgcacatcgtcaagccaatgcgtttcgtgctgccgcaccgtccgcacctgcgtccggcatggatgatccgcgcgggtctgttcctctatgaccacctcggcaagcgcgaaaaactggctggctcgaaaagcctgaagttcggcgccgacagcgcactgaaaagcgaaatcagcaaaggcttcgaatactccgattgctgggtcgacgacgcccgcctcgtggtgctgaacgccatggccgcccgtgaaaaaggcgcgcatattcacacccagacccgttgtgtcagcgcccgccgcgccaagggtctttggcacctgaacctggagcgtgccgacggcagcctgttttcgatcaccgccaaagcgctggtgaacgctgccggcccgtgggtcgccaagttcatccgtgacgacctgaagatggaatcgccgtacggcatccgtctgatccagggcagccacatcatcgtgccgaagctgtacgaaggcgatcacgcgcacattctgcaaaacgaagatcagcgcatcgttttcaccatcccgtacctgaacaacctgaccctgatcggcaccaccgaccgcgagtacaccggcgatccggccaaagtggcgatcaccgacggcgaaaccgattacctgctcaaagtggtcaatgcccatttcaagaagcaaatcagccgtggcgacatcctgcacacctactcgggcgtgcgcccgctgtgcaatgacgaatccgacaacccctcggccgtgacccgcgactacaccctggcgttgtccggcagcaccgaggaggcgccgctgctgtcggtgttcggcggcaagctgaccacctaccgcaagctcgcggagtcggcgatggcgcagctgatgccgttcttcacccagatgcgcccgagctggaccgccaccgccaccctgcccggcggcgaagacatgactacgccacaggccctgagcgcgctgatccgcgacaagttcgactgggtaccgaccgaaattgcccgccgctgggccaccacctacggcagccgcacctggcgcatgctcgaaggcgtcgacaccctggccgacttgggcgaacacatcggcggcgggctctacacccgtgaagtcgattacctgtgcactgaagagtgggccaccaccgcgcgtgacattctgtggcgtcgcagcaaactgggcctgttcaccacgccagccgagcaagaaagactggcggcgtacctgaacaaggtcgagcagaaccgcagcaagatcgaagcggcc

SEQ ID NO: 37755 - DNA, 1482 bp, Pseudomonas fluorescens
atgaccgacattgagaataagaactacatcattgccctcgatcagggtacgaccagctcccgcgcgatcattttcgaccgcgacgcgaacgtggtctgcaccgcacaacgcgaattcgcccagcactacccgcaagccggttgggtcgaacacgacccgatggaaatcttcgccacccagagcgcggtgatggtcgaagcgctggcccaggccggcctgcaccatgaccaggtcgccgccatcggcatcaccaaccagcgcgaaaccaccgtggtctgggacaagaccaccggccgcccggtgtacaacgcgatcgtctggcaatgccggcgcagcaccgagatctgccagcagctcaagcgcgacggtcatgaagactacatccgcgacactacgggactggtcaccgacccgtacttctccggcaccaaactgaagtggatcctcgacaacgtcgaaggcagccgtgagcgcgcgcgcaacggcgaactgctgttcggcaccgtcgacagctggctgatctggaaattcactggcggtaaagtccacgtcaccgactacaccaacgcctcgcgcaccatgctcttcaacatccacaccctggagtgggacgcgaagatgctggagatcctcgacatcccgcgcgagatgctgccggaagtcaaagcctcttcggaaatctacggccgtaccaaaagtggcatcgccatcggcggtatcgccggcgaccagcaggctgcgctgttcggccagatgtgcgtcgagccgggccaggcaaaaaacacttacggcaccggttgcttcctgctgatgaacaccggcgacaaagcggtgaaatcccagcacggcatgctcaccaccatcgcctgcggcccgcgcggcgaagtggcctacgccctggaaggtgccgtgttcaacggcggttcgaccgtgcagtggctgcgcgatgaactgaagatcgtcaacgacgcccacgacaccgaatacttcgccaataaagtgaaggacagcaacggcgtgtatctggtgccagccttcaccggcctcggtgcgccctactgggatccgtatgcccgtggcgccctgttcggcctgacccgtggcgtgcgcgtggatcacatcatccgcgctgctctggaatcgattgcctatcagacccgcgacgtcctcgacgccatgcaacaggactccggcgaacgcctcaaggccctgcgcgtggacggcggcgcggtggcaaacaacttcctgatgcagttccaggccgacatcctcggcacccaggtcgagcgtccgaaaatgcgcgaaaccacggcgctcggcgcagcttatctggccggtctggcgtgcggattctggggcagcctggaagaactgcgcggcaaggccgtgatcgagcgcgaattcgaaccgagcctggacgaagtcgagaaagagaagctgtataaaggctggaaaaaagctgtcagccgtacccgtgactgg

SEQ ID NO: 37756 - DNA, 919 bp, Pseudomonas fluorescens
agcaaaaaggtagtcaatgatgagcgcaaggcactttctctccctgatggattgcacgcccgaagagctggtcagcgtgatccgtcgaggcgttgagctcaaggacctgcgtaaccgcggcgtactgttcgagcctctgaaaaaccgcgtcctggggatgatcttcgagaaatcctcgacccgtacccggatctccttcgaggccggcatgatccagctcggcggccaggcgatcttcctgtcgccgcgcgacacccaactgggtcgtggcgagccgatcggcgactgcgccatcgtcatgtcgagcatgctcgacgcagtgatgatccgtacctttgcccacagcaccctgaccgaattcgctgccaactcccgcgtgccggtgatcaacggcctgtccgatgacctgcatccgtgtcagttgctggccgacatgcagaccttcctcgaacaccgcggctccatccagggcaagaccgtggcctggatcggcgacggcaacaacatgtgcaacagctatatagaagcggcgatccagttcgacttccagttgcgcgtggcctgcccggaaggctatgagccaaaccctgaattcgtggccaaggccggtgaccgcgtgaccatcgtccgcgacccgaaagacgccgtgcgcggcgcgcatctggtgagcaccgacgtctggacctccatggggcaggaagaggaaaccgccaagcgcctcaaactgttcgcgccgtttcaggtcaaccgcgccctgctcgacctggctgccgatgacgtgctattcatgcactgcctgcccgctcaccgcggtgaggaaatcagcctcgacctgctcgatgatccgcgctccgtcgcctgggatcaggcagaaaaccgtctccacgcacagaaggccctgctcgagttcctcgtcgaa

SEQ ID NO: 37757 - DNA, 2103 bp, Pseudomonas fluorescens
atgaccaagactctccaccaccgtgcctgccacctgtgtgaagccatctgcggcttgaccatcgaaaccaccgaaaccgacggccaggtgcagatcacctcgatcaagggcgatgccctggacacgttcagtcgtgggcacatctgccccaaggccgtcgcgctgcaagatatccagaacgatccggatcgcctgcgtcagccgatgcgccgggtcggcagcgaatggctgcccatcgagtgggacgaggcggtcgagctggtcgccgaaaaactctcggcgattcaggagcgtcatgggcagaacgcggtcgccgtgtatcagggcaaccccagcgtgcacaactacgggttgatgacccacagcaattacttcctcggcctgttgaaaacccgcaaccgctattcggcgacgtcggtcgatcaactgccccatcacctgaccagctacctgatgtacggccacggcctgctgctgccgatcccggacatcgatcacaccgatttcatgctgatcctgggcggtaatccactggcctccaacggcagcatcatgactgtgccggatgtcgagaagcgtctgaaagcgatccaggcccgaggcggcaaagtggtggtggtcgatccacggcgcagcgagacggcggcgatggccgatcagcatctgttcgtgcgccccggcggcgatgcggcgttgttgtttggtgtgcttaatacgttgttcagcgaaggactgacgtctgacagtcatttgccggtggacggtctggacgacgtgcgcgcggcggtggcggggttcaccgctgaagccatgagcccgttgtgcgccgttccctccgaacagatccgccagttggcccgggacttcgccgctgcgccaagcgccgtttgctacggtcggatgggggtttccactcaagccttcggcacgctgtgtcattgggttgtgcagctgatcaatctggtcaccggcaacctggaccgcgtcggtggtgccttgtgcaccgagccggcggtggatctggtcgcctcgacttcaggcgggcacttcaataaatggcagagccgcgtgtccggacgtcccgagtacggcggtgagctgccggtctcggcgctggctgaagaaatgctcacagagggtgaagggcagattcgcgcgctgatcaccgtggccggcaatccagtgttgtccacgcccaatggccgacaactggagcaggcgctggacgggctggaattcatggtcagtgtcgacctgtatatcaacgaaaccacgcgctacgccgatctgatcctgccatcgacttcggcgctggagaacgatcactacgacaccactttcaatctgtttgcggtgcgcaacgtcactcgattcaaccgggcaatcctcgccaaacccgaaggggcgctgcacgactgggaaatcttcgtcggcctggccaaggccttcgccgcgaagaccggcaaggagctgaaaccgacgatgccgccgtcgaagatgatcgacacgggattgcgcatgggcgcctatggcgatgcgtccgagcataaattgtcgctggcgacgctgttcgatcatccgcacggtgttgacctgggagcgctgaaacccaacctgacaccgcgattgaagaccttcaatcaacgagttcaggcggcgccgccggaaatcctcgccgatctggcgcgcttcgccgcgttgcaggcgccggccgccgatgagctgttgatgattggtcgccgtcatgtacgcagcaacaattcgtggatgcacaattaccaccggttggtgaagggcaagccgcgtcatcagttgttgatgaatccggacgatctcgccagtcgcgggctcagtgatggtcagcttgtccgggtcagttcgcgggtcgggcagatcgaggtcgaggtgctgggcagtgcggacatgatgaagggcgtggtcagcctgccgcatggatggggccatgcccggccgggcgtgcagatggcgattgccagcggtcagccgggctccagtgccaatgacctgaccgatgaatgccagctcgacgagctgtcaggcaatgcggcgctcaatggcgtgccggtgaccgtggcggcggcg

SEQ ID NO: 37758 - DNA, 594 bp, Pseudomonas fluorescens
gtactcgtaggcaaacaagcccctgacttcaccgtcccggccgtactcggcaatggcgagatcgttgacagcttcaccctgtcctcggccatcaaaggcaaatacggcctggtgttcttctacccgctggacttcacctttgtctgcccgtccgagctgatcgctctggacaaccgcatggccgacttcaaggcacgcaacgttgaagtagtcgccgtttcgatcgactcgcacttcacccacaacgcctggcgcaacacaccggtcaacaatggcggcatcggccaggtgaaatacaccatggctgccgacatgaagcacgaaatcgccaaggcctacgacgttgagtccgaaggcggcgtggctttccgtggcgcgttcctgatcgatgacaaaggcgttgtccgctcgcagatcatcaacgacctgccgctgggccgtaacatggaagagctgatccgtctggtcgacgctctgcaattccacgaagagcacggcgaagtctgccctgccaactggaaaaaaggcgacaaaggcatgaacgcttcgccagaaggcgttgcggcttacctgaccgagaacgctgctgccctg

SEQ ID NO: 37759 - DNA, 1194 bp, Pseudomonas fluorescens
aaggtcgttctggcgtattccggcggcctggacacttcggtgatcctcaagtggctgcaggatacttataactgtgaagtcgtgaccttcaccgctgacctgggtcagggcgaagaggtcgagccggctcgcgccaaggcgcaggccatgggcgtcaaagaaatctacatcgacgacctgcgcgaagaattcgtgcgtgacttcgtgttcccgatgttccgcgccaacaccgtttacgaaggcgagtacctgctgggtacttccattgcgcgtccgctgatcgccaagcgtctgatcgaaatcgccaacgaaaccggcgccgacgccatttcccacggcgcaaccggcaagggcaacgaccaggtgcgtttcgaactgggtgcctacgcgctcaagccaggcgtgaaagtgatcgccccttggcgcgagtgggacctgctgtcccgcgagaaactgatggactacgccgagaagcacgcgatcccgatcgagcgtcacggcaagaagaaatccccgtactcgatggacgccaacctgctgcacatctcctatgaaggcggcgtgctggaagacacctggaccgagcacgaagaagacatgtggcgctggaccgtctccccggagaaggctcccgacaccccgcaatacctggaactgacctaccgcaacggcgacatcgtcgcgctggacggcgtcgaaatgactccggccaccgtactggcgaccctgaacaggatcggtggcgagcacggcatcggccgtctggacatcgtcgagaaccgttatgtcggcatgaagtcccgtggctgctacgaaaccccgggcggcaccatcatgctgcgcgctcaccgcgccatcgaatcgatcaccctggaccgcgaagtcgctcacctcaaagacgagctgatgccgaagtacgccagcctgatctacaccggttactggtggagccctgagcgtctgatgctgcaacagatgatcgacgcttctcaggtcaacgtgaacggcgttgtgcgccttaagctgtacaagggcaacgtgatcgtgaccggccgcaagtccgacgattcgctgttcgacgccaacatcgcgaccttcgaagaagacggcggcgcctacaaccaggccgacgcggcgggcttcatcaagctcaacgcactgcgcatgcgtattgctgccaacaagggccgcaag

SEQ ID NO: 37760 - DNA, 756 bp, Pseudomonas fluorescens
atgcaactcaacgacaaagtaatcattatcactggcggttgccaaggcttgggccgctcgatggccgagtatttcgcgggcaagggcgcgaagctggcgctggtcgacctgaaccaggaaaaactcgatgacgccgtcgcggcctgcaaggccaagggtgtcgaggcacgcagctatctgtgcaacgtcgccaacgaagagcaggtgacgcacatggtcgctcaggtcgccgaagacttcggcgcgatccacggcctgatcaacaacgccgggatcctgcgcgacggcctgctgctcaaggtcaaggacggcgaaatgaccaagatgagcctggcccaatggcaggcggtgatcgacgtcaacctgaccggcgtgttcctctgcacccgtgaagtggcggcgaaaatggtcgagctgaagaacagcggcgcgatcatcaacatctcgtcgatctcccgcgcgggcaacgtcggccagaccaactactccgccgccaaggccggcgtcgctgcagcgaccgtgacctgggccaaggaactggcgcgctacggcattcgcgtggccggtatcgcgccgggcttcatcgaaaccgagatgaccctgggcatgaagccggaagcgctggagaaaatgacctcgggcattccgctcaagcgcatgggcaagccggaagagatcgcccattcggcggcgtacatcttcgagaacgactactacaccggccggattctggagatggacggtgggttgcgcatc

SEQ ID NO: 37761 - DNA, 291 bp, Pseudomonas fluorescens
atgaagcttcgtcctctgcatgaccgcgtcgtcatccgtcgcagcgaagaagaaaagaaaaccgctggcggtatcgtcctgccaggttcggctgctgaaaaagccaaccacggtgagattctggctgtaggcccgggcaaggcactggaaagcggtgaagtgcgcgcactgtccgtgaaggtaggcgacaaggttgtgttcggtccgtactccggcagcaacactgtgaaagtcgacggcgaagacctgctggtaatgagcgagaacgaaatcctcgccgttatcgaaggc

SEQ ID NO: 37762 - DNA, 2460 bp, Pseudomonas fluorescens
tggctgacccagcgcatgcgcgacttcctgcaagcgcgcaaattgaatctgctgtacgtcagcagcggcgccgatgcccaggtctggcgcttgtacaacacgacgcccatggccgacgactttccgcatgagatgcttgatcgtctggaaaccctcaagtgcgacaacaacggtgccctgaaagagatctggctgacccacaactggcaagggcactcgcagctgtacatcttcattcgtctggatgagcgcgacctcgattctggctggctcggtctggagatggatgaccgcgaagtctccaatgcgctgagcgaccacagcgccggcgagttcaccatgttcaattctcagggcatgccgttattcagcaacagccacaagccgccgcccgggcagaatctgccgctgctgcgtcagcaggatttcttcggtttcgtcggcgacggctggctgcccgagcaactggtattgcgcaaacagctcaagtcgtcggacaggcaactgacctactccatcgacttactcgccgtgctgtgggccttgtggccgcagttgctcggtgcgctggcgttctgtctggcgagcatcagcctggtgtggctgctgatccgtcgtctggaacatcgtttcatcacgccgaccctgcagcggattcaggccctggtcgaaagcgagctgttcagccgcgacgtgatacagaccgcgcccgtggcgctctgcgtattgcggcgcagcgatgctcgagtggtgctggaaaacaccctcgcccggcactggctgggcgaatgcggccagcaactcgggcctggctggatccgcgctgcgtttgcggataaatcgccgtgcctcaccgattatttcgaaaccgccgacggtcgccacctgtacctgagctgcgcgccgacccgctacaagggcgaagacgtgttactttgcgccttcagcgacatcagcgcgcgccggcagatcgaagcagcgctggaacgggcgcgccagtcggccgatgccgccaacgaagcgaagaccctgtttctggcgaccatgagccacgaaatccgcacaccgctgtatggcgtgctcggcactctcgaactgctcgctcgcactcagctcgatactcagcagaaaagctacttgcgggcgatcgaaggctcgtccgcgaccctgctgcaattgatctgcgacgtgctcgacgtgtcgaaaatcgaggccgggcaactggcgctggaactcagtgacttttccatcgtcgccctggcccaagaggttgtgcagggctacgcggcagcggcgcagagcaaaggtttgcagctgtatgcctgcttcgatccgcaactgcccgacagcttgattggcgacatcagtcgtgtccggcagattctcaacaatctgctgagcaatgcggtcaagttcaccgattccggacgcgtggtgctgcgggtcaacgtgctgtctcgcgaaggcgagcgcgtctgcgtgcaatggcaggtatcggacaccgggcgcggcattgcccacgatgatcaggcgtttattttcgagccgttttaccagacccgaggcaacagccacgtcattgcgggtaccgggctgggcctgccgatctgtctgcggctgacgaatttaatgaacggcaccctgcggatggtcagcgaaccggggctgggcagcagtttttccctgaccttgccgcttgagcagcgctcgggcaacacgccgcctgacatacaaccgaaactggcgggggacatcatttacgtggtgtcgccagtgcgcgagctggctgacagcctcgctggctggctgcgccgctggggcgcccgcccgcaggtcggcgcgccggccagtcaagtacctgccgacggcggcgtattgcttgagctatatccgacgccgatggaccagcgcagcgaactgcgctggtcagggccacgtgtgctggccagcggcgcgggtgcctgtgagccgcaatgcacagtcgacggctggatagcgaatctgaacgatctggccgcaatccgccaggccctgcgccaggctcagggcggcgccgttatcgagcatcagcagacacagacccaggcgttggcgccgctgcacctgcacatcctcgtcgccgaagacaacgcgatcaaccagttgattctgcgcgaccagctgcaagaactcggctgcacggtggcgctggccagcgatggcgaagaggccttgtcgctatggcaggccaacacctttgatgtcgtgctcagcgacgtcaacatgccgcgcctcaacggttatgaactggccaagaccctgcgcagactgggctgcaccacgccgatcatcggcgccaccgccaacgccctgcgcggcgaagaggcgctgtgtctggccgccggcatgaatcactgcctgatcaaaccgtttacgctaagagccttgtcgatcgtcctggctccctaccaacgagtcgcc

SEQ ID NO: 37763 - DNA, 1811 bp, Pseudomonas fluorescens
atggtgctcagtacaaatcctggtcgctggatcatctaccgatcattcccgcgcagtggcaggtcgaggtcaaatccaagaccgccgcgcagttcaaaatcatcaaacgcctgctgagtgaagcctcaagtgttgtcatcgcgaccgacgccgatcgcgaaggtgaaatgattgcccgcgagctgcttgaactctgcaggtatcgaggccccgttctgcgcctctggttgtccgccctcaacgaggcgtctattcgcaaagccttgtcctcgctgaagtccggtcaggtgactttcccgctctatcactcggcgctcgcccgcagccgtgccgactggctgatcggcatgaacctcagtcgtttgtttacccttctcggtcggcgagcaggttacgacggcgttttgtcagtggggcgcgtccagacacccactttacgtctggtggtcgatcgggatcgtgcgattgccagcttcgtcccggtgccttactggaccgttgacgtgcacctatcgtcgatgggccagcgattcatcgcgtcgtggttaccaccacgttcaggacgggacgaagcggggcgttgcctgcaacaggcgctcgcccatcacgcggtccaaacaatcaccggcgagaagtccgccacggtactctcgttgcaaactgagcagctccgagaaccgccgcccctgcccttcgacctgagcacgttgcaagaagtctgctcgcgtaagctggggctcggtgttcaggaaaccctgaacatcgcccaagccctgtatgaaacccacaaagccaccacctacccgcgcagcgattgccgctatttgccagagagcatgttcaacgaggcacccgcggtactcgacgccctgctcaaaacggatcctgcactcagacctgcattcgggagcctcgatcgatcattgcgcgcccgcgtatggaacaatgctaaggtcaccgcgcaccacggcatcattcccaccaccgagcccgcaaatttggtgcggatgtccgaacaagaacgccaagtctacgaactgatccgcagccactacctggcgcagtttcttccgcatcatgagtttgatcgaacccaggtcgaactggaatgtagcaaagaacgtttgaccgctgtcggcaaacagatcctgatccagggctggaaaggcttgctcaccgaaaacaccgaggacgatgagcccagtcaaaagcaccaagtattgccagtcctgcaacagggtactcagtgcgccgtaaacgacgtcgaactcaagtcaatgcgcaccgtcgctcccaaaccgctcaccgagggcgatctgatcaaggcgatgaaaaacgtcgccaagctggtcaacgacccacgcctgaaacagaaacttcgggacaccaccggtatcggtaccgaagccacgcgagccggcattatcaaagggttggttgatcgcggttatttgctgaagaaaaaacgcgccttaatggcctccgccgcggcccataccctgatcgaggcggcaccgacagcagtcgccgatccgggtatgaccgcaatctgggaacaggcgctggacgaaatcgaagcgggacgcctgaccctggatgcgttcgttgccaagcaggcgaactggattgcgcagttggtcgcacactaccgctcgcacactttggcaatagcggtcgaaacgagcccgagctgccctatgtgcaacgcctcaatgctcaggcgaaagggaaaatcagggccgttctggtcgtgctcctgctacccggattgcaagggcactgtgtcgatcagtaaagatacgcgtcgctca

SEQ ID NO: 37764 - DNA, 1674 bp, Pseudomonas fluorescens
gctgcgttgcgttggctttacagttttgtacgcccgcatcgactggcgatcgtcgggctgctcggcttgtcagtttctgcctcgcttttggtgttgctgcaaccatggctaacgaaactgctgatcgatgatggtttgctggcacgtgactttccgaagctgttaacaatcgcaagcctgatgatagtcgcaggcctgttgggaacagctctttctgggataaatcgttacctgcacacgcgcttgtcgggacggattttgttttcgctacgtgacgacctttatcgacacctgcagaccttgtcggcgagtttttatgctcagcgacgcatcggtgatttgatgtcacggctagatggtgatgtcgcggaaattcagcgcttcgccgtggattcattattttcggctgtatcgagtgtggtcggcttgctctgtgcagtagcgatgttggtcacgctatcgtggaagctttcattgttggtcctagtgttgattcctctcgacatactgtggttgcgctggatgcgtcgcaaggtcgagcgcgatgtacgccggttgcgtgagtgttcagcggacgtgtcgtcgttcatggtcgagacgctgccagtaatgaaattcattcagtcagccggtcagcaaaaaagggaatcccatcgattggaagcacttgggcagggctatatgaaccagttgctgaagttgcagattacggagttttttactcaggctgtgcctggaacattgacgtctttggcgcgtgcctgcgcttttctcttgggaggctactgggttgttcaaggaacgtggcaactcggctcgctgatcgcgttttccacctatctggggatggcagtagggccagttcagagcctgttaggtctttatgttgcaatacaaaggatgacggtcagtctcgggcgggtcatggagctacgcggtgaggagcctacaatcgtcagccctgtattacccaagcccatgcccgcccaaagtgatttgcgtttcgacgacgttcacttcacccatcccgggcgcctaagcacgttgcgcggtgtcgatgcacggattccttatggcttgaaagttgcgctgagcggcggctccggcgttggtaaatcgacattgatagaccttcttcagcggcatctcgatccacaggctgggcgggtgctgctgggagaagtcgatgtgcgagagctggacctatttgagctacggcgacggattgctgtggtcagtcaagatatcgtcttgtttcgtggcagtctcgccgacaacctggcctacgccatgccggacgctagtcgggaagctataaccgcagtggctcaactcgcgcagctcgagagtttgatcgcgtccctccccgaggggctcgatagccctttgggtgagcggggtcaacagttgtctggcggacaaaaacaacgcatcgcaatcgctcgggcactgctccaggatccgatgattttggtcatggacgaagccacgtctgcggtagatgaagccaccgagcgtgaggtcattgaagccatcgaccgattgttttccgagcgcacgcgaatcttgatcagtcatcgcccttcaacgctggccaacgcagatctacattttgagctgctcgacggcgtgttgaagcccaaatcggtccaatacgaaatctaatctgaggat

SEQ ID NO: 37765 - DNA, 1440 bp, Pseudomonas fluorescens
gaagagctctggagtaactgtgttttcgacggtacttggataaatatttctcctgacgtcagtcaggtcatagagcccgcaacgggggcgtcgttgggttgcatcggcatggctaacgcggcctcggtttcagcggccgctcgcgtggctaatgaagtacaagcggattggttcctcaccgcttatgaagaacgtgctgcaatcatgcgtaaagcggcggaaatcgcagagctgcattttggcgatatcgtcgagtggttggttagagaaagcggttcgacccagttaaaagcggcgtttgaaacccgtgtaacgataaaagcgttgcaggaaagcgccatgatgcctgggaaaagccagggtgacgttctgcccaatgctccgggatccggtcgcctcagcctggccaggcgtcgtccattaggggttgtagggatcatctcacctttcaattttccgctttacctcgctatgcgctcggtcgcgcctgctttggccgtcggtaacagtgtcgtgctgaaacccgatccccgaaccgccgttagcggcgggctggtcattgggcgcttgtttgagcttgctgggctgccgaaaggcgttctccacgtcttgccgggtgggggcgatgcgggcgcagcgctggttgagtcgccagatgtggcgatgatccaatttaccggatcgaccgccgcaggtcgcaaagtcggcgaagcggctggccgcaatctaaagaaggtgtcactggaattaggcggtaagaattcgttgatcattttggacgatgcgaatcttgacctggcagtcgccaacgccatctgggggacgtttttgcaccaagggcaaatttgcatggctactgggcgtattctcgttcagcgcagcctgtacccagcctttctcaaagcactgactgccaaagtgggcaagctctcggtgggtgatcccgccacgacaaaggtctcgctcgggccgcttatcaatgcacaccagcgcgatcaagttgccaagattgtccgcgaggctcagcaggccggtgcaaaactcgaagtgggtgggcgttacgaagagcttttcttccagccgacggtgctcagcgatgtcaaaccggacaatcccgcgttccgtgaagagatttttggacctgtcgccgttgtcgtgccctttaactctgacgaggaagcaatacgactcgctaacgacacggaatacggcttggctgccggcatcatcagttcgaacattggccgtgcgatgaaggtcggtgacaagcttcggactggaatgcttcatatcaatgaccagacagtcaatgacgaagtggtgaacccattcggtggctggggcgcatctggaaatggcacgagcgtgggaggggcggcgaactgggaagagttcactcaatggcaatggttgaccatcaaggatgaggccacgccttat

SEQ ID NO: 37766 - DNA, 759 bp, Pseudomonas fluorescens
atgaaaaacagattcgaaaacaaggttgccttggtgactggcgcggctcaaggcatcggtcgacgcgtgtgcgagcaactgcgggccgagggcgcgcgggttgtagcggtggatcgatcggagctggtgcatgagctcaaacaagacgacgtattgaccctcgtcgccgatctggaaatgcataccgaatgcatgtcggtgatggcagccgccgtcgaggctttcggcagcctgcacatattgatcaacaacgtgggcgggactatctggaccaaaccgttcgagcgttacgaggccgcgcaaatcgagtcggaagtgcgtcggtcgttgttcccgaccctctggtgctgtcacgcggcgttgccctacatgctcgaacaagggcacggcgcgatcgtcaacgtctcgtcaatcgcgacacggggcgtcaaccgtgttccgtatggcgcagccaaaggtggcgttaacgccttgaccgcctgcttggcgttcgaaaatgccgaacgtggtatccgggtcaatgcgatcgcgaccgggggcaccgaggcgccaccgcgacgtatcccccgcaacaccgcgcagccaaccgaagaagagaaggtttggtatcagcaaatcgtcgaccagacgattcaaagcagtttgatgaagcgttacggaacgattgacgaacaggtcgccgcgatcttgttcctggcctcggatgacgcgtcctatatcactggcgtaaccctgccagtcagtggcggtgacctcggc

SEQ ID NO: 37767 - DNA, 969 bp, Pseudomonas fluorescens
atgttcaaaggcattttgatcgacaaagacgacagcggttatcgcgccaacctgcaagagatcagtgatgagcaactgccggacggcgatgtgacggttcgggtcgcgtacagcacgctgaacttcaaggacggcctggcgatcaccggcagcagcccggtggtgcgcaagtttccgatggtgccggggatcgatctggcgggcaccgtcgaagtcagctcgcacccggattacaaggttggcgatgccgtgctgctcaatggctggggcgtcggtgaaagccactgcggcggactggcgcagaaggcgcgtctgaacggtgactggctgattccgctgcccaaggcattcaccgccgcgcaagccatggccatcggcacggccggctatacggcgatgctgtgcgtcatggcgctggagcgcaacggcgtgaccccgcaacagggcgaagtgctggtgaccggtgccaacggtggcgtcggcagttttgccatcgcattgctgagcaagctgggctaccgcgtggtcgcttcgactggtcgggtgtcggaacacgaatacctgaaacaactgggtgccagtgaaattattgatcgcgccaccctgtccgaacccggcaagccgctggccaaggagcgctgggcgggcgttatcgattcggtcggcagccacacgctcgccaatgcctgtgccagcacccgggccgaaggcaccgtggctgcgtgcggtctggctcagggcatggatttcccggcgtctgtggcgccgttcattctgcgtggcgtgacgctggccggaatcaacagcgtgacccagcccaaggcccgccgcatcgaggcttgggatcgtctgacaaaggatctggatttcgcgctgttgccgctgatcagccatgaaatcggcctcggcgaagccctcgaagcggccccgaagttgctggcggggcaactccgggggcgagttgtagtt

SEQ ID NO: 37768 - DNA, 837 bp, Pseudomonas fluorescens
atgatcaagaaatgcttgttcccagcagccggttacggtactcgcttcctcccagcgactaaggccatgcccaaagaaatgctgccggtggtaaacaagccactgatccagtacggcgtcgaagaagctctggatgctggcctgaacgaaatctccatcgtgaccggccgtggcaagcgcgccctggaagaccacttcgatatcagctatgagctggaaaaccagatcaaaggcaccgacaaggaaaaatacctggtcggtatccgcaagctgctggacgagtgctcgttctcctacacccgtcagaccgaaatgaaaggcctgggccacgcgatcctgaccggccgcccgctgatcggtgacgagccgttcgccgtggtgctggcggacgacctgtgcgtcaaccttgaaggcgacggcgtgctgacccagatggtcaagctgtacaagcagttccgctgctcgatcattgccatccaggaagtcgatccgcaggaaaccagcaagtacggcgtgatcgctggcgaaatgatccgcgacgacatctaccgcgtacacagcatggtcgagaagccaaagccggaagacgcaccgtcgaacctggcgatcatcggccgttacatcctgaccccggacatcttcgacctgatcgaacagaccgagccaggcaagggaggtgaaatccagatcaccgacgccctgatgaagcaagcccagaacggctgcgtgatggcctacaagttcaagggcaagcgtttcgactgcggtggtgctgaaggctacatcgaagcaaccaacttctgcttcgagaacttctacaagactggcaaggcttac

SEQ ID NO: 37769 - DNA, 1074 bp, Pseudomonas fluorescens
atggcagatttatacgaaaacccaatgggcctgatgggcttcgagttcatcgagttcgcatcgcccacacctggcaccctggagccgatcttcgagatcatgggcttcaccaaggtcgcgacacaccgttccaagaacgtgcacctgtaccgccagggcgcgatcaacctgatcctcaacaacgaaccccacagcgtggcctcgtacttcgcggccgagcacggtccatccgtttgcggcatggcgttccgggtcaaggattcgcagaaggcttacaaacgcgcgttggaactcggtgcccagccaatccacatcgaaaccggcccgatggaactgaacctgccggcgatcaaaggcattggcggcgcgccgctgtacctgatcgaccgttttggtgaaggcagctcgatctatgacatcgacttcgtgttcctcgaaggcgttgaccgcaacccggtcggtgccggcctgaagatcatcgaccacctgacccacaacgtgtatcgcggtcgcatggcctactgggcgaacttctacgagaaactgttcaacttccgcgaaatccgttacttcgatatcaagggcgaatacaccggcctgacctcgaaagcgatgaccgcgccggacggcatgatccgcatcccgctcaacgaggaatcatcgaagggcgccgggcagatcgaagagttcctgatgcagttcaatggcgaaggcatccagcacgtggcgttcctcactgacgacctggtcaagacctgggatcagctgaagaagatcggcatgcgcttcatgaccgcgccgccggatacctactacgaaatgctcgaaggccgcctgccgaaccacggcgagccggtcgatcagttgcaatcgcgcggcatcctgctggatggtgcgtcggataaggaagacaagcgtctgctgctgcagatcttctcggaaaccctgatggggccggtgttcttcgaattcatccagcgcaaaggcgacgatggtttcggcgaaggcaacttcaaggctctgttcgaatcgatcgagcgtgaccaggtgcgtcgtggcgtactcgctaccgag

SEQ ID NO: 37770 - DNA, 921 bp, Pseudomonas fluorescens
atgtctgagatcgatattctgtcgttcggcgaaaccatggccatgtttgtcgccgaacagagcggcgatctggccttcatcgaccagttccacaaacggattgccggggccgacagcaacgtggccatcggactttcccgacttggtttcaaggtcgcgtggttgagccgtgtcggtgccgattcgctgggacgatttgtcgttgagaccctggcccgcgaagggctggattgcagtcacgttgaagtcgacccggcgcacccgaccggtttccagctcaagtcgcgcaacgatgacggcaacgatccgacggtcgagtacttccgccgtggctcggcggccagtcatctgtcgccgcagtcgatcaccccgaaactgctaggcgcccggcatctgcacgccactggtattccgccggcgctgtccgcgtcggcccgggaaatgtcccgtgaactgatgacccgcatgcgcaacgccgggcgcagcgtgtcgttcgacccgaacctgcgcccgagcctgtgggccggcgagcgggagatgatccgcgagatcaaccgcctcgccgccctcgcccactgggtgttgcccgggttgagcgaaggccggctgctgaccgggtttgaagatccggcggatatcgccgcgttctatctcgatcagggtgccgaagccgtggcgatcaaactcgggccgcagggcgcctactaccgcacgcatctggatcaggggtttgtcgccggggtgccggtcgagactgtggtcgatacggtcggcgccggcgatggatttgcggtcgggatgatcagtgccctgctggagcatcagagctttcccgaggcggtcagacgtgccaactggattggcagtcgggcggtgcagagccggggtgacatggagggtttgccgacccgttccgaacta

SEQ ID NO: 37771 - DNA, 1623 bp, Pseudomonas fluorescens
atgcgcgattacttgtctgccaccgcacagtttgattatcagcacaccgtggacgccgcactcagcggcacgctcgaggcgctcaacgcctgcgtcgaatgttgtgaccggcacgcgctgccggggcgcattgcgctgttctgggaaggccgcgacggcgccagtgcgacgtacaccttcagcgacctgcaggacaaagccgcgcgtttcgccaatttccttctcgcccaaggcgtgcagaagggcgacaaggtcgccggcctgctgccgcgcaatatcgaattgctgatcaccgtgttcgccacctggcgcatcggcgcggtgtatcaaccgctgttcaccgcgttcggccccaaggccctcgaacatcgcctgaacagctccggcgccaaggttgtagtcactgatgcagtcaatcggccaaaactcagcgaagtcgccgattgcccgacgctggtcactgtcggtggtccgaaaggccagggcatcgtccgtggcgatttcagtttctgggccgagctgcccaaccattccagtgtctgcgagccgctgatgctgaccggcgaagacccgttcctgctgatgttcacctcgggtactaccggcccgtcgaaggcgctgtcggtgccgctcaaggccatcgtcgcgttccagagctacacccgcgatgccgtggatctgcgcccggaagatgcgttctggaacgttgccgatccgggctgggcctacggcatttatttcggcgtcaccggcccgttgtcgatgggccatccgatcacgttctacgatggcccgttcaccctcgaaagcacctgccgggtgatcaacaagtacgggatcaccaacctcaccggttcgcccaccgcgtatcgcctgctgattgccggtggcgatgagttcgccaagtcgatcaagggcaagctgcgcatcgtcagcagcgccggcgagccgttgaatccggaagtgatccgctggttcgccgacaacctcggcgtggccattcacgaccactacggccaaaccgaactgggcatggtcctgtgcaaccaccacggcctcgaacacccgatccacctcggcgccgccggtttcgcctcgccgggccatcgcatcgtggtgcttgacgagcagaacaacgaactcggcgtcggccagcccggcatcctcgccatcgaccgcacacagtcgccgatgtgctggttcgccggctatgaaggcgtgccgaccaaggccttcgtcggcgattactacctgagcggcgacaccgtcgagtggaacccggacggcagcatcagcttcgtcggccgcagcgatgacgtgatcaccacttccggctatcgcgtcggcccgttcgacgtggagagcgcactgatcgaacacccggccgttgtcgaagccgccgtggtcggcaagcccgatcctgagcgcaccgaactggtcaaagccttcgtcgtgctcaacccgcaataccgcgccgagcctgcgctggccgaagaactgcggcaacacgtgcgcaaacgtctggccgcgcattcgtacccccgtgaaatcgaatttgtcagcgagttgccgaaaaccccgagcggcaaattgcagcgctttatcttgcgcaaccaggaaatc

SEQ ID NO: 37772 - DNA, 759 bp, Pseudomonas fluorescens
atgcagatcgagaacaaggtttttatcgtcaccggcggtgcgtccgggctgggtgcagccaccgctgagctgttggttgccgccggcgccaaagtgatgctggtggacatgaacgccgaagccgtcgccgctcaggcccagcgcctcggcgcgcaaagcgtggtggccgacatcagcaacgaagccgccgccgaagccgccgtgcaggcgaccgttaaagccttcggcagcctcaacgggctggtgaactgcgccggcatcgttcgcggcgagaagattcttggcaagaacggcccgcacgccttgtccagcttcgcccaggtgatcaacgtcaacctgatcggcagtttcaacatgctgcgtctggcagccgctgcgattgccgaaagcgaagccaacgccgacggcgagcgtggtgtgatcatcaacaccgcgtcggttgcggcgttcgacggccagatcggccaggccgcgtattcggcgtccaaaggcgcgatcgccagcctgactctgcctgccgctcgtgaactggcgcgcttcggcatccgcgtgatgaccatcgccccgggcattttcgaaaccccgatgatggccggcatgaccccggaagtgcgcgactcgctggccgccggcgtaccgttcccgccgcgtctgggcaaacctgccgagtacgccgcgctggtgcggcatatcattgaaaacagcatgctcaacggcgaggtgatccgtctcgacggtgccttgcgcatggctgccaag

SEQ ID NO: 37773 - DNA, 1161 bp, Pseudomonas fluorescens
attgtcatcgtcagcgccgtccgcaccccgatgggcggtttccagggcgaactgaaaagcctgaccgcgccgcaactgggcgccgctgcaatcaaggcggcggttgagcgtgccggtgtggccgccgatgcggtcgatgaagtgttgttcggctgcgtgttgccggccggtcttggtcaggcgcctgcacgtcaggctgcactgggcgccgggctggacaagtccacccgctgcaccacggtcaacaagatgtgcggttcgggcatggaaaccgccattctggcccacgacatgctgctggctggcagcgccgatgtggtgatcgccggcggcatggaaagcatgtccaacgcgccgtatctgctggatcgcgcccgtgccggttaccgcatgggccacggccgggtgctggattcgatgttcctcgacggcctcgaagacgcctatgacaagggccgcctgatgggcaccttcgccgaggattgcgccgaaaccaacgacttcagccgtgaagcgcaggacgcctttgccatcgcctcgaccacccgcgcccagcaggcgatcaaggacggcagcttcaaggacgaaatcgttccgctgaccgtgaccgtcggcaaggaacaggttgtgatcagcaacgatgagcagccaccaaaagccaagctggacaagattgcttcgcttaaaccggcgttccgcgaaggcggcaccgtgaccgctgccaactccagctcaatctctgacggcgccgctgcgctggtgctgatgcgtcagtcgcaagcacaaaagcagggtctgaagccgctggcggtgattcacggacacgcggcgtttgccgacaccccgggcctgttcccggtggcaccgattggcgcgatcaagaagctgatgaagaaaaccggctggtcgctggatcaggtcgatctgttcgaagtcaacgaagccttcgccgtggtcggcatggcggcgatgacccacctggaaatccctcacgacaagctcaacatccatggcggcgcctgcgccctcggtcacccgatcggtgcgtccggcgcgcggattctggtgactttgctctcggccctgcgccagaaaggcctgaaacgcggcgtcgcggcgatctgcatcggcggcggcgaagccacggcgatggctgtcgag

SEQ ID NO: 37774 - DNA, 1110 bp, Pseudomonas fluorescens
gaccaacaacaaatccgcgacatggcccggcagtttgccgaggaacggctcaaaccgtttgccgccgagtgggatcgcgagcaccgctttccgaaagaggccatcggcgaaatggccgggctgggcttcttcggcatgctggtgccggagcagtggggcggttgcgacaccggttacctggcctacgccatggccctggaagaaatcgctgccggcgacggcgcctgctcgacgatcatgagcgtgcacaactcggtgggttgcgtgccgatcctcaagttcggcaacgacgaccagcgcgaacgcttcctcaagccgctggccagcggcgagatgctcggtgctttcgcgttgaccgaacctcaggccggttccgatgccagcagcctgaaaacccgcgcgcggctggaaggcgatcactacgtgctcaacggctgcaaacagttcatcacttccgggcagaacgccgggatcgtgatcgtgtttgccgtgactgatccgagtgccggcaagcgcgggatcagcgcgttcatcgtgccgaccgactcgccgggctacaaagtcgcacgcgtcgaagacaagctcggccagcacgcctcggacacctgccagattctgttcgaagacgtgaaagtgccggtggccaaccggttgggcgaggagggtgagggctacaagatcgctctggccaacctcgaaggcggccgtgtcggtatcgcttcgcaatcggtgggcatggcccgcgccgcgttcgaagcggcacgcgattacgcccgcgaacgcgacaccttcggcaagccgatcatcgagcatcaggccgtggcgttccgcctggcggacatggcgacccagatcgccgtggcgcggcagatggtgcattacgccgccgccctgcgcgacagcggtcagccagcactggtcgaggcgtcgatggccaaactgttcgcctcggaaatggccgagaaggtctgctccatggccttgcaaaccctcggcggttacggttacctcaacgacttcccgctggagcgcatctaccgcgacgtgcgggtctgccagatctacgaaggcaccagcgacatacagcgcatggtcatttcgcgcaatctt

SEQ ID NO: 37775 - DNA, 1131 bp, Pseudomonas fluorescens
cacgatctcgaattgactgaagaccaggtaatgatccgcgacatggcccgggactttgcgcgcggcgaaatcgcgccccacgcgcaagcctgggaaaaggccggctggatcgatgacggtctggtggcaaagatgggcgaactcggtctgctgggcatggtggtgccggaggaatggggcggcacctacgtcgactacgtggcttatgcgcttgcggtggaagagatttccgccggtgacggcgccaccggcgcgttcatgagcattcacaactcggtgggctgcgggccggtgctgaactacggcagcgaagaacagaagcagacctggctggcggatctggccagcggtgcagtgatcggctgcttctgcctgaccgagccccaggccggctccgaagcacacaacctgcgcacccgcgccgaactgcgcgacgggcaatgggtaatcaacggcgccaagcaatttgtcagcaatggcaagcgggcgaaactggcgatcgtgtttgcggtgaccgatccggatctgggcaagcgtggcatctcggcgtttcttgtgccgaccgacatgccgggcttcatcgtcgatcgcaccgaacacaagatgggcattcgcgcctccgacacctgcgcggtgacgctgaacaattgcagcattcccgaagccaatctgctgggtgaacgcggtaaaggtctggcgattgccctttccaacctggaaggcggacgtatcggtatcgccgcgcaagcattgggcatcgcccgtgcggcgtttgaagctgcactgggttatgcccgtgatcgagtgcagttcggcaaggcgattgtcgagcatcagagcatcgccaacctgctggcggacatgcagatgcagatcaacgcggcgcgcttgatgatcctgcacgcggcgcggctgcgtacggcgggtaaaccgtgtctgtcggaggcttcacaggccaagctgtttgcgtcggaaatggccgagaaggtgtgctcgtcagcgattcagattcatggcgggtatgggtatctggaggattacccggttgagaagtactaccgggatgcgcggattacccagatttacgagggatcgagcgagatacagcggatggtgattgctcgtgagctg

SEQ ID NO: 37776 - DNA, 1224 bp, Pseudomonas fluorescens
gacccattgctgaagttgctgcaaaagcccctgttcgaccccgaaaagcgccatcgcgtgtctctgcgcgaatacatggatctgaatatcgatcggatgcgcgcaatcatcggcaacgggctcatgaccaatgccatgtggctgagccaaccccgtcagtctgaattccggttgatgcttgaacgtgcagcattgatcggtgccgtggattactccctgcttgcctgcatcgtcgaccacttcattgccggcgacgcattttttgcacacggcagtcagcaccagattgcgcagtaccaccaggaaatctgccaactgaaagcggtttacgcctttggttgcacggagatcgccagcggctccgatgtggctaacctgcaaaccacgatcaactacgacccacacaaacattgcctgattctgaactcacccacgccgcagtcctgcaagttctggatcggcaacgcattgcacgcggcggtggtggtcatggtgctgggacgtctgatcgtcaagggtgtggatgagggcttgcactggtttcgggtacgcattcgcgagcaagagaatggcccgctcctgccaggtgtcaggatcaccacctgcgatcccaagggagggattcacgccaatcaagttgccggcatccgtttttgcaacatgaagctgccactcgacgcactgatgcaacgctatgccaggttttctgcgcaaggcgttttcagcagtgagatcccgccaaaggagcgcctgaaaagcgctatgcagacattcatccaggagcgcctgttcctcatcgctggcgcccgtggtgccgccagcatgtgtgtttatctggcgtaccgtttcgcttgccatcgcctggtcaaggggaacgagggaagccagtctctcctgaccaaggcacttttccgacaacggctgtatgccgaacaacttaaggtattggccctgaagttgctggagcaggcggttctgtcgcggttcgaagcgtgctggcatcagccagcacggcgaaaggagctgcatattctcgccgctgtcgtcaaaagtgtcggcacctggctgggtctcgaagtcatgagtgcatgcagggagctttgtggttcgcaaggcttccaccatcacaaccgaattgtcaccttggtcatggatcacggcatcagcaccaccttcgcgggcgataacaacatcctgtgctgtcaggttgcacgggacgccatc

SEQ ID NO: 37777 - DNA, 876 bp, Pseudomonas fluorescens
gcgaacgtacgtgtactcgatggtggcatggggcgcgagttgaagcgaatcggcgcgccgttccgtcaaccggaatggtcggccctcgcgctgatcgaagcgcctgagtatgtactgcaggcgcatcaggcgttcgtgacagcgggcgcccggatcatcaccaccaacagctatgcggtggtgccttttcatattggcgacgagcgatttgccgagcagggaagagcgctggctgagcgcgccggacgcttggcgcggcaggccgccggcgaaagtaccgatccggtcaccgtggccgggtcgttgccgccggcactggggtcgtaccggccggatctgttcgatcatcagggttcagtagctattcaccgcgaactgattgccggattgcaggcgcacgtcgatgtgtggctggccgaaacgcacagctccattgctgaagtgcgtgcggtggtcgaagccctcggaacggatcccgcgccactctgggtgtcattcacgctgttggacgaagagggccgggaaccgcgattacgctcaaacgaggccgttgccgatgcggttcgcgtggcggctgagctgggggccaaggcggtgctcttcaattgcagccagccggaagtgatggccgcggccttgattgaggcacgcgctgtgattgaaaacctggatcatcctgtcgaactgggggtttatgccaatgctttcccccctgtcagtgccaaagccgaggccaatagcgatttgttggaaattcggcgcgatctgggccccgagtcctatctggactggtcgaaatcatgggttgccgcaggggccagcattgtcggcggatgctgtgggatcggcccggagcatatcgcccagttgcatttg

SEQ ID NO: 37778 - DNA, 429 bp, Pseudomonas fluorescens
gagcaggcgacattcggtgccggctgtttctggggggcggaagcctcattccgggcattgccgggtgtgctcgacacccgtgtcgggttcgcgcggtcagacttgggcgacgccaccctgatcgaagtcgtgcaagtcgacttcgacccccgactcatttcctacagccgtctcgtcgagcacttctggacactgcacgatccaacgtcagtcgaccggcagggtgcggacgtcggggcgaaataccgttccgcgctgtttttcaacagtgccgagcagtcccgactggcacttgtcgccaggcagcagctggacgccagtggccagttgggcaagccagtggctacggtgatcctgccactgggtgagtttcaaaaggcaaatgaagaacatcagcgctaccttgaaaagcatggtggcagcgcctgt

SEQ ID NO: 37779 - DNA, 1218 bp, Pseudomonas fluorescens
aagtcccgctggtatagccagctgtatgtgcaggtgctgatcggtatcgtgatcggtgcagcaatcggttacttcgtgcctgatattggagccaagctccaacccttcgccgatggtttcatcaagctgataaaaatgctgctggcccccattatcttcggtacggtcgtcgtcggtatcgcgaaaatgggcagtatcaaggaggtcggacggattggcgtaaaagcgctgatctactttgaaattctatcgactatcgccttggtcgtaggccttatcgtggtgaacatcgtcaagcctggcgtcgggatgaacattaacgtcaacgcgctcgatggaaatgctatcagcaagtacagccaggccgcgagtgaacaaggcggtacaattgatttcttccttaatatcattccccacacgttcctcggcgcattctccaacggcgtcatgctgcaggtcattctgctttcggtcttgatgggagttgccctggttcagatgggcgaaaccagcaagccgctgatcaacactattgatttgttcctgcaaggcctgttcaagatcgttgcaatggtcatgcgcttggcgccgattggtgcgggtgcaggtatggcgttcactatcggcaagtacgggattggcaccttgctgtcactcggtcagttgctgatcgcgctctacattacaaccttgattttcattgtggtggtgctaggcacggtggccagatggtcaggcatgccactcatgcagtttctccgttatttcaaggacgaaattctcatcactcttggcacctgctcaaccgaagcagtgctgccacgcatgatggtgaaacttgaaaaacttggctgcaagaaatctgtagtgggcatggtgctgccaacgggatacaccttcaacgcagacggcacctgcatctacctcaccatggccgcgatcttcatcgcccaggcgaccaacacgccactgaccttcgttgatcagatgatcctgctaggcgtattcctgctgacatccaaagggtcagctggtgtcgcgggtgcggggtttgtcacgctggctgcaacactcacgaccatccactccattcctctggtcggactcgttttgcttttgggcattgatcgtttcttgaacgaagcgcgggccgtgaccaatctgatcggcaatggcatcggcaccatcgccattgccaagtgggacaactcgttcgat

SEQ ID NO: 37780 - DNA, 723 bp, Pseudomonas fluorescens
atgaacagcactggcaacacgattctggttacaggcggcacctcaggcataggcctcgggcttgcgctacggcttcataaagcgggcaacaacgtcatcatcgcgggacgtcgcaaggctctgctcgacaaaatcgtgtcggaaaatcctggcattgaatcagtattgctggacgtttctgatgctcattccatccagcgcaccagcgaagcgcttgcgatcagccatccaaatcttaacgttctcatcaacaacgcagggatcatgcattgggaggatctgactgatccgggatacttgagtacagcggaagatatcgtgacaacgaacctgctaggcacgattcgtatggtgtatgcgtttactccccaactaatcaagcagcctggcgcgacagtgatcaatgtcagttcatctttggcatttgtcccgctgccagccacgcccacctacagcgcaaccaaagcggcagttcactcgttcactcaaagtcttcgagtgcagctggaagcctcgccagttgaggttatcgaacttgcgccaccgggtgtgcgtaccacattgctcggccaggaaaacgacgagcatgcgatgccgttggaggagtttttggatgaagtcttcgaactgctaaagatttctcccactccacctgaactcgtcgttgagcgggctaagcccctgcggtttgctgaggcaagtgggtcacatgatgacgtgctg

SEQ ID NO: 37781 - DNA, 2067 bp, Pseudomonas fluorescens
cgcgtcgtagatggcctggcgctgatcggtcttgaccgtgcgccggtcaacgcactcgaccagaccctacgtgcagccctcattgatgcctgtgagcgtgccgctacggacatagcggtgggtgccgtcattctctatggggtgcagggactgttcagtgctggtaccgacatcaaagaattcgggaccgaagcgtgcttcgctgaacctgacttgcctggcatcctgactcgcttgagcgcgcttcataaaccactgattgcggcgatcggtacgtttgcgttaggaggagggctagagctggccctggcctgcggataccggattggtgcgccagatgcacggctagggttgtcggaaatcaatcttggtctgatgcctggcgccggcggtacgcaacgcttgcccaggctgataggcgccgaatcggctttgaacctcattctttcaggtgagcagatcgatgccgagcgtgctcgaatgctcggcattcttgaccgtatctcctccagcaccgaacagttgctggaagaggcgcgcgcttatgccaatgagttgatcgaatgttgtgctcctgcgcggccagccgaagcatggccaaaccccgccgaggacttgcccgatgatttcctggcgcgttatcgcgtggagcatgagccgcgctggaaaagtcgactggcgcccaggttggtgctttctgcgctggaggccgcctgcctgttgccgttggaagagggactggtgcgggaattgacgctgttcaagcaggctgaagcatcacgtcagtcgaaagcattgcggcatgttttcttcgcagaacaagacgcgcggcgaacgccccggatcgatacggctgatccgtcgcgcaagatcaacaaggttgccgtgatcggtgcaggcaccttgggtggaggcatcgcgatgagctttgccgatgtagggattcccgttgcgctgatggatcttgatgggcgcacgctggatcgcggtctcaaacgtgttcgtgaaaactatcaactcagcgtcaagcgcggaaaactcagtgccgtgcaaatgcagcagcggatggaactgctgtttggcacgctcgactacgcagacctttcagatgccgacctgatcattgaggcggtatgcgaaaagatggagagcaagcatcaggtgttcctcgctctggagagcgtgtgtaagccaggtgccattcttgcgaccaatacgtcgtcgctggatatcgatgcgctcgcgaagatggtctctcgtccgcaggatgtcattggcatgcatttctttagtccggccaacgtcatgcgattggtggaaattgtgctttgtcagacgacagcgccggacgtcgtaaccgctgtcatggacatcgccagacgtatcggcaaacttccggtcatctccggtaacagcgccggctccatcggtaatcgcatgctcgaaccctatgcccgcgaagctcaccgtctggtactggagggggcgacgccggtccaggttgatgcagtgctgaccagtctggatttgaatatgggcgtattcagcatgctggatctggcaggtatcgatgtgagctttctaatgcgcgacgccaatcgtgaagccatcgcccatgaccagagctactgctgccttgccgaggaactgtatgccttgggacggtacgggcaaaagaccggacgtggcttttacctctacgagggacgtagtccaagggaagaccgggaagtcatcatgctggcagagcagcttgcccgtgaacacaacgttacgcgtcgcaacatcgaagatctggaaattcacgatcgctgcctgtttgtaatgatcaacgaaggcattcgcttgctggacgaaggtattgcgctgcgtgccagcgacatcgatctggtgtggatcaacggctatggctttcccgcgcatctcggaggccccatgcattacgccgagcagttgggcctggaaacggtgctcagccgcatccatcactatcgcagcgcgcttggcgaatacggtgagatgtggtttcgcccagcggcgcttctggaacgtctggtagccgccggc

SEQ ID NO: 37782 - DNA, 741 bp, Pseudomonas fluorescens
cttgccggccgaactgtattgatcaccggcgcctccagcggcattggagctcacctggcaagggtcgctgggcatgccggcgcccgggttgtgctgactgcacgacgcgtcgaaagactcgcacaggtggcaaaggacattgaatgggattgcgggcaagcgctgtccgtcgaactcgatgtgactgaccggaacagtgtcgaagcggcgttcgatgcggccgaagcacattttggcgtggttgacgtggtactcaacaacgcaggtatcggtaacggccagcgtccactcgaaatcagtgaagagcagtggcgtgagatgctttcaaccaatctggatggcgtctggcgtgtcgcccaggttgctgcacaaaggctggcaaaggccggacgtaagggcagcatcgtcaacgtggcctcgatactcggactgcgcgttagcaccggttacagccattactgcgctgcaaaagccggggtggttcagctgaccaagtcactggcgctggagctggcgcggtacaacatcagggtcaacgccatcgcgccaggttatttcaagactgaaatgaacgaagctttttttgagggtgacaagggcaacagctacatccgcgatagggtgcccatgcgtcgactgggtcagttacacgaactggccggtccctttttgctgttagcgagtgacgccggtgcattcatgactggcagcgtactgaccgtggatggaggccatctggtc

SEQ ID NO: 37783 - DNA, 1167 bp, Pseudomonas fluorescens
ctgacagaagaggaggctgcaatacaggcctccgtccaccgcttcgccaaagaggtgttacgcccgctgggtcgagagctggaccggatgaccccggaagaagtcgttgccccgggctcgccttactattcgttgttcggcgaattcgccaagctcggtcttgacccggcactgttggcgcagttaccgccggaaatggcagtgcggatcgaatctctgataggcgaagaactcggctggggcgatgcaggcctggctgtctcgctgggttgcgccgacttccctctgcaaatggccatcgccgctggcaatgccgagttggtcgaactctgccaaggccggatcggctgctggatggccactcaacctgatcgtggcagcgacaaccagatcttcgacatggcgcgagactggccggcaggtaagctcggcaatatcggcaatctgaccgctaaagtggtcggcgatgaagtcatcctcaatggccaaagctccgcgtgggtctccaacggagccattgcacaggttgcactgggcttgatgtgcgctgattacggcgacggtttctacgatgagaacggccggccgcacggtattgcgctgattatccccctcgacctcaaaggtgtgtccaaaggcaagcccctggacaagatcgggcagcgttccttgccccaaggcgaaatctacttcgacagtgtacgagtgccacgtcgcttcgctattgccgagcgcgaccagtactacggtgctgtcagctcctcctggtccttcgccggcacccacatgagtcaggtgttcaccggtgtcgcacgtgccgccttcgagatggcgctgcagtactgccatgagcgccgccagggcggtcatccattgatcgatcaccagatgacccgtctgcgcctcggcgaaatgttgcgtcgggtcgaggcagcgcgtgcggttgcccgacgttcgttgagcttcgcgcgcctgtcgccgcaaacccacccgtacgccacagcctccgccaaggtcacggtgaccgaagaggcaatggccgttgtgcaagaggctttccgcctgttcggcggcaatggcaccacgcgcgaatacccgatcgaaaaactgctgcgcgacacccagtcgtcattgatcgaggacggcgaaaaccgggtcctgaccatg

SEQ ID NO: 37784 - DNA, 1542 bp, Pseudomonas fluorescens
aactgtgaagtgactgacatggcgattattgatttctttgaccgtggctggcggatcaatccgcatggcgcggcgtatatccaggacgatcgggtgttcacttttaccgaagtccgcaacctgtcatgccggatcgccaacgcactgttggcggccggtttgcccagcggcaccaagggcgccatctggtctgccaatgatgcagtggcgtggacctgcaccttggggttatggcgcgccaacctttgctggattcctgttggtgcacgcaacagcgccgaagagaaccgtcacgtgctcgacgcattcgactgcgaagtgctgtttttccagaaagagttcgcgccgatcatcgacgcgttgcgtcctggcctgccgaaaattcgtctgtggatctgtatcgacgagcacctgccgggggcaccgtcgctcaagtcctggatcgatggtcagccggtcacggcaccggaggtcgagtatcaactggacgatgtcgtggcactctcgccaaccggcggcaccaccgggctgccgaagggggtaatgaacactcatcgcagcatccagacgttctgcgcgcacttcatgatcaatttcccttacggggatgaccatccgccagtcaacctggcggcggcgccaatgacccacaccgctggcacgctgtcgctgccgtgcacctcccggggcggtacggttgtgatcattaccaaaccggatccggctctgatgctggcaatgatcccgaagtacaaggtcaccgaaacctttttgccgcctaccgtgatttatcgactgctggacgtgccggatctggcgcagaaggtcgatttcagctcgctgaagtatttcctgtacggcgcggcgccgatgtcggtggacaaactcaagcaagccatcgagaccttcggcccggtcatggccggtggttacggccagactgaagccccagcctcgatctccaacctgccgcccgccgagcatctgcacggtggacgcctggcatcggacgagcgtctgtcttctgtgggccggcccaatccgctggtgcgcgtggaaatcctcagcgacgccggggacatcctcggccaggggcaaaccggtgagatctgtgtgcgcggcgacctggtaatgaaggggtactacaaggatccgcagaaaactgcagaaaccatcattgatggctggctgcacaccggtgatatcggtcacctcgatgcccacggctacctgcacattaccgaccgcaagaaagacatgatcatttccggtggattcaatgtttatcccagcgaagtcgagcaagtgctgtggagtcatccggcggtgcaggactgcgcggtcatcggtgtgccggatgagcaatggggcgagggcgtgaaagccgtggttgagttgagcgccgggcttaccgtcaccgccgaggagttgatcgagctgtgcaagagccggctcggctcggtcaagtcgccgaaaaccgtggatttcattgatgcattgccgcgcagcccggtcggcaaggtgctgaagaaagatctgcgt

SEQ ID NO: 37785 - DNA, 1188 bp, Pseudomonas fluorescens
atggaacctatttacatcgccggcattgccatgaccgagttcggtcgccacctggaacgcagtctccaggatttagcgctggaagctttgcagggcgcactcgccgactccggcgccttgcgcgctgatatcggtgcggtgttctacgccggcatcaccaacggtcatctgcaaggacaactgtcgattcccgggcaggtgctgtgcagcaagatcggcctcgaaggggtgccggtgtacaacgtcgaaaacgcctgcgcctcgggcagtacagcggttcatctggcagtgcagagcttgcgctcaggggctaccgacgtggccctggcgttgggcgcggagaaaatgaacgtgccggacaagtcgcgggcactggccctgttcgaaaccggttgggacgtttccactgccgaagagaactacgcgacgctggtgaaaatgggggagggcatcattgttccgccaggctcggaatctgatcgtccgtacagtaaattcatggccatttatgctgccatgtgtcgctggcatatgaagacctatggcaccactcaacggcagattgcggcggtgtgtgccaagaaccatcaacactcggtgcacaacccctattcgcaatttcgcaagaccttcagcatcgaagaagttctggcggcgcctccaattacctatccgatcacattgcccatgtgcgcgccgctgtccgacggtgcggccgccgcgatcctttgcaccgaggcgggactgaaacgcattggtgccgatccaaaacgttgtgtgcgaatcgccgccagcgtgatccgcagcttcaccctgcgcgggctcgacgagccgcacaagcacgtcagcctgttggcggcgcgtgaagcctacgaaatcgccggcctcggcccgcaggacatgcacgtggccgaggtacacgacgcctcggcaatgggggaaatcatccagtcggaaaatctcggacttgcaccgctgggagagggtggggtttgtgcagaacggggagatttcactctaggtggccgtcttccgatcaatacctccggcggcctggaatccaaaggtcatccacttggcgcgacggggatcgggcagttgtacgagttggtcacccaattgcgcggggaggccgggccgcgtcaagtccacggcgcgcggcatgccatccaggaaaacggtggcggt

SEQ ID NO: 37786 - DNA, 1302 bp, Pseudomonas fluorescens
gatgtggtgatcatcggtgccggcctggctggtttgaccgccgcccgtgatctgcatctggcaggctgtgagtcgctgctggtgcttgaagcgcgtgatcgtgtcggcggccgcaccctcaatcatgacttgggctccggctacatctccgaagccggaggtcagtggatcggtccaggacaaaccgccgtagcggatctggcccgtgagcttgaggtcggcacctttcccagtttctatgacggggaaaccgtgatcctcgggggcgatggacgtgtcgctgtcgatttgaaaggcaccttcggtaccgacgaaagcgtctcggcaaaactcagcgagctgtcgcgtgatgtgccgtgcggtgcgccatggaaatcccccagggtggccgaactggacaagctctcggcgggcgactggctcgctcagcaaaacatcaagccggaagatcgcgcagggtggaatgccagcttcctcctgacctgcggtgtcacgccggcgaagatgggcttcttgcattttctgtcgatgatcaattcggccggcagcgaatacatgcggctcgattcgatcaaggacagcgcgcaaggcacgcggatcgtcggcggttcacaggttctcagcagcaaaatggcgcaattgttgggcgacagggttcgcttgtcgtgcccagtgcgcaaaattgctgactggaaccgcgacatcgtcagactgcaaacggatcagggcgagatccgcgcccgccgggtgatcatggcgattcatcccgcgctgtgccaacgcctgcaattcgatccaccgctgcccgaagctcgcgccgccctgcagcgggcctggccagcgcactcgccggcacgcaagaccgcaatggtttacccgcggcctttctggcgtgacaagggcttgaacggccacatcattcaggtcggtgggccagtcatctgggcctacgacaactcgccgccaaacggcgaaatcggcgtgatcaatgcattcattctgaatgccgcagcccccaccgaccccgaagccgcgaagcgtgtgcagaccgaaatctatgcacgcgccctgggggacgcagcgcttgagccggtttcctaccacgatcacgactgggcgcatttcgacccgtggaccatcacgtgcgtgtcgccgattcctcccggtttctggtcgacacatggcgaggcactgcgtccgccgtgcggcaatctgttctggtcgggcaccgaaaccgctgacatctgggcaggttacatggacggtgccgtgcgcgccggacgccatagcgccttgcaggtg

SEQ ID NO: 37787 - DNA, 1308 bp, Pseudomonas fluorescens
ctggatgtggtgatcattggcgcagggctttccgggctaacctccgccagagacctccaggccgctggctgcgagtcttttgccgtgcttgaagcccgcgaccgcgtcggtggtcgcacgctgaaccatgatctgggcaatggcgtgatctccgaagccggtggccaatggatcggcccggggcaaacgtcgatcgccgacttggccagacagctcgatgtcgccaccttccccacctactacaagggcaaggcggtgtatctgatggacgaggtcaacatccaggaagatctcagcgacgggccgaattccaatacagaagtcgtcgcaaaactgaacaagctcgccgaaggcgtccccagcaaagcgccgtggaaagccaaggacgcggctgagctggacaaactgtcggtcggccagtggctggccggtcaaggcatcagcaacgtcgacaagatcggcttcaacatgtccgtgagcctcaccttcggtaccacgccggccggcatgggactcctgcattacctggcgatgatcaactcgtcggactgccgccttgaaaagctcgaagggctccagggcggtgcgcaggaatctcgcctggctggcggctcgcaaattctcagtttgaagatggctcaggcgctgggagataaaatccggttggcgtgcccggtgcgcaagattgtcggttgggatcgtgatgtcgtcgagttgcacaccgatcagggcatcatccgcacgcggcaggtaattgctgcgctgagcccggcgttgtgcaatcagatcctcttcgatccgcccctgccgtccgggcgtgccgagctgcagcggcattggccggcccatgcaccgatgcgcaagaccgtgcacgtctatgagcgcccgttctggcgcgaccaaggcctcaacgggcagattgtgccagtggaaggtccgctgatctgggcctttgacaactccccggcggacggcagcctgggtgtgctcagcggcttcgtcaggaccggccaattaccccatgacccgaaaacggcgcaggacatcctgtcggcgatttacgccagcgccatgggcgaacaagccctgcacccgattcagtttcatgatctggactggggcaagatcgacccgtggagtttgagttgtatttcccctatgccccccggtttctggacgcaatggggcgagtacctgacgccggcggtcggtcgcctgatctggtcgggtaccgagactgcggaaatctgggccggggcaatggacggtgcggtccgcgccggacatcgcgcggcaatggaagcgctg

SEQ ID NO: 37788 - DNA, 1701 bp, Pseudomonas fluorescens
acagtgggtgattttctggtcgaacgcctgagccaatggggtgtgacgcgcatttttggttatccgggcgacggtatcaacggcgtcttcggtacgttgagccgggcaggtggcaagatcgaattcgtccaggcgcgtcacgaggaaatggcggcgttcatggcgtccgcccatgccaaattcactggtgaactgggtgtgtgcatcgcgacatccggccccggcgcctcgcacctgatcaccggactgtacgacgctcggctggaccacatgccggtgctggcgattgtcgggcagcaggcgcgcacggcactgggcagccattatcagcaagagctggatctggtctcgatgttcaaggacgtggccggagcatttgtgcaacaggcctcggcgccttcccaggtccggcacttgctggatcgtgcggtgcgcacggcgattggcgaacgccgggtgactgcgttgatcctgccgaacgacctgcaggacttagagtacaaggcgccggcgagggcccacggcactgcgcattcgggggttggttacagcaagccgaaagtgctgccttatgacgcggatctgcaacgtgcggccgatgtgctgaatgcgggagagaaggttgcgattctggtgggtgccggagcgctgcacgccagcgagcaagtgtttgcgattgccgagaaactgggcgccggagtggcaaaggcactgctcggcaaagctgtattaccggacgaattgccttgggtcacaggttgtatcggtctgctcggcaccgaaccgagctacaaattgatgacggagtgcgacaccctgctgatgatcggatcggggtttccttatgccgagttcttgccgaaagaagggcaggcgcgcggggttcagatcgacctgcaaccggacatgctcagtctgcgctatccgatggaggtgaaccttgccggcgatgcggccgagaccctggcggcactggcaccgttgctcgaacacaagccactgcgcaagtggcgtaaaaagatcgaaggctggcgggcgagctgggataaaacgctcgagaagcgcgcgatggccaaggccgacccggttaacccgcaacgggtggtgtatgagttgtccccgcgtctgcccgagcaggccatcatcaccagcgactccggttcttgcgccaactggttcgcccgtgacctgaaaatccgcaagggcatgaagtgctcgctctccggtggcctggcctcgatgggcgccgctgtgccatacgcgatcgcggcgaagttcgctttcccgcaacggccggtgatcgccctggtgggcgatggcgccatgcagatgaacaacatggccgaactgataacggtcgccaaatactggcgacagtgggacagcccgaagtggatctgcgccgtgttcaacaatgaggatctgaatcaggtcacctgggaacagcgcgtgatggagggcgatccgaaattcggtgcctcgcagagtattccggatgtgccataccatttgttcgccatctccatcggcctcaaaggcatttttgtcgatcgggaggaagacgtggccgcagcctgggagcaggcgttagcttccgaagtaccggtcgtcattgaattcaagaccgacccgaatgtgccgccgttgccgccgcatatcaagctggaacaggcaaagaaattcgccagcacgttgctcaag

SEQ ID NO: 37789 - DNA, 756 bp, Pseudomonas fluorescens
atgtcaggtaaattcagtgatcaggttgccgtcgtgaccggcggttccacagggatcgggttttccatcgcgcaagccttgatcgccgagggcgccaaacgcgtttacatcactgcacgggcagcagacaggctggaggcggcagttgccagactcggcgacaaagctgtcgcggtggtttccgatgtctcgcgtcaggctgatctcgacgcgctcaaagcgacaatccaaacgcgcgacgatcggctggacgcagtgttcgcaaatgccgggatctgtgagaaaaatccgctcggagagaccagcgaggctgcttactacgccatgttcgacgtgaacgtgaaaggcgttttcttcagcgttcaaacgcttcttccgttgatgaaagacgcttcgtccatcgtcttgactgcctcaatctgctccagcaacggcatggaaggattgagtctgtacaacgcgtcgaaggcggcggtccgatcgtttgcacgcacgtgggccaatgaactcaaggaccgcaaaatccgcgcaaacgtgttgagccctggcttcacccgcacaccgctgatggacaacgggctgaaaatgagcgagagcgacattgccgcgctacgccagcacgtcgagcaaatcacgccattgggctacatggcgcaacccgaagaaattgccagcgcggcactgtttctcgcctcggacgacgccagatacgtgaacggcgtggagctgatggtcgatggtggtttatcgcaaatc

SEQ ID NO: 37790 - DNA, 747 bp, Pseudomonas fluorescens
atgcttcttcaaggcaaagtcgcgatcatcacaggtgctgcctccgcacgtggtatcggccgcgcgacagctacgaccttcgctcaacatggcgcctgggtggtgattctggatctggacgcatccgctgcccgcgatgcagctgcctctttgggcgaggggcatctcggcctggctgccaacgtcgccgacgagtcccaggtgcagcaggctgtcgccaccgtcatcgaacactttggccggatcgacatactggtcaacaatgccggcatcacccaacccctcaagaccctcgatatccgccccggtgattacgataaggtgctggacgtcagcctgcgcggtacgttgcagatgtcccaggcggtaattccgctcatgcgccagcaagccagcggcagcattgtgtgcatgtcttcggtttccgcgcagcgcggcggcggcatttttggcgggcctcattacagcgccgccaaggccggtgtgctgggcctggccaaggccatggcgcgtgagctggggccggacaacgtgcgcgtcaactccatcgcccccggcctgattcacaccgacattactggcggcctgatgcaggacgagcgccgccacgcgatcatcgacggcattccgttgggtcgcctgggcgaggcgcaggatgtggccaatgcggcgctgttcctggccagcgacttgtcctcctatctgactggcatcaccctggatgtgaacggcggcatgctgattcac

SEQ ID NO: 37791 - DNA, 771 bp, Pseudomonas fluorescens
gcgctcatcaccggcgcgtccaccggcatcggctcgatttacgccgaacaccttgcccgccggggttacgacctcgtgctggtggcgcgcaaccgcgaacgtctgaacgcactggccagccgcctgaccagcgaaacccggcagaacatcgaagtgttgcaggccgatcttggccgccccgaggacctcgccaaggtagaacgcaagttgcgtgaggacgccagcatcactttgctggtcaacaatgccggcatcggcacccataccggcctgctggagagtgatgtagagcgaatggccgagatgatcacgctgaacgtcaccgccctcacccgcctgacctacgccgcgattccaggttttgtcgcccgcgaacgaggcgccgtgatcaatatttcctcgatcgtcagcctggcgccggagctgctcaacggcgtgtacggcggcagtaaggcctacgtcaccgcgttcacccagtccctgcacaaggaactctcggataaaggcatccggatccaggccgtcctgcccggcgcaaccgcgacggacttctggcaaatcggtggattgcctgtcgaacatctggatccgggcatcgtgatgtcggcccaggacctggtcgccggcgctctgcaggatttcgacaacggcgtgctgatctccatcccctcgatgcacgacctgcaaggttacgagcgttacgaagccagccgccaggccttgttctccgagctttcgagcaaccggctcgcgccgcgctacaacgccaac

SEQ ID NO: 37792 - DNA, 2355 bp, Pseudomonas fluorescens
gtgatcatcgccctgctcggcctggcactggccgctggcggtgtgaaattggtcagcctgggaggctcctggtacttcctggtgggtggtctggtgatggccgtttccggtctgctgatcgcgcggcgcaagcctgccggtgcctggctgttcgcggcgtttctggttgggaccgccatctgggccgtgatcgacgcagggctggtgttctggccggtgttctctcgcctgttcatgttcagcgcggtgggtctggtggtcgcgctggtctatccgctgctcaaacgcgccaatggtgacgttgcaggtcgcggtgcttacggcgttgcggctgttctggccgttggactggccgtggctgccggcaacatgttcgtcgcgcacccgaccgtcgcccctaccggcaccggcccgggcctcaccccggtcgagccggaaaaggcgcagaaagactgggcccactacggcaataccgaaggcggcagccgcttcgccgcgctggaccagatcaaccgcagcaacgtcgacaagctgaaagtggcgtggacctaccacaccggcgacatcgccgagagcgatggcaacggtgccgaagaccagctgaccccactgcagattggcaacaaggtgttcatctgcaccccgcacaacaacctgattgcgctggatgccgataccggtaaagagctctggaaaaacgcgatcaacgctcaatccaaagtctggcagcgttgccgtggcatggcgtatttcgacgccagcgccgccgtcgccaaaccggccagcgcgccagtgagcgaaaccccgaccgctccaatcgccaactgcacacgtcgcttgctgaccaacaccatcgacgcccgcctgatcgcggttgatgccgacaccggcgagttctgccggggtttcggcaacaatggccaggtcgatctgaaggccggtctgggtgatgtcccggacagctactatcaactgtcctccgcgccgctgatggccggcaccactgtggtggttggcggtcgtgtggccgacaacgtgcagaccgacatgccgggcggcgtgatccgtggtttcgacgtgatgaccggtgccatgcgctgggcattcgacccgggcaatccaaccgatcgcaaggcacccgcagacggcagcacttatgtgcgcagcacgccgaacagctgggccccgatgtcctacgacccggcgaccaacaccgtattcctgccgatgggcagttcttccaccgacatctatggtgtcgagcgcagcaaactcgatcacacctacggtgcctccgtcctggcgctggacgccaacagcggcgaagaaaagtgggtattccagaccgtgcacaacgacctctgggacttcgacttgccgatgcagccaagcctgatcgacttcaccaaggacggtaaaaccgtaccggcggtggtcatcggcaccaaggccgggcagatttacgtgctcgaccgcgccactggcaaaccgttgaccgacgtaaaggaagtgccggtcaaggccgccaatatccccaacgagccgtactcgccgacccagccgaaatccgtgggcatgccgcaaatcggtgcccagcacttgactgaatcggacatgtggggcgccaccccgtacgaccagctgctgtgccggatcgatttcaagtcgatgcgttacgacggcttgtacaccgcgccgggcactgacaaatccctgagtttcccgggttcgctgggcggcatgaactggggcagcatttccactgacccggtgcacggtttcatcttcgtcaacgacatgcgtctgggcctgtggattcagatgatcccgtcgcagaacaaggctcaggcctcttccggtggcgaagcgctgaacaccggcatgggtgccgtgccgctcaagggcacgccttacgccgtgaacaaaaaccgcttcctgtcggtcgccggcattccgtgccaggccccgccgttcggtacgctgaccgccatcgacatgaaaacccagaaagtcgcctggcaagtgccggtcggcaccgttgaagacaccggtcccttgggcatccgcatgcacctgccgatcaagatcggtctgccaaccctcggcggcacgctgtcgacccagggcggcctgatcttcatcgccggcacccaggacttctacctgcgcgccttcaacagcgccaatggtgaagaaatctggaaagcgcgtctgccggtcggcagtcagggtggcccgatgacctatgtgtcgccgaaaaccggcaagcaatacgtggtcatcaccgccggtggcgctcgccagtcgactgatcgcggtgactacgtgatggcttacgccctgccgtaaaccgtc

SEQ ID NO: 37793 - DNA, 3060 bp, Pseudomonas fluorescens
atggatctcagccgtcgtcagttcttcaaggtcgccggtatcggccttgcaggctctagcctgggcgcgttgggcatggccccgacgcaggccttcgccgagcaggtgcgccatttcaagcttgcccacacccatgaaacccgcaacacctgcccgtattgctcggtcggctgcggcttgatcatgtacagccagggcgatgccgcgaagaatgttgcgcaaaacatcatccatatcgagggcgacgccgaccacccggtcaaccgcggcaccctgtgccccaaaggcgccggcctgctggatttcattcacagccccggccgcttgcagtacccgcaggtgcgcaagcccggcagcagcgaatggacccggatcacctgggacgaagccctcgaccgcgtcgccgacctgatgaaggccgaccgcgatgccaatttcgtcgagcagaacgcccagggccaaacggtcaatcgctggctgaccaccggattcctcgcggcgtcggcggcgtccaacgaagcgggttacatcacccacaaggtggtgcgcagtctcggcatgctggggttcgataaccaggcgcgtgtctgacacggcccgacggtggcaagtcttgccccgacgtacggccgtggagccatgaccaacacctggaccgatatcgccaatgcgaatctgatcctggtgatgggcggcaacgcagcagaagcccacccttgtggcttcaaatgggtgaccgaagccaaggcgcacaacgccgcgcggctgattgtggtcgatccgaggtttacccggaccgcatccgtggccgattactacgcgccgattcgcaccggcagcgacatcgcgttcatgggcgggctgatcaattacctgctgaccgaggacaagatccagcacgaatacgtgcgcaactacaccgacgtatcgttcattgtcagagccggattcggcttcgaggacgggctgttcaccggttacgacgcggccaagcgcagctacaccgacaaatccacctggggttacgaactgggcgaggacggcttcgtcaaagtcgacccgaccctgcaggacccgcgctgcgtctatcaactgatgaagcagcattacagccgctacaacatcgacctggcgagccagatctgcggcatgccggtcgatgcgatgaaaaagatctgggaggaaatcgccacttgctcggcgccgggcaagaccatgacgattctttatgcactgggctggacccagcactcgatcggctcgcagatcattcgcagcgcggcgatggtgcaactgctgctgggtaacgtcggcatgcccggcggcggggtcaatgctttgcgcgggcactcgaacattcagggcctgaccgaccttggtctgctgtccaacgcgctgccgggttacctgaccttgccgaccgacgccgagcaggattacgcggccttcatccataaacgcacgcaagtcccgctgcggccggggcaattgtcctactggcagaactacagcaaattccacgtcagcctgatgaaagcctggtacggcgccaatgccaccgccgagaatcagtgggcctaccactacttgccgaaactcgacatccccaactacgacatcctcaaggtgttcgacctgatggggcagggcaaggtcaacggctacatgtgtcagggcttcaacccgattgccgcgctgccggacaagaaccgggtgatggcggcactggccaaactgaaatggctggtggtgatggacccgctggccaccgaaacttcgcagttctgggaacacgtcgggccattcaacgatgtgaagagcgccgacatccagaccgaagtcatccgcctgccaaccacctgttttgccgaagaggacggctcgctggtcaacagcagccgctggctgcaatggcattggaaaggcgccgacggccccggcgaggcgcgcaccgacgtgcaaatcatgagtgcgctgttcctgcgtctgcgtgagcgatatcaggcggagggcggcaaattcgccgacccgctgttgaaactgtcgtggccgtacaagatcgccgaagaaccctcgccggaagagatcgccaaagaggtcaacggctacgccaccaccgatttcaccgacgccacgggtgcggcgatcaagggcaattcgcaactggccgggttcgcccagctcaaggatgacggcagtaccgcgtccggctgctggattttctgcggcagctggaccgaagccggcaaccagatggcccgccgcgacaacaacgacccttacggcatgcatcagcatcaaggctgggcatgggcctggccggccaaccggcggattctctataaccgcgcttcggcggacgtcgccggcaagccgtgggatccgaaaaagcgcctggtctggtggaacggcaaggcctggggcggcaccgatgtgccggattacaaggccgacgtgccgccggaagccgggatgaacccgttcatcatgaaccccgaaggcgtggcgcggttcttcgccgtcgacaagatgaacgaagggccatttcccgagcattacgagccgttcgaaacgccgatcggcatcaacccgctgcacccggacaacaagaaagccaccagcaacccggcggcacggatcttcgattcggtgtgggacagcctcggcgtggccaaggattacccgtacgccgccaccagctaccggttgaccgagcacttccacttctggagcaagcactgcaagttgaacgcgattgctcaacccgagcaattcgtggaaatcggcgaggtgttggccaaagagaaaggcatcgtcgccggggatcgggttcgcgtgagcagcaagcgcgggttcattgaagcggtggcggtggtgaccaaaaggatccggccgttgcaggtcaacaaccaggtggtgcaccagatcggcattccgctgcactggggcttcaccggcctgacgcgccacggttacctgaccaacaccctggtgccgtttctcggcgatggcaatacacagaccccggaatccaagtcattcctggtcaacgtggagaag

SEQ ID NO: 37794 - DNA, 819 bp, Pseudomonas fluorescens
ccgaaacaggcgcaaccggttcccggttcgcagcgcaagatggagccgtaccccgattgcggcgaacagagctacaccggctccggtcggctggccggcaagattgccttgatcaccggcgccgacagcggcatcggccgggcggtggccattgccttcgcccgcgaaggtgccgatgtggcggtcgcctatttgaatgaacatgaagatgccaaggaaaccgcgcgctgggtcgaacaggccggtcgccagtgcctgttgctgcctggtgacattgcgcagaaagcccagtgccaggcgttggtggatcaaaccgttgagcacttcggccgcatcgacgtgctggtcaacaacgcggccttccagatgacccatgaaaccttcgaggagattcccgacgacgaatgggtgatgaccttcgacgtcaacatcaccgcgatcttccgcctgtgtcaggccgccatcaaacacatgggacctggctcctccatcatcaacaccagttcgatcaactcggacatgcccaagcccaccctgctcgcctacgccaccaccaaaggcgcgatcgccaatttcaccggtggtctggcgcaaatgctcggcccgagggaaatccgcgtgaattgcgtcgcaccggggccgatctggacgccgctgatcgtctcgaccatgcccgatgaggaagtgcagcattttggcgagcaaacaccactggggcgtcccggccagccagtggaggtcgcgccgatctacgtactgctggcatcggatgaagccagctacatcaccggccagcgctacggcgtgaccggcggcaaa

SEQ ID NO: 37795 - DNA, 2256 bp, Pseudomonas fluorescens
gggcgcttgagctacagcatcgcggtgcgggcgctgtgcgaattcaccgcgaaaaccggtgacctcgacctgcgcttcaccccgtcaccgactgcgctggagggcatcgccgggcatcgcaccgtggcgtcccggcgcaacgacgcctaccaaagcgaagtggcgctggagggcgcattcgggccattgaaggtcaagggtagggcggatggctacgacccgaagcagaactgcctggaagaagtcaaaacctaccgcggcgacctgagcaagcaaccggccaatcaccgttcgttgcattgggcccaggcaaaaatttacggctggttgatgtgctgtcgattgcagcttgagcagatcaatctggcgctggtgtatttcgacatcgtcacggaaaaggaaacctgtctggtcgaagcgttcagcgccgatgcgctgcggcagttcttcgaacaacagtgcggtttgttcctggcgtgggccgaacaggaaatggcccaccgcgaagcgcgcaaccgggcggcgcagcagctggggtttccccatgccgcgtttcgccccggccagcgtcacctcgccgaatcggtgttcaaagccgtcagcaccggccgctgcctgatggcccaggccccgaccgggatcggcaagaccctcggcaccctgtttccgatgctcaaggcgatggcgccgcagcaactggacaaggtctacttcctcaccgccaagacacccggacgcaaactggcgctggatgcggcgcaagtgctgttcgatcacagcgaaaccttgccgctgcgggtgctggaaatggtcgcccgggacaaggcctgcgaacacccggacaaggcttgccacggcgaatcctgcccgttggcccaaggcttttacgaccgtttgcccgctgcccgcgaagccgccagccaattgcgtctgctggatcaggccgcactgcgtgaagtcgcggcgcagcatgcggtgtgcccgtattacctgagccaggaaatggcccgctgggccgacgtggtggtggcggactacaactactacttcgatttcagcgcgctgctgttcggtctggctcagttcaatcaatggaacgttgcggtgctggtcgacgagtcgcataacctggtcgagcgcgggcggcagatgtacagcgcgacgctcgatcaggcaacactgggcagcgtgcgcaaaaccgcgcccgaggccttgaaaaagtcgttgcaacgggtcaatcgcgaatggaacgccctgcacaatgaccagttggcgccgtatcaggcctacgacaaggcgccggaaaaactgttgcaggcgctctcatcctgcacggcgagcatcggcgactacctcaacgatcacccgcaaggactcgacagcggattgcagaatttctacttcgagatgctgcaattcggtcgggtagcggaactgttcgacgcgcattacctgttcgacatcagcaaacgtgacctcgaacgcaaacgcccgttatcgcaactgtgcctgcgcaacgtggtgccggcggcgttcatcggcccgcgcctgacggcggcgcgcagcagcgtgctgttttccgccaccctcagcccgcgccactattacgcggatttgctcggcacgccggccgacacggtctggatcgacgtcgagtcgccgttcagcgccgaacaattgcaggtgcagatcgtcagccggatttccacgcgtttcacgcaccggcaagcatcgctggaaccgattgtcgagctgatcgcccgccagttcagtgaacgtccgggcaactacctggcgttcttcagcagtttcgattacctgcaacaggtcgcgcagttgctggccgagcgccaccctcacatcacccggtggcagcaatcccggggcatggacgaaggggcgcgtcaggcgtttctcgatcaattcaccgccgacagccagggaatcggcttcgccgtgctcggcggcgcgttcggcgaaggcatcgatctgcccggcgcgcggctgatcggcgcgttcatcgccaccctcgggctggctcagctcaacccggtcaatgaacagatgaaacgccgtatggccgcgatcttcggcgccggctacgactacacctatctgttccccggcgtgcagaaagtggtacaggccgccggacgggtgatccgcacccagcaggatcgcggcgtggtgatgctgatcgatgatcgttttgccgagggccggattcggcagttgctgccgcgctggtggcaaatc

SEQ ID NO: 37796 - DNA, 1776 bp, Pseudomonas fluorescens
atggcgaaggccccagccaccgctcccttattcaaggcattaggtgactataaaagcattctgatcagcgtcggatgctttaccgcactgattaacgtgctgatgctggtgccctccatatatatgcttcaggtctacgaccgggtgctgtcttcgcaaaacgaaaccaccctggcgatgctgtcgctgatggtcgtcggtttcttcgccttcattggtctgctggaggtggtgcgcagctttatcgtgatccgcatcggcagccagctcgagcgccgtttcaatctgcgggtctatcaggcggcgttcgagcgcaacctgttcaagggcgagggtaacgccgggcagtccctgggtgacctgacccacattcgccaattcgtcaccgggcctgcgctgttcgcattcttcgatgcaccgtggtttccggtttatctgttcgtgatttacctgttcaacgtctggctcggcgtgctggccacggcgggagcgctgctgctgatcgcgctggcatgcctgaacgaatacatgaccaagaagccactgggcgaagccgccggcttctcgcagaaatccagccaattggccaccagccacctgcacaacgccgaaaccattcaagccatgggcatgctcggcgccttgcgcaagcgttggttccaggtgcattcgcgctttctcggcctgcaaaatcaggccagcgacaccggcgcggtgatcagctcgctgagcaagaccctgcgtctatgcctgcaatcgttggtgttgggcctcggcgcactgctggtgatcaagggcgacatgaccgccgggatgatgatcgccggctccatcctgatgggccgggtgctgagcccgatcgatcagttgattgccgtgtggaagcagtggagcggggcgaagctggcttaccgtcgcctcgatgcgttgctgcaagccttcccgccgagcgatgacgccatggcgctgccggcgccgaaaggccagatcaccttcgaacaagtcagcgccggccctccgggtcagcgtgccgcgaccttgcatatggtcaacttcaacctggcggccggtgaagtgctgggcgtgctgggagcctccggctccggcaaatcgaccctggcacgtgtgttggtcggcgtatggccggcccttggcggcacggtgcgtctggacggcgccgacatccaccgttggaaccgcgatcagctcggcccgtacatcggctacctgccgcaggacatcgaactgttcagcggcagcatcgccgagaacatcgcccgcttcagtgaagccgatccgcaaaaggtcgtggctgccgcgcaacaggccggcgtgcacgaactgatcctgcgcatgccgcaaggctacgacacgcaattgggcgaggacggcagcggtttgtccggcggccagaaacagcgcgtggcactggcccgtgcgttgtacggcaacccgagcctggtggtgctcgacgagccgaactccaacctcgacaccgtcggcgaagccgcgctgtccagcgcgatcgtgcagctcaaggcccaaggcacgactgtagtgctggtgacccaccgttcttcggtgctggcccaggccgacaagctgctggtgctcaacgacggtcgcctgcaagccttcggcccgagccacgatgtgctcaaggcactgtccggcaatcagcccggcaaccagccacaacaaaatgaaaaacctgcgcaagcaccggccgggctcagcatgagccgccagtatcagccgacgacaaggaattcgggt

SEQ ID NO: 37797 - DNA, 1662 bp, Pseudomonas fluorescens
acactcagtccttttgcgggcaaaccggcaccggcagaactgttggtcgacatcccgcgactggttacggcgtattacaccgggcaacccgacgcctcggtttccacccagcgcgtggcgttcggcacctccgggcaccggggcagttcctttgatttgagtttcaacgagtggcacgttctggccatcagccaggcaatctgcctgtatcgcgaagcccagggcatcaccgggccgttgttcgtcggtatcgacacccatgcgctgtcgaccccggccggggccagtgccctggaagtgctggcggccaacggtgtgaccgtgatgatcgccgaaggcgatgagtacaccccgaccccggcggtctcccacgccattctttgctacaaccgggggcgcaccaccggcctggccgacggcatcgtcatcaccccgtcgcacaacccgccacaaagcggcggttacaaatacaatccaaccaacggcggcccggccgatacccacatcaccaagtggatcgaagccaaggccaacgaactgctggccaacaaactggccggcgtcaaacgcatcagctacgagcaggcgctcaaggccgaaaccacccaccgtcacgactacgtcaacacctacgtggccgacctgatcaacgtcatcgacttcgatgccattcgcggcgccaaactgcgcctgggtgtcgatccgctgggcggagcaggggtgcgctactggtcggcgattgccgagcactatcgtctggacctggacgtggtgaacaaggaagtcgattcgacgttccgcttcatgactgtcgactgggacgggcagattcgtatggacccatcgtccagccatgccatgcaaggcctgatcggtctgaaagaacgctttgacgtggccttcgcctgcgatccggatcacgaccgtcacggcatcgttacgccgtccggcggcctgctggcaccgaacaactatctggccgtgtcgatcgactacctgttccagaaccgtccgcagtggcgcgccgatgcggccgtgggcaaaaccgtggtcagcagcggtctgatcgatcgcgtggccaagcgtctgggtcgtcgcctgtacgaagtgccggtcggcttcaaatggttcgccgatggtctgtttgacggctcgctgggttttggcggcgaagaaagcgccggcgcctcgttcctgcgcaaggacggcggggtctggagcaccgacaaggacggtctgattccagccctgctggccgctgaaatgaccgcccgtaccggccgtgacccaagccaggcctaccgtgcgctgaccgacgagctgggcgagccgttctcggtgcgtgtcgacgccaaggccaatccagagcagaaagccctgctgagcaaactgtcgccggagcaggtcacctcgaccgaactggcgggcgagaagatccagagcattctcagcaaagcgccgggcaacgatcaggccattggcggtctgaaggtgatgaccgaaaacggctggttcgccgcacgtccgtcgggcaccgaagacatctacaagatttacgccgagagctttatcggcgacgaccacctcaagcaactggtggctgaagcgcaaatgctggtagacggtgcgatcagcacccagtaaatccaggcaacggaaaag

SEQ ID NO: 37798 - DNA, 1011 bp, Pseudomonas fluorescens
atgtcccgcacgatccgttttcacaagtttggtccggccgaggtgctcaaatgcgaagagcatgcggctgctcagccaggtcctggcgaagtgcaggtgcgtgtcgaggcgatcggcatcagctggtatgacacgctctggcgccagaatctggcgtcgtcccaggcgcgcctgccttcaggcctgggtcatgaaatggccggcgtggtcacggccatcggcgatggcgtcgaagatctggcagtgggcgacaaggtggccagtttcccggccgagagtcccaacgattacccggtctacggcgaactgatcgttctgccgcgcaccgcgctgacccgctatccggatgtgctcagcccgattgaagccagcgtgcattacacgccgctgttgatcgcctatttcggatacgttgatctggcacgggtcaaacccgggcagttcgccctggtaaccgacgccagccactgcgccggcccatccttcgttcagttgggcaaagcactgggtgtgcgggtgattgccgccaccaaaacagcggaggagcgtgagtacctgctgtcgctcggtgccgagaaagtgattgtcaccgaagaagaagacctgttgatgcggatcaacaagatcaccgacaaccgcggtgtcgacgtggtgttcgatggtctcggcgggccacagatgtcgctgctcggcgatgtgctggcaccgcgtggcagcctggtgctgtacggcctgcagggcggcaaccagacgccattcccggcctgtgcggcgttccagaagaacattcagttcttcgtacattgcatcggcaacttcaccggcaaaccggagctcggcatcattcaggaccacgtcgccttgcagcgtgccttgcgtgatatcaaccagctcaccgctgaccgtgtgctgctgccgctcaagacccgggtgtttccgttcaacgagtttgtcgaagctcaccgctacatggacgagtgcccatgccgcgagcgggttgccctgcaaatc

SEQ ID NO: 37799 - DNA, 3108 bp, Pseudomonas fluorescens
gtgggcgacgtatgcgcagtcgatgatcgatctgcaacgcgcgagcggtgattacaagtccgcggtcaaagcggggaagggcaagcgcctgaccgacgaaatacgtaaacagttcgaagatgtaattgaaaccgaacagttgctgcgtgcttcacgcaacgaagacgtgcgccgcaccacgatctggagcatcagcctttatctgctgtttgtggccggtatcagcggtctgctggcctatgtcggtcggcgcgatctggtcaacctgtcgcaaagctatggcgcgaccctggcggcgcaagaggccagtgcaaaacgtctggaacagcaagcctggttgcgcaacggccagacccagctcgccgaacaagtgctggggcaactgacggtcaatctgctggggcgcaatatcctgcagttctgcgcccagtatctcggcagcgccgtggccgcgctgtatgtacgcgaggaacatggcggcctcaaacgcgtggcgacttatggcttctcccgcgaacaggaacaacagaaccaatcgatctacagcgaagaaggtctggtcgggcaggtcgctcagcaggctcggctgattcgtctcgactcggtgccgtccgactatttcaaggtcagttcgggtctgggcgagggcctgccgcgcagcgtgctggtagtgccgaccagtgatgacgagcgggtcaacggcgtgatcgaactgggcttcctgcgtccgctcaccgaccgtgatgtggcgttgctggaactgatcgccggcaatatcggcacgtctatagaagcggcgcgataccgtcagcgtttgcaggaagtgctggccgaaacccagcaactcaacgaagagttgcaggtgcagcaggaagagctgaaaaccgccaacgaagagctggaagaacagtcgcggattctcaaggaatcccaggcgcatctggaaacccagcaagtcgagctggagcagaccaacgaacaattggccgaacaggcccagaccctggccgagcagcgcgacgccatggatcagaagaacaccgagctcaatcaggcgcaggtgcagctcgaagaacgcgccgaagagttgcagcgttctagcaagtacaaatccgaattcctcgccaacatgtcccacgaactgcgcacgccgctgaacagttcgctgatcctggccaagctgctggcggaaaacccgcaggaaaacctcagcgccgagcaggtcaagtttgccgagtcgatctattccgccggcaacgacctgctcaacctgatcaacgacattctcgatatttccaaggtggaagccggcaagctcgaagtgatgccggaaaacaccagtgtcgcgcgcctggccgacggtttgcgcgggatgttcgaaccgctggcggcagtcaagcaactcgcattcagtgtccagttgcagcccgatgcgccgagtacgctgttcaccgaccgccagcgtctggaacaggtgatcaagaacctgctgtccaacgccgtgaaattcaccgagcacggcaccgtcagcctgaccattgccggtcagccggacgaccgcattgccttcatcgtgcgcgattcgggtatcgggatcgcggcagaccagcaggaaagcattttcgaagccttccgccaggccgacggcaccaccaaccgcaaatacggcggcactggcttgggcctgtcgatttcccgggatctggcgacgctgttgggcggctcgatcagcgtcagcagcgcgccggggcaggcagtgtcttcaccctggtgctgccgcagcactaccgcgaaccgggcgacgcgcctgtcgcgccgctaacgttcagcccgccagccgccgctccggtcatggcatccgctgtagcggtttcgccgctggcctctgtcgagattccgcgcttcaacgatgaccgcgataaagcgccgttcaatacccgctgcattctggtggtggaagacgaaccgaatttcgcccatatcctctacgacctcgcccatgaactgggttatcagtgcctggttgcccacggcgccgatgaaggctatgacctggcgaaagagttcgtgccggacgcgatcctgctggacatgcgcctgccggatcattcgggcctgaccgttctgcaacgcctgaaagaacacgccggaacccgccacatcccggtgcacgtgatttccgtggaagaccgcgtcgaagcggccatgcacatgggcgccatcggttacgcggtcaagccgactacccgtgaagagctcaaggacgtgttcgcccgtcttgaagcgaagctcacccagaaggtcaaacgcgtgctgctggtcgaggacgacgatctgcaacgggaaagcatcgctcggctgatcggcgacgacgacatcgaaatcaccgccgtcggcctggcgcaggacgcactggagctactgcgcacgacgatcttcgattgcatggtcatcgacctgaagctgccggacatgcttggcaacgacctgctcaaacgcatgtccaccgaggacatctgctcgttcccgcctgtcatcgtctataccgggcgtaacctgacccgcgacgaagaggccgacctgcgcaagtattcgcgttcgatcatcatcaagggcgcccgctcgccagagcgtctgctggacgaggtcacactctttctgcacaaagtcgaatcgcagttgtcccatgaacggcagaagatgctcaagaccgcccgcagtcgcgacaaggtcttcgaaggccgcaaagtgctgctggtggacgacgatgtacgcaacatcttcgccctgaccagtgcgctggaaaccaagggtgcagtcgtggtgatcggtcgaaacggtcgtgaagcgattgaaaaactgaatgaagtcgaggacatcgacctggtgctgatggacgtgatgatgccggaaatggatggtttcgaagccaccatggaaatccgcaaggatccgcgctggcgcaagctgccgatcatcgcggtgacggccaaggccatgaaggacgatcaggagcgctgcctgcaggcgggcgccaatgattacctggccaagcccattgacctggatcgcctgttctcgctgattcgcgtgtggttgccgaagatg

SEQ ID NO: 37800 - DNA, 1494 bp, Pseudomonas fluorescens
atgcacaaacaacaactattcctcggcatcgactgcggcacccaaggcaccaaagccatcatcctcgacgccaccagcggtcaggtgttgggccagggcgccgccgcgcacacgatgatcagcggcgccaacggtcgtcgcgaacaagacaccgcgcaatggctggaagccttcaccctcggcacccgtcgcgctttattggcggcaaatgtcgacggccagtcgatcctcggcatcggcgtctccggccaacaacacggcctggtactgcttgacgaccaaggccaggtcctgcgcccggccaagctctggtgcgacacggagaccacaccagagaacgatcaactgctcgctcatctgggcggtgagcaaggctcgctggaacgcctcggcgtggtcatcgcgccgggctacaccgtgtccaaactgttgtggaccaaggagcagcatccgaatgtgttctcccgcatcgcgcgagttctgctgccccacgactacctgaatttctggctcaccggtcgtgcgtgcagcgaatacggcgatgcatccggcaccggctatttcaatgtgcgcacccgccaatgggatttgcagctgctgcgcgacatcgacgccagcggccgtctacaatccgcgctgccggaactgatcgacgcccatcaagcggtcggcacgatccttcccgccattgccgaacagctgggcatcaaccctaacgcggtggtttccagcggtggcggcgacaacatgatgggcgccatcggcaccggcaatattcagccgggggcgatcaccatgagcctcggctcttccggcacggtgtacgcctacgccgaggcaccgaaggtcagcccggatgcgtcggtcgcgaccttctgttcctcgagcggcggctggctgccgttgatctgcaccatgaacctgaccaacgccaccggcgcaatccgagaactgttcaacctcgatctcgacgccttcaacgctttggtagcccagaccccgatcggcgcagaaggcgtaagcatgttgccgttcctcaacggcgaacgcgtgcctcccctgcctcatgcgaccggcagcctgcatggcctgacgatcgataacctgacgcaagccaatctgtgccgcgccgccgtcgagggcaccaccttcggcctgcgttatggactggatctgttgcgccagaatggtttacaaagccgcagcatttgcctgatcggcggcggttcgaaaagcgcggtatggcggcagatcgtcgccgacatcatgaacaccccggtgatctgcaccgagcaaagcgaagccgcagccctcggcgcggcgattcaggcggcgtggtgcaaatcgtggtcgaacggccacgaagacaccctggccgatctgtgccagcgctgcgtgaagctcgacctgaacagtgaaaccctcccggttgccgcgaatgtcgcggcgttccagcaggcctatgaacgctatcgactgcatgtcgcaacctta

SEQ ID NO: 37801 - DNA, 933 bp, Pseudomonas fluorescens
atgtacctggtatgtggcgaagcactgttcgatttcttcagcgaagacgatgccggcgggcaagcgtcgaaagtcaatttcaaggcgattgccggtggctcgccgttcaacgtggcggtgggtttgcgccgactgggcgtggattcggcgctgttcggcgggttgtccaccgactacctcggacgacgcttgcagcaagtgttgcaggatgaaggcgtacacccggattatctggtcgatttcgctgcaccgaccacgctggcgatggtcgcggtgggcgccaatggctcgccgcactacagcttccgtggcgaaggttgcgctgaccgccagctgagcctggcgcacctgccagcgttggggcctgaagtgcgcggcctgcacttcggttcgttctcgctggtggtgcaaccgattgccgataccttgcttgcgctggtgcagcgcgaaagcggcaaacgcctgatcagcctcgacccgaacgtgcgcctcaacccggagccaaacatcgacctgtggcgcgaacgaatcgccacgctggtgccgttggcggacttgatcaaggtcagcgacgaagacttgagcctgctgtaccccgagcaggatcctgcgcgcgtcatcgaaggctggttgcagcatcgttgccaggtggtgttcctgacccgtggcggtgaaggcgcgaccgtgttcagccgggttcacggttcatggtcggtgccggcttcttcggtgaagattgccgatacggtcggggccggcgataccttccaggccgcgctgatcacctggctgaccgagcatgaactggactcggtggaaggcgtgcagcacctgagccgcgaacaaatcgacggcatgctcaggtttgccgtacaggccgccgcccttacatgcagtaaaacaggtccggatttgccttatcgccaccagttg

SEQ ID NO: 37802 - DNA, 1488 bp, Pseudomonas fluorescens
ccgaccacgctgtttctgttcggcgcccacggtgatctggtcaagcgcctgcttatgccggcgctgtacaacctgagtcgcgacggcctgctggatgatggcctgcggatcgtcggcgttgaccacaacgcaatcaccgatgaagccttcgcgcaaaagctcgaagacttcatccgcaccgaagtggcagcgaaagtcggcaagggcgatcagatgcttgatccggccttgtgggcgaagctcgccaaaggcatcagctacgtccagggtgacttcctggacgacagcacttattcagccctggcggcgaaaatcgccgacagcggcactggcaatgcggtgttctacctggccaccgcgccacgtttcttcagcgaagtggtgcgccgtctcggcagcgccggattgctcgaagaaaccgcggaagcctttagaagggtggtgatcgaaaaaccgttcggctccgacctgcaaaccgccgaggcgttgaacgcctgcctgctcaaggtcatgtcggaaaagcagatctaccggatcgatcactatctgggcaaggaaaccgtgcagaacattctggtcagccggttctccaacagcctgttcgaagcgttctggaacaaccactacatcgaccacgtgcagatcaccgccgccgaaaccgtcggcgtcgaaacccgtggcagtttttacgagcacactggcgccctgcgggacatggtgcccaatcacctgttccagttgctggccatggtcgcgatggaaccgccagcggcgttcggcgccgatgcggtgcggggcgagaaggccaaggtcgtcggtgcgatccggccctggaccaccgaggaagcacgggaaaactcggtgcgcggtcaatacagcgccggtgaagtcgccggcaaaccggtgtccggttatcgcgatgagaacaacgtctcgcccgacagcaccacggaaacctacgtggcgctgaaagtgatgatcgacaactggcgctgggtcggcgtgccgttctacctgcgcaccggcaagcgtatgagcgtgcgcgacaccgagatcgtcatctgcttcaaaccggcgccgtatgcgcagttccgcgataccgaggtcgacgaattgcagccgacctacctgcgtatccagatccagcccaacgaaggcatgtggttcgacctgctggccaagcggccggggccggcgctgaacatggccaatatcgagctgggtttcgcctacaaggacttcttcgaaatgcagccgtccaccggctacgaaaccctgatctatgactgcctgaccggtgaccagacgctgttccagcgcgccgacaacatcgagaacggctggcgcgcggtacagccgttccttgatgcctggcaacaggacgccagtgtacaaacctatgccgctggcgaagacgggccgaaagccgccgatgatctgctgactcgcgatggtcgcgtctggcatggtctcggatgagtgagccga

SEQ ID NO: 37803 - DNA, 972 bp, Pseudomonas fluorescens
atgcaactcgggattattggactgggccgcatgggcggcaatattgcgcgacgtctgatgctcaacggtcacaccaccgttgtttacgaccgcaataccgcctttgtcgataccctggccgccgagggctctaccggcgtcgccgacctgcctgcactggtcgcaggcctggccaaaccgcgtgcggtgtgggtcatgctgccggccggcgcaccgactgaagacaccatcgaaaccctgagccatctgctcgaggcgggcgacaccatcatcgatggcggcaacaccaactacaaggacgacatccgtcgggccaagaccctggccgagaagggcctgcactacattgatgtcggcacctccggcggcgtctggggcctggagcgtggctactgcatgatgatcggcggtgatgccgagaccgttaagcgtctggacccgctgttcgccgcgttggcgccgggcatgggcgacatcccgcgcaccaaggaccgcaagtccgatgaccaccgtgccgagcacggctacatccacgccggtcccgccggtgccggtcacttcgtgaagatgatccacaacgggatcgagtacgggatgatggcggctttcgccgaaggcttcgatattctcaagaccaagtccagcgagctcctgccggaagatcagcgtttcgacctgaacgtggccgatatcgccgaagtctggcgtcgtggcagcgtggtgtcgtcgtggctgctcgacctgaccgccgatgccctggcggtcgacccgaaactcgacggcttctccggctccgtggccgacagcggcgaaggtcaatggaccatcgaagcggccatggaacaaaaggtgccggtaccggtgctgtccaactcgctgttctcgcgctaccgctcccgcggccagggcactttcggcgacaagattctttcggcccagcgcttcggcttcggcggccatgtggagacaccg

SEQ ID NO: 37804 - DNA, 816 bp, Pseudomonas fluorescens
gcggacgtggcggtcagcggtgtgccgttcgacaccgccaccagcaaccgtccgggcgcccgtttcgggccgcgcgggattcgtgcggcgtccaccgggattgcctgggaacggcactggccatgggcgttcgacccgttcgatcatctggcggtgatcgactacggcgattgcgacttcgattacggctcgccgcacaccatcccggacagcatcgaggcccacgccgagcatattctcagctccggcagcgccatgctcacctttggcggcgaccatttcatcagctatccgctgctcaaggcccatgcacgcaagcacggcacgctgtcgctgatccacttcgatgcgcacagcgatacctggccggacgagggtggcaagcgggtcgatcacggcaccatgttctggcacgcggcgcgggaagggctggtggatccggcgcgttcggtgcagatcggcttgcgcaccaccaatgacgatcatcagggctttcaggtgctggacgcgcggcaggtgcatcggtgtggatgcgaggcgatcatcgaggcgattcgcgcgcgggtcggggataacccggtgtacctgacgttcgacatcgattgcctcgacccggccttcgcaccgggcaccgggaccccggtgtgcggcgggttgagcacggtgcaggcgctggagatccttggcggcctgcgcgggatcaatctggtgggcatggacgtggtggaagtggccccggcttacgaccacgcggacgtgacgtcgctggcggcggcaaccctggccatggagatgctttgcctgtacgcggcccgg

SEQ ID NO: 37805 - DNA, 984 bp, Pseudomonas fluorescens
gtgtccctggacgagctgactcaactgctggaaacgattttcacccgtcacggcacctcggccgaagtcgccagaaccctggccaccaattgcgccaatgccgagcgggacggtgcgcacagtcacggcgtattccggattcccggttatgtctcgacgctcaacagtggctgggtcaacggcaaggccgtgccgaaagtcgaggacgtggcttcagggtttgtcagtgtcgatgccggcaacggttttgcccagcctgcgctggcggcggcgcgtccactgttggtggagaaggcccgcagcgccgggattgcggtgttggcgatccgaaattcccatcactttgccgcactgtggccggacgtcgagccgttcgccgacgaaggcctggtagcgctgagcgtggtcaacagcatgacctgcgtggtgccgcacggcgccgaccggccattgttcggcaccaacccgatcgccttcgccgcgccacgggccgacggtgcgccgatcgtgttcgacctggccaccagcgccattgcccatggcgatgtgcagattgctgcacgcaagggcgaaaaactgccggcaggcatgggcgtcgacagcctcggccagccgacctgcgaccctaaggcgattctggaaggcggcgccttgctgccgtttggcggacacaaggggtcagcgctgtcgatgatggtggaactgctggccgccgcgctgactggcggcaatttctcgttcgaattcgactggaaaaaccatccgggggccaagacaccgtggaccggtcaacttttgatcgtgatcgacccgagcaagaccgccggacaaagcttcgccgaacgcagtcaggaactggtgcggcagatgcacggggtagggctcaagcgtttgccgggtgatcggcggcatttgcagcggaccaagtcattggtcaaagggattgagctggatcaacagaccctgtcgcagctgcgtgaactg

SEQ ID NO: 37806 - DNA, 1401 bp, Pseudomonas fluorescens
aaagtcttgttcgtcacctcggaaattgccgatctggtgaagaccggcggtctgggagacgtttcagccgccctgccccgcgccatggcgcacctgcatgacgtccgggtgttgatccccggttacccgcaagtgatgaacagcgagaatccgatccacatcatcggcgaactgggcggtcacgccgcgctgccgccctgcaagatcgggcgcatggacatgcccgatggtctggtgatttatgtgttgatctgccctgaactttacgctcgtgacggtggcccgtatggcgccaacaacggccgcgactggccggacaaccacattcgcttcgcccgcctgggcctggccgccgccgatatcgcggccaatctcgcgcaaatccactggtgcccggatctggtgcacgcccatgactggccggccgggctggcgcctgcctatatgcactggcgcgggcaacgcacgccgaccctgttcaccattcacaacctcgcttatcaaggcgtgaccagcctcggttcgtgcccggaactcgggatccccgctcatgccctgcaacaggaaggcatggagttctacggcaagatgtcgttcctcaaggccggcatggcctattcgagccacatcaccacggtcagcgccacctacgcgcaggaaatcaccaccccggatttcggctgcggtctcgacggttttcttgccgccaagacccagcaaggcctgctcagcggcatccccaacggcatcgatgagagctgggacgctgccaccgacccgcatctgttcgcgccatttgccatcggcgactgggaaggcaaggccatcaacgccgcccatgtgcgcgaactgttcggcttgaaagactcggaaggtccactgtttgccgtggtctcgcgtctggtttatcaaaaaggtttggacctgaccgaggcggtgtcggaatacatcgtccagaacggtggccagatcgcgatcatcggccgtggcgaaccggaagaagaacaggccatgcgtgaactggcgctgcgcttccccggccagatcggcgtgcgcatcggcttcaacgaaacagacgcccggcggatgttcgccggcagcgatttcctgctgatgccgtcgcgctatgagccgtgcggcctgagccagatgtacgcccagcgcttcggctcgctgccggtggcgcgcaacactggtgggctggccgacaccattgaaaacggcgtcaccggtttcctattcaacgaatccaccgccgacagctaccgcgaagccctgagccgcgcgttcaaggtgtttgccttccccgaactgctcaatgcaatgcgttgccgggcgatggccgcacccttcaactggtgcaaggcggtcgaaccttacgccgaactctacgaaaaactg

SEQ ID NO: 37807 - DNA, 2100 bp, Pseudomonas fluorescens
ccctcgcgcatccgtgaaggcctgcccttcccgctcggcgcgacctgggatggtctgggggtgaacttcgcgctgttttccgccaacgccacccgcgttgaactgtgcattttcgacgatgccggcgaagtcgaactcgagcgcatcgagctgccggaatacaccgacgagatcttccacggctacctgcccgatgcgcatccggggctgatctacggctaccgggtctacggcccgtacgacccggccaacggccaccgcttcaaccacaacaaattgctgatcgacccgtacgccaaacaactggtgggcgagttgaaatggtccgaggcgctgttcggttacacaatcggccacccggacgccgatctcagcttcgacgagcgcgacagcgcgcctttcgttcccaagtgcaaggtcatcgacccggcgcacacctggggccacgaccaccgcgtcagcgtgccgtgggacaagacgatcatttacgagacccacgtgcgcggcatcagcatgcgccacccttcagtgcccgagaacgtgcgcggtacgtttgccgggctgatggtcgacgacgtgctcgaacacatccgcaagctgggtgtgtcgaccgtcgagctgttgccgatccatgccttcgtcaacgatcagcacctgctgcacaagggcatgaccaattactggggttacaacagcatcgcgttcttcgctccggacccgcgctacctggccagcggcaagatcgccgagttcaaggagatggtcgcgcacctgcacgatgccaatctcgaagtgattctcgacgtggtctacaaccacaccgccgagggcaacgaacaaggcccgaccctgtcgatgcgcgggatcgacaacgcctcgtactaccgcttgatgccggacgacaagcgcttctacatcaacgattccggcaccggcaacaccctcgacctgagccatccgtgcgtgctgcaaatggtcactgactcgctgcgctactgggccagcgaaatgcacgtcgacggcttccgcttcgacctggcgaccatcctcggccgctatcacgacggattcgatgaacgccacagtttcctcgtggcctgccgccaggacccggtgctgcgtcaggtgaaaatgatcgccgagccttgggactgcggccccggcggttatcaggtcggcaacttcccgccgggctgggtcgagtggaacgacaaattccgcgacaccgtgcgcgccttctggaaaggcgatgacggccagctcgccgacttcgccagccgcatgaccgcgtccggcgagatgttcaatcagcgtggccgccggccctattcgtcggtgaatttcgtcactgctcacgacggttttaccctcaacgacctggtgtcctacaacgacaagcacaacgaggccaacgacgaaaacaatcaggacggcagcaacaacaacctgtcctggaaccacggcgtcgaaggccccaccgacgacccggaaatcaacgcgctgcgccaccggcagatgcgcaacttcttcgccaccctgctgttgtcacagggcacgccgatgatcgtggccggcgacgaattcgcccgcacccaggacggcaacaacaatgcctactgccaggacagcgaaatcggctgggtcaactgggacctgagcgaggacggcaagacgctgctgaaattcgtcaaacgcctgatcaagttgcgcctggcctacccgatcctgcgacgcgggcgtttcctggtcggcgaatacaacgaggacatcggcgtcaaggacgtgacctggcttgcgccggacgccacggaaatgaccaccgagcactggcatgacgcgcagaatcgctgcatgggcatgttgcttgacggtcgcgcccaggaaaccgggatccgccgcaagggtggcgacgccacgctgctactggtagtcaacgcccatcacgacatcgtcaacttcaccttgccggaagtacccgagggcagtttctggacgtgcatgatcgataccaaccagccatcgatccgtggccaggagcgtttcgagttcggtcacgagtactcggtcaccggacgctcgctgctgctgtttgaactgcaa

SEQ ID NO: 37808 - DNA, 2163 bp, Pseudomonas fluorescens
gacattgatgctttagtgcgcgcagaacaccacgacccgttttccattcttggcccccacggcgatggtgccggcgggcaatttatccgggcgtatctgcccggcgcattgagtgtttctgtcgtcgataaaaacagtggcgaagagctcggtccgctggaggccaccgaaacgccggggctgtttgtcgggcatttcgaaggctcacggccgtacctgttgcgcacccgctgggccggtggtgaacaggtcgcggaagatccttacagctttggtcagttgctcggtgaaatggatttgtatctgttcgccgaaggcaaccatcgcgatctcagcagttgccttggcgcgcagctgaaaaccgtcgatggcgtcgacggtgtgcgctttgccgtgtgggcaccgaatgcccggcgggtgtcggtggtcggcgatttcaacgtctgggacgggcggcggcatccgatgcgcttgcggcatccatccggggtctgggagctgttcattccacgcttgcaggcgggcgagctgtacaaatacgaaatcctcggcgcccacggcatcctcccgctcaaagccgacccgatggcgctggccaccagcctgccgccggacacggcctcgaaagtcgcctcgccgttgcagatcgactggcaggatcaggactggatgagcggccgtcgcgaacgccagcaacacaacgcgccgttgtcgatctatgaattgcacgccggatcctggcaatgcgaactcgacgatctgggcgaagtggcgcgccagtacacctggccggagctcgccgagcggctgattccctacgtgaaggaactgggtttcacccacatcgaactgatgccgatcatggagcacccgttcggcggttcatggggctatcagttgctgtcgcagttcgctccgagtgcgcgatacggcacacccgagcagttcggcgagttcgtcaatgcctgtcaccaggccggcatcggtgtgattctcgactgggtgccggcgcatttcccgaccgatacccatggccttgcgcaattcgacggcaccgcgctctacgaatacggtaatccactggaaggcttccaccaggattgggacacgctgatctacaacctgggccgcaccgaagtgcacggctacatgctggcgtcggcgttgcactggctcaagcatttccatatcgacgggctgcgggtcgatgcggtggcgtcgatgctctatcgtgattattcgcgcaaggccggcgagtgggtgccgaaccgtcatggcggtcgcgagaacctggaagccatcgatttcctgcggcacttgaacgacgtggtggcactggaagcaccgggcgcactggtgattgccgaggagtccacggcgtggccgggcgtcagccagagcacccaacagggcggtctcggtttcgcctacaaatggaacatgggctggatgcacgactcgctgcactacattcagcaggatccggtgtaccgcgcccatcaccacaacgagttgagtttcggcctggtctacgcctggtccgagcgcttcatcctgccgatttcccacgacgaagtggtgcacggcaagcattcgctgatcgacaagatgcctggcgatcgctggcagaaatttgccaacctgcgggcttacctgagtttcatgtggacccatccgggcaagaagctgttgttcatgggttgcgagttcggccagtggcgcgagtggaatcatgatcagcagctggactggtatctgctgcaatattcggaacacaaaggcgtgcagaaactggtcagcgacctcaatcggttgtaccgcgaagagccggcgctgcatgagcaggacgatgcgccgcaagggtttcagtggttgatcggcgacgatgcgatcaacagcgtctatgcgtggctgcgctggagcaaggacggcacgccagtgctggtggtggccaacttcaccccggtgccgcgtcagtcttaccgcgtgggcgtgccgtttgccgggcgctggaaggagttgctcaacagtgacgccgacacgtatgccggttccaattatggcaacgggggcggggcgttcaccgaagaggtggccagccatggccaggcgttgtcgctggagctgaacctgccgccgctggcggtgttgatcctcaaaccc

SEQ ID NO: 37809 - DNA, 735 bp, Pseudomonas fluorescens
gtcattgtgatcaccggcggtggtcgtggaattggcgccgccaccgcgctgttggctgccgagcaaggctatcggatctgcatcaattaccagacggacgaacaggccgctcaccacgtgctcgaccaggtccgtgaacgcggcgccacggccatcgccgtgcgcgccgatgtcagtatcgaagacgaagtgatcgcgctgttcaaccgagtcgacagcgaactgggccgcgtcaccgccttggtgaacaacgccggcaccgtcgggcacaagtcgcgggtcgacgaaatgtccgaattccgcatcctcaaaatcatgaaaaccaacgtcctggcgccgatcctctgcgccaagcacgcgatcctgcgcatgtcgcccaaacacggcgggcagggcggcagcatcgtcaacgtttcttcggtcgctgcgcggctgggatcgcccaatgaatacgttgattacgcggcctcaaaaggtgcgctggatacgttcaccatcggtctgtccaaggaagtggcgggcgaagggattcgggtgaatgcggtgcgtccgggttacatctataccgatttccacgcgttgagtggcgaccccgatcgggtcagcaagctggagtcggcgatcccgatggcccggggcgggcggccggacgaagtggcggaggcaattgtctggttgctgtcggacaaagcctcgtatgccaccgggacttttgtcgatctcggcggcggacgt

SEQ ID NO: 37810 - DNA, 1662 bp, Pseudomonas fluorescens
atgtatgagtacgatgattacgaccgggcgctggtgttcgagcgcgttgcgcaatttcgcgatcaggtcgagcgcttcatggccggggagttgagcgaagaggaattcctgccgttgcgcctgcaaaacggcctgtacatgcaaaagcacgcgtacatgctgcgggtggccattccttacggcacgctgagtgccgagcagatgcgcacactggcaagcatcgcccgggactacgaccgtggttacggccacttcaccacccggcagaacatgcagttcaactggatcgagctgcacgaggtgccggacattctcgagcgtctggcgcaggtcaacatgcatgcgatccagacctcgggcaattgcgtgcgcaacatcaccaccgaagccttcgccggggtcgcggcggacgaactgatcgacccgcgtccgctggcggaaatcctgcggcaatggtcgacgatcaacccggaattcctgttcctgccgcgcaagttcaagatcgccatctgctcggcgaagcaggatcgcgcggcgatcatgatgcacgacatcggtctctacctttaccccggtcgtgacggccagatgctgctgcgggtgatcgtcggcggcggtctggggcgcacgccgattctcggtctgcaaattcgcgatggcctgccgtggcagcatttgctgtcctatgtcgaggcggtgttgcgggtctacaatcgccacggccggcgcgacaacaagtacaaggcgcggatcaagattctggtcaaggcgctgggcatcgaggcgttcgccaaagaggtcgaagaggaatggcaacacctcaaggacggaccggcgcaattgaccgaggatgaataccagcgcgtcgccagtgccttcgtgccgccgagctatcgcacattggcgggcaccgatctggatttcggcacgcatctggcggagaacccggcgttcgcccgctgggttgcgcgcaacgttcagccgcacaaggtgccgggctacaccagcgtggtgctgtcgaccaaaccgggcctggccgcgccgccgggggacgtcaccgatgcgcagatgcaggccgtggccgactggtccgagcgtttcggtttcggcgaaatccgcatcgcccacgagcagaacatcgtcttgcccgacgtgcccaagtccgagctgtttgcgctgtggcagcaggcgaaagagcaggggctgggcgccgccaatgtcggcctgctgaccgacatcattgcctgccccggcggtgatttctgtgcgctggccaatgccaaatcgatcccgattgcccaggcgattcaggcgcgtttcgacaacctcgattacctgcatgatctgggcgacatcagcctgaatatctccggctgcatgaacgcctgcggccatcaccacatcggcaacatcgggattctcggcgtcgataaaaacggcagcgagtggtaccagatcaccctcggcggcgcgcagggcaaaaacagcgcactgggcaaagtcatcggcccgtcgttcagcgccgccgaagtgccgcaggtgatcgagcggatcatcggcaccttcgtccgttatcgcgaggccgaagaacagttcgtcgagaccgtggcgcgcatcggactggagccgttcaaggagcgggtctacccgaaagcgctggag

SEQ ID NO: 37811 - DNA, 344 bp, Agrobacterium tumefaciens
gaaatgaacccgcgcgtttcccgctcctcggctcttggcttccaaggcaaccggcttcccgattgccaaggtcgccgccaagctcgctatcggctatacgctggacgagctggaaaacgacatcaccggcggcgccacgcctgcgtccttcgagccctccatcgactaccgtcgtcaccaagatcccgcgtttcgccttcgagaaattcccgggcgccttggcgatcctcaccaccgacatgaagtcggtcggtgaagtcatggccatcggccgtacctttgccgaatcgctgcagaaagcgctgcgtggcatggaaaccggcctcaccggtctcgatgaaatc

SEQ ID NO: 37812 - DNA, 729 bp, Agrobacterium tumefaciens
atgaagcgtaaccgcaaagtcaaaattcttgcaactctcggcccggcctcttccgaagaggccatgatcgaaaagctgcatcttgctggcgctgatcttttccggatcaacatgagccatgcgagccacgacgtgatgcggacgctcattcagcgtatccgctctgtcgaaagccgcaacggccgtcccatcggcattctggccgacctgcagggtcccaagctgcgcgtcggaaaattcgccgagacgaaggtcgatctggttccgggccagaccttcacgcttgataacaacgacacccccggcgacaacacccgcgttttcctgccgcatcctgaaattctcgaggcggtcaagcccggccaccgtctgctgatcgatgacggcaagctgcatctgcgcgctgaaaagagcgacggcaagagcatcgtcaccacggtcgtttccggcacccggatttccgaccgcaagggcatcagcctgcccgacaccctgctcggcgtcggcgttctgaccgacaaggaccgcgtcgacctcgatgccgttctcgagaccaacgaagtggactgggttgctctttccttcgttcagcgccctgaagacctggcagaagtgcgcaagatttcccgcggccgcgttggcctgatgtccaagatcgaaaagccgcaggctgttgaacgcatcgaggaaatcatcgagctttccgatgcattgatggttgcgcgcggc

SEQ ID NO: 37813 - DNA, 123 bp, Agrobacterium tumefaciens
ctggccatcgcccatcgcctgtcgacgattgccgctctcgaccggctgatcgtgatggatcaggggcttatcgtggaagaagggagccacgctgagcttgtcgcacagggggggctttattcg

SEQ ID NO: 37814 - DNA, 876 bp, Agrobacterium tumefaciens
  unsure (1)..(876): unsure at all n locations
gctcttgcagggctgcagatcccgatccgcacngacaatgcgcatggcgccgcccgcatcctcgagatcgacggttcggnatatcgttcatcgcatgggtgaggggcaggttgccgtggttgccggtttccagggcatcggcccggataatcgcatcgcgacgctcggccgcggcggctcggatacgtcggctgtcgccatcgccgctgccgtcaaggcggatcgttgcgatatctataccgatgtcgacggcgtctacaccaccgatccgcgcatcgagcccaaggctcgccgcatgaagaagatcgccttcgaggaaatgctcgaaatggcgtctctcggcgcgaaggttctgcaggttcgctcggtcgagcttgccatggtacacaaggtgcgcaccttcgttcgctccagtttcgaggatcccgatgcgccgggcatgggcgacctcatcaacccgcccggtactttgatttgtgacgaggatgaaatcgtggaacaggaagtcgtaaccggcatcgcctatgccaaggatgaagcacagatttcgctgcgtcgcgtcgccgaccgtccgggcgtctccgccgcgattttcggaccgctcgccgaagcgcatatcaacgtcgacatgatcgtgcagaacatctccgaagatggctcgcgcaccgacatgaccttcacagttccttcgggcgacgttgccaaggctctgcgcgttctggacgagaacaagggccagatcggcttcgacgtcgcgcagaacgaaacgggcctcgccaaggtttcggtcatcggtatcggcatgcgcagccacgccggcgttgcccgcagcgcgttcaaggcgctggccgagaagacatcaacataaggcgatca

SEQ ID NO: 37815 - DNA, 441 bp, Agrobacterium tumefaciens
tgccttctgccgcatggttatgaaggccagggcccggaacattcgtccgctcgtctggaacgctggttgcagatgtgcgccgaagacaatatgcaggtcgccaacgttacgacgccggctaactacttccatatcctgcgccgccagatgaagcgtgacttccgccagccgctgatcctgatgacgccgaagtcgctgctgcgtcacaagcgcgccacctcgtctctggcggaactggccggcgagtcctccttccaccgtctcctgtgggacgatgctgaagtcatcaaggacggcccgatcaagctgcagaaggatgcgaagatccgccgtgtcgtcatgtgcaccggcaaggtctattacgatcttctcgaagagcgtgaaaagcgcggtatcgacgacgtctacctgctgcgcgtcgaacagctttatccgttcccg

SEQ ID NO: 37816 - DNA, 835 bp, Agrobacterium tumefaciens
gaattcgccagcttctaccgcaccatgggcgtcgatgttaccgtcgtcgagatcatgagccaggtcatgccggtcgaagatgcggaaatctctgcctttgccaagaagcagctggaaaagcagggtatcaagattcatctggagaccaaggtttccaaggtcgagaaggccgcgaattccgttaccgcgacgttggagaagaaggacggttcgtccgagaagatcatcgctgagccggatgatttcggctgtcggcgtcgtggcgaatgtcgaaggcatcggccttgaggccgccggcgtgaagaccgatcgcggtttcatcatcattgacggttacggcaaaaccaacgtgcctggtatttacgccatcggcgatgtcgccggcccgccgctgctcgcccataaggccgagcacgaggccgtcatctgcgttgaaaagatcgctggtctgccgaatgtccatccgatggacaagctcaagatccccggctgcacctattgcaacccgcaggtcgcctcggttggtttgaccgaagccaaggccaaggaacagggccgcgacatccgcatcggccgtttctcctgtgcggcgaacggcaaggcggttgcgctcggtgaagaccagggcatggtcaagaccatcttcgacaagaagaccggcgaactgctcggtgcccatatggtcggtgcggaagtgaccgaactcattcagggcttcgtcgttgccatgaacctcgagacgacggaagaagatttgatgcacacgatcttcccgcatccgaccatttcggaatcaatgaaggaaagcgtgctcgacgcttacggacgtgtgctg

SEQ ID NO: 37817 - DNA, 635 bp, Agrobacterium tumefaciens
atggctcaaatgagtagcaaggttgccctggtcgtcgggggtgccaagggtatcggcttggcaattgcagagcggctttcagaggaaggggcgaaggtcttcatcaccagtcgtcgaagcgaagatgccgaaaaggcagcaacggctattggtcatggcgcgatcggtatcgccgccgatgccgcgatccccgaagatatggtggcgactgtcgaaaaagtgcgaaaggcacacggccgtatcgacgcgctcgtcttgaatgcgggtctttctgagcctgcgcagatcgccgagataactcctgaacatttcgaccgccacttcgacgtcaacgtccgcgggatggtcttcggcttccaggcggctctgcctgcaatgacggaaggcgggtcagtcgtccttgtcggatccattgctgatagtggcggctacgcttcctacggaacctacgctgctaccaaggcagccgtgcgttcctatgcccgaacctgtgacggcagagctcgcatccgtcggcatccgcgtcaacgtcgttgcacccggccctacagatacagaaatgatggctgcggttcagccagacatgcgcgcggccattgtcgctcctatcccgatggggccgatggcgcggcctt

SEQ ID NO: 37818 - DNA, 1349 bp, Agrobacterium tumefaciens
gaaaatggcggcatcatcctgttcatcgatgagatgcacaccctggtcggcgccggcaaggcgatggcgccaatggatgcgtccaacctgctgaaacctgcgcttgcccgcggtgagctgcactgcgtcggcgccaccacgctcgatgaatatcgcaagcatgtggagaaggatccagcccttgcccgccgtttccagcccgttctggtggatgaaccgaacgtcgaggatacgatctcgatcctgcgcggtctgaaggaaaaatacgaacagcaccacaaggtccgcatctcggattcggccctggttgcggctgcgacgctttccaaccgttacattaccgaccggtttctgcccgacaaggcaatcgacctgatggacgaggccgcttcgcgtcttcgcatgcaggtggattccaagccggaagaactggacgaactggatcgtcgcatcatccagctgaagatcgagcgcgaagccctgaagcaggaaacggaccagtcctccgtcgaccgtttgaggaagctcgaggacgaactggccgatacggaagaaaaggcagatgcgctgacggcccgctggcaggcggaaaagcagaagctcggccacgccgccgacctgaagaagcggctggatgaagcccgaaacgaactggcaatcgcccagcgcaatggccagttccagcgtgccggcgagttgacctacggcatcattcccggcctcgaaaaggaactggcagcggcggaagcccgcgatagcagcggtgccggttcgatggttcaggaagtggtgacgccggacaatattgcccatgtcgtctcccgctggaccggcattccggtcgacaagatgctggaaggccagcgcgaaaagctgttgcgcatggaagacgagctcgccaagtccgttgtcgggcagggtgaggccgttcaggcggtgtcaaggcggttcgccgttcgcgcgccggcctgcaggatcctaaccggccgatcgggtcgttcatctttctcggcccgacgggtgtgggcaagaccgagctgaccaagtcgctcgcccgcttcctgttcgacgacgaaaccgcgatggtccgcctcgatatgtcggaatatatggagaaacactccgttgcccggctgatcggtgcacctccgggctatgtcggctacgaagagggcggtgccctgacggaagcggttcgccgccggacctatcacgtcgagttgttcgatgagatcgaacaagcgcatgcggatgtcttcaacgtactgctgcatgtgctggatgatggctcgctgaccgatggccagagccgcaccgtcgatttcaagaacaccatcatcatcatgacc

SEQ ID NO: 37819 - DNA, 741 bp, Agrobacterium tumefaciens
ttctctctcgaaaaccgcaccgccatcatcaccggcagcggtcgcggcctcggtttcgaaatcgccaaaggcttcgccgaggcgggcgcccatgtctggctgaccggccgtaacgccgagacgttgcaacaggcggtcgacacgctgcgcaaggcgggcggaaaggccgattatgcagccttcgatattgccgacacggctgcaggaagcgcgcttgtccgccgcatcatggatgaggccggccatctcgatatcctcgtcaacaatgtcggcgcgcgcgaccgccgcccgcttgccgaatttaccgacgacgacgtgctggagctcatccgcaccgacctcacctcctccatctcgctgtcgcgtgatgcggctgaagccatgaatgccaacggttacggccgcatcatcaccatcacctccattctcggccatatcgtccggccgggtgatgcgatctatcccgtcgccaaacaggggctgaccgggctgatgcgggcgattgcagtggaatatggcgcgcgcggcatcaccagcaacgccattgcccccggcatgttcgccaccgaaaccaatgccgcccttgccgaaaaccctgacatggtggcctttgccaagctgcgcgtaccgctggagcgctggggcagacccgatgaaatcgccggggctgccctgtttctcgccagcgacgcggcctccttcgtcaacggccacatattgacggtggacggcggcatgtcg

SEQ ID NO: 37820 - DNA, 1354 bp, Agrobacterium tumefaciens
ccaaaacttgggttgcagtcggtggcgtggaacgaggcggtcaagatcaatggtgccgatcccgattttcaccggcgtgatctctggaccgcaatccagtcgggaaatttcccggaatgggagttgcaggtccagctcttcgatcaggatttcgccgacagcttcgatttcgacgttcttgatcctaccaagatcattcctgaagagatattggctccgaagcctgtcggccggctcgtgctcgaccgtatgccggacaatttcttcgccgagacggaacaggtggcgttcatgacacaaaacgtcccgccaggcatcgatttcagcaatgacccactgctgcagggtagaaatttttcctatctcgatacgcagttgaagcgtcttggcggtcccaacttcacgcatttgccgatcaagcgccaagtgtcctttcgcgcatttccagcaggacggtcacatggcgatgcgaaatccgacaggacgggccaattatcagccgaattcattcggggaaggccagcgggaatcgccgacgcgtggtttccagcatttcgcggctgaggagcagggggtcaaggcaaggttgcggccggaaagttttgccgatcactatagtcaagcacggcagttctacatcagccagacgccacccgaacaacgtcatatcgcatcggccctgactttcgaactcagcaaggtcgaaacggtggagattcgagagaggatggtttcacatcttcttaatatcgacgaaaccctcgctacgacggtggcgcagaagctcggccttcagacaatgccggagccggcgaatacggccattcctacccgtcaggatctggagccgtcgcccgcgctcagcatcgttgaacggggtcccaaacgcttcgaaggccgaaagcttggcattctcatcacggatggcgtggacgcaaaactgctgaaggggctgacccaggcagtaacagccgaaaaagccgtcttcgagttcatcgcgcccaaggtcgggggcgtaacggcgtcgaacggcacccttatcgaggcacatcacatgattgatggaggcccttcggtgcttttcgatgcggttgctctgctgacatcggaggcggccatcgctgagctgaccgaggaggcaactgcccgggatttcgttgcagacgcgttccagcactgcaaattcatcggatacgaccggtcagcgttgccgttgctggaaattgccggaattgccgacgccatggatgaaggcgtgctgcccttgcccggcgaggaagggcttgcggccttcgtggcagaacttgggaaattgcgtgtctgggctcgggaaccctcgctgaaactcggcaag

SEQ ID NO: 37821 - DNA, 555 bp, Agrobacterium tumefaciens
ggtcgggaagaggaaatcgccattctcttctgcgatctgcgcaatttcaccacgctgtcggaagcgaagctgccctatgatgtggtcttccttttgaaccgctacttcaccatcgtcggccaggccgtcgaacaggccgatggtcatctcgacaaattcatcggcgatggcgccatggccctttttggacttggcgaggatacggaccgggcctgccgcaacgccatgaaggcagccgcaaccatattgcgggatatcgccatcctgaacgaagggttggagaaacaattcgccgtccgcctggaagtggtggttggcattcactccggcccgagcatcgtcggcgtgatgggatatggcgcggcaaaaaccctgacagccataggcgataccgtgaatgtggcaagccggctcgaatccaaggccaaggaattcggcgccgccatcgtcgtttccgaaccggccatcatccaggcaggacaggatattgccgatctcagaagcgaaaacatcgccattcgcggacgaaactcgcagatgaaagtgtatctgctc

SEQ ID NO: 37822 - DNA, 684 bp, Agrobacterium tumefaciens
atcatgcgtggtcttcgcaccgtgcggcatctgtgtaaaatctgcgaggatatcctcgccgtctgccccaacgccgtcatgctgcaatatgtgaacccgatggcgatcaacacctgggcgattgccgagaaatacccgacgatccggcaggttggcctttgccattccgtgcagggcacggccatggaactcgcccatgatctcgatatcccttatgaggagatccgctatcgttcggccggcatcaaccacatggcgtttttcctcgaattcgagcatcgccagcccgacggcagctataggaacctctatcccgatctcgtgcgcggctaccgcgaaggccgtgcgccaaaacccggctggaacccgcgttgccccaacaaggtgcgttacgagatgctgacgcgactcggttatttcgtcaccgaaagctcggaacatttcgccgaatatacgccctatttcatcaaggaggggcgcgacgacctgatcgagaaattcggcatcccgctcgatgaatatccgaagcgctgcatcgaacagatcgagcgctggaaggggcaggcggcggcctatcgttcggccgagaagatcgaggttaagcaatcgaaggaatatgccttctccatcatcaactccgtctggactggcgaaccctccgtcatctatgggaaccagcgcaac

SEQ ID NO: 37823 - DNA, 1017 bp, Agrobacterium tumefaciens
  unsure (1)..(1017): unsure at all n locations
ttcaagcagcatagcgggctcgaagcggaaggttaccgcatcgctttttccaacgaagccgtcaccgtggaatattccgccgctgccggcctgcaatatggcctgacggttctggcgcagctgctgcatggcgcgcgcattgatccgaagttccgtttcccggcctccggcaccatcagcgatgcgccgcgttacagctggcgcggctgccatctggatgtctcgcggcaattttatccgaccgatgatgtgctgcggctgatcgatattctcgcatggctgcgcatgaaccgcttccattggcacctgacggatgacgaggcgtggcgtctcgaaatcaaggcttatcccntgttgaccaccgtcggcgcgacgcgcggtccggatgggccgcttctgccgcagctcggcaatggcgcggaaccggtttccggctattacacgcaggataatgtgcgcctggttgtggcgcatgcggcggcactgaatgtcgaaatcgtgccggaggtggatattcccggtcacagcaccgcggctcttgttgcctatccggagctgacggacgggcaggaagcgccggacagctatcgctcggggcagggatatcccaataacgcgctcaacccggccatcgagccgacctatgagttcctcggcatgattttcgacgagatggcggagctggtcccatcgccggtcatccatatcggcggcgacgaggttgcggatggctcgcggctcgctgcgtcactggccaatgcgctgttggacaaagaggggctggacggcaccctcagcatgcagtcttatgccatgaaacgcattcatgggatgctgcatgagcgcggtcgccagcttgccgggtgggacgaaggttaccatggcggcagcgtccatcccgccggaacattgctgatggcatggcagaagcccctagtcgggcttgagcctgcaaggccggggtttggcagggtgatgaccccgggtcatgtctattatctcgacatggtgcaggac

SEQ ID NO: 37824 - DNA, 714 bp, Agrobacterium tumefaciens
atgaaaaatcccttttcgcttgagggccgcaaggcgctcgtaacgggcgcgaatacggggcttggccaggcgattgcggtgggtcttgccgctgccggtgcggaggtggtctgcgccgctcgccgtgcgccggacgaaacgcttgatatcatcgcaaaagacggcggcaatgcgagtgcgctgctcatcgattttgccgatccgctggcggcgaaggatagctttaccgacgccggtttcgatattctcgtcaacaatgccggcatcatccgccgcgccgattccgtcgagttttccgaactcgactgggacgaggtgatggacgtcaatctcaaggcgctgtttttcaccacgcaggccttcgcgaaggagcttttggcgaaaggtcggtccggcaaggtggtcaatatagcctcgctcctgtcgtttcagggcggcattcgtgtgccgtcctacaccgcggcgaaacatggcgttgcaggtctcaccaagcttctggcgaatgaatgggcggcaaagggcatcaatgtgaacgctattgcacccggttacatcgaaaccaacaataccgaggcgctgcgcgccgatgcagcccgcaacaaggccattctggagcgtattccggccggccgctgggggcattcggaagacattgccggggcggcggttttcctgtcatctgcggcggcagattatgtgcatggcgctattctc

SEQ ID NO: 37825 - DNA, 411 bp, Agrobacterium tumefaciens
atgaatgccattgtttccatacggaatctgacaaaatcctacgcaaatggctttcaggcgctcaaaggcgtcagcctcgatattaaagagggggaaatccttgcccttctcggcccgaacggtgccggcaagacgacgctgatttccatcgtctgcggcctcgtcaatccgggggaaggttcggtgcttgtcggcggccacaatgtggtgaaggattttcggcagacccgcgcgcttatcggcctcgtgccccaggaactgacgacggacatgttcgagactgtgtggaacacggtcagcttctcgcgcggcctgcacgggcagaagaagaacccggcgctgatcgaaagcattctgaagtccctgtcgttgtgggacaagaaagacaacatgctgcgggaacttttcggc

SEQ ID NO: 37826 - DNA, 624 bp, Agrobacterium tumefaciens
gacctttccggtcggagggccgtcatcacgggcggcgctcgggggatcgggcgcgctatcgctgacggcttcttagaagtgggagctgatgtcgtctgcatcgaccgtggatgggaaagctctgacctcccggccgataaccggcagattgtcacggccgatcttagcgaccgcagcgacctgaagcgcggattcgatgaagctgtggagcgactggggggccagatcgatgtccttgtcaacaacgcaggcatctgggacgacacgccgtcgctccatatggagcttgagatgtgggacaggatcatcgaggtcaatctgactgcggccttcgcgctgagcaggcatgcagccaggctgatgcttccccgaggccgcggacgaataataaacattggctccatccgcagtctgaggggaggccacaatgcggctgcctatgcagccagcaagggagggatcgccttgctcactcagaccttgtcgaatgaatgggcaccttcaggactaagggtcaatgccatagcgcccggcgctatggtcaccgtcctgactgaaaagctgcgccacgatcctgaagtggtcacccgcttcatcgagcgcatccctgccagaagattggga

SEQ ID NO: 37827 - DNA, 964 bp, Agrobacterium tumefaciens
atggacactggcgaccgcgccgacttcagcggaacttctagatggcatgcaggctatgacgcgggaaaaccgctggcgcgacgtcaccgggcgtgtcgccgcttacgatgccgcagccgaaaagatcgaaacggtggaagtggaacggcctaatctttatgccacccgggcattttcactctcgaactggaggctgatcgccgccaactggctgtcttccaacgttctttcctattcgctggcattcattggttttgtgtcgctgctcggttttgccaccttcgtaatgctgcgcatgatggggcggcatcgatgaagagcgggatttcgaaaattgccggtattgtctgcctgtcggccatgatgctgtttgccggcctctccctcagccgcgcggcttcgatcccgacggacgcatgggctgcctataagggcgcgtttctcgatcccggtggccggatcatcgataccggcaacagcaatatcagccacagcgaagggcagggctatggcatgtggctcgccgtgcttgccgacaacctgtccgacttcgagctgatctggagcttcacccgcaccgaattgctggtgcgcgatgacgggctttccgcctggaaatgggatccgcgcaccagaccgcatgtcaccgacatcaataatgcgacggatggcgacatcctgatcgcctatgcgctggcgctggcggccgggcagtggaaccggcaggattatgccgaagcatcggcggccatcgcctccgtcatcctcaaaaagaccgtggtgcagcgtggcgggcgcacgctgcttctgccggccgccagcggttttggcgagggcgatcgggccgatgggccggtggtcaatccgtcctatctgattttcgaagcctttccggtgctcaatctcgtcgcgccgtcgccgctctggaaagcggtggcagatgatggggtggcgcagatcggcg

SEQ ID NO: 37828 - DNA, 1225 bp, Agrobacterium tumefaciens
ttcgtgccgaaatcgggccggctggcgcaagaccaggccgatgcacgctcgatgatgacgggcgcggatcgtcgacagctacaccaatatctcgacgatcaagctgttttcccatgcggggcgtgaggaaagatatgcgcgtgagggcatgaatgtgttcctcggcacggttcaccgccagatgcgcaagatttccggcttcaacatcctgatcgacctcaacaatgccgtggtgctgttttccacggcaacgcttgggctgtatttctggatgcagggttcggtgacggccggttcggtcgccatcgccatcagccttgccatgcgcgtcaacggcatgtcgcagtggatcatgtgggaagtcacgtcgctgttcgaaaatatcggcactgtctatgacggcatgtcgatgatgacgaagcctcatgatattgtcgacgttccgaaagcgcctgagcttgcagcgccgcagggtgcaatccattatgacaacgtccgcttccactacggcaagaacaagggcgtgatcgacgggctgacgctcgacatcaagccgggcgagaaggttggccttgtcggccgttcgggtgcgggcaagacgacgctgatgaacctgcttctgcgcttctatgatctagaaggcggcaggatcacgattgacgggcaggatatttccaaggtgtcgcaggacagcctgcgcgagctgatcggcgtcgtgacgcaggatacctcgcttctgcaccgttcgatccgcgacaacatcgcctatggccatcccgaggccaccgacgagcaggtgatcgcggcggcgaagcgggcaaacgcctgggacttcatcgaaacgcttgtcgacatgcatggtcgtcagggtctcgatgcccaggtgggcgaacgcggtgtcaagctgtccggtggccagcgccagcgcatcgcgattgcccgcgtcttcctcaagaacgcgccgatcctggtgcttgatgaggcgacctcggcgctcgatagcgaagtcgaggcggcgatccaggagaacctgttctcgctgatggagggcaagacggtgatcgcgatcgcccaccgcctttcgacgctgaccgaaatggaccggctcatcatcctcgacaagggccggatcgtggaggcgggcagccatgcggaactggcggcgatgggcggcatctatgccgacctgtggcggcgtcagtccggcggcttcatcgccgaccac

SEQ ID NO: 37829 - DNA, 729 bp, Agrobacterium tumefaciens
ctcatcaccggcgcgacgtccggtttaaaaaaggccacggcgcggcgtttcgtcaaggaaggctggaaggtcatcggcaccggccggcgggcggaacggctggaggcgctggcggctgaactcggccaggcctttcatggtatcgccttcgacatcaccgacgaggatgcgaccgaaaaggcgctcgcggctttgcctgatggtttcagggatatcgacattctcgtcaacaatgccggtctggcgcttggcaccgcgcccgcgccgcaggtggcgctgaaggactggcagaccatggtggacaccaacatcaccggtctcctgaacattacccatcatcttctgccgacgctgatcaagcagaagggcattgtcgtcaacctctcgtcggtggccgcccattacccctatttgggtggcaatgtgtatggtggcaccaaagccttcctgcggcagttctcgctcggtcttcgctccgacctgcacggcaagggtgtcagggtgacctcgatcgaacccggcatgtgcgaaacggaattcacgctggtgcgcaccggcggcaatcaggaagcctcggataatctctacaagggcgtcaatccgattacggccgacgatatcgccaatacgatctattgggtcgcctcgcagccgaagcatatcaacatcaacagccttgaactgatgcccgtcaaccagtccttcgcgggtttccaggtctatcgggaa

SEQ ID NO: 37830 - DNA, 777 bp, Agrobacterium tumefaciens
atggttgaactcgctctccccaagaattcccagatcagcgaaggcaaggtctggccgaagcctgacggtgccaagaatgtgcgcgaataccgcatctatcgctggaacccggatgacggtcagaacccgcgcatcgatacctattacatcgatgtcgatgattgcgggccgatggttctcgatgcactgctttacatcaagaataatatcgacccgacgctgacgctgcgtcgctcctgccgcgaaggcatttgtggttcctgtgcgatgaacatcgacggcaccaatacgcttgcctgcaccaagggtatggaagagatcaagggtacggtaaaggtttatccgctgccgcatatgcctgtcgtgaaggacctcgttcccgatctgtcgaacttctacgcccagcaccgctccatcgagccctggctgaagacggtgtctccgacgcccgccaaggaatggaagcagagccatgaggatcgtctgaagctggatggtctttacgagtgcatcctgtgcgcctgctgctccacctcctgtcccagctactggtggaatggcgaccgttatctcggccccgccgttctgctgcaggcctatcgctggctgatcgacagccgcgatgaggcaaccggtgagcgtctcgacaatctcgaggacccgtaccgcctttatcgttgccacaccatcatgaactgcgcacaggcttgcccgaagggcttgaacccggccaaggcgatcgcggaaatcaagaagatgatggtcgagcgttgcgtc

SEQ ID NO: 37831 - DNA, 1233 bp, Agrobacterium tumefaciens
  unsure (1)..(1233): unsure at all n locations
ctgcatcgacgcgatttgatcgaagaccgtgcgtttgtgaatggggcatgggtggagcgcgatcagatgttcgccatcgttgatcccgcgggaggcgatcacctcgccgacgtggcgtcctgcacgctcaatgatgtcgattttgcgatagacgcagccagcaaggctttcgccggctggcgcgatatgctgcctgttgatcgcggcgacattttgcgcaactggagtgcgcgcatgcgggagaatgcgcatgacctcgccacgatcatcagcgccgaacagggcaaaccgctggcggaatcacgcggcgaaatcgcctacgccgccaatttcctcgactggttcgcgagtgagggggagcgatcttacggcgaaacaattccaacccatctgaagggcagcaatctttccgtgcggatgcagccgatcggcgttaccgtcgccatcacgccatggaactttccctcagcgatgatagcgcgcaaggccggtgctgcacttgctgccggctgtacgatgatcgtcaaacctgctcccgaaacacctctgtcagcgctggcgctggcaagacttgccgaagagtccggcgtaccacctggcgtattgcaagttctgccgggagaagccgcaccccttgcgcgccgccttctggaaaataccgaggtgcgggcattttcctttacgggttcgaccgaggtgggacgaattcttctgacgcaatctgcggcgacggtgaaaaaagcatccttggagcttggagggcacgcacccttcatcgtcttcgcagatgcagatctcacagaggccgtcaaaggctgtctgggcgcaaaattcgccacttccgggcaggactgtcttgcggcaaaccgcatctatgtgcagcgcagcctttatccgcgatttgttgagcggtttgccgaggcgacgtccaggctgactgttggtcatggcctcgaaaccggtgtcgatatcggccccatgacgcggccgtccgtcgccgaaaagtgccgccagcaggttgcccaggcgctgtcggcgggtgcacggctcgtctgcggcggacaggacagtccgctcggcggcaacttcgtcacccncaccgtgcttgccgatgttaccgacgacatgctgatcgcccgcgaagaaaccttcggcccggtggccgccatcttgccgttcgatgacgaggcggaggtgatcccccgcgccaatgcaacagagatgggactggcg

SEQ ID NO: 37832 - DNA, 732 bp, Agrobacterium tumefaciens
atgtcgcaggcaaaacttctgtgcgacacgatgagcacgctggcggaatcccctgtttgggacgaaaggcgtcaggtgcttttctggtgcgatatcctcggcaaaacggtgcggtccgcagcgctcgagcccggccaatatcgcgaatggccgtttcctcacacggtgtcgagcctcgggcttcgtgaaaacggcgatctcgtcgtcgcctgcggcatggatatcgtcatcctcgatcctgatagcggcaggacacgtctcctccactccattccggcgccggagggcattccctgccggcttaatgacggccgtgttggccccgacggcgccttctgggtaggaaccatgcacaatgttccgctctcagagatgaagccttacggcgaactctggcggatcaccgcaacgagcgccaagcgcatgcagacggggctgacatgcccgaacggtctggctttctcccctgacggttccatcatgtggcagagcgattccgtgcagaaatggatacgcagacgcaatttctacagggtaaacggcctgttcgacgagggtgtgctggtagctcagatgacggaagaaaccggacggcccgatggcggctgcctcgacagcagcggcacctactacagtgcgggggtttccgccggcatgttgaatgtcttcgccgaagatggcggcaaacaaaccgccgcgataaagatgcctggtgccggcacccgacaatgc

SEQ ID NO: 37833 - DNA, 1089 bp, Agrobacterium tumefaciens
agcgcgcgagcggccggggccgatatcatcgatctcggcatgggtaatcccgaccttccgacccccaaggccatcgtcgacaagctctgcgaagtcgttcaggacccgcgcacccatcgttattcctcgtccaagggcattcccggccttcgccgcgcacaggccggctattatgcccgccgtttcggcgtgaagctgaaccccgatacgcaggtcgtcgccacgcttggctccaaggaaggtttcgccaatatggcgcaggccatcacggcaccaggtgacgtgatcctgtgcccgaacccgacctatccgatccatgccttcggcttcctgatggcgggcggcgttatccgttcgatgaatgtggagccggatgagagcttcttcgggcctttagagcgggcggtgcgtcactctattccaaagccgctggcgctaatcgtcaactatccgtcgaacccgacggcgcatgtcgcatcgctcgatttctacaaggatgtgatcgcgtttgcgaagaagcacgaaatcatagtgctctccgatcttgcctattcggaaatctacttcgacgacaacaatccgccgccttcggttctcgaagttcccggcgcgatcgacgttgcggtggagttcacctccatgtcgaagaccttctccatgcccggctggcgcatgggcttcgctgtcgggaacgagcggctgatcgcggcgctgacccgcgtgaagtcctacctcgattacggcgccttcacgccgatccaggtggcggcgacgcatgcgctgaacggtgacggttccgacatcgccgaagtgcgcagcgtctatcgccgccgccgcgatgtcatggtcgatacgttcggcaaggccggcttcgaggttccgccgccggcagcgacgatgttcgcctgggcgaagatcccggaaaaattccgccatctcggcagcctggagttttccaagcttctggtcgagaaggcagatatcgccgttgctcccggcatcggctttggcgaaatgggcgatgattacgtccgtcttgcgcttgtggaaaacgagcatcgaattcgtcaggcagcgcgcaatctgaag

SEQ ID NO: 37834 - DNA, 1290 bp, Agrobacterium tumefaciens
gtgcgctggcaatcctatatgcatgtggcgcggcaatcgctgacctttttccagaatgatttttccggccgcatcgtcaccaaggtctggtccggcgggcaggcggcgggcgatctcgtcacctcgctgatggaaagtgtgtggttcgtcggtatctattcggtttcaatgctgttcctgatcggcgggctggactggcggcttgcggttctcgtcgtcgtctgggtagcgatcttctcgctgctggcgcggtatttcgtgccgcgcatccgccatcattcaaaggagacggcggaagccgcctcgatgctgtcaggccgcatggtggatgcctatagcaatatccagacgctgcggctgttcgggcgcgacgacgccaatgatcgctacatgcgtcagggcttcgatattttccagacctcgacgatgaagtttacgcggttcatcaccggcgtgcgcgcctccatggcgctgctatcgggcgtgatgatcacctccatggcggcgctctgtatcgatttgtggctgtccggcaagatcagctccggtgcggtggctttcacgctggcgctggtactgcgcctcaacttcctgctcgggcggttgatgacgcagttcaacggaatcatgcgcaatttcggcacggtgcagaatgccgccgaattgatctcgcagccgatcggtctcgttgatgcgcccgacgcggcggtgcttgaggtcaagaagccgagcatccgttttgagaatgtcagcttccattacgggcgggcgaatggcgtcatcgacaatctcaacctcgagatcagggccggtgaaaaggtcggcatcgtcggccgctccggcgccggcaaatccacgctcgtcaacctgctcctgcggttttacgatgtcgagaaaggccgtatcctgatcgatgggcaggatatagcccgtgtcagccaggaatccctgcgcgcccatatcggcatggttacgcaggatacatccctgctgcatcgttctatcagagacaacatcatgttcggccgcacggatgccacagaagcgcaattgattgaggcgacgcgtcgggccaaggcggatgatttcatcacaaggctggaggaccagcgcggccgcacgggttttgacgcgcatgtgggcgaacgtggcgtgaagctctccggcggccagcgtcagcgcatcgccattgcccgcgtgatgctgaaggacgcgccgatcctcgtgctcgacgaggcgacctcagcgctcgattcggaggtggaggcggcgatccagagcaagctggac

SEQ ID NO: 37835 - DNA, 559 bp, Agrobacterium tumefaciens
atggatctgcgtctaattttcggtccaacttgcacaggaaagacgtcgaccgcggtagctcttgcccagcagactgggcttccagtcctttcgctcgatcgggtccaatgttgtcctcagctgtcaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattcttgagggaggatctatctcgttgctcaagtgcatggcgcaaagcagttattggagtgcggattttcgttggcatattattcgccacgagttagcagacgaggagaccttcatgaacgtggccaaggccagagttaagcagatgttacgccctgctgcaggcctttctattatccaagacgttggttgatctttggaaagagcctcgcccgaggcccacactgaaagagatcgatggatatcgatatgccatgttgtttgctagccagaaccacgct

SEQ ID NO: 37836 - DNA, 1024 bp, Agrobacterium tumefaciens
gacgctctcacatttgacgatgtgttgctgcaacccggacattccgaagtcatgccgggacagacaaatatcgccacccgcattgcccgcgatatcgatctgaacctgccgatcctctcttccgccatggatacggtcaccgaaggccgcctcgccatcgccatggcccaggccggcggcatcggtgtcattcaccgtaaccttacccccatcgagcaggccgaagaagtgcggcaggtgaagaagttcgaaagcggcatggtcgtcaatccggtcaccatcggccccgacgcgacgcttgccgaagcgcaggcattgatgaaggcgcacggcatttccggcattccggtggtcgaaaacggcggtgccggcggccacaagaatggccgcctcgtcggcattctcactaaccgcgacgtgcgcttcgcctccgatccgcagcagaagatctacgaactgatgacccgcgaaaatctggtcacggtcaaggaaagcagcgtcgatcagcaggaagcgcgccgcctgctgcacaagcaccgcattgaaaagctgctggttgtggacggaaagggcaattgcgtcggtctcatcaccgttaaggatattgagaagtcgcagctaaaccccaatgccaccaaggatgcgcagggccgccttcgcgccgccgccgccatcagcgtcgccgtgctgatgccatcgagcgcgccgaacgcctcatcgatgccggcgttgaccttctggtcgttgataccgcgcatggccattcgcagcgggttctcgatgccgtggcgcaggtcaagaagatgtcgaactcggttcgcatcatcgccggcaatgtcgcccctcgccgacggcaccaaggcgctgatcgatgccggtgcggacgccgtcaaggtcggtatcggccccggctccatctgcaccacccgtatcgtcgccggcgttggcgttccgcagcttgccgcagtcatggccgcagtcgaagcggccagcctcgccgatattcctgtcatcgccgatggcg

SEQ ID NO: 37837 - DNA, 984 bp, Agrobacterium tumefaciens
ccgtggaactcacctttgatgctgcttaccggaacgctcgccccgtgccttgcaatcggcaacacggtggtaatcaagccttccgaacacgcgactgcctccacactcgcgcttgcggaactgatcgtagaggcggggttcccggccggtgtggtcaatgttgtcactggcggtggcgcggtaaccggtgaggctttgacccgccacaacggtattgccaaattcgtcttcacaggtagcaccgcgactggtcggcgcatcgccgcgaacgcggcggccaacctggtgccatgccagatggaactgggcggcaaatctccgcatgtcgtgttctcggacgtcgacattgaaaagacggttaacggggtcgtctcgggtgtcttcgctgcagctggacagacctgcgttgcgggatcacgctgcttcgttgaagccaatatctatgatcggttcatcgaagcgctggtggagcgcacccgcaacatcaagctcggcgacccgatggatgacgcgaccgacatcggcccgctcgcactcgaaagccagctatcaaagctcgaggggtacgttgcctccggcgtccgcgaaggttcgcgcatcgcaatcggtggcaaacgtccgcaatcggaggaactgtcgaggggctggtacttcgagccgacggtgatggcggatgcaaccaacgacatgagcttcatgcgccatgagttgtttggcccgatggtcggggtcatgcccttttcctccgaagaggaaatgatctcgcttgccaacgatacgaattacggcctggcatcgggcatctggacgcagaacatcgatcgcgccatgcggttcgccaaccagatcgacgccggcaccgtgtggatcaacacctatcggtcggccgcttacatgtccgccaatggcggcttcaaggaaagcggttacggccgccgcggcggcttcgacgtgatgcgcgaattctctcgcgccaagaatgtc

SEQ ID NO: 37838 - DNA, 1083 bp, Agrobacterium tumefaciens
  unsure (1)..(1083): unsure at all n locations
gtcatcccatcgaaccgccggggaaccatggccatggcgctccgtcagccggcagnggtcgtgctgtcgatggcgccgtggaacgcgccggtcattctcggcgtgcgctccatcgccaccccgcttgcctgcggcaatacggttgtcatgaagacctcggaactttgcccgcggacccacgccctgatcatcgaagcggttgcctccgcaggactgccgaaaggcgtgctgaacgccatttccaacgcgccggacgatgcggcgaagatcgttgaaacgctgattgcccatccggcggtcagaagggtgaacttcactggctccacccgtgtcggccgcgtcattgcggaaacggcgggccgctacctcaaacccgccctgctggagcttggcggtaaggcgcccttcatcgtgcttgacgatgccgatatcgacgcggcggtcgctgccgctgcattcggcgcctacatgaaccaagggcagatctgcatgtcaaccgagcgtatcatcgtgcttgacagcattgccgatacattcgtcgaagctttcgcgaaaaaggccgccagcctgacggcgggcgatccgcgcgagggcaagacaccgctcggctcactggtcagtgccgaagcagcctcgcgtatccgggtgctggtcgatgacgccgtctccaagggtgcaaggcgggttgccggtggcggtggcgatggcacgatgcttgacgcgatcgccgtcgatggcgtcaccccggccatgcggctttattcggaggagagcttcggcccggtcgtatccatcatccgggccggcagcatcgatgaggccgtgagcatcgccaatgaaagcgaattcggtctttccgccgccgttttcggcagggaccaggcgcgggcgctttccgttgccgcgcggattgaaagcggcatttgccatgtcaacggcccgaccgttcatgatgaggcccagttgcccttcggcggggtcaaggcttccggttatggccgtttcggcggcacagcgggtatcgccgaattcaccgaattgcgctgggtcacgctgcaggacgggccgcttcactacccgatc

SEQ ID NO: 37839 - DNA, 361 bp, Agrobacterium tumefaciens
ctgatgtttcgcatcaccaaggagtttcacttctccgcctcgcatcagctgaaaagcctgccgtcagatcaccagtgcaaccgcctgcacgggcacaattacatcgtcgaagtggaactatcaggcgaagagctgaacgagcatggtttcgtgcgcgattatcacgagctggcgccgctgaagcgctacatagacgatcatttcgaccatcgccacctgaacgacgttctcgagccatgaccaggtgacggcggaatgtctgacaaagcatttctacgactggtgcaagcccagcctgacgcaaaccagccccgttcgagtgagtgaaaccaccaagacctggacgtaacaccggccatga

SEQ ID NO: 37840 - DNA, 1131 bp, Agrobacterium tumefaciens
atgatcctgaacgaagcccagcagcagatcagggacatggcccgcgatttcgcccgcgagcggctttcccccggcgctgccgcgcgtgaccgggaaagccggttcccaaaggacgaattgaaggaaatgggcgagctcggtttcctcggcatgctcgtctccgaggattatggcggatcggaaaccggtgccgtggcctatgctttagcgctggaggagatcgccgccggtgatggcgcctgttccactatcatgagcgtgcataattcggtcggctgcgtgccgatcctcatattcgggaccgaggagcaaaagcagcgattcctgccgaagctggctcctgtcgaatggatcggcggttctgcgctgaccgatccgcaggccggttccgatgcctccaacctcaagacccgggcgcggcgcgacggcgatcgctatgttctcgacggcgcgaagcagttcatcacatcgggcaagaacgacgatgtcatcatcgtttttgccgtcacagatgcggcggcgggcaaaaagggtatcaccgccttcatcgtgccgacggatacgccgggttacgaggtcatcagggtcgaagaaaaactcggcctgcattcctccgatacctgccagatcgccttcaccgagatggcggttccagtcgacttgcggctgggcgaagaggggcagggttaccgtatcgcgcttgccaatctggaaggcggccgcatcggcatcgccgcacaggccgtcggcatggcacaggcggccttcgaggcggctcgggactacgcccgcgaacgcaaggctttcgggcaggcgatcatcgagcatcaggctgtggcgtttcgtctggcggatatggcgacgcggattacggcggcgcggcagctggtgctgcatgcggcggcgctgaaggaagcgggtgagccctgtctttcggaggcgtcgatggccaaactctttgcgtcggaaatggccgaacgcgtctgctcggacgccatccagattcacggcggttatggctacatggcggattatccggtggagcggatctatcgcgatgtgcgcatctgccagatttacgaggggacaagcgatgtccagcgcatggtgatcgctcggaacctgtgagga

SEQ ID NO: 37841 - DNA, 294 bp, Agrobacterium tumefaciens
atgccagaggggagggcgactttacagccagaaacggtgcggtcgtttaggctgcgcgtggaatatcggtatctaaaccggttgagatccgcctgcatatcggtccatataggacgaagcagagatcgaagagccatggtcctttcactttccggcatcaagaaatcctaccagacagccgaaggcaatatcccggtcctgaacggcgtcgacctttcacttgaagcaggcgaaagtcttgccctgacgggggaatccggcagtggaaagagtacgcttttgcatctggccggc

SEQ ID NO: 37842 - DNA, 1452 bp, Agrobacterium tumefaciens
atgaccacttccggcgttcgcgtccgcatcgcaccttcccccaccggcgagccgcatgtcggcaccgcttacatcgcgctgttcaactatctcttcgccaagaaacacggcggcgagttcatcctgcgcatcgaggataccgacgccacccgctcgacgctggaatatgagcagaaggttctggaggcgctgcgctggaccggcctcacctggtcggaaggccctgacgtcggtggcccctacggtccctaccgccagtccgagcgcaagccgatgtactggccctacgccgaagaattgctggaaaaaggccatgccttccgctgtttctgcacgcccgagcggcttgagcagatgcgcgaagcgcagcgcgccgctggcaagccgccaaaatatgacggtctctgcctccacctgaaggctgaagaagtgaccacccgcgtcgccgccggcgaagccaacgtcgtgcgcatgaaaatcccgaccgaaggttcgtgcgatttccatgacggcgtttacggcgatgtctcgatcccctgggattcggttgacatgcaggtgctgatcaaggccgacggcatgccaacctatcacatggcaaacgtcatcgacgaccatctgatgaagatcacccatgtggcgcgcggcgaagagtggctggcttcagtgcccaagcacatcctgctttaccgttatttcggctgggaccagccgacgttcatgcatctttcgctgatgcgcaacgccgacaagtcgaagctttccaagcgcaagaacccgacgtcgatctcctattattccgcgctcggctacctgccggaagcgctgatgaacttcctcggcctgttcttcatccagatcgccgaaggcgaagagctgctgaccatggaagagctggccgcgaagttcgatccggaagcgctttcaaaggctggcgccatcttcgatatccagaagctggactggctgaacggccgctggctgcgcgaaaagctcacgcctgaggacttcattgcccgcacgctggaatgggcgatggaaaattcccgcctgaccgaaggcctgaagcttgcccagagccgcatttccaagctcggcgaattgccgaacctcgccggcttcctggtgtcgagcgatgttggcctgacaccggcttcgtttgccgggttgaagagcaaaccggaggaaatccacgaaatcctcaccacggttgccgccgacctcgaaaaaatgccggattggaacgttgaagccatcgaggccgaactgcgcgacattgccgaacgcacgggcaagaaactgcgcgtcgtcaccccgccgctcttcgtcgccgtctccggttcctcgcgctagctgccgctgtttgacagcatggcgctgctcggccgctccgtggtgcgccagcgcctgaaagtggcgattgccgttgtggccacgatggttggcagcgga

SEQ ID NO: 37843 - DNA, 810 bp, Agrobacterium tumefaciens
aacatgcgcgcgctcagatttcatgcagccaaggatttgcggatcgaagacattgccgagccgaaacggcctggcccgggacaggtcctcgtccgcaaccgtttcgtcggcatctgcggcaccgatctgcatgaatatagctacggcccgatcttcattcccaccgaaccgcatccttttaccggcgcccatggcccacagattctgggccacgaattcggcggcgtggttgaggcgatcggcgacggtgtgacctccgtcaacgtcggcgaccgcgtctccatccagccgctcatcatgccgcgatccggcgattatttcgctgatcgtggccttttccatctcagcacgcaactggcactggtcggcctcagctgggacggcggcggcatggcggaagccgcacttgtcaacgaatacaacgtccagaaaattccggacgagatgaccgacgaagaggccgcactggtggaaccctcggccgttgccgtttatgcctgtgatcgcggtggcgttaccgccggtaatagcgttctggtcacgggtgccggcccgatcggcatgttgacgcttctggcggcccgcgccgccggcgctacccagctttttgtctccgatctgaatgacgcccgcctcgagcttgcccgcaatgtcatccgtgatgtcatcaccatcaaccccaagcgcgataatgtcggtgatgtcgtccgctcggcaaccgaaggcaaggtcggctgcgacgtggcgatcgaatgcgtgggtaatgaacatgcgctcaaagcctgcgttgacgccgtgcgcaagcagggc

SEQ ID NO: 37844 - DNA, 987 bp, Agrobacterium tumefaciens
ggcggccggcgtcatgtgactgacgccactaatgcctccggtaccttgatctacaacatcgaagacaacgcctgggatgacgaattgctgtctatccttaacattccccgcgccatgctgccggaggtgctggactgcgctgccgatttcggcgtgacggataaggcgcttctcggtgcggaaattccaatcctcggtgtggccggcgatcagcaggccgccgttatcggcaatgcctgcttcgagccgggcatgatgaaatctacctatggcacgggctgctttgcccttctcaataccggcacagaccgggtggcatccaccaaccggttgctaacgacgattgcttaccgcctcgatggcgtgacgacctatgcgcttgaaggttcgatcttcattgccggcgccgccgtgcaatggctgcgtgacgaacttggtttcatctcggttgcgtctgaagtcagcgcgctcgccgaaaaggccgatcccaagcagcgggtttatctcgtgccggcctttaccggccttggcgcgccttattgggatgccgaggcccgcggagcgattttcggcctgacgcgcggtacgggacctgcggaatttgcccgcgcggcgctcgaaagcgttgcctaccagacgttcgatctcctggacgccatgcgcaaggactgggcgggtgacaatggcaagacggtgctgagggtggatggcggcatggtcgcttccgattggaccatgcagcggctggcggatattcttgccgccccggtcgatcgtccggtctttctggaaacgaccattctgggcgcagcctggcttgcggcctcccgcgccggcatctggccggaccgcaaggcctttgccgaccattggcgccgtgaccgccgcttcagccccgacatggaagaaagcgagcggaagaacgcgatcgcgggctggcgtgacagcgttggccgttgcctctcgaaacgggacaattgaggcgcg

SEQ ID NO: 37845 - DNA, 996 bp, Agrobacterium tumefaciens
gattgtgtcgttttcggcggcacgggcgatcttgccgagcgcaagcttctgccggccctttatcaccggcaggtcgaaggccagttcacggagccgacccgcatcatcggcgcgtcgcgttcggtcatgacccatgaggaatatcgcaaattcgcgcaggacgccctgaaggaacacctgaaggccggcgaatatgacgatgcgcaagtgaccctgtttctcaaccggcttttctacgtgcccgtcgatgccaagtccggcaatggctgggacgtgctggagaaactggtcgatgagggcaaggaacgcatccgcgcgttttatctggccgtcgcacccggcattttcggcgacatcgccgacaagatccgtgagcacaagctgatcacccgctcgacccgcatcgtcgttgaaaagccgatcggccgggatctcgcatccgcgcaggaactgaacgacaccatcggtcacgtcttcaaggaagagcagatcttccgcatcgaccactatctcggcaaggagacggtgcagaacctgatggcgctgcgtttcgcgcaatgcgctttacgagccgctgtggaattccgcccatatcgaccacgttcagatcaccgttgccgaagcggtgggtcttgaaggtcgcgccggttattacgacaaggccggtgcgctgcgcgacatggtgcagaaccacattctccagctgctttgcctcgttgccatggagccgcccgcttccatgaaatcggaggcagtgcgcgacgaaaagctcaaggtactgcgctcgctgaagccaatcgataccagcaatgtcgaaaagctgacggtacgcggccagtaccgcgccggcgcttccgcaggcggccccgtcaagggttatctggaagagctggaaggcggcgtttccaacaccgaaaccttcgtcgccatcaaggctgaaatcgccaactggcgctgggccggcgttcccttctacttccgcaccggcaaacgcct

SEQ ID NO: 37846 - DNA, 750 bp, Agrobacterium tumefaciens
ggaatattcagcgggcaagtggtcgtcgtcacgggcggatcgaccggcatcggcttttcagtcgccaaattgtttctggaaggtggggcgtctacggtctatgtgacgggccgcaattcggccaatctcgatgccgccgtcgccaaacttgggaagggggcaatcggcttcgtttccgacgttgcgaagctctccgacctggagcagctcaagagccgcttagaagcagacgggcggaaagtggatgtactggtcgccaacgccggcatcgcggagaataacgatcttggcgagacccacgaggcactttacgaccggatcttcgatatcaacgtgaagggcgtattctacacggtgcagactttgttgcccgtgctgcgcgacggcggttcgatcgtattgacggggtcgatcgtcggcaacaagggcatggaaaggctgagtgcttacaatgcctcgaaagcggcggttcggtcattcgcccgcagctttgccaatgacctgaaggggcgtggcatccgcgtcaatacggtcagcccgggtgttacccgcacgccgatcatggaaaatggactgaagatggacgatgaaaagatcgccggtttcaaggcctatctgaaggatgcggcaccgatcggccggatggccgaccccgacgaaattgccgaggcggtgctgtttctggcgtcttccaaggccagctatattaccggtgtggaactttccgtcgatggtgggctggcgcagatc

SEQ ID NO: 37847 - DNA, 1461 bp, Agrobacterium tumefaciens
cgccttcaccgcgaactcgaacttgccgcccgccgcaaagcgctggaggaagacaagccgttgctcgcagcggaatagggtgggcgccaaaccgcatcaggtgcaatcgcgatgctggacaaagcgttaaccttatcccataccacctgacgaaatttcgtaacggatcgaatccgttacgggcagatgttgtggtggagattgacgatggcactgaaggatgtggtggcgggcaagcggaacgaagagggtatcgcgtctgcgctcgcggtgctgaagcagcagctgggcgataagctccagacgggccaggcgtttcgcgagcagcatggccataccaccacctacctgaccctgcaggcgcccgacggtgtcgtttttgccgaaagcgccgatgatgtgaaggccgtggtaaaggcctgcgcgcaatacaaggtgccggtcattcccttcggaacgggatcttcgctcgaagggcaggtcaacgcgcccaatggcggaatatgcatcgatttcagccggatgaatcgcatcattgaggtgaatgccgaagatcttgacgtgacggtggagcccggcgtgacgcgcgaggatctgaatgtctatctgcgcgataccggcctgttctttccgatcgatcccggcgccaatgcttcgattggcggcatggcctcgacgcgcgcttccggcaccaatgccgtgcgttacggcacgatgaaggacaatgttctggccgtcaccgccgttgtcgccaatggtgaggaaatccgcactgcgcggcgcgcccgcaagtcgtccgccggttacgacctgacgcggcttttcgtgggggccgaaggcacgctcggtgtcatcacctcggtgacgctgcggctgcagggcattccggaaaagattaccggcggtgtctgcaccttcgacagtatcaaggcggcctgcgatgccgtcatcatgacgatccagatgggcgttccggtcgcccgcatcgaattgcttgacgaggtgcaggtgcgcgcctgcaatgcctattccggtctgaactatgcggaaaagccgacactcttcgtggagttccatggcaccgaggagacggcggcgctgcaatcgcagcagttcgccgagattgcagccgaatgcggcagcgtcgatttccgctggacgggcgatgcggcggagcgcaacaagctgtggaaggcgcgccacgacgcctattgggcgtcgcgggcgctggcaccacatctcgacgggctttccaccgatgtctgcgtgccgatttcacggctggccgattgcgtcgtggaaacgcagcgggatattgccgagaacggctttctggcgccgatcgtcggccatgcgggtgatgggaacttccatgtgcttattctgtttgatggcaaggacgccgaaagcgttgcgaaaacagaggcctttgttgcccgtctcaaccgccgcgccattgcc

SEQ ID NO: 37848 - DNA, 1011 bp, Agrobacterium tumefaciens
atgcaagcagattacgtcatcgtcggctccggctctgcgggctccgccatcgcctaccggctgtcggaagacggccgttattctgtcatcgtcatcgaagctggcggttcggatttcggccccttcatccagatgccggcggcacttgcctggccgatgagcatgaagcgctacaattggggttatctctccgagcccgagcccaatcttgacaaccgccgcatcactgcgccgcgcggcaaggtcatcggcggctcgtcctccattaacggccttgtttacgttcgcggccatgccgaggatttcaaccgctgggaggagcttggcgcgcagggctgggcctatgcggatgtgctgccctatttcaagcgaatggaacacagccacggcggcgaggaaggctggcgcggcacggatgggccgctgcatgtgcagcgcgggccggtcagcaatccgctgttccacgccttcattcaggcgggcgcacaggcgggctttgaactgacggacgactataacggctccaaacaggaaggtttcggcctgatggagcagactatccacaatggccgccgctggtccgccgccaatgcctatcttaaaccggcgctgaaacgcggcaacgtcacgctggtcaatgggtttgcccgcaaggtcatcatcgagaatggccgtgccgtcggcgtcgagatcgagcgcaggggtcgggttgaaaccgtaaaggccaatcgcgaggtcatcgtttcggcctcctccttcaactcgccgaaactgctgatgctctcaggcatcggccccgccgcgcatctgaaagacatgggcatcgaggtgaaggcggatcgtcccggtgtcggggccaatcttcaggaccatatggagttttatttccagcaagtctccaccaagccggtctcgctttattcatggctgccatggttctggcagggggttgccggtgcacaatggctgctgtcgaaaggcgggctcggtgcctccaaccagttcgaggct

SEQ ID NO: 37849 - DNA, 723 bp, Agrobacterium tumefaciens
atgccgaagcgccaagatatcaagtccatcctcatcatcggcgcgggaccgatcgttatcggtcaggcatgtgaatttgactattccggcacgcaggcgtgcaaggcgctgaaggaagagggttaccgggtcattctggtcaactccaacccggccaccatcatgaccgatcccggtcttgccgatgccacttacgtcgagccgatcacaccggaagtcgtcgccaagatcatcgccaaggagcgcccggatgcgcttctgccgaccatgggcggccagaccgcgctgaacactgcgctttctctcaagcgcatgggcgttctcgatcgctacaatgtcgaaatgatcggcgccaagcccgaagccatcgacatggctgaagaccgcgctttgttccgcgaggcgatggcccgcatcggccttgaaacgccgaagtcgatgctcgccaacgccactgaaatcaaggacgccgaccgcaagacgcacgaagccgcccgcactgaactcaaggcaaaactgtcaggcgcagagctggacaaggctctcgacaacctcgaaaaccagtggaacctcggcgagacggaccgcaagcagcgctatatcagccacgccatggccattgccgcgcaggccatcgacgtcgtcggcctgcccgccattatccgcccttccttcaccatgggcggcacaggcggcggcatcgcctataaccgctcggaattc

SEQ ID NO: 37850 - DNA, 888 bp, Agrobacterium tumefaciens
aaagccttcgtcgcgatcgtgacctgctttaacgatgacgagaccatcaactacgaagccacccgcgcgcaggttcgccgtcaggtgacggctggcaacaacatcatgtgcgcaggcaccaacggtgattttaccgctctcacccattccgaaaaaatcaggattctggaagaggttgtcgatgaagtcggcggaaaggtcgatgtcatcgtcaatgcgggcatgccggcaacattcgagacgctgcaacttgccaaggaattcgaccgcatcggcgtcaagggcattgccgtcatcacaccattcttcatcgcctgcacgcaagatggtctgattcgccacttttctacggtggcagatgaggtgaacacgccggtctatctttatgacattccagcgcgcacccagaaccacatcgaacccgaaacggcacgaaagctggcgacccatggcaatattgccgggatcaaggattccggcggcgcgcaggagacattggaagcttacttgcaggtctcaaaggaggtcgatggcttcgaggtctattccgggcccgatcatctcgtcctctgggcactgcaaaatggagccgcgggctgcatctccggtctcggcaacgcgatgcccgacgttctcgcaggcatcgtcaatggcttcaactctggagatatcacgtacgccgaacgccaacagtccgtctacacagctttccgcaccgatctctacgcccacggctttcctccagccatggtcaaacgcgcgctttatttacaggacccctctgtcggagccagtcggcagccagcattacttcccgatgcagaacaggatcaaaagattgaggaacccctcagaaaatatggccttctagtaacaaaggcgtgacaa

SEQ ID NO: 37851 - DNA, 1105 bp, Agrobacterium tumefaciens
  unsure (1)..(1105): unsure at all n locations
atgcggattcttgccgttacggccgaaatgtttcccttcgtcaaaaccggcggattggccgatgccacgagcgctttgccgcaggcgctggaacgaaaaggggctgacgttcggacattgctacccctctaccgcgggctcacgccgcttgtccgcggccggaagccggtcctggttgccaatattctggagcagccggtatcagtttattacgttgtttccgatggtcacaagcttctgcttcttgaagcggcaagcctgttcgacagagacggacatccctatggcgtaaaaggcgagccttttgctgacaacgatcttcgctttgcggttctgtccaaagtagcggcggaaatagccctcggcgcgattgacggctggcagccggatgttgtccatgtccatgattggcacgcggctctgacctgcgtctatctcgcggattcgacgccctcggtagcctccgttctaacccttcacaatctcgcatttcagggtcagtatccgctggagagggcgggtatgcttggactaccctcgcacctctgcactgtcgattgccttgaatattacgatgacatgtcatttttgaagggcggtctgacgaccgcgtcggcggtaacgacggttagtccaacttatgcaagagaaatccttacgccggaaatggggatgggaatgcatggcgtgctcgccaggcggcgaggggacctgcgcggcatcgtcaacggtgtcgatcacgacgtctggaatccggcaacagagccgaacactctcgcagatttcacggatgccgcggcgacaagccggagcctcaacatatatgccttgcttcaggccattgcgcctagcccctacccagggccctgtnttcggcgtggtcagtcgcctgacctggcaaaagggaatcgatctcctccctcacgtcgtaccccttataatactaaggaaaggcactctcatcgttcctgaagaggnagatacggcactggaagacagcttgcaggcgctagcaaagcgctatccggaactagtctgcgcccatatcggctatgacgaacggctggcgcacatgatccaggccggctcggatttcatcatccag

SEQ ID NO: 37852 - DNA, 870 bp, Agrobacterium tumefaciens
aatatcgcagcgggtgctgcgcgccttggattgaacagcgccgtcattacccgcgtgggtgatgagcatatgggccgcttcatccgcgagcagctggtgcgcgaaggcgtcgatgtgcgtggcgtgaagacagacccggagcgactgaccgcgctggttctgctcggcattcgtgaccagaaccagttcccgctgatcttctatcgcgagaactgtgccgacatggcgctcagcgaagacgatatcgacccggccttcattgccgacgccggctgcatctgcgccactggaacgcatctgtcgcatccgaacacggaagctgccgtactgaaggcgctgaagctcgcccgtgaaaacggtgcaaagaccgcactcgatattgattaccgtcccaatctctggggtgttgccggccatggcgatggcgaaagccgtttcgtcgaatcgcagaaggtcactgccaagctgcaatccaccctgcatctctttgacctgatcgtcggcacggaagaggaattccacatcgccggcggctccaccgatacgctgaccgcgctcaacgccgtccgcaaggtctcgaatgcgacgctggtgtgcaagcgcggcccgatgggcgcttcggtcttcaccggcgatattcctgatagcctcgacgatggagaaacgggcgaaggtttcccgatcgaggtcttcaatgttctcggtgcgggcgatggtttcatggccgggctgttccgcggctggctgcgcggcgaggactggccgacgacactgaaatatgccaatgcctgcggcgctttcgcggtctcccgccatggctgcacgcctgcctatccgagctgggaagagctgcaatatttcttcaaggcc

SEQ ID NO: 37853 - DNA, 645 bp, Agrobacterium tumefaciens
  unsure (1)..(645): unsure at all n locations
gaaagcgaaattcaggcacggctgctcgcgcaggctttgccctttatgcagaaatacgaaaacaagacaatcgtggtgaaatatggcggtcacgccatgggcgattccacgcttggcaaggctttcgcggaagatatcgccctgttgaagcagtccggcatcaaccccatcgtcgtccatggcggcggcccgcagatcggtgcgatgctgtcgaagatgggcattgaatcgaaattcgagggcggcctgcgcgtcaccgatgccaagacagtcgaaattgttgaaatggttctggccggctcgatcaacaaggaaatcgtcgccctcatcaaccagacaggcgaatgggccattgggctgtgtggcaaggacggcaacatggtcttcgcggaaaaggcgaaaaagaccgttatcgatcccgacagcaatatagagcgcgtgctcgatctcggtttcgtcggtgaagtcccccccccgaccgcaccttgatagatatgcttgccaaatcggagatgatcccggtcatcgcgcccgtcgctcccggccgtgacggcgccacctacaacatcaatgccgatactttcgccggcgccattgncggtgcgttctacgccaccgcccctcctgctcctcacggatgtgcct

SEQ ID NO: 37854 - DNA, 948 bp, Agrobacterium tumefaciens
tccaaactcgaacaacttcgcgccatcaccacggtcgttgccgataccggcgacatcgaggcggtagcacgcctgaagccggtggattgcaccaccaacccgaccatcgttctcaaagcgctcggcacgccggcctttgccgatgcggtgaaggaagctgtcgcctggggcaggaagcagggcggccagtccgacgccgtcgttgccgccgttgccgaccgtctggcgatttccgtcggtgcagctcttgccggtctcgttcccggccgtgtgtcgaccgaggtcgatgccgacctgtccttcgacacgcaggcttccatcaccaaggcacgccacatcatcgcctcctataaggagcgcggcatcgagcgtgaacgcatcctcatcaagctggcctccacatgggaaggcatcaaggctgccgaagttctgcagtccgaaggcatcgactgcaacctgacgctgctgttctcgcaggcacaggcgattgcctgcgccgaagccaaggctttccttatctcgcccttcgtcggccgtatcctcgactggtacaagaaatcgaccggcgagacctacactgccgagacagatccgggcgtcgtttcggtgcgcagcatctacaattattacaaggcgaatggcatcggcaccgttgtcatgggcgcctccttccgcaatgttggcgaaatcgaagcgctggccggttgcgaccgcctgacgatcagcccggcgctgctcgaagagctggacaaggacaatggcaagctcgagcgcaagctttcgcctgacaatgtcaaggccgaggcgctgcagtcgctcgatgaaaaggcgttccgctgggcgatgaacgaagacgcgatggcaaccgagaagctttccgaaggcatccgcctgttcgccaaggatctggttacgctgcgcgagatggtccgcaaggagctgacggcc

SEQ ID NO: 37855 - DNA, 672 bp, Agrobacterium tumefaciens
atcatcgcagagattgatggtacgatccgcctcggccgcgactacaagaacaagcgtcgcgtgatgatcgagcctgcggaagacggcgtcgagccggtcgaatacctgatcccgaagggcaagcccttccatcttcaggaaggcgactacatcgagaagggcgaatacattctcgacggcaacccggcaccgcacgacattctggcgatcaagggtgtagaggctctggcttcctacctcgtgaacgaaatccaggaagtctaccgactgcagggcgttgtgatcaacgacaagcacatcgaggtgatcgttcgccagatgctgcagaaggtcgagatcaccgatgctggtgacagccagtacatcgttggcgacaatgtcgaccgtatcgagatggaagacatgaacgaccgtctcatcgaagagggcaagaagcctgcttatggcgagccggttctgctcggcatcaccaaggcttcgttgcagacgccgtccttcatctcggccgcatccttccaggaaaccaccaaggttctcacggaagctgcgatcgccggcaagacggacacgctgcagggccttaaggaaaacgtcatcgtcggccgtctcatcccggccggcaccggcggcaccatgacgcagatccgccgcatcgccacctcgcgcgacgac

SEQ ID NO: 37856 - DNA, 507 bp, Agrobacterium tumefaciens
ctgctagaggccatgcgccatggcgtgctgaacggcggcaaacgcctgcggccttttcttgtcatcgagagtgtcgcccttctgggcggagatgccgaagccggcctccacgtcggcgcagcactcgaatgcctccattgttattcgcttgtccatgacgatctgccagccatggacgacgacgacctgcgccgtggccagccgaccgtgcaccgcaaattcgacgaggcaaccgccatcctcgccggtgacagcctgctgacgcttgctttcgacataatcgcctcggatgacaatccgctggcggccgagcgcaaggccgccctcgttatctcgctcgcgcgtgccgccggtattggtggcatggctggcgggcaggcccttgatctcgctgccgaaaagaaagcgcccgacgaggatggcattattacattgcaggctatgaaaaccggtgccttgctgcgtttcgcctgtgaggccggcgcgatcattggcggcagcaatcaa

SEQ ID NO: 37857 - DNA, 639 bp, Agrobacterium tumefaciens
gtcgcatcgcagaacaaggccgaagccgcgcagaacgccggtcgcttcactgacgagatcgtggctttcacggtaaagggccgcaaggccgatatcgtcatcgatgcggacgaacatatccgtcatggcgcatcgctcgaaaccatggccaagctgcgtcccgccttcgacaaggaaggcacggtcacggccggtaacgcctccggcctgaatgacggcgcagccgccacgcttctcatgtcggaacagcaagcggcaaagcgcggcatcaaaccgctagcgcgcatagcctcctgggcaacggccggcgttgatccgcagatcatgggcaccggtcccatccccgcctcccgcaaggcgctggccaaggccggctggtcgatcaacgatattggccttgtcgaggccaacgaggcctttgccgcccaatcctgcgcggtcgtgcgcgagctgggccttaaccctgacatcgtcaacgttaatggcggagcgattgccatcggccatccgatcggcgcttccggcgctcgcgtcctgaacacgctgattttcgaaatgcgtcgccgcaacgtatcgaggggtctcgcaacgctctgcatcggcggcggcatgggtgtcgccatgtgcatcgaggcgctc

SEQ ID NO: 37858 - DNA, 1710 bp, Agrobacterium tumefaciens
tgtcccgtcatgcatggaggcaatacggcctccggcaaatcggtgaccgaatggtggccgaacgcgctaaacctcgacatcctgcatcagcacgacaccaagaccaatccgctcggcacctccttcaactaccgcgaagcgctgaagacgcttgatgtcgaagccctcaaggccgatctgcgcgcgcttatgaccgacagccaggaatgggggccggccgactggggcagttatgtcggcatcactcgcccgtgttacctggcatgccgccggttcctatcgtgtcacagacggtcgcggcggcgccaataccggcaaccagcgttttgcaccgctcaattcctggccggacaacgtcaacaccgacaagggccgccgcctgctgggccgcatcacgcgcactacggcaacaagatttcctgggccgaccttatcgcgctcgccggcacgatcgcctatgacgtcgcgggtctgaagaccttcggcttcgccttcggccgcgaagacatctgggcgccggaaaaggacacctattggggtgacgaaaaggaatggctggcgccgagcgacggccgttatggcgacgtgagcaagcccgagacgctggaaaacccgcttgccgccgtgcagatgggcctgatctacgtcaacccggaaggtgtcaacggcaagtccgatccgctggcgacggcggcgcagatgcgcgaaacctttgcccgcatggggatggatgacgaggaaaccgttgccctgacggccggcggccacaccatcggcaagtcccatggcaatggcagtgctgccaatctcagccccgatccggaagctgctggcccggaatatcagggtctcggctggatcaataccaagggccgcggcattggccgtgacaccgtggtgtcgggtatcgaaggcgcatggacaagcgaaccaaccaagtgggacaacggcttcttcgacatgctgttcaagcacgagtggaccctgacgcacagccccgcgggtgcatcgcaatgggcgccgattaccatcgccgaagaagacaagcctgttgatgtcgaggatgcgtcgatccgcaccatcccgatgatgaccgacgccgacatggccctgaaggtcgatccgatctaccgcgagatttcgctgaagttcaaggacgatcaggaccatttctctgatgtcttcgcccgcgcctggttcaagctgacgcatcgcgacatggggccgaagtcccgttacgtcggcccggatgttccggctgaagacctgatctggcaggatccgatcccggcaggctccacgagctacgatgtcgctgccgtcaaggctaagatcgctgcctccggcctttctgtcgccgatctggtttcaaccgcatgggacagtgcccgcaccttccgtggttcggacaagcgcggcggcgccaatggcgcgcgtattcgtctcgcaccgcagaaggattgggaaggcaatgagcccgcccgtctttcccgcgtgctttcggttctggagccgattgcccgcgaaaccggtgcaagcatcgccgatgtgatcgttctggctggcaattacggcgtggagcaggcggcgaaagcggctggtttcgatatcgccgtgcccttcgcggccggtcgtggtgacgcttccgccgagcagacggatgccgacaggtttgcgccgcttgagccgctggcggatggtttctttaga

SEQ ID NO: 37859 - DNA, 1056 bp, Agrobacterium tumefaciens
tctaaagagattgatcgcaacgaccgcttcccgcgtcagctctggccgcaaatgggtgagcttggcctgcacggcatcaccgtttcggaagagtttggcggtgccgatatgggttatctcgcccattgcgtggcgatggaggaaataagccgggcttccgcttccatcggcctttcctatggcgctcattccaacctctgcatcaaccagattcaccgctggggaaccgatgagcagaagcacagatatctgccgaaactcgtctccggtgaccatgtcggttcactcgccatgagcgagacggaagccggttccgacgtcgtatcgatgcggctgaaggcggaacgcaagggtgaccgttacgtactgaacggcgcgaagatgtggatcaccaatggccatgaagccgatacgctggtggtttatgccaagacggacatgtccgccggtgcgcgcggcatcaccgccttcctgatcgaaaagggcttcaagggtttccgcccggcccagaaactcgacaagctcggcatgcgcggctcgcccacatcggaactggtgttctaggattgcgaggtgccggaggaaaacatactcgggcgtttgaatgacggcgtgacggtgctgatgagcgggctggattacgaacgcgccgtgctggccgccggccctgttggcatcatgcaggcggccatcgatctggtgctgccctatgtccgcgagcgcaagcaattcggcaaggctatcggcgagttccagctggtgcagggaaagcttgccgatatctattcggccatgaatgcatcccgcgcctatgtctatgccgtggcccgcgcctgcgacaatggccgtatcacaagacaggatgcggcgggcgcgattttgtttgccgccgagcgggcgacacaggtggcgctggatgcgatccagcttctcggcggctccggttatgtcaatgaaagcccggccggacggctgctgcgcgacgccaagctttatgagatcggcgcaggcaccagcgaaatccgccggatgctgatcggccgcgaactggtcaag

SEQ ID NO: 37860 - DNA, 1227 bp, Agrobacterium tumefaciens; identical to SEQ ID NO: 35326

SEQ ID NO: 37861 - DNA, 636 bp, Agrobacterium tumefaciens
aagaaaattcggaaggccgtatttccggtcgcaggtctcggtacacgtttcctgcccgccaccaaggcagttccgaaagaaatgctcaccgtcgtcgacaagccggtcattcagtacgttgtcgatgaggcggcggaagcgggtatcgagcattttgtatttgtcaccggccgcggcaaggcagtgatcgaagattattttgatattcaatttgaacttgaacagatgctgcgcgagcgcaacaagaatgccgagctgacattgctggccggccttctgcccaaggcgggcacggcaagcttcacgcgccagcaggtgccgctcggtctcggccatgcggtttggtgtgcgcgtgatatcgtcggcgatgagccttttgccgtgcttttgcccgacatgatcatgcattcgcaaaaaagctgcctgaagggcatggtcgaactttacgaccagacccagggcaacgtcatcgcggtgcaggaatgcgctcccgaccagacgcataaatatggcattgttggcgtgggaaatgccgtcggcgaaggcttcaagattaccgaaatggtcgaaaagccagccaagggtacggcgccgtcgaatttctacatcaacggtcgttatatcctgcagccggaa

SEQ ID NO: 37862 - DNA, 1248 bp, Agrobacterium tumefaciens
gacatcaaccttgccgcattcggccgcaaggaactggacatcgccgaaaccgaaatgccgggcctgatgtcctgccgcaaggagttcggtgaaagcaagccgctgaagggcgcacgtatcaccggctctcttcacatgacgatccagaccggtgttctcatcgaaacgctcaaagaactgggcgcggaaatccgctgggcctcctgcaacatcttttcgacccaggaccatgcggcagcggccattgcagcagccggcattccggtcttcgccgtcaagggtgaaagcctgacagaatattgggaatataccgacaagatcttccagtggaccgatggcggcctctccaacatgatcctcgatgatggcggcgatgccaccatgtatatcctgcttggcgcacgcgccgaagccggtgaggatgtgctttccaatccggggtcggaagaagaggaaatcctcttcgcgcagatcaacaagcgcctcaaggcttcccccggctggttcaccaagcagcgtgatgcgttgaagggcgtgacggaagaaacgacgaccggcgttcatcgtttgtacgatctcgccaagaagggcctgctgcccttcccggccatcaacgtcaacgacagcgttaccaagtcgaagttcgacaacaaatacggctgcaaggaatcgctcgtcgacggcattcgccgtgcaaccgacgtgatgatggccggcaaggttgccgtggtctgcggttacggcgatgtgggcaagggttccgcggcctcgctgcagggtgccggcgcccgcgtgaaggtcacagaaatcgaccctatctgcgcacttcaggccgcgatggacggtttcgaggtggttcgcctggaggacgtggtttcctccgccgatatcttcatcaccaccaccggcaacaaggacgtgatccgcatcgagcatatgcgcgagatgaaggacatggccatcgtcggtaacatcggccacttcgacaatgaaattcaggtcgcctcgctgcgtaacctgaagtggacgaacatcaagccgcaggtcgacatgatcgagttcccgaagggcaaccgcatcatcctgctttccgaaggccgcctgctgaaccttggcaacgctaccggtcacccgtccttcgtcatgtcggcatccttcaccaaccaggtgcttggccagatcgagcttttcaccaagccgggtgaatacaagaacgaagtttacgtgctgccgaagcacctcgatgag

SEQ ID NO: 37863 - DNA, 403 bp, Agrobacterium tumefaciens
gaggaaatcatcgccgcggccaaggcggcaaacgcacatgatttcatcatgaacatgcctgatggttacgacagccaagcttggcgaaaacggctccggtctgtctggtggccaaaggcagcgcgttgcaatcgcccgcgcgatgctaagagacgcagacatattgatcctcgacgaagcaacaagcgcgctcgattcggaatccgaagcgcttgtccgggacgcgcttgagcgtttgacgcttaacaagacatccattgtcattgcccaccggctctctacaataaaccgggccgacaagattgtcgttatggataatggtcaggttgtggagcaaggaagccgtcgcgagttgctcgccacggatggtctctacaagcgcctgcacagcatccagttcgat

SEQ ID NO: 37864 - DNA, 1050 bp, Agrobacterium tumefaciens
gtcgcgaccattgccgcaaagcatgctgatgacgtggatgtcaccggccgcttcccgcaggaagccgtcgatgccttgcgccgcgaacgtctcctcggcattcaggtgccctcctcactcggcggcgaaggcgcctccattcaagagatcgccgatatctgcgcccggctcggccaggcctgttcggcaaccgcaatgattttcgccatgcaccacatcaagctgtccagcctggtggaacatggggtcgacagcacctggcatccgggttttatgcgccgcgttgccggcgaacagctactgctcggctccgcgaccaccgaaggcggcattggcggcaatctgcgcaactctatctgcgcgatcgaggtcgaaggagacagctgtcggctggaaaaggatgccaccgtcatttcctacggcagcaatgccgatgcgatcctcatcacctcacgcgcccacaaggatgccgcacccgccgatcaggtgatgaccgtcttcctgaaaaatcagtacacgcttgaaaagacccatgtctgggatacgctcggcatgcgtggcacctgttcggacggtttcctgtttcgcggcgaagcgccggcggcacagattttcccgaagcctttcgcggaaatcgccgcgcaatccatgcttgcaagctcgcatctcctgtggagcgccgtctggtatggcatcgcctcggacgccgtgctgcgcgcgcaatcctttgtcagagccgcggcgcgcaaatcgcccggcaccgcccctcccggcgcaatccgccttgccgaggtttccaccaaactgcaggtggtcaaatccaacatcatcgccggcatcaaggcctacgaggacaccaagagcgatcccgaaaagctgatgtccatggccttcgcggtggcgatgaacaatgtgaaaatctgctcttcggaaaccattcttgagatcatcgatcacgccatgctggtctgcggcatcatgggctacaagaacggcacgccctatagtctcggccggcatctgcgcgacgcgcattccgcccggctaatg

SEQ ID NO: 37865 - DNA, 981 bp, Agrobacterium tumefaciens
atccgtgccgccatcggcacaccgaacgccgaccgcctgcgcatggtcgcacaggcgatgcgcatgggaatgagcgaagaagaggtccacgaaaactcgaagatcgatccgtggttcatcgcccagcttaaggccatcgtcgacatggaggcccgcattcgcgagcatggcctgccgcaggatgccgaaaacctgcgcatgctgaaagccatgggcttctccgacgcccgcctcgccagcctgacgtccaagcgcccgaaggaagtggccgagctgcgtaacagcctgaacgttcgcccggtcttcaagcgcatcgacacctgcgctgcagagttcgcttcgcccactgcctacatgtattcgacctatgagacgcccttcgtcggcgctgcccgctcggaagcgcaggtttccgaccgcaagaaggtcgtcattctcggcggcggtccgaaccgtatcggccagggtatcgagttcgattattgctgctgccacgccgccttcgccctgaaggatgccggcttcgaagccatcatgatcaactgcaacccggaaaccgtttcgacagactacgacacctccgaccgcctctatttcgagccgctgacggccgaagacgtgatcgagatcatgcgcgccgagcaggaaaagggcgagctggtcggtgtcatcgtgcagttcggtggccagacgccgctgaagctcgccgaagcgctggaaaagaacggcatcccgatccttggcaccgcgcctgacatgatcgaccttgccgaagaccgcgaccgcttccagaagctgctgatgaagctcgatcttgcccagccgaacaatggcatcgcctattcggtcgagcaggctcgcctcgtcgcctcggaaatcggtttcccgctggtcgtgcgtccgtcctacgtgctgggtggccgcgccatgcagatcatccattcggaaggccaactccagacctatctgctcgacaccgtt

SEQ ID NO: 37866 - DNA, 906 bp, Agrobacterium tumefaciens
gtccgcaacgactggcacaatgccgtttccccgatcgttccgagccacgatatcgccggtgtcgtagccgggccgttggttccaggtcacgccggttcaaggtcggcgaaccatgtcggcgtcggctgctttgtcgattcctgcgttggctgcgccacccgcgatgtcgacaatgagcagtatatgccgggtctcgtgcagacctacaattccgttgaacgggacggcaagagcgcgacccagggcggttattccgaccatatcgtggtcagggaagactacgtcctgtccatcccggacaacctgccgctcgatgcctccgcgccgcttctctgcgccggcatcacgctctattcgccgctgcagcactggaatgcaggccccggcaagaaagtggctatcgtcggcatgggtggccttggccacatgggcgtgaagatcggctcggccatgggcgctgatatcaccgttctctcgcagacgctgtcgaagaaggaagacggcctcaagctcggcgcgaaggaatattacgccaccagcgacgcctcgacctttgagaaactcgccggcaccttcgacctgatcctgtgcacagtctcggccgaaatcgactggaacgcctacctcaacctgctcaaggtcaacggcacgatggttctgctcggcgtgccggaacatgcgatcccggtgcacgcattctcggtcattcccgcccgccgttcgctcgccggttcgatgatcggctcgatcaaggaaacccaggaaatgctggatttctgcggcaagcacgacatcgtttcggaaatcgaaacgatcggcatcaaggacgtcaacgaagcctatgagcgcgtgctgaagagcgacgtgcgttaccgcttcgtcatcgacatggcctcgctcgacgct

SEQ ID NO: 37867 - DNA, 1047 bp, Agrobacterium tumefaciens
  unsure (1)..(1047): unsure at all n locations
ttgcagatgtcggataagaaatttcgtgtgggtattattggagcagacactcacgcaagttgggcaggcgcatcgcatgtgccagctctggcgtcacaagctcacctgacgctggcggcagtcgcgacccggcgcgaggaaagcgccagggcggcggctgaagcattcggcgcagagctatggtttgccgatccctacgcgatgatcagtgataaaaccattgacgtcatcacggtcgccgtgaaggtgccggcgcacaagaatctcgtgatggccgccttgcacgcgggtaaagccgtctattgcgaagcgcctctaggcgcaacgctggcggaaacaaacgagatggccgcagcggtcgggtctttgcataccgcgatcggcttgcaaggtcggcataatcctgccgtccgacgagcggcggaactagtcgcgtcaggaaagctgggtcgcttgatgtccgcccgtgtcggcgcaaccacattcggctacggtccgcaatctccgagcatgtacgactatttcaacaaggccgcttctggcgccagtttcatgacgatcacggcaggccacgtgctggacgtcatcgaggctgtgctcggcaacattaccgaggtcgatgcgcgcacggagttgctctggccggagatcgagatcgtcgatacaggcgaaacttcacagcgagaaattccggatcatctcgatctgatcgccaagacggcaagcggtgcgcctgtatctgtgcaggttctggcgggcgtgcctgcagatgaggcgagtgttgtattcgagatcccgtgttcccggggctggctgaagctaaccggcaatcatctggcaggcgtacaagtcggagacattttactttcatcgagcgtggaattcgctgcgcccgatagaccggtcgccaacggtgtcggtccgaccgcggccgaattctggtcaggcgccgctatcaatgtcggngaggtctatgcgtccctggggcgcgatttgaggaatggtacatataccactcccggtttcgaccatgcccgccataacagc

SEQ ID NO: 37868 - DNA, 714 bp, Agrobacterium tumefaciens
gctctaaagacgccgaatggccagaaggtctccatcatgctggaagaattgctggccgccggccacaagggcgcagactatgatgcgtggctgatcaagatcggcgaaggcgaccagttcggctccggttttgtcggcgtcaatccgaactccaaaatcccggcactgatggatcactcgacgcctgagccgacgagggttttcgagagcggctcgatcctcgtttatctcgcggaaaaattcggcgctttcctgccgaaagagggcaatgcccgcacgcaggcgctgaactggctgttctggcagatgggctccgcgccgttcctcggtggcggtttcggccatttttacgcctatgcgccgatcaagatcaaatatgcgatcgaccgttacgccatggaagtcaaacgccagcttgatgtgctggatcggcatctcgccgaaaaccgctatctggccggtgatcagtatacgatcgccgacatggccgtctggccgtggtatggcaagatcgcgctcggccaggcctatggcgatgccggtgctttcctggaagcagatggctataagaacctcatgcgctggacgcttgaaatcggcgaacgcccggcggtcaagcgtggcgtgatcgtcaacaaaacctcgggcgatccgtccgaacaactgcatgaacgccacgatgcttctgacttcgacacgaagacacaggacaag

SEQ ID NO: 37869 - DNA, 634 bp, Agrobacterium tumefaciens
atgactgtaaaagttgccattaacggcttcggccgtatcggccgcaatgttctgcgcgccatcgtcgaatccggccgtaccgatatcgaagtcgttgccatcaacgatctcgggccggttgaaaccaacgctcacctgctgcgctacgattcgatccacggcaagttcccggctgacgtcaaagtcgaaggtgacaccatcatcgttggcggcggcaagccgatcaaggtcacggctgttcgcgatccggcaaccttgccgcacaaggaactcggcgttgacatcgcgctcgaatgcacgggcatcttcaccgcccgcgacaaggctgccgctcacctgacggccggcgccaagcgcgtcatcgtttcggcaccggctgacggcgctgacctgaccgtcgtcttcggcgtcaacgacgaccagctgacgaaggaccatatagatcattgacatcgctttctgcaccatcaactgactggtgcctgactggaaggtgctggatgacgtcattgtcatccatcatgtatacatgacgactatccactgctacacggacaaccagactgcactggacaccatgcacaaggatgtgtatcgctctcgcgcggaacacctgtccatgattcgaacatac

SEQ ID NO: 37870 - DNA, 1347 bp, Agrobacterium tumefaciens
ctcgccaaattgccggtcttctgggggctcgagggtaagcgcgtcgttctgacaggcggatcggacggagcagcctggaaggcggaactgttgttggcctgcggggcgcagcttgatctttattgcgaggaaagcgggctttcggaaagcctcgcgacgctcgtcgcaaaaagcccgatgctgacatggcatgaccgttgctgggatgcagatattttcaaaggggcggaactggcgctggcagattgcgaagctgaagaggaagccggaagattttatcatgccgcgcgggcagcaggcgtgccggtcaatgtcatcgacaagccggaattctgccagttccagtttggttcgatcgtcaatcgctcaccggtggtggtgtcgatctccaccgatggtgccgcgcccattctggcgcaggccatccgccggcgcatcgagacattgctgccgctttcgctcaaggactggggcgctcttgcccagacaattcgagagcgcgttaatctgcggcttgcgcctggcgcggcacggcgctctttctgggaaaagtttgtcgaccgggcttttaccgaaagactggacgagggtagcgaagaacggctgctgaaagatgtagcgacgcggacggggctggcagaatcgggacgtggttttgtgacgctggtgggcgcagggccaggtgatgccgagcttttaaccctgaaagcggtgcgtgccctgcaggcggccgatgtcatcctgttcgacgatctcgtctcagcggaggtgctggaactggcgcggcgggaggccaagcgcatgctggtcggcaagcgcggcggccgcgaaagctgcaaacaggaagacatcaacgacatgatgatccgcttcgccaaggccggtagacgggtggtgcggctgaaatccggcgatccgatgattttcgggcgcgccggcgaggagatcgcggcgctggaagccgaaaatatcccggtcgaggttgtgcccggcatcaccgccgcaagcgccatggcctcacgtctcggcgtttccctgacccatcgcgaccatgcccaatccgttcggttcgtcaccggacattcgcggcagggaaagctgccggaaaatatcgactggcagtccctgtcgaacccttcggtgaccacggtgttttacatgggcgggcgaaccgccgcggacatccagtcttgcctgctcgcccacggcatgcccgcctcgacccccgtggttgtgatgatttccgtcagccgggtgaatgaacaacgctggtgcggttcgctcgcgcaactggttgctgcagtcgagaggctgggcgtgaacgaacccgtgctgatcggtgtcggg

SEQ ID NO: 37871 - DNA, 1110 bp, Agrobacterium tumefaciens
tatcccaccgccgtcaagcttggccgtggccggatcaaggaactggcggaagcctgcaaaacgctcggcatcaggaagccgctgctcgtcacggatcgtggccttgccaatatggcgatcaccgcgcatgcgctggatgtgctggaagaggcgggtcttggccgggcgatctttgccgatgtcgatccgaaccccaacgaaatcaacatggaagccggcgtcaaggcttaccgcgatggcggtcatgacggcgtcgtcgcctttggcggcggctcgggcctcgatctcggcaagatgatcgccttcatggccgggcagacacgtccggtctgggatttcgaggatatcggtgattggtggacacgcgctgatgcgtcgaagatcgcgcccatcgtcgcagtcccgacgacggctggcaccggttcggaagtcggccgcgccagcgtcatcaccaattcgcagacgcatgtgaagaagatcatcttccatcccaagctgcttcccggtgtcgtcatctgcgatccggaactgacggtcggcatgccgaaggtcatcacggccggcaccggcatggatgccttcgcccattgcctcgaagcgtattcgtcaccgttcttccacccgatgagtgctggtgtcgcgcttgagggcctgcgtctcgtcaaggaattcctgccgcgcgcctataaggatggcacggatatcgaagcccgcaccaatatgatggcggcggcggcgatgggggcggttgccttccagaagggtctcggggccattcattcgctctcgcatccgatcggggcggtctacaacacccatcacggcatgaccaatgccgtcgtcatgccggcggtgctgcgtttcaaccgtcctgccatcgaagacaagatcgcgcgtgctgccgcctatctcggcatttccggcggttttgacggtttttatgactacgtgctggatcttcgcagggaactcggcgtgccggaaaacctgaccgccatgggcatcaagcctgatcgtatcgacgagctggcggcagaagcgatcaaggatccgagctgcggtggtaatccggtgccgatgacgcttgagaataccaaggcgctttttgag

SEQ ID NO: 37872 - DNA, 958 bp, Agrobacterium tumefaciens
cgattgagccggaatggagcgcccgtttcgagcttgccgaccggtctccgccagccgcaaagccgggtgacgcctatgagcggttcatgacggcgttgcgccagcgtcccgatccggcattccaggaagccgcattgttcggcgcgatttccgaacggtctttccgccggttttggcacgcgcggcctgccggtcacgctgtctacggccttgtgcttcgggtgcgactgcgatccagctcggcgtcgaggcgatccgccagggccgcacggagcgcgctctgacggttgcgactgacggttccgtcagcgccgaagccctgatccgcttctcgcttctgtctgcgctttcgacccagaacgatccgcccgaaaaggcctccaagccgttcagcaaggatcgcgatggtttcgtgatcgctgaaggtgcggcgacgctggtgttggaatcgctcgaagctgccgttgcccgtggcgccaaggttctcggcatcatcaagggcgccggcgaaaaggccgacagcttccaccgcacgcgttcttcgcccgatggcggcccggcgatcgcgacgatccgtgcggcacttgccgatgcgggcgtggccgaaagcgatatcggctatatcaacgctcacggcacctcgacgcctgagaatgacaagatggaatatggctcgatgctggccgtcttcggcgaaggcctgaagaatattccgctgtcgtctaacaagtcgatgattggccatacgctgacggccgcaggcgccgtggaagcggtgttctcgctgcagaccatgctgaccgggaccctgccgccgacgatcaactacaacaatcccgatccgaccatcaccctcgacgtggtgccgaatgtgaagcgggatgcgcaggtgggtgcggttctctccaactccttcgggtttggcgggcagaatgcaagccttgtcatgacgcgggaa

SEQ ID NO: 37873 - DNA, 513 bp, Agrobacterium tumefaciens
atggatatcaggcttgttggtgcgccgttgcagatcggggccgggcaattgggctgcgagatggggccgagcgcctatcgtgttgcggggcttgcccatgctcttgaagaactggggcatagggtggtcgataccggcaatgtgatgccggcgccgctcagggaattctgccaccccaacccggccgtgcatcatctcgccgaaaccgtggcctggaccgaggcgctgacggaggctgcctatcgcgaaagcgcggatgccgtgccgatcttcctcggcggcgaccatgcgatttcggccggaaccgtggccggcatggcacgccgggtggcggaaacgggccggccgttttttgtgctctggctggatgcccataccgattatcacacgctggagaccacccgcagtggcaatctgcacggcacaccggtcgcttatttcagcgggcgtgacggtttttccggctattttccgccgctttcccatgcccgtgcggaaagaaatattggcatg

SEQ ID NO: 37874 - DNA, 1011 bp, Agrobacterium tumefaciens
ggctcgatgcatgaccggcaatggccgacgcggtttccggtgctagacctcaaagccggtctttcgaccgaacctcaggaggtggcggagacggttgcgtgcggtcagacaccggttctgtcggtcaagaacctcgtgacaaggtttcccatccgctccggtctttgggcgcgtcagacgggtgcggtccatgccgtcgaaaacgtttccttcgatctctttcagggggagacgttgtcgcttgtgggggaatccggctgcggaaaatccaccacaggccgctcgatcatgcgcctcgtggaaccgtcatccggcgatgtgtcgctcgacggttacgatgtgatgcggctcgataccgttgggctgcgcaacatgcgcaaatccgtgcagatgatctttcaggacccgttctcctcgctcaacccacgcatgactgttggcacggcgatttccgaacctttcatcaagcacaggctaggcagcacgaaacaggcgaaggaaaagacggccgatcttctggagaaggtaggcctgtcggccgatatggccaatcgctacccgcatgaattttcgggtggccagcgccagcgcatcgcgattgcccgcgcgcttgcgctcgatccaaaggtcatcgtcgccgacgaaagcgtttcggcgctcgacgtatcgatcaaggcgcaggtctgcaacctgctgctcgacctgcagcagagcctgaatcttgctttcctgttcatttcgcacgacatggcggtggttgagcgcgtcagccatcgtgtagcggtgatgtatctcggcgagatcgtggaaatcgggccgcgggccgccgttttcgacaatccgcagcatccgtacacaaaaaagctcatggcagcggtaccggtgcccgacccggcccggcgcgggatgagacgcggcatatccaatgacgagctgaaaagcccgatacggacaatgagttatgaagcgccgacgcgacattacagaacggtatcacctggccatctggtg

SEQ ID NO: 37875 - DNA, 2265 bp, Agrobacterium tumefaciens
  unsure (1)..(2265): unsure at all n locations
gccactccgatgatggagcaatatatcgagatcaaggcgaacaatcccggttcgctgctgttttaccgcatgggcgatttttacgaattgttctttgacgatgcggtcgaagcctcccgcgcgctcggtatcacgctgacgaaacgcggccagcatatggggcacgatattcccatgtgcggcgttcccgttcacgctgccgatgactatctccagaagctcatcctgcgcggctaccgtgtcgccgtctgcgaacagattgaagacccggctgaagcgaagaagcgcggatcgaaatccgtggtcaagcgtgatgtggtgcggctcgtcacgcccggaacgctcactgaagaanagctgctgtcgccgacggaatccaactatctgatggcgcttgcccgtattcgcggcagtgcggaggcgcagttcgcgctggcctggatcgatatttccaccggcgtcttccgtctggcggaaaccacgctgacgcggcttctcgccgatatctggcgtatcgatccgcgtgagctgatcgttgccgacagcctgttccacgacgaggaactacggccggttttcgatgtgctgggccgtgtcgcggtgccgcagccggccatcctcttcgacagtgcggtggcagaaggccgtattgcgcgttatttcaacgtctcgacgctggatggtttcggaacgttttcacgggtggaaatggcagccgcagcagcagccgtggcctatgtcgaaaagacccagattgccgagcgtccgccgctcggcgcgccggaacgcgaaagtgcggcatcgacgctcttcattgatcccgccacccgcgccaatctggaactggtgaaaacactatccggcgaccgggatggatcgctcctgcacgcgcttaaccgcactgtcactggcggcggtgcgcgacttctggccgaacgactgatgtcgccattgaccgatccggaaaggatcaatgcccgtcttgatgccgtggcctatctcatcgatgacgtctccctgtgcgatggtctgcgtgacgcgctgaaacatgtcgcggatatgcctcgtgcgctttcccgccttgcgctggaacgtggcggcccgcgcgatcttggcgccatccggcagggtctggtttcggccgaaaaaattgcggtcattctcgacggtgggctgctgccggatgagctggcgaaagctctcagggatttgaaagccctgcccggcgctcttgaagccatgctcggctcgatgctggccgacgatctgccgcttctgaaacgcgatggtggtttcctgcgtgagggcgccaatcccgaactcgacgaagttcgcgcactgcgcgaccagtcacgccgggtgatcgccgggttgcagctgcaatatgccgatgagaccggcatcaagtcgctcaagatcaagcataacaacgtgctgggttattttatcgaggtgacggcgggcaatgccgatgtgatgatggcaacggatgaggccaaagcgcgctttatccattcgcagaccatggcgggcgccatgcgcttcacaccacggagcttgccgatctcgaaagccgcatcgncaatgccgctggcgaggctctgaccatggagctggaagccttcgagcgcatggtcgaggccgtggtgcagcaggcggaggcgatcaaggccggggctctggcgcttgcggtgatcgatgtcgcctcaagcctcgcctatcttgcgaccgaacaggcctattgccgtccgatcgtcgatgccttcatgaccttttcaatcaagggcggccggcaccccgnntgttgagcaagcgctgcggcggcagtctgccgggccgttcattgcgaataattgcgatctctccgccgtcaatggtggcaagaacggtgcaatctggctgctcaccggcccgacatgggcggtaaatcgaccttcctgcgccagaatgcgctgatcgccatcctcgcgcagatcggttccttcgttccggcggaggctgcccatatcggcgtcgtagaccggctgttttcgcgcgtcggcgcctccgacgatctggcccgtggacgctcgaccttcatggtggagatggtcgaaaccgccgccattctcaatcaggcgacggatcgctcgctggtgatcctcgacgagatcggccgtggcaccgcaacttttgacgggctttcgatcgcctgggcggccgtcgagcatctgcatgaggtcaatngttgtngnggncttttnnncacncacttncacnaactga

SEQ ID NO: 37876 - DNA, 669 bp, Agrobacterium tumefaciens
ctcgaagacagctggaagcacgttctctcgggcgaattcgccagcccctacatgcagaagctgaaagagttcctgcttgccgaaaagaccgccggcaagcgcatctttccgaagggcgcggaatatttccgcgctctcgacctcacgcctctcgacgaggtcaaggtcgtcattcttggccaggatccctaccatgggctcggtcaggcacatgggctctgcttttcggtgcagcccggggtgcgcattccgccctcgctcgtcaatatctacaaggaattgcagagcgacctcggcattcgcccggtcaagcacggttttctggaaagctgggcaaaacagggcgtgttgctgctcaacagcgtgctgacggtggaagaggcgcgggccgcctcgcatcaggggcagggctgggaaaaattcaccgatgcggtcatccgcgccgtgaacgacgaatgtgaccatgtggtctttctgctctggggttcctatgcccagaagaaggcggccttcgtggaccagcgcaaacatctcgtgctgcgctcgccacacccgtcacccctttcagcccataacgggtttttcggcaacggccatttttctaaggccaacgctttcctcgtttcgcatggccgtgatccgatcgactggcaattgcctgacgtggtg

SEQ ID NO: 37877 - DNA, 1075 bp, Agrobacterium tumefaciens
cttgccgtctcgcttccctcaaccgttcctttcgttggccctgaggccatcgagcgcagccgcggcctgaaggtggaagcgcgcatcggcgccaatgaaagcggcttcggccccgcgccttcagtgcttctcgccatgcgggacgcggcggcggagacctggatgtacagcgatccggaaaatttcgagctgaagaaagcgcttgccattcaccacggcgttgcacgcggcaatatcgccatcggcagcggggttgatggattgctgggggagatcgccaggctgatcgttgagccgggcacgcctgtcgtcacctcgtttggcggctatcccactttcaattaccatgtgaacggttctggcggcaaactcgtcaccacgccctatgtcgatgatcacgaaaatcttgacgggcttctcgatctcgtcatccgggaaaatgcgccgctcgtctatttcgccaaccctgataatccgatgggaagctggtgggaggcgagcgaagtcgtcgccttcagccgcgcattgccggaaacctgctctgctcattctggacgaggcctattgcgaaaccgggcccatcagcgccgtgccggccatcgacgcgctgatcggccaaccgaatatcctgcgcatgcgcaccttctcgaaagcctatgggctggccggtgcgcgcgtgggttatgccatcggcacgctcggcaatgtcgaagccttcgacaagatccgcaatcatttcggcatggcgcgtatttccgtcgccggcgccctcgcggcgctgaaggatcaggcctatctgcatgaggtggttggcaagatttccgatgcccgcgatcgtatttccgcgatcgcccgcaataacggcctttcgccgctgccgtcggccaccaatttcgtcaccatcgattgccaccgcgacggcgcttatgcccgcgccatcgttgatgggctgatggaccatggcgtgttcatccgcatgccgggcgttgccccgctcaaccgctgcattcgtgtcagcgccggcaccgccgacaagctcgatcttttcgagcaggcgctgccaaaggttctcaag

SEQ ID NO: 37878 - DNA, 1059 bp, Agrobacterium tumefaciens
atcgccccggcgatcgcgcaggcgttggaaaaacgcggctacaaagacttgacccccgtacagcaagccatgcttgcgcccgaacttgccaacaaggacgcgctggtttccgcgcagaccggctccggcaagacggttgccttcggcatagcgcttgcgaccacgctgctgtcggaaaatacacgcttcggtcaggcttccgcaccgctggcgctggcaatcgcacccacccgcgaactggccatgcaggtcaagcgcgagctggaatggctttatgaattcgccggtgtctccatcgcatcctgcgtcggcggcatggatatccgcaacgagcgccgggcgctggagcgcggcgcccatatcgtcgtcggcacgcctggtcgcctgtgcgaccatatcaagcgcaatgcactcgatctgtcgtcgatccgcgccgtggtgcttgacgaggccgacgagatgctcgatctcggcttccgcgaagatctggaattcattctggaagaatcgcccgacgatcgccgcacgctgatgttctcggccaccgtgccgcgcagcatcgccaagctggccgaaagctaccagaagaacgccgtgcgcattgccaccgcttccgaacagaagcagcatgtcgatatcgaatatcgcgcgcttctggtgtcgccttccgatcgcgagaacgccatcatcaacgcgctgcgcttttacgaagcccgcaacgccattgtgttctgctccacccgcgccgcggtgaaccacctgacggcccgcctgaacaatcgaggcttctccgtcgtggctctctccggcgaactgacccagaacgagcgcacacatgccctgcaggccatgcgtgacggccgcgcccgcgtttgcgtggccaccgacgtagccgcccgcggtatcgacctgcccggcctggaactcgttatccatgccgacctgccgaccaattccgaaacgcttctgcaccgttcaggccgtaccggtcgtgccggccaaaagggcgtcagcgccatcgtggtaccggtcagtcagcgccgcaaggccgagcgcctg

SEQ ID NO: 37879 - DNA, 1032 bp, Agrobacterium tumefaciens
catcgcatcgcactcatccccggggacggcatcggccaaagcgtgacggacgcggcgtggcaggtcctcaatgccgtcgccaaaacctccggttttgtgctcgaaggaaccgaattcccctggtcctgcgccttctacaaggaaaccggggcgatgatgccgaaggacggcatcgaaacgctgcgcggattcgacgccatcatgctcggcgcggtcgggtggccggcggaggtgcctgactcggtgtcgctgcacggtctgctgctgccgatccgcaaggctttcgtgcaatatgccaatatccgcccgcaccggctactatcaggcgtacaagggcccttgaaggccgacggcttcgatattctctgcatccgcgaaaacacggaaggcgaatattccggcgccggcggccgcgtgcatcaaggcacggaggacgaggtggccgtcgaaacctcgatcttcacccgcaagggcgtggagcgaatcttgcgcttcggtttcgaacaggcgcaaaaacgtcgcggcaagctcgcctccatcaccaaatccaatgcccagaaatattcgatggtgttctgggacgaagtgacccacaagctcgcggcggaatatcctgacgtggaggtctcaagctatcacatcgacgccatggcggcacgtatggtgatggcgccggaaagcctcgatgtcgtcgtcgcttccaacctcttcggcgatattctgaccgatctcggcgccgccattcagggcggcctcggttttgccgcttccgccaatatcaatcccgaccgcagcgccccctcgatgttcgagccggtgcacggctcggcacctgacatcgcccatctcggcatcgccaacccgatcgccgccatctggtccggcgcgatgatgttcgagcatctcggcgaaaaggatgcagccgcgaaaatcatggcggccctggaaacggcgaccggccgcggcatcggcaccgtgccgggcaaggacaagactgacaccatcaccgccgcggttctcgcggcactcgcc

SEQ ID NO: 37880 - DNA, 849 bp, Agrobacterium tumefaciens
atcatcaatatcggccgtacccacacgcaggacgcgaccccgctgacgctcggccaggaattctccggttacgccgctcaggtcgcctcggcgatcgccaatatcgaactcacactgcccgcactgtcgaagctcgcccagggcggtacggcggttggcacgggcctcaatgcccctgttggttttgccgaaaaggtcgccgaggaaatctctgagattaccggcctttccttcgtcaccgcgccgaacaagttcgaagcgcttgcctcgcatgattccatggtcttctcgcacggcgcgatcaacgccgctgccgctgcactcttcaagatcgccaacgacatccgcttcctcggttccggcccgcgcgccggtctcggcgaattgtcgctgccggaaaacgagcccggctcgtcgatcatgccgggcaaggtcaacccgacgcagtcggaggcactgacgcaggtttgcgcccatatcttcggcaacaatgcagcgctttccttcgcaggctcgcagggccacttcgaactcaacgtctataatccgatgatggcctacaactttctgcagtcggtccagcttctgggcgatgcggccgtgtccttcaccgacaactgcgtcgtcggcatcgaggcgcgcgaagacaatatccggaagggcgtcgagaactcgctgatgctcgtcacggcgctcaacggcaagctcggctacgacatctgcgccaagatcgccaagaccgcccacaagaacggcacgacgctgcgcgaagaagccgttggtggtggatacctcaccaacgaggaattcgaccagtatgtgcgccccgaaaacatgatcggcccgaag

SEQ ID NO: 37881 - DNA, 1218 bp, Agrobacterium tumefaciens
gttaatgtgacccggctttcgtccgggttgaccgttgttacggaaagaatgccacatctcgaaagcgttgctcttggggtgtggatcaaatccgggtcccgcaacgagacgactgccgagcacggcatcgcccatcttctcgaacatatggccttcaagggtacggcgcgccgcaccgcccggcagatcgccgaagagatcgaaaacgtcggtggcgaagtcaacgccgcaacatcgacggaaacaacctcctattatgcccgcgtcctgaaagaccatgttcctctcgcggtcgatatccttgctgatatcctgacggaatcgctgttcgacgaagacgagctggagcgcgagaaaaacgtcattctccaggaaatcggcgctgcgaccgatacgcctgacgacgtgatcttcgacaatttctccggcgtcgcctatcgcgaccagaccattggccgggcgatcctcggcacgcccgacaccgtgcaatccttcacgagcggtgagatcaggcattatctcgcccgcaattacacgacggaccggattttcgtcgtcgccgccggcgcggtcgatcacgaaagctttgtgaagcaggtggaagagcgttttgcctcgctgccgctcgtgccggcggcaccgcccgtcatggaaaaggcgatctataccggcggggaaatccgcgagacccgcgacctgatggatgcgcaggtgctgctcggtttcgagggcaaggcctatcacgcccgcgacttctattgctcacagattctcgccaatattctcggcggcggcatgtcatcgcgtctcttccaggaagtgcgcgaggcgcgcggcctgtgttattccgtttatgccttccattggggtttttccgataccggcattttcggcgtgcatgcggcgaccggcggcaatgacctgccggaactgatacccgtcatcgtcgatgaattgcgcaagtcttctgagactatccatcaggacgaaatcaaccgcgcccgcgcacagattcgggcgcaattgctgatgggacaggaaagcccggctgcccgcgccggccagattgcccggcagatgatgctttacggccgccccatccccaatgaagaaatgatgacgcgcctcgaggacatcacccgggagcgcctgaccgatcttgcaggccggctatttttcgatacagttccgacattgtctgccattggcccgctggaa

SEQ ID NO: 37882 - DNA, 983 bp, Agrobacterium tumefaciens; identical to SEQ ID NO: 35461

SEQ ID NO: 37883 - DNA, 720 bp, Agrobacterium tumefaciens; identical to SEQ ID NO: 35444

SEQ ID NO: 37884 - DNA, 1326 bp, Agrobacterium tumefaciens
gtcgagcgcgccatcgcctcggccaagcgcgcccagaaggaatgggcggcgatgagccccatggcccgcggtcgcatcctcaagcgcgccgccgatatcatgcgcgaacgcaacgatgcgctttccacgctcgagacgctggataccggcaagccaatccaggaaaccatcgtcgccgatcccacctccggcgccgatgccttcgagtttttcggcggcatcgcaccttccgcgctgaatggcgattatatccccctcggcggcgatttcgcctataccaagcgcgtgccgctcggtgtctgcgttggtatcggcgcctggaactatccgcagcagattgcctgctggaaggctgcaccggccctcgtcgccggcaatgccatggtcttcaagccctcggaaaacaccccgctcggtgccctgaagatcgccgaaatcctgatcgaggcgggcctgccaaaaggcctcttcaacgtcattcagggtgatcgcgataccggcccacttctagtcaatcatcccgatgtcgccaaggtctctctcaccggctcggtgccgaccggtcgcaaggtggcggccgccgctgccgggcatctgaaacatgtgacgatggaactcggtggcaagtcgccgatgatcgtcttcgacgacgccgatattgaaagtgccgtcggtggggccatgctcggcaacttctattcttccggccaggtctgctcgaacggcacgcgtgtcttcgtgcagaaaaaggcgaaggcgcgtttcctcgaaaacctgaaacgccgcaccgaggcgatgatcctcggcgaccccttggattacgccacccatctcggcccgctggtctccaaggcccagcaggaaaaggttctgtcctatatcgaaaagggcaaggcagagggtgcaacgctgatcaccggcggcggcattcccaataatgtcgcgggtgagggcgcctatgttcagccgactgtctttgccgatgtcaccgacgacatgaccatcgcccgcgaggaaatcttcgggcctgtcatgtgcgttctggatttcgacgatgaggacgaggttctcgcccgcgccaacgccaccgaattcggccttgccggcggcgtctttaccgccgacctcgcccgcgcccaccgtgtggtggatgggctggaggcgggcacgctctggatcaacacctacaatctctgcccggtggaaattccctttggcggctccaagcaatccggtttcggacgggagaattccgccgcggcgctggagcattatagcgaattgaagaccgtttatgcagcacggggaaggtggacgcgcctatta

SEQ ID NO: 37885 - DNA, 916 bp, Agrobacterium tumefaciens
tgccaaatcctgggagctcccgttcaagtggcgcatcccaacccggatgcctgatgggacctgatgcgtttcggactgccggcttgacgcaagttctgacggagctgggctgggctgtcaccgatctcggagatgcgacaccaacggtcgaacccgaactcagccaccccaattccgcggtgaagaacctcgatgctctggtgggatggacgcgcagtctgtcccagaaagctctggagatggcccgcagctgcgatcttccggtctttctcggcggcgatcactcgatgtctgctggcaccgtctcaggtgtggcccaacgtacagccgagcttggcaaggagcaattcgtcctttggctggacgcgcatacggacctgcataccctccacacgaccgcgagcggcaatctccacggcacacccgtagcctactatacgggccaatccggcttcgaagggctgccgccgctggccgcgcctgtaaatccccgcaacgtatccatgatggggattcgctcagtcgatccggaagagaggcgacgggttgccgagatcggtgttcaagtcgctgacatgcgggttctggacaacaaggggtcgtacgcccgctcgaagcttttcttgaccgcgtgagtaaggtcagcggcagattgcacgtcagccttgatgtcgatttcctcgatcccgcgatcgcgccagcagtgggcacgaccgttcctggcggagcgaccttccgggaagcgcacctcatcatggagatgctccatgacagcgggcttgtcacgtcactcgacctggcggagctcaatccgtttctggatgagagggggcgcactgcccgcctcataaccgatcttgcctcgagcctattcggccggcgcgtgttcgacagggtgacaacagcattttgatca

SEQ ID NO: 37886 - DNA, 942 bp, Agrobacterium tumefaciens
atggcaaagatcaaggtagccaatccagtcgtcgatctcgacggcgacgaaatgacccgtatcatctggcagctcatcaaggacaagctgatcctgccatacctcgatctcgacatcgaatattacgacctctcggttgaaaaccgcgatgccaccaacgaccaggtcaccgtcgatgcggcacacgccatcaagaagcatggcgtcggcatcaagtgcgcgacgatcacgccggacgagcagcgcgtcgaggaattcggcctgaagcagatgtggaagagcccgaacggcacgatccgcaacattctcggcggcgtcatcttccgcgagccgatcatctgcaagaacgttccgcgcctcgttcccggctggaccaagccgatcgtcgtcggccgtcacgcctttggcgaccagtacaaggcaaccgatttcaagttccccggcaagggcaagctgacgatcaagttcgtcggtgaagacggcacggtcatcgaaaaggacgtcttcgacgccccgagcgccggcgtggcactcgccatgtacaacctcgacgaatccatccgcgaattcgcccgcgcctcgatgatgtatggcctgatgcgcaagtggccggtttacctctccaccaagaacaccatcctcaaggcctatgacggccgcttcaaggatatcttcgaagaagtctaccagaccgagttcaaggcaaagttcgacgaagtcggcatcacctacgaacaccgcctgatcgacgacatggttgcctcggcgctgaagtggtccggcggctacgtctgggcctgcaagaactacgatggcgacgtgcagtccgacacggttgcccagggcttcggctcgctcggcctgatgacctcggttctgctgtcgccggatggccgcaccgtcgaagccgaaagcgcgcacggcacggtgacgcgtcactac

SEQ ID NO: 37887 - DNA, 222 bp, Agrobacterium tumefaciens
cacactggcgcacgtgaggccggtaccatcggttttgccacgctgcgtggcggctcggtcatcggtgaacattcggtgatcttcgccggcgaaggcgagcgcgtcgagctttcccattatgccggcgaccgctccatcttcgcacgcggcgcgatcacggcagcagtctgggccttcgacaagaagcccggtttctattccatgctggatgtgctcggcctt

SEQ ID NO: 37888 - DNA, 775 bp, Agrobacterium tumefaciens
ggcatcatgcaaggtaagcgcggcctcatcatgggcgtcgctagcaatcactcgatcgcctggggtatttccaaggcacctgcggccacagggcgcggaactggccttcacctatcagggtgaagcgcttggcaagcgcgtgaaaccgctcgccgcggaactgggctcggacttcatcgtaccttgcgatgtcgaggatatcgcttctgtggatgcgctttttgcgacgatccgcgaaaaatggggcgcgctggatttcgtcgtgcacgccatcggcttttccgacaagaacgagctgaagggtctctacgccaacacgacgcgcgagaatttcagccgcaccatggtcatttcctgtttctccttcacggaaatcgccaagcgcgccgctgaactgatgaccaatggcggctccatgctgacgctgacctataatggttcgcagcgcgtcattccaaactacaacgtcatgggcgtcgccaaggcggctctcgaggcatccgtgcgttatctcgccgccgattacggcccgcgcgatatccgcgtcaacgccatctcggccggcccggtccgcacgctggcgggtgccggcatttcggatgcgcgcgcaatttacgcgtggaaccagaaaaacgcaccgttgcggcgaacggctgacatcgacgacatcggcggctccgcactttacctgctgtccagcctgtcgcgcggcgtgaccggcgaatgtcattacgtggattgcggttacaatatcacctcgacgcccacgcttgag

SEQ ID NO: 37889 - DNA, 819 bp, Agrobacterium tumefaciens
atgtcgcgtttcaccaccactgacggtacccgcctcttttataaggactggggcgcagggcagccgatcctctttgcccacgggtggccgctgtcatccgatgcatgggaccagcagatgctgttcttcagccagaacggcttccgcgtcatcgcccacgatcgccgcagccatggccgctcggatcagacatttgacggcaacaacatggaccagtatgccgacgatctcgccgaactgatcaatgcactcgacctgtcggacctgatcttggttggccattcgaccggtggcggcgaggtctcgcattatgtcggccgtcatggcacggctcgtgttgccaaggtggttctggtgggtgcggtgccgccggtgatgctgaagaccgttgacaacccgaacggtacgccgatggaggtattcgacagtatccgcgaaaacaccgcgaagaaccgttcgcagtttttcttcgatctgacggtgcctttctacggctttaaccgggaaggtgtcgcgaccaatgacggcatgcgggaaaacttccgccgcataggactgcaaggcggcgtcaagggccagtacgattgcatccgggagttctctgaggtcgattacacccgtgatctgaagagtattgaccgcccgacgctgatcatccatggcgatgacgaccagatcgttccgatcgatgcatctgcccatcgggctgcggacctcgtggccgatgccacgctgaagatctattcgggcggctcccacggactggcagagactgaggctgatcgtttcaacgccgacgtgctcgcctttatccacggc

SEQ ID NO: 37890 - DNA, 822 bp, Agrobacterium tumefaciens
  unsure (1)..(822): unsure at all n locations
aaaatcatgaaattctcaatcgcagaggcggaggatctcgtatcctctatctttgagcgcaatggcgttctgccgcaaaatgcccgttctgtggcaaaggcgctggtcgcctccgaggcggctggccagggcggccatggttttcgccgtattcccgtttatgtccgtcaggcgcgggttggaaaggtggacggtcaggcgcgtcccgtggtgaggcgcgtgaagccgggcgtgctctcgatcgacgccaatcatggttatgcctatccggcgatcgactgcgctcttgaagaattgcctgaaatggcccgacagcagggcattgcgctggcagcgatccatcgctcccaccatgcaggcgtcatggctctgacggtcgagcgttttgcggaaatgggccttgtcgcgctcatgttcgccaatgcaccagcctccatggctccctggggcggccacacgccgctttatggcaccaaccccatcgcctttgcggcccccattggcggcgccgatccgctcgtcatcgatctggccctgtcaaaggtcgcgcgcggcaagatcatggcggcacgacagannnnnnnnnnnnnnnnnnnngactgggcgctcgatagaaacggccggccgacgaccgatccagaggaggccattgccggaaccatggtccccgcgggtgaagccaagggcgctgctctggcgctgatggtggagatcatggcagctgcggtgactggtggaaatttcgcattccaggcatcgtcccttctggatgataagggtgcgccgccctccctcggccatacgatcatcgccatcgacccg

SEQ ID NO: 37891 - DNA, 1233 bp, Agrobacterium tumefaciens
cgttcgaagatcatgcgcaaggccgccgacatcctgcgtgagcgcaaggacaagatcgcctacatcatgacccgcgagcagggtaagccactggcgcagtccgctaccgaaatcatgggcgccgccgacaccatcgactggttcgcggaggaagcgcgccgcacctatggccaggtcatccccgcgcgcgccaccggtgtgtcgcagcttgccatcaaggtgccggtcggccccgtggcggcgttcacgccgtggaatttcccgctcaaccagatcgtccgtaagctctccgcggcgcttgccaccggctgctccatcatcgtcaaggcacctgaggaaaccccggcatcgccggccgaactcatccgcgccttcgtggatgcgggcgtgccggcaggtgtcatcggcctcgtctacggcgttccgtcggagatttcggaatatctgatcccgcatccggtcatccgcaagatttccttcaccggctccacgcccattggcaaacatctggcggccttggccggcaagcacatgaagcgcgccacgatggaactgggcggccacgcaccagtgatgatcttcgatgatgccgatatcgagaaggcgatcgaggtgacctcgcttgccaagttccgcaatgccggccaggtctgcgtcgcccccacccgcttcctcgtgcaggatggcgtggcggaccgctttctcgagggtttcgtggaagcaacgaaagccatcaaggtcggcaacggtctcgaagagggcgtcatcatgggtccgctcgccaatgagcgccgcattcccgccctggaaggtctcatcaacgacgccgtttcccatggcgcggaactgaagaccggcggccgccgcatcggcaacaagggcaatttcttcgagcccacggttctcgccaatgtgccggtgaccgccaagatcatgaatgacgagccgttcggcccggttgcgatcatcaaccgcttttcgagcttcgatgatgccattaccgaagcaaatcgcctgcccttcggccttgcatcctatgccttcaccggctcggtcaaaaccgcgcatgcgctcggccaacaggtcgaggccggcatgctgaccatcaaccataacggccttgcgcttcccgaagtccccttcggcggcatcaaggattccggttatggcacggaaggcggttcggaagcggttcaggcctatctggagaccaaattcgtcagccagatgagt

SEQ ID NO: 37892 - DNA, 414 bp, Agrobacterium tumefaciens; identical to SEQ ID NO: 35390

SEQ ID NO: 37893 - DNA, 294 bp, Agrobacterium tumefaciens; identical to SEQ ID NO: 35446

SEQ ID NO: 37894 - DNA, 954 bp, Agrobacterium tumefaciens
atgaaggcagccgtttacgatcaagcaggacctccggatgttttgacgtacagggacgtcgccgacccgattgtaggtccggatgatgtcctcatcgcagtggaagccatttcgattgaaggaggagacttgatcaatcgtcgatccacgccgcctcctggccgcccgtggatagtcggctatgcagcatctgggcgcgtcgtgggggccggtgcgaacgtgagggaccgcaaagtcggagacagggttactgcctttgacatgcagggttcgcacgccgaactctgggccgtgccagcgatccgaacgtggcttttgccatccggcgtggatgcagcgtcggctgccgctttgccgatatcgtttggtactgcccaccattgtctttttgccagaggtggccttctgcgcaaccagacggttcttgtacaggcagcggcgggtggagttggcctcgcgggagttcagctcgcggctcaagccggcgcaaccgtcatcgccgtctcaagtggagaaagccggctgcaaaggatatcttcccttggggctgatcacgttgtcgatcggtcgatggggaacgttgtcgaggctgtcagacagaacacgggaggcaaaggagtcgatctcgtgattgatcctgtcggtgtcaccttgtccgcttctctgactctcctggcaccagaaggacgtcttgtgtttgtgggaaacgctgggggcggaagcctgaccatcgatctgtggccagccatgcagtcaaatcagactttgctcggagttttcatgggcccgctattagagagacctcaggttcgtgcgacggtagatgagatgcttcaaatgctcgatcgtcgcgaaatccgtgtgatgatcgaaaagacgtttccgctctcggaagcggcagccgctcatgattttgcagaaaatgcgaaaccgcttggccgggtgattatggag

SEQ ID NO: 37895 - DNA, 1663 bp, Agrobacterium tumefaciens
catttcggtcggctatgctccagggttcggctctcgccgaaaccatcgatctcgacggccgcctcctccacccggaaatcgccggcaggcgggcggcatgggacgaggcgctcgatctcgtcgcttcccgtttttccgacgccattgccgaacacggcccggattcggtcgccttttacgtttccggccagttactgacggaagattattacctggcgaacaagctgatgaaaggtttcatcggctcggccaatatcgacaccaattcaaggctctgcatgtcgtcctccgtcgccggccaccgccgcgccttcggcgcggatacggtgccgggaacctacgaggatatggagcttgccgatctggtgatcctcaccggttccaacctcgcctggtgccatcccgttctttatcaaaggctggcggcggcgaaggcggcgcggccggggatgaaggtcgtcgtcatcgatccgcgccggacgatgagcgctgatattgccgatatgcaccttgcaatccgcccggatggcgatgtggcgctgtttaccggcctgctggcgcatcttttcgccagcagcgcaatagaccgcggttacgttgaaaaccacacggccggtttcgaggccgccacgcaggccgcaagtgagcatagcctgcgggaaattgccgaggccaccggcctgaccatcgccgaactgattcccttttatgaattgttcgagcgcacggaaaaaaccgtcacctgttacagccagggcgtcaaccagtcggagagcggcaccgacaaggtcaacgccatcatcaattgccacctcgccaccggccgcatcggcaggccgggcatggggccgttttcgctgactggtcagccgaacgccatgggcgggcgcgaggttggcgggctggcaaacatgctggctgcccatatgtccatcgaaaatgctgacgaccgcgaccgcgtgcagcgcttctgggcctcgcccgccatcgcgcagaaacccggtctcaaggcggtggatatgttccgggcggtggctgatggccgcatcaaggcgctgtggatcatggccacaaacccggtcgtctccatgccggatgccggtgccgtcgaggtgacgatcaaggcctgtcctttcgtcgtcgtctccgatgtcatggccaatacagacacggcccgccatgctcatgttcttctgccctcgctcggttggggcgaaaaggacggtacggttaccaattccgaacgacgcatttcccgtcagcgcagctttctcgatgcacccggcgaagcgaaagccgactggtggcagatggcggaagtggcccgacgcatgggcttcgacgctgcttttgcttaccagcagccctcggagatttttgcagaacatgcagccctttcgggtttcgagaatgcggggcgtcgggattttgatatcggcggaatcgaacgcgattcctacgagacgatggcacccgtccagtggccgaaagccggggccggcgaggccgaggtgacgcgcttttttgcaaatggccggttttatcatgccgatggcaaggcacgcttcatcgccaccgccctgccggagacggacagaacatcggcggactatccgctgacgctaaataccggccgcattcgcgatcaatggcacacgatgac

SEQ ID NO: 37896 - DNA, 1356 bp, Agrobacterium tumefaciens
ctgccaaaacccgctgaggagactccgctgatcgccgcgcagggtgtgcgcctgctccatgagacgggcgttccgcaagacgccgtgcagcttctgccgggcgatgccaagacgggtgcggcgctggtcggctcaccactgacggcgggcgtgatgttcaccggctccactgaggtggcgcggctcattcaggggcagcttgccggccgggttctggccaatggccagccggtgccgctgattgccgagaccggtggtcagaacgccatgatcgtcgattcctccgcgcttgccgaacaggttgtcgccgatgtcatcgcgtctgccttcgacagtgccggacagcgctgctcggcactgcgcatcctctgcctgcaggaagatgtggcggaccgcacgctgaccatgctgaaaggcgcgctgcacgaattgcgcatcggccgcacggatcagctctccgtcgatgtcggccccgtcatcaccgccgaggccaagggcatcatcgaaaagcatattgacggcatgcggtcgctcggtcaccgcatcgagcagattgcgcttgcgggggaaaccggcaagggcaccttcgtaccgccaaccatcatcgagatgaaatcgctcgccgatctgaagcgcgaggtcttcgggccggtgctgcacgtcatccgcttcaagcgcgatcatctcgaccggctgatcgatgagatcaacgccaccggctacggcctgaccttcggcctgcatacgcgtctcgacgatacgatccagcatgtgctctcccgcgttgcggccggcaatctttatgtgaaccgcaacatcatcggcgcggtggtcggtgtgcagccctttggcggacgcggcctttccggcaccggccccaaggccggcggtccgctttatctcggccgcatgacggagaaagcgccaaagatagaccgcatcgccagccagcaggatcaggctgcggtcgatctcgcccgctggctggatgaaaatggtcagactgttgcggcagaagccgcacgccaggcggctgcgctttcaggccttggctttgagaccgagctggccggccccgtcggcgagcgcaatgtctatgcgctgcatccgcgcggcaagatcctgctggtgccggcaaccgaacaggggctttaccgtcagcttgcggcagcgctatctaccggcaactctgttgtcatcgacaatgcttcgggactggaaaaggcgatctacggcctgccggcaagcgtgacctcgcgcatcgtctgggcggatgactgggaaaaatcggcacccttcgccggtgcgctggtcgagggcgatgcggaacgcgtggttgcgatcaacaggaagatc

SEQ ID NO: 37897 - DNA, 774 bp, Agrobacterium tumefaciens
cagaatacctttctcatcaccggcgcatccgatggtatcggcgccgtatattccgatcgcctcgcaggacgcggccacgatcttatcctcgtggcgcggcgtgccgagaagctgaaggcactggcagcgcagctggaaaaggaccacggcattgccgtcgaggttctcagcgccgatctttccagcgcggaagacctcgaaaaggtcgaggtccggctgcgcgaagaccagcgtatcaccggcctcgtcaacaatgccggcatagccggggaaggcgcgatcacggcactggacccggcctatgtgacgacgatgatcaatctcaacattcttgccgtcacccggctggcggcagccatcgcgccccgccttgccgccgcaggcaaaggcacgatcatcaacatgacttcggtcacggcgctgatgccggcggcattcaccgccgtctatccggccacaaaggccttcgtgctcgccttcaccgaagcactgcaggcgcagctttcgccgtccggcgtgcgggttcaagccgtgctgcccggcatcacccgcaccgcgatatgggaagaggaacggctcgatgccatcccggccgccatggtcatggacgtgcacgacatggtggacgcggcccttgccggtctcgatctcggtgaggcgctgaccattccttccctgccggatacggtcgaccttgaaaatttccttgcagcacgcgcagcgttgaggcccaatctgtcgcatgcacttgccgccagccggtatcgtgcaggc

SEQ ID NO: 37898 - DNA, 744 bp, Agrobacterium tumefaciens
agacttcaaaacaagatcgccgtcgtcaccggagcaaccagcggcatcggccttgcaacggccaaacttttcgctgtcgaaggtgcacgcgtctacatcaccggccggcgcaaggatgccctggacaaggcggtggccgagatcggccatggcgctgtcggcgtacaggccgactccgcaagtaacgaaaatctcgacaagctgttcgcccaggtgaaggcggagcaaggccgcctcgacgccctcgttgtgaacgccggtggcggcagcatgcttccgctcggccagatcaccgaggagcagatcgaccacaccttcggccgcaacgtgaaggctgtcatcttcacggtgcagaaggcgcttccgttgatgggcaagggcgcatccatcgtgctgaccggttcgaccgcaggcaccgaaggcacggccgccttctccgtttactccgcctccaaggccgccgtccgcaacctggcccgctcctgggcgcttgacctgaaaggcaccggcatccgcgtcaacgtcgtctcgcccggtgcgacacgtacgcctggcctcgtcgagcttgccggtgacgacaaggaacagcagcagggcctgctcgactatctcgcctcgcgcataccactcggccgcgttggtgaatccgaggagatcgccaaggcaaccctgttcctcgcctctgacgacgcgagcttcgtcaacggcgccgaactcttcgccgacggcggccaggcccaggtc

SEQ ID NO: 37899 - DNA, 1572 bp, Agrobacterium tumefaciens
gaaaatttgaccttgtttcaggtttacacacgcgctctgcgctatctgaccgttcataaatggcgtgtggccgttgtcgtcatcgccaacgtcattcttgcagcgatcaccatcgccgaacccgtgctgttcggccgtatcattgacgccatttcctccggcaccaatgttacgcccattcttattctgtgggcgggtttcggcgtctttaataccgtcgcttatgtcgcggtcgcccgcgaggcagaccgtctggcccatggtcggcgcgcaacgctgctgacggaagctttcgggcgcatcatttcgatgccgctctcctggcatcatctgcgcggcacgtccaatgcgctgcacacgctgctgcgcgccagcgaaacgctgttcggcctgtggctggaattcatgcgcacgcatctcgccaccttcgtggcgctggtgctgctcatcccgaccgccatggccatggacctccgtcttagcttcgttctgatcggcctcggcattgtctactggttcatcggcaagtgggtgatgggccgcaccaaggacggccaggcctcagtcgaggagcattatcacagcgtttttgcccatgtcagcgattccatcagcaacgtgtcggtgctgcacagctacaaccgcatcgaggctgaaacgaaggcgctgaaatccttcaccgaaaagctgctgagcgcgcaatatccggtgctcgactggtgggccttcgccagtgcgctgaaccggacggcctccaccgtttcgatgatgattatcctcgtcatcggcactgtgctcgtcaagaacggcgaattgcgcgtaggagatgtcatcgccttcatcggtttcgccaatctcctgatcggccgtctggaccagatgcgccaattcgtgacgcagattttcgaagcccgcgccaagctcgaggacttcttcgtgctggaggatgccgtcaaggaacgggaagagcccggcgatgcccgcgagctctcgaatgtctcgggcaccgtggagttccgcaacatcaatttcggtttcgccaacaccaagcagggcgttcacgacgtctcgtttacggccaaggccggcgagaccgttgcgatcgtcggaccgaccggtgccggtaagaccacgctgatcaaccttctgcaacgtgtctacgaccctgattccggccagattctgatcgacggcaccgatatttcgacggtgacgaaaaactcgctacgcaactccatcgcgaccgtgttccaggatgccggcctgctgaaccgctccatccgcgaaaacatccgcctcggccgagaaacggccaccgatgcggaagtggtggaagcagcagcagcggcagcggcaacggatttcatcgacagccgcatcaacggctacctgacgcaggtgggcgagcgcggtaaccgcctttccggcggcgagcgccagcgtatcgccattgcccgtgcgatcctgaagaacgcgcctattctggttctcgacgaggcgaccagtgcactggacgtggaaaccgaggcccgcgtgaaggccgccgtggacgcgctgcgaaagaaccggacg

SEQ ID NO: 37900 - DNA, 1899 bp, Agrobacterium tumefaciens
atggcaaaagtaatcggtatcgaccttggcacgaccaactcctgcgtcgcagtgatggatggcaaggacacgaaagtaattgaaaacgcagaaggcgcgcggaccacgccgtcgatggtggcattttccgacgatggcgaacgccttgtcggccagccggccaagcgccaggcagtcaccaacccgaccaacaccctgtttgcggtcaagcgccttatcggccgccgttatgaagacccgaccgtcgagaaggacaaggcactcgtccccttcgaaatcgtcaagggcgacaatggcgacgcctgggtgaaggctcaggacaagaattattccccttcgcagatttccgcgatgatccttcaaaagatgaaggaaacggctgaatcctatctcggcgaaaaggtcgagaaggccgtcatcaccgttccggcctactttaacgacgcccagcgtcaggccaccaaggatgccggccgcatcgccggtctcgatgttctgcgtatcatcaacgagccgacggcagcagccctcgcttacggcctcgacaagaaggaaggcaagaccattgccgtttacgaccttggcggcggcacgttcgatatttccgttctggaaatcggcgacggcgtctttgaagtgaagtcgaccaacggtgataccttcctcggtggtgaagacttcgacatgcgtctggtcgaatatctggccggcgagttcaagaaggatcagggcatcgacctgaagaacgacaagctcgctctgcagcgcctcaaggaagctgccgaaaaggcgaagatcgaactttcgtcctcgcagcagaccgaaatcaacctgccgttcatcacggctgatgcttccggtccgaagcacctgacgctgaagctgacccgcgccaagttcgaaagcctggttgacgatctggtgcaacgcactgtcgccccttgcaaggcagcactgaaggatgccggcgttaccgcggccgagatcgacgaagtcgttctcgtcggcggcatgagccgcatgcctaaggttcaggaagtcgtcaagcagctgttcggcaaggagccgcacaagggcgtgaacccggatgaagtggttgccatgggcgccgctattcaggccggcgttctgcagggcgacgtcaaggacgttctgctgctcgacgtgaccccgctgtcgctcggcatcgaaacgctgggtggcgtcttcacgcgtctgatcgatcgcaacaccacgatcccgacgaagaagagccagaccttctcgactgccgaagacaaccagtcggccgtgaccatccgcgtttcgcagggtgagcgcgaaatggcacaggacaacaagctgctcggccagttcgacctcgtcggtctgccgccgtcgccacgcggcgttccgcagatcgaagtgaccttcgatatcgacgccaacggcatcgtgcaggtatccgccaaggacaagggcaccggcaaggagcagcagatccgcatccaggcctccggtggtctctccgacgccgacatcgaaaagatggtgaaggacgccgaagccaatgccgaggccgacaagaagcgtcgcgccggtgtcgaagccaagaaccaggccgaaagcctcattcactccaccgaaaagtcggtgaaggaatatggcgacaaggtttccgagaccgaccgcaaggcgatcgaagacgccattgccagcctgaagaccgctgtcgaagccgccgagcctgacgcagacgacattcaggccaagacccagaccctcatggaagtctccatgaagcttggtcaggccatctacgaagcacagcaggccgaggccggtgatgcttccgcagaaggcaaggatgacgtcgtcgatgccgactatgaagaaatcaaggacgacaagaagtccgca

SEQ ID NO: 37901 - DNA, 753 bp, Agrobacterium tumefaciens
ctgttcgatctttccggtcaggtggcgctcgtcaccggtgctggatccggcatcggccagcggatcgccatggggcttgcccagtccggcgccaatgtcgcgctgctcgaccgccgcaccgatgacggtctggcgcagacggccgatttcatcgccagggccggccgcaagtcgatccagatcgccgccgacgttaccagcaagcaggcgctgacggatgcggttgcccgcacgcaagccgaactcggcgcactttcgctcgccgtcaatgcggccggcatcgccaatgccaatccggccgaggagatggaagaaagccagttccagacgatgatggacatcaacctgaagggcgtgttcctgtcctgccaggccgaagccaacgccatgctgaaaaatggccgaggtgccatcgtcaacatcgcgtcgatgtccggcgtcatcgtcaatcgaggcctgatgcagtgccattacaacgcctcgaaggcgggtgtcatccacatgtcgaaatccatggcgatggaatgggtgggtcgcggcatccgcgtcaacaccatctcgccgggctacacggcgacaccgatgaacacgcggcctgaaatggtgcaccagaccaagctgttcgaagagcagacgccgatgcagcgcatggcaggcgccccccccatggtgggaccggcgatcttcctgctgtccgacgccgcgagttttgtgacgggtgtggatctcttggtggatggcgggttctgctgc

SEQ ID NO: 37902 - DNA, 753 bp, Agrobacterium tumefaciens
gtgaccgggggcaacaagggcatcggttacggcatcgcccgccgttttgccgaagaaggcgcgaaagtcgccatcgcctctgtcgacaaagacacacatgacgccgctaaaaaactggcggacgaaaccggcaccgtcacccatggcgtcatcctcgacgttagggatgcggcggcggtgcgtgacgcctatggcgctgcggaagacgcgatcggcgcgctttccatctccgtccagaacgccggcgtcatcactatctcaaagatcgaggatctgacgcaagaacagtgggatttgaacctcgacgtcaacaccaagggcgcgttcctctgctgccaggaggcaatccgtcgcttccgcgcaagcggcaccaagggccgcctcgtcaacaccgcctccggccaagcgcgtcagggcttcatctacacgccgcattatgctgcgtccaaattcggcgttatcggcctgacgcaaagcctcgccaaggaacttgcacctgagggcatcaccgtcaacgccatctgccccggcatcatccacaccgaaatgtgggattacaacgaccgcgtctggggccagatgctgggcgaatacaagcccggcgagttgatggccgaatgggtgcgcaacatccccatgcgtcgcgccggaacgcccgccgaagtggcggcgctggtggcatttctggcatcagaggatgcggcctatatcacggcccagacgatcaacgtcgatggcgggttgatcatgtct

SEQ ID NO: 37903 - DNA, 2674 bp, Agrobacterium tumefaciens
  unsure (1)..(2674): unsure at all n locations
tgcaccacgccggttgctgccggtctcgtcgtgcatacccagaccgagcggctgaagcagatccgcaagggtgtgatggaactttatatctccgaccacccgctcgactgtctgacctgcgccgccaatggcgattgcgaattgcaggacatggcaggtgccgtggcgccttcgcgatgtgcgttacggttacgagggcgacaaccacgtcaagtcccgcaccggagggggcgatatcaatgcccgctggatgccgaaggacgaaagcaatccctatttcacctatgatccgtccaaatgcatcgtctgttcccgctgcgttcgggcctgcgaggaagtgcagggcacctttgcgctgacgatcgaaggccgtggtttcgagagccgcgtatcgcccggggcgcacgaggcgtttctcgattccgactgcgtttcctgcggcgcctgcgtgcaggcctgtccgaccgcgacacttaccgaaaaatcggtgatcgagatcggccagccggaacattcgatggtgaccacctgcgcctattgcggcgtcggctgctccttcaaggcggaaatgcgtggcgaggaattggtgcgcatggtgccgtggaaggacgggcaggcaaaccgcggtcattcctgcgtcaagggtcgcttcgcctatggttatgcgacccacagggatcgcattctcaacccgatgatccgcgagaatatcggcgatccctggcgggaagtgagctgggatgcggcctttgcctatgttgcttcggngtttcggcgcattcagggcaagtatggccgggagtccattggtggcatcacctcgtcgcgctgcacgaatgaggaaaccttcctcgtgcagaaactcgttcgcgccggcttcggcaataataacgtcgatacctgcgcccgcgtctgccattcgccgacgggttatggtcttggccaggccttcggcacctccgcaggcacgcagaatttcgacagcgtcgaacaatccgacgtggtgcttgtcatcggtgccaacccgaccgacggccatccggttttcggttcgcgactgaagaagcggctgcgtcagggcgcgaaactgatcgtcatcgatccgcgccgcattgatcttgtgcgcacgccgcatgtggaggccgctttccatctgccgttgctgccgggaacaaacgttgccgtcctgacagcactggcgcatgtgatagtcacggaagggttgttcaacgaggccttcattcgcgagcgttgcgactggtcggaattcgaggactgggccgcttttgtcgccgagccgcagcatagcccggaagagacggaacgtttcacgggcgtaccggctgaagatctgcgtggtgcggcccgcctttatgccaccggcggtaatggcgcgatctattacggtcttggtgtcacggaacacagccagggttcgaccaccgtcatggcaatcgccaatcttgccatggtcacgggcaacatcggccgccccggtgtcggcgtcaacccgctgcgcggtcagaacaatgtgcagggctcctgcgacatggagtctttcccgcatgagctgccgggctatcgccatatctccgacgatgcgacacgcgacgtgttcgagaaactctggggcgtgaagctcaacaacgaaccggggctgcgtattcccaacatgctggacgccgccgttgatggcagcttcaaaggcatctacatccaaggtgaggacattctccagtccgatccggacaccaagcacgtatccgccggcctagctgccatggaatgtgttgtcgtgcacgatctcttcctcaacgagacggcgaattatgcccatgtgttcctgccgggttccaccttcctcgaaaaggacggcaccttcaccaatgcggagcgccgcatcaaccgcgtgcgcaaggtcatgtcgccgaagaacggttatgctgactgggaagtgacccagaaactggcgcaggccatgggccttacctggaactacacgcatccctccgagatcatggacgaaatcgcggcaacgacgccaagctttgccagcgtttcctacgcctatctggaagagaaggggtcggtgcagtggccctgcaacgaaaaattccctgaagggtcgccgatcatgcatgtggacggtttcgtgcgtggcaagggtaagttcatccgcaccgaatatgtggcgacggatgaacgcaccggtccgcgtttcccgctgctgctcaccaccggccgcatcctgtcgcaatataatgtcggcgcgcagacacggcgcaccgaaaacgtcgtctggcacgaggaggatcgcctggaaatccatccgcacgatgccgaacagcgcggcgtgaaggatggcgactggatcaagctcgtcagccggtccggcgatacgacgctccgggcgctgatcaccgaccgtgtggcaccgggtgtggtctatacgaccttccatcaccccggcacgcaggcgaacgtcatcaccaccgacttctccgactgggcgaccaattgtccggaatacaaggtgacggcggttcaggtgtcgccctccaacgggccgacggaatggcaggaagaatatgatgcgctcgcgcgtcagtcccgccggatcgccggcaagctcgaagctgcggaataatcgggggccgggccagtcccggccttc

SEQ ID NO: 37904 - DNA, 657 bp, Agrobacterium tumefaciens
atgaaggttttcgcaggcaattcgaaccggcacctcgccgaagcgatctgcaagtatctgaacgttcctctcggaaatgccactgtaaagcggtttgctgaccaggaaatattcgtagaaatcagcgagaacgtgcgcggcgaggacgtttttatcgtccagtccacctccttcccggcaaatgatcatctgatggaactgctcatcatgatcgatgccatgcgccgctcttcggcaaaacgtatcaccgcggtgcttccctatttcggttacgcccgccaggaccgcaaagccggtccccgcaccccgatttccgccaagctcgttgccaacctgattaccgaagccggcgccgaccgcgttctaacgctcgatcttcatgccggccagatccagggttttttcgacatccccaccgacaacctcttcgcagcgcccattctcgcccgcgacgtgaaggaccattacgacaccaacaatgtcatggtcgtttcgcctgatgtcggcggcgtggttcgcgcccgcgccctgtcgaagcgcctcgactgtctgctggcaatcgtcgacaaacgccgtgaccgtcccggtgaatccgaggtcatgaacgtcatcggcgatgtctccggcaaggattgcatcctgatcgacgatatcatc

SEQ ID NO: 37905 - DNA, 1401 bp, Agrobacterium tumefaciens
atgaccatcgacatcaaaaatatcgcggaaatggatcgaaacgccgttctgcatcccttcacgcagctcaaggattttgccagcggtaaactcggcgaacccaccatcgttgaaaccggcaagggcatccgcattcaggacgcgcacggcaagcaattgatcgatggatttgccggtctttattgcgtcaatgtcggttatggccgcaccgaggtagctgaggcgatttcgcgacaggcctaccgcctcgcctattatcattcctacgccgctcacacgacggatgaactggccatcctttccgaccgcctcgtcaggatggcaccgggcaaaatgagcaaggtgttctacggcatgtcggggtccgacgccaacgagacgcaggccaaactcgtctggtattacaacaatctgcgtggcaagccgcagaagaagaagatcatctcccgcgagaggggatatcacggctgcagcgtcgtcgccggctcgatgacaggcatgagtttttatcacgaccacatggaccttccacgggtcggcatcctccataccggcgttccgcatcactattggggcgcggaagccggtgaaaccgaactggaattctcaaaacgacgcgccgccgaactggaagccctcattctgcgcgaaggaccggacacgatcggagcattcatcgccgagccggtgcttggaacgggcggtatcacaccgccgccggaaggttactggccagccatccaggaggttctcaaaaaatacgatgtgctgttgattgcggatgaggttattaccggcttcggccgcacgggttccatgtttggttcacagcattacggcatcgaaccggatctgatcaccgtcgctaaaggcctgacctcggcctatttcccgctttccggcgccatcgtaggggagaaagtctacacggtgatggaggacggcgcggatcgcgtcggcgccttctcccacggctacacctattccggccatcctatcggcgcggcggcggcaaacgccgtgctcgacatcgtcgaaaaggaagacctgccgggcaacgcacaggccgttggcagctatttccaggaacagctccccgcgaagttcgcccagcttcctatcgtcggcgaggtgcgcggtgtgggactgatgggcgctatcgagttcgtcgctgatcgggaaaagaagacccgttttgcccctcatctgacggtcggcgcacgcgtttcaaaggcggcgcgcaacggcggcctcattgcgcgcgccatgccgcacggcgatattctcggctttgcaccgccgctcgtcacaacgaaggcggaggtggacgaaatcatcgccatcgcggaagccgccgtgcgcaccgtcatggacgatctggtccaggccggcgagaaaatc

SEQ ID NO: 37906 - DNA, 852 bp, Agrobacterium tumefaciens
cgcgaccgcatcatcgccgaccttaaggatatcctgccggaggactgtcttgtgcacgagccgcgcgagctcgtgcctttcgaaaccgatgccttcgtctcctatcgccgcctgccgctggccgtagcactgccgaaaacgacggaagaagtggcggcagtgatgagatattgccaccgttacggcattcccgtcgtgccgcgcggcgccggcacctcgctgtccggtggcgctattccgcaagaggatgctgtcgtgatcggcctctcgaagatgagcgcgatcctcgatcttgatttttacaatcgcacggcgcgggtgcaggcgggtgtcaccaatctttccatttccgatgcggccggggctgagggttttttttatgcgcccgatcccagctcgcagctcgcctgcaccattggcggcaatatcggcatgaattccggtggtgcgcattgtctgaaatatggtgtcaccaccaataatctgcttggcgtgaaaatggtgctggtggatggcacggtgctggaactgggcggcaatcacctcgatgccgcaggctacgatcttctcgctctcgtctgcggttcggaaggccagctcggcatcgtcacggaagcgacggtgcggctgatcgccaggccggaaggggcacggcccgtgctgttcggtttccagacctctgaagaagcgggctcctgcgtagccgatatcatcggcgccggcatcatccctgttgcaatcgaattcatggacaaaccggccatcgagatttgcgaggccttcgccaaggcgggctatccacttgacgtcggtgcgcttctgatcatcgaggtcgaaggctccgaggcggaa

SEQ ID NO: 37907 - DNA, 234 bp, Agrobacterium tumefaciens; identical to SEQ ID NO: 35411

SEQ ID NO: 37908 - DNA, 1089 bp, Agrobacterium tumefaciens
ttggcgatgaggcgtgtcgttatcaccggtaccggcatggtatctcctcttggatgcggaacggaagtgacctgggagcggctgttggccggccagaatggtgcccgtctcgtgactgaattcgaggtcgaagacctgcccgcaaagatcgcctgccgcattcccgtcggcgacggctccaacggcaccttcaatgccgatgactggatggagcccaaggaacaacgcaaggtcgatcctttcattctctacggcatggctgccgccgacatggcgcttgccgacgcaaactggcatccggaaacggacgacgaccagatcgctaccggcgttctgatcggctccggcattggcggtctggaaggcattgtcgaggcgggttacacgctgcgcgacaagggcccacgccgcatttctccattcttcattcccggccgtctgatcaacctcgtatccggtcaggtttccattcgccacaagctgcgtggaccgaatcattccgtggtaacggcctgctcgaccggcagcacacgctatcggcgacgccgcccgactgatcgcgcttggcgatgccgaggtcatggtcgccggtggtgccgaatcgccggtctgccgcatttcgctcgccggatttgccgcctgcaaggcgctctccacccagcacaatgacgatccgcaaaaggcctcgcgcccctatgatcgcgaccgcgacggtttcgtcatgggcgagggtgccggcatcgttgttctcgaagaactcgaacacgccaaggcgcgcggcgcgaagatttacgccgaagtcgtcggttatggcctgtccggcgatgccttccacatcacggcgccgtccgaggatggcgacggtgcgtatcgctgcatgtccatggcgctgaagcgcgctggcctcacgcctgacgatatcgactatatcaacgcccacggcacctccaccatggccgacacgatcgagcttggcgcggtcgaacgtctggtcggcgaatctgctccgaagatttccatgtcttccaccaagtcggccaccggccatcttctcggcgctgccggcgcaatccaggcgattttcgcgac

SEQ ID NO: 37909 - DNA, 732 bp, Agrobacterium tumefaciens; identical to SEQ ID NO: 35194

SEQ ID NO: 37910 - DNA, 888 bp, Agrobacterium tumefaciens; identical to SEQ ID NO: 35356

SEQ ID NO: 37911 - DNA, 1839 bp, Agrobacterium tumefaciens
gttgcctatctggacaagttgaacgagcagcagcgcaaggcggtggaacacggtgtcggcctggcggatggagagacggccggtccgctgctgatcattgccggcgccggttccggcaagaccaatacgctcgcccaccgcgtcgcccatctgatcgtgaatggcgccgatccccgccgcattctgctgatgacgttttcgcggcgggctgcctccgaaatgtcgcggcgtgtcgagcggatctgcaagcaggttatcggggcaaattcggcaatcatgaccgatgcactggcctggtcaggcacgtttcacggtatcggcgcacgcctgttgcgcatctatgccgaacagatcgggctcaatatcgatttcaccatccacgaccgcgaggacagcgccgacctgatgaaccttgtccggcacgaactcggtttttccaagacagaaagccgctttccaacgaaggggacatgccttgcgatctattcgcgcgccgtgaattcccagacgccgttaaaagacattcttcgccaacactatccatgggtcgccgactggcagagcgaactgaaggaactgtttgcagcctatgtcgaggccaagcagatccagaacgtgctcgattacgacgatctcctgctctactgggcgcagatggtcagcgatcccattctggctgatgatatcggcaaccgtttcgaccatgtgatggtggatgaatatcaggataccaaccggctgcaggcctcggtgctgatggcaatgaaacccggtggccgcggcctgaccgtggtgggcgacgatgcgcagtcgatctattcgttccgggccgcgacggtgcgcaacatcctcgattttccggcgtgcttcaacccggcggccgatatcatcacgctggatcgcaactatcgctcgacgcagcctattctggccgccgccaatggcgtcatcgacctggcgcgtgaacgttttaccaagaacctgtggacagagcggcagtcgctcgagcgcccgaagctcgtgacggtgaaggatgaaaccgaacaggcgaatttcatcatcgaccagattcttgccaatcgcgaaaccggcacgacgctgaaacagcaggccgtgctgttccgcacctctagccacagcggcccgctcgaagttgaactcacccgccgcaatatccccttcgtcaaattcggcggcctgaaattcctcgacagcgcccatgtaaaggacatgctggcggtgctccgtttcgcccagaacccgcgcgaccgcgtcgccggtttccggctgctgcagatgctgccaggcatcgggccgaagaaggccggcaatatcctcgatacgatagccccggacccggagcccctgcttgcccttgccgaaattccaccgccgccgaagaccggtgacgactggacggctttcacgcaattgctagtggggctgcggcggggcccgaacggctggccgggcgaaatcggcttggcgcgcctgtggtacgagccccatctcgaacgcatccatgaggatgccgacacccgcaaggccgatctgcagcaactcgagcagatcgccggcggctatccttcacgcgagcgttttctgaccgagctgacgcttgacccgccggacgccaccagcgatcaggccggcgtcccgcttctcgacgaagactatctcagcctctctaccatccattcggccaagggccaggaatggcgttccgtgttcatcctcaacgtggtcgatggctgtataccctccgacctcggggtcggcaccagccaggaactggaggaagagcgccggctactctacgtcgccatgacccgcgccaag

SEQ ID NO: 37912 - DNA, 1413 bp, Agrobacterium tumefaciens
ttcatcggcggccggttgatcccggctcaaaacggcatcgacatgcatcgcccctcggacggcgtcgaatatgccggctgccccagggcgaatgccgcgctggtcgatgaagcggtgcagaccgccaaggccgccctgaaaagcagcaactggggtggcgtgcgcccgcgcgaacgcacgaaaatcctgcagcgctgggcagacctgatcgagcaggaagccgagacgctggcgaaaatcgaggccctgtcctctacgcggcccgtcggccagctgatcgccggcgacatcgccgtgaccgccgaacagatccgtttcttcgccgaattcgccgacaaggaaggcggcgatctcgtgccaaccgacgatgccagcctcggcatgatcatgaccgaaccctatggcgtagtcggcgcgattacaccgtggaatttccccgtctcgatggccggctggaaactcggcccggcgctcgcggccggtaatgccgtggtgctgaaaccatcggaaatgacgcctttttccagcattttcatggctgaactggccatcaaggccggcctgcccgccggcctcatcaacgtcgtgctcggcgacggtcccgtgacgggcaacgccatcaccggccatcccgagatttccaaggtcagttttaccggctctaccgcggcgggcgccgccatcatggccaatgtcgcccgcaccggcatcaagcccatgacgctggaattgggtggcaaaagcccgcaactggtctttgccgatgccgatatcgaaaaggcggcagcggcgatcgccggcaatattctctcaaatgcgggacaggcctgtgtcgccggctcgcgcatcatcgttgaggaaagtgcggccgacgccctttccgccgcgatcatcgcccgcatgaagacggtaaagcccggccctacttgggacgaggccacccaatattcgccgatcatctccgaagtgcagcgccagcgtatagacggtatcgtgcaggcagccgtcgcccatggcggcgaatgcctgacgggtggcgcaatcatggatggtcccggttatttctaccagccgacgctgatcgccaatgtcgaccagacctcgcccgccgtcaccgaggaaatcttcgggccggtgctgacactacagaccttccgcacggaagaagaggctctggcgcttgccgatcatccgacatacggtctggcggcgggtcttttcagccgggacgtctcgcgtgtcctgcgcctgtcgcgcgctatccaggcgggaacgatctgggtcaatcgctatggacgttcgcgcgaccacatcctgccgaccggcggttacaagcgttccggcatcggcaaggatcttggacgggacgcctatctcgccaaccgcaagagcaaaagcgtcctcatcggactg

SEQ ID NO: 37913 - DNA, 1245 bp, Agrobacterium tumefaciens
aaagcgcgggtttcagtccaccgggacttccggattgggcgtatcgacgatcgcctatattccgccttcatcgaacatatggggcgtgcgatctatggcgggatttacgagcccggccatccgcaggcggatgcgaacggctttcgcaaggacgtcctgaaattcgtgcaggacctgaaaatcccggccatccgttatcccggcggcaacttcgtctctgcctatcgctgggaagacggcatcggcccgcgcgaccagcgtcccatccgtctcgaccttgcctggcgctcgaaggaaaccaaccagatcggcatcaatgagtttgccgactgggcgcagatggccggcatcgagatgatgcttgccgtcaatctcggttcccgtggcctggatgatgcccgcaactttctcgaatatgtgaattttccaggcggtacggcgctcagcgatctgcgccgcagccacggcaccgaaaagccgcatggcgtgaaaatgtggtgcctcggcaacgagatggacggcccctggcagatcggccacaagacggcagtggaatatggccgtctggccaacgaaaccgccaaggccttcaagggcttcgatcccaccattgaagcgattgtctgcggcagttccaatgacggcatgccgacctatcccgaatgggagcgcgaggtgctggaggagtgctacgagaatgtcgatcacatctcgctgcacaaatatttcggcaataacagccgcgacacgctgaattatttcggcaagatcgaggaaaccgggcgttacatccagaccattgccggtgtcatcgattacgtgaaggcgaagaagcgcgccaagaacgacgtgtccatctgctttgacgaatggaatgtctggtatcacatccgcgaagacgacggcaaacgcatcaagagctgggactggccggaagcgccggcgctgctggaagagacttacaacttcgaggatgcgctgtttgtcgccggcctgctcaacgaattcatccgccgttcggatcgcgtgcgcatcgcctgcatcgcccagctcgtcaatgtcatcgctcccatccgggcggaaaagaacgggcccgcctggcgccagacgatctattacccctatcagttcgcctcgctttatggccgtggcgttgcgctgaatggcgcggtcgattgcccgacttatgattgcaacgcggccgatgacgtcaaatatctcgacgtcgccggtgtttatgatgaa

SEQ ID NO: 37914 - DNA, 801 bp, Agrobacterium tumefaciens
atctggggtattccgtttgacgcggcaacctccaaccggccgggtgcgcgcttcgggccgcaggcgatccgccgcgcgtccgcgatcttcgacaatgatccgcaatatcccttcgcgcgcgatcttttcgcccatatgccgaccatcgattatggcgactgcctgctcgactacggcaaccattggaaaacgcctgacacgatcgaaaaggaagcgcgcaggatcatctccaagacggattatctgctgacgctcggcggggatcacttcatcacctggccattgctgaaagcgcatgtggccaagcacgggcgtctggcgctagtgcagttcgacgcgcatcaggatacatggttcgatgatggcaagcgcatcgaccacggctccttcgtggcgcgcgccgtgcgcgacggactgatagatcctgaccgttcgatccagatcggtattcgcacccatgcgcccgacgatttcggcatccgtattctccacggttacgaggtggaggatatgcgggcgagcgatattgcctcgctgatcgtcaagcacacgggcggcatgcctgcttacctgaccttcgatatcgattgcctcgatcccgctttcgcaccgggaaccggcacacccgtcgccggcggaccgaccagcgccaagattctctcggttctgcgcgggctcggccagcttgatattcgcggctctgacgtggtggaggtggcacccgcttacgatcatgcggatattaccgccattgccggggccaccgttgcaatgtatatgcttggcctgcgtgccgaacgg

SEQ ID NO: 37915 - DNA, 915 bp, Agrobacterium tumefaciens
aagatcttcatcgatggcgaacacggcaccacgggtctgcagatccgcacgcgccttgccggtcgccgcgatatcgagctgctgtccattccagagaccgagcgccgcaacgcggcgatgcgcgaggatttgctcaacaacgccgacatttcgatcctctgcctgcggatgaatgcctcgaaggaggctgtctccatggtggccggcaacaataatgtccgcattatcgacacctccaccgcctatcgcgtccatcaggactgggcttacggttttgccgaaatggaccgggaccagggcgagaaggttcgctcggcccgtttcgtcgccaatcccggctgctacccgaccggcgcaatcggcctcatccgtccgctgcgcgctagcggcatcctgcccgacggttatccggtcagtgtcaatgcggtctccggttacaccggcggtggcaagcagatgatcgcgcagatggaggaccaaagccgcgacgatgcgatcagcgccaataatttcctgtatggcctgacgctgaagcacaagcacgtgccggaaatgaccattcacggtcagctcgaccgcgcaccgctgtttgcgccctccgtcgggcgtttcccgcagggcatgatcgtgcaggttccgctgtttgcagcggaccttgcggaaggcaccacgatcgaaaccatccatgcggcgctgaccgcccattatgcgggccaggacatcgtcagcgtcgtgccgcttgccgaaagcaaggggatttcccgcatcgacgctgaggagctggcgggcaaggacacgatgaagctcttcgttttcggtacgccgggcggtgagcatatcaatctcgtggcgctgctcgacaatctcggcaagggtgcctccggcgctgcggtacagaacatggagttgatgctc

SEQ ID NO: 37916 - DNA, 738 bp, Agrobacterium tumefaciens
ataaccacctggaacatcaactcggtcaggctcagaatgccaatcgttgagcagtttctggtgcgttacaaacccgacattctctgcctgcaggaaacgaaatgcccgaatggcgagtttccgatgaaaccgctaaaagcactcggttacgagcacgtcatcatccatggtcaaaaaggctatcatggtgtggcgatcgcttcgaaaatcccgctgaccgaagaccaccggcaggattattgcggcatcggcgatgccaggcatatttccgcgattttccaggtcggatcgcgccgcgtgcggctgcataatttctacgttccggctggcggcgacgagccggatcggtcgatcaatccgaaattcggccacaagctcgatttcatcgaggaaatgaaggcactgcgcgccgatggcgtgcccgggacctcctccattctcgtcggcgatctcaacattgcaccgcttgaaaatgacgtctggtcgcacaagcagcttctgaagatcgtcagccacacgcctgtcgaaaccgaaggcatgctggatatcatgaagaagggcaactggctcgatctgatgcgcctgaacgtgccggagacggaaaagatctatacgtggtggagctaccgcgccaaggattgggaagccgctaaccgcgggcgccgtctcgaccatatctggtcctcacaggacctcggttcctcgcttgaaaaaatcgagatattgcgtgaagcccgc

SEQ ID NO: 37917 - DNA, 885 bp, Agrobacterium tumefaciens; identical to SEQ ID NO: 35469

SEQ ID NO: 37918 - DNA, 855 bp, Agrobacterium tumefaciens
  unsure (1)..(855): unsure at all n locations
gacccgcgcagccagtatccccgcccgccgttttcaaccccgacccaggaaatgccgggtctggtgacgaatatgacgcctttccctgatcatggtgaaaagagctacaagggcaccggcaagcttgcggngcgcaaggcactgattaccggcggcgattccggcatcgggcgcgcagtcgcaatcgcttttgcgcgggaaggtgccgatgtcgcgatatcctatctgccggaggaagaatcggatgccgaggaagttgttgcactgatcgaggcggaaggccgcgtggcggtagcgctcccgggcgatattaccgacgaggcatggtgccgtgaactggtcgagaaagccgtcagcgatctcaatgggcttgatattcttgtcattaacgccgcaaggcagcaatatcgcgaagacatcgaagagctctcgaccgatgatttcgaccgcaccatgaagaccaatctttatgcgttgcactggattgcgcaggcggctgttccatatctgaagccgggtgcgtctgttatcaccaccgcgtccatccaggcctatgaaccatcggccatccttctcgattacgccacgaccaaggccggtatcgtcgcttataccaaggcgctcgcaaagcagctgatcgaaaagggcgtgcgcgccaatgcggtagcgcccggtccgttctggacggttcttcagccgagtggcggccagccggatgagaaggtgaagaacttcggcaaggacagcgatttcggccgtccgggacagcctgtggaactggcacctgtttatgtgctgctcgcctcgcaggatgcgagtttcatcaatggtgaagtatatggcgtgaccggtggg

SEQ ID NO: 37919 - DNA, 649 bp, Agrobacterium tumefaciens
acccagatattttcgcaagagttcgcggccttcctgttcgacatggacggaacgctggtcaattcgattgccgttgtcgagcgcgtctggcgggagtgggccgttgcaaacggtatcgagccgaacgcatttctgcaacgtatccatggcatgcgggcttccgaggtaatacgccgcgaggcggttcccggcctggacgtggatgccgaggccgacatgatcttgcgcgccgagatggatgacgtggagggcatcattccgataccgggcgccgcagactttcttgcgtctttgcccgcgggaaaatgggctatcgtcacctccgccgtgcgtgaactggcggaaaaacggctcgcggcggccggcatcacaccgccacccgtgatgatctgcgccgacgatgtggtcaacggcaagcccgatcccgaaggttaccggaaggcccgccgaaaggctcggcgttgcgccggaaagctgcgtcgtcttcgaagatgcgcccgcgggcatccaggccggcgaacgcatgggggctgcggtggtggtcatcaacgtgacccattcccacccgatcgagacgccgcatcttgccatcggcagttacggtgaactggatgtggtgatcgacgggaatggtggcctgaagctgacc

SEQ ID NO: 37920 - DNA, 878 bp, Agrobacterium tumefaciens
atgccttcactaaaggatctgaaaaaccgcattgcctccgtgaaggcgacgcagaagattaccaaggcgatgaaaatggtcgccgcggcgaagcttcggcgcgcccaggaagctgcggaggccgcccggccttattctcagcgcatgagcgccgttcttgccaacatcgccacggcggtcgaggcggacgttgctccggcgctgatgaccggcaccggcaaggacgacgtgcatctgctcgtcgtctgcacggctgaacgtggtctttgcggcggtttcaactcgcaaatcgcccgttttgcccgcgatcaagcccgcaagctgatttccgaaggcaagacggtcaagatcatcacggtcggcaagaagggttacgacagccttcgccgcgaatttgcatcgctcatcatcgagcgtatcgaactgcgtgacgtgaagaaggtcggctttgaaaacgccgaccagatcgccaagaaggtgatctcgctcttcaacgcgggtgaattcgacgtctgcacgctgatctactcggaattcaagtccgtcatcagccagatcccgaccggcctgcagctcattccggccgcaacgcctgttgtggaagcggctgagacgacgcagaccgccgtctacgaatatgagccggatgcggcttctattctggaagaccttattccgcgcaacatttcggttcaggttttccgggctctgctcgaaacgttgccggtgaaatgggcgccaagatgagcgcgatggacaatgcaacgcgcaatgccggtgagatgatcaacaagctgacgctttcctataaccgtcagcgtcaggctcagatcaccaaggaactcattgaaatcatttcgggcgcggaagcgctctga

SEQ ID NO: 37921 - DNA, 420 bp, Agrobacterium tumefaciens; identical to SEQ ID NO: 35409

SEQ ID NO: 37922 - DNA, 489 bp, Agrobacterium tumefaciens; identical to SEQ ID NO: 35489

SEQ ID NO: 37923 - DNA, 765 bp, Agrobacterium tumefaciens
cgcattccggaagacgatgtcaggcgcattctgccggaagcgctgaaacttggtttccgccatgtcgataccgcccagatctacaagaacgagggtgccgtcggcgaggttatcgcgcaatcgggcatttcccggcacgatatctttctcaccaccaaagtctgggtggaccgctaccgccatgacgattttctcgcctccgtcgatgaaagccttgcgaaactgaagaccgactatttcgacctgctgcttctgcactggccgaaaagtgacgtgccgcttgccgagcgcatgggcgcgttgaatgcggtgcgcaaggccggcaaggcccgcaatatcggcatttccaacttcaacgtggcgctgaccgaagaagcggtgaaactttccgacacgccgcttgccaccaaccagatcgaatatcacccctatctcgaccagacgaaggtgatttcggcggcccgtaaacacggcatgtcggtgacggcctattatctgatggccgatggcaaggtgccgaacgatcccgttctcaaggatatcggcgcgaaacacggcaagaccgccgcacaggtgaccctgcgctgggccgtgcagcagccggatatcgtggcgctttccaagacggcgacggaaagccgcctcaaggagaatttcgacattttcgattttgcgctctcggaagaggaaatgcaggcgatccatgcgcttgccaagccgaatggccgcatcgtcagccccggccacctcgcgcccgattgggac

SEQ ID NO: 37924 - DNA, 1905 bp, Agrobacterium tumefaciens
gaaaaggccgaacgattgaccggaatgccacagacaccattgctcgaccgggtgaattttccctccgatctcaaggagatcgatgatcgcgacctgccggaactggcacgggaactgcgcgacgagatgattgacgcggtgtcgaagaccggtggccatctgggtgccggcctcggtgtggtggaactgacgattgccattcacaaggtgttcaacacgccggaagaccggctgatcttcgatgtcggccaccaatgttatccgcacaaaatcctgaccggccggcgtgaccgcatccgcacgcttcgacaggaagacgggctttccggtttcacgcggcgggccgaaagcgaatatgacgattttggcgccggccattcctccacctccatttccgccggtctcggcatggcggtggcggcggggctcgatggcagcgaccgcaaggtcatcgccgtgatcggcgacggttcaatgtcggccggcatggcgttcgaagcgctcaacaatgccggtgcactcgatgcgcggctgatcgtcatcctcaacgataacgacatgtcgattgcgccgccgacgggtgcgatgagcgcctatctggcgcggctggcctccggccgcacctatatgggctttcgcgatttcggcaagaaactgaccgcctatctcggcaagaccatcgatcgcgccattacccgcgccgtgacccatgcccgcggttatgtgaccggcggcacgctgttcgaggagcttggtttctatcacatcggcccgatcgacggtcattccttcgatcaccttttgccggtgcttcgcaatgtgcgcgacaaccagaaaggccctgtcctgatccatgtggtgacgcagaagggcaagggttacgccccggcggaagcggcagcggacaaatatcacggcgtcaacaagttcgacgtcatcaccggcgcgcaggcgaaagccaagccaaatgcgccgagctataccagcgtgtttgccgaagcgctgatccaggaagcgaccctcgacgagaagatcatcggtgtcaccgctgccatgccgaatggtaccgggctggacaagatggccgagcttttcccgtcccgcaccttcgatgtcggcattgccgagcaacacgcagtcaccttcgcggcgggacttgcggccgatggttacaagccgttctgcgcgctttattccaccttcctgcaacgcggttacgaccagctggtgcatgatgtggcgatccagagcttgcccgtgcgtttccccatcgatcgcgccggcttcgtcggcgccgacggaccgacccatgccggctccttcgacacgacgttcctcgccaccctgcccggcatggtggtgatggcggcggccgacgaggcggagctaaaacatatggtccgcacggcggcggcttacgatgaaggcccgatttcattccgttatccgcgcggcgaaggtgtcggcgtcgaaatgccggcacgcggtgagattctccagatcggcaaaggccgcatcatcaaggaaggcaccaaggttgccctcctctccttcggaacgcggcttgcggaatgccttgcggccgccgaagatctcgatgccgcgggcctttcgactacggttgccgatgcgcgcttcgccaagccgctcgatctcgatctcatccgccagcttgccgcccatcacgaggttctggtaacgatcgaggaaggttctgtcggcggttttggtgcgcatgtgctgcatttcatggccagcgccggcctactcgaccatggcccgaaggttcggaccctgaccctgcccgaccagtgggtggagcaggccaagcctgagaccatgtatgccaatgccggcctcgaccgcgccggcatcgtttccaccgtgtttaatgcgctcggccag

SEQ ID NO: 37925 - DNA, 1422 bp, Agrobacterium tumefaciens
atggcaaagctcaaggttgacggtaaagagatcgaggttccggatcatttcacgctgttgcaggcgtgcgaggaggctggtgccgaagttccgcgcttttgttttcatgagcgcttgtcggtcgcgggtaactgccgcatgtgtctcatcgaggtgaagggcggaccaccgaagccggccgcctcctgcgccatgggcgtgcgcgatgttcgcggcggcccgaatggcgaattgcctgaggttttcaccaacacaccgatggtcaaaaaggcccgcgaaggtgtgatggagttcctgctcatcaaccacccgctcgattgcccgatctgcgaccagggcggcgaatgcgacctgcaggaccaggccatggccttcggtatcgccggttcgcgttacgcggaaaacaagcgcgcggttgaagacaaatatatcggcccgctcgtcaagacggtcatgaaccgctgcattcactgcacgcgctgcgtccgtttcaccacggaagtggccggcattgccgaactcggcctcatcggccgcggcgaagatgccgaaatcaccacctatctcgaacaggccatgacgtctgagcttcagggcaacgtcgtcgacctttgcccggttggtgcgctcacttccaagccattcgctttcaccgcccgtccgtgggaactgaacaagaccgaaaccatcgacgtgatggacgcgctcggttcggccatccgcgtcgatacccgtggccgcgaagtcatgcgcgtcatgccgcgtgtcaacgaggcgatcaacgaagagtggatttccgacaagagccgcttcatctgggacggcctgaagacgcagcgcctcgaccggccttacgtccgcaaggatggccggctgcagcccgccacttggggcgaagcctttggcgccatcaagcaggctgtagccgcaacgtcgggttcgaaaattggcgcaatcgccggcgatctgtcctccgtcgaagagatgttcgcgctgaagtcgctgctcgcttcgctcggctcggccaatgtcgattgccgtcaggatggcgcagcgcttgatccgtctttgggtcgtgccagctatatcttcaattccactattgaaggcatcgaacacgccgacgctctgctgatcgttggttccaacccgcgcttcgaagcggccgtgctcaacgcccgcatccgcaagcgctggcgtcgcggcggtttcccgatcggtgtgatcggtgaggccggtgagctgcgctacaattacgaatatctcggctcgggcgcggaaacgctttccgatctcgccaatggctcgcacagcttcatcgacaagctgaaatccgccaagaacccactgatcatcatcggtcagggcgctctggcacgtgccgatggtgctgccgttctcgcggctgctgcaaaacttgcc

SEQ ID NO: 37926 - DNA, 1231 bp, Agrobacterium tumefaciens
  unsure (1)..(1231): unsure at all n locations
atgacgaatgttgtggtggtcggctcgcaatggggcgacgaaggcaaaggcaagattgtcgactggctgtccgagcgggcagatgtcgtcgtgcgatatcaaggcggccataatgccggccacacgcttgtcatcgacggcatcagctacaagctttcgcttctgccgtccggcgtcgtgcgttccgggcaagctcgccgtcatcggcaatggcgtcgtggtcgatccgcatgcgctgattgctgaaatcggccgtctggaagtgcagggcgtcaaggtcacgccggaaaacctgcgcatcgccgacaatgccacgctcattctttccctgcaccgcgaactggatggcatgcgcgaagacgccgcctccaacagcggcaccaagattggcaccacccgtcgcggcatcggcccggcttacgaagacaaggttggccgccgcgccatccgcgttatggatctcgccgacatggaggcgctctccgccaaggtcgatcgcatcctgacgcatcacaatgcacttcggccgtggtttcggcgcgaccgaggtgtcgcatgaaaccatcatggaagagctgggctcgattgccgagcgcatcctgccgttcagcgaaaccgtctggctgctgctcgacaagaagcgccgcgccggtgcgcgcatcctgtttgagggcgctcaagtgctagatgcttgataangtccacggcacatacccttatgtgacctcgtccaacacggttgtcggtcaggccgctgccggttcgggcatgggtccgggatcgctcggttatattctcggcatcaccaaggcttacaccacccgcgtgggcgaaggcccgttcccgaccgagctgcatgacgaaatcggccagttcctcggtgaaaagggtcatgaattcggcaccgtcaccggccgcaagcgccgctgcggctggttcgatgcggcactggtgcgccagtcggtcgccaccaacggtattaccggcatcgcgctgaccaagcttgacgttctcgacggtctcgacgagctgaaaatctgcgtcggctacaagcttgacggtcaggaaatcgaccatcttccggcaagccagggtgcgcaggctcgtgttgagcctatctatgtcacgttggaaggctggaaagaatctaccgtcggtgcccgaaaatgggcggatttgcctgctcaggcaatcaaatatgtccgtcaggtcgaagagctgatcggggcgc

SEQ ID NO: 37927 - DNA, 540 bp, Agrobacterium tumefaciens; identical to SEQ ID NO: 35122

SEQ ID NO: 37928 - DNA, 898 bp, Agrobacterium tumefaciens
ttaatgacgacatttgatattcgccaggcgctgcacggcatctccggcgttcccgttacggcatatgacgccgatggagagatcagtttcgacatcaccgccgaggcctacgcccgtgtggccagggccggcattcacaacatcgtcgcggctggcaatacaggcgagttttacgcgttgacgcccgctgaaatcctgacggtttacgaggccgcaatcaaaggcgtggacggcattgctcccgtcaccgcagccattggacgctcgcagcgcgaagcaattgcgatggcgcggaccgcaaaggaactcggcgcatccgcagtgatgtctcaccaaccggttgatccgttcgccgctcctcaatctcaaatcgcctatttcctggggctggctgaagacagcgcgcttcctcttgtcgcctatgtacgggccgatggatttgcggtggacgatatggtgaggctctccagccatccaaatgtcgcgggcatcaaattcgccacgacagatatcatgctgctgtcgcgcgccatcgccgcctccgacgcagacggagccttgtatatttgcggccttgcagaaagctgggccccagccttcgccgcagtcggagcgcgtggcttcacctccggtctcgttaatgtcgccccgcatttttcaatgcaggtacacgaggctctcatggcaggcgatttcgacagcgcccgaaagatcgttgagaagatcgaattgttcgagcggctgcgcacgcgctaccgaaacggcgccaatggtgactgtagtgaaagaagctatggaaatcatggggctcgccgtcggtccggtgcgcgcccctgggctcgtgcgcttggatgcgcctgaccgcgctttgctcgaaaacctgctggccagctggaaa

SEQ ID NO: 37929 - DNA, 786 bp, Agrobacterium tumefaciens
cgggtgggcgagtctccgacatgggacgagcgaaccggcgacctgtggttcgtggacattctggcgcctgcaattttttgcctatcaccaagcggaaaactccagcgtttcgacatgccggcacagatcggctgtcttggcctctgccaaagtaacctgatcgtcgcggcattgaagacaggcgttcatctgctcaatccgcagaatggtgaactcgagcttctctgcgatcccgatgaggggagagccgacagccggttgaatgatggaaaggttggcccagatggtcacttctgggtgggcacaagagatgaggcagacgttcccaccggcaatgctcgcctctatcgcgtttcttccagcggtcacgtcgagcgcttcatagacggcgatatgttgacgtccaacggtctcgcctggagcccggacgagacacggatgtaccattcagatagcagcgggctgctgcttcaggttttcgacttcgatgttcaaacgggcaggcttgggcccgccaaacgcctccatgattttcagccggacgaaggcaggccggatggtgctgcgacagacagcgaaggttgttactggagtgccggtgtgcaggcgggcagattgaaccgcttcacccccgatggcgaattgtttgaaatctacaagatgccattcaagggtccgaccatgccctgcttcggcggtcccgaactcaagacactctacgttaccagccttgtgacagacacaaacggcgtcgcgacatcaggaacattggttgctttcgacgcg

SEQ ID NO: 37930 - DNA, 1449 bp, Agrobacterium tumefaciens
gtggtggcgcagcttctggcgaaatacacccgcgaggggcttggccatcgcgaagcaatgttgaagatgctgaaccacgtaacgggcgcctatgcgctggtcgtgatgtttcaggacgatcccggtacgctgctttcggcgcgctccggcccgccgcttgcggttggttacggcaggggcgaaatgttcctggggtccgacgcgatcgcgctttcgcccttcaccaacgagatcacctatctggtcgatggcgactgcgccatcgtgacccgggacggcgcggaaatcatcgatttctccggcaagccggtgaaacgcgagcgccagatttcgcaggcgacggcttttgtggtcgacaagggcaatcaccgccatttcatggaaaaggaaatctatgagcagccggaagtcatttcccacgcgctcagccactatgtggatttcgccaccaggaccgtgaaggacgccgataaggcgattgattttgccagcctttccggccttgccatctccgcctgcggcacggcctatctgtcaggcctgatcggcaaatactggttcgagcgttatgcccgcctgccggtggaaatcgatgttgcctcggagttccgttaccgcgaaatcccgcttgttcccacgcaggcggcgctgttcatttcgcaatctggcgaaaccgccgatacgctggcggccctgcgttattgccagcaggagggtctgaagatcggcgcggtggtcaatacccgcgaatcgaccatggcgcgcgaatccgatgcgatctttccgatcctcgccgggccggaaatcggcgttgcctccaccaaggcctttacctgccagcttgcggtgcttgcttcgctggccgttgccgccggcaaggcgcgcggcacgctgaaaccgggtgaagaaaagcagctggtgcagcagctgatcgagatgccgcgcatcatgagcaaggtgttgaacgtcatccagccgcagatcgaggcgctgtcgcgtgacctgtcgcgcttcaaggatgtgctttatctcggccgtggcaccagcttcccgctggcgctggaaggcgcgctgaagctcaaggaaatctcctatatccacgctgaaggttacgccgctggcgagctgaagcatgggcctatcgcgctgatcgacgagaacatgccggttatcgtcattgctccgcacgaccgcttcttcgaaaagaccgtgtcgaacatgcaggaagtagccgcgcgcggcggccgcatcatcttcatcactgatgagaagggtgctgccgcttccaagctcgaaaccatggcgacgatcacgctgcccaatgtcgatgaactgatcgcgccgatggtcttctcgctgccgatccagctgctcgcctatcacaccgccgtcttcatgggcacggatgtggaccagccgcgcaatctggcgaaatcggtgaccgtggaa

SEQ ID NO: 37931 - DNA, 861 bp, Agrobacterium tumefaciens; identical to SEQ ID NO: 35263

SEQ ID NO: 37932 - DNA, 1224 bp, Agrobacterium tumefaciens
actgaaatccgcgtaccaaccctcggcgaatccgtcagcgaagcgaccgtcggcacctggttcaagaaggtcggcgataccgtcaaggccgacgaacctctcgttgaactcgaaaccgacaaggttaccgtcgaagtcccggcccctgcgtcaggcgttctcaccgaaatcgttgcgcagaacggcgagaccgttggtctcgacgcgcttctcggccagatcgccgaaggtgctgccggcgctgcgacttctgcacctgcggcaaagcctgctgcgcccgccgccgcaccggcacctgccgcagccgtagccgccgctccgggtggcagcgccatgccaccggcacctgccgctggcaagctgcttgccgaaaacaacctgtctgccgatcaggttgacggttcgggcaagcgtggtcaggttctgaagggcgacgttcttgccgctgtcgccaagggcgtttcggcacctgccgccgcaccggcaccggttgccgccccccgtccggtttcggccgagcaggatcaggttcgcgaagagcgcgtcaagatgacccgtctgcgccagacgatcgcccgccgcctgaaggacgcgcagaacaccgccgccatgctcaccacttacaacgaagtggacatgagcgcggtcatggaccttcgtaaccgctacaaggacgtgtttgaaaagaagcacggcgtcaagcttggcttcatgggcttcttcaccaaagccgtgacccacgcgctgaaggagctgcctgctgtcaacgctgaaatcgacggcacggacatcatctacaagaactattgtcacgtcggcatggctgtcggcaccgacaagggcctcgtcgttcctgttatccgtgatgccgaccagctctccatcgccggcgtcgaaaaggaactcggtcgccttgccaaggcagcccgtgacggttcgctcggcatggcggacatgcagggcggcaccttcaccatcaccaatggtggcgtctacggttcactaatgtcttcgccgatcctcaacgcaccgcagtcgggcattctcggcatgcacaagatccaggagcgcccggtcgccatcggcggtcaggtcgtcatccgcccgatgatgtatcttgcgctctcctacgatcaccgtatcgttgacggcaaggaagccgtgaccttcctcgttcgcgtcaaggagagcctcgaggatccggaacgtctggttctcgatctc

SEQ ID NO: 37933 - DNA, 618 bp, Agrobacterium tumefaciens; identical to SEQ ID NO: 35483

SEQ ID NO: 37934 - DNA, 789 bp, Agrobacterium tumefaciens
atgagcgaacgcaagggtatgactgttttgaacgggaagacggttacgccgccgccaatatggctgatgcgccaggctgggcgttatcttccggagtatcgggaaacgcgcatgagcgcaggaagtttcctggatctctgttataatcctgagctggcgagcgaagtgacctttcagcccattcgccggtcggggctggatgcggccatcctcttttccgatattcttgtcattcccgacgcgcttcatcgcaatgtgtccttcagcgaaggcaagggcccggccatggatccgatcgatattagcggtatcgaaaagcttgatgcatctgatgtcatggcgcatctttcgcccgttttcgaaacggtgtcgcggctgcgcacctcattgccggatgaaacgacgcttctcggtttttgcggtgcgccttggacagttgcgacctatatgatcgccgggcatgggacgccggaccaggcgccggcgcggctgttcggttatcaggaaccggccgcgatggaaaagctgctggctctcctcgctgaggtctcagccgattatctggtggcgcagatcgatgccggcgccgacgcggttcagatcttcgattcctgggctggcgtgctcggcgaaaaggaattcgaggaatatgcgatcaagccggtcgccaggattatcgcgtctgtgcgcgcccgccgaccttcggcaaagatcatcgctttcgccaagggcgctggttatctgctgagggattatcgccgcaagacgggtgctaacgccattggcctc

SEQ ID NO: 37935 - DNA, 564 bp, Agrobacterium tumefaciens; identical to SEQ ID NO: 35434

SEQ ID NO: 37936 - DNA, 1845 bp, Agrobacterium tumefaciens
agtcatcagattgcgatcgacggcatgacctgcgcctcctgtgtgggtcgtgtggagaaggcgatcgccagggtgccgggcgttttgaaagcctcggtcaatcttgcgacggagcgtgccgatatctccttttccggaccacctgatgtgcccgccgtgattgccgctgtacggcatgcgggttatggcgtcgaagaaaaaaccgtcgaactcgatattgaaggcatgacctgggcctcctgcgtcggacgtgtcgaaaaggcgctgaaggctgtttccggcgtttccgatgcaagcgtcaatcttgcgaccgagcgcgccgccattcgtgtggcgggcaatgccgcttccgccgccactctggcggaggcgatcaagcgggcgggctatcaggcgaaagagatcgtcgccgacaaagccggcgatgcggaacaggacaggcgcgcagcggacatgccgcagtctgaaaatcagccttgccgtcgccgttgtcctgacattgccggtcttcgtgctggaaatgggttcgcacctggtgcctgccatccatgatttcgtcatggaaacggtcggcatgcggaaaagctggtatctgcaattcgtactgaccacgctggtcctattcgggcccggcctgcgcttcttcaagaagggcatacccgcccttatgaggctcgcgccggacatgaattcgcttgtggtgctgggcactgccgccgcctggggattttcggtggtcgcgaccttcctgcccgaaatcctgccgcgcggcacggccaatgtctattatgaggccgcggcggtcatcgtcacgctgatcctgctcggccgtttccttgaagcgcgcgccaaaggccgcaccagcgaggcgataaagcggctcgtcggtcttcaggccaagtcggcccgcgtgctgcgcgacggcgaaaccatcgatgtgcctcttcaggacgtgcgaacgggcgatgtgatcgtcgttcgccccggcgagaaagtgccggtcgacggtctggttctcaacggatcttcttatgtcgatgaatcgatgatcacgggtgagccggttccggttaccaagaccgagggttccgaggtcgtcggtggcacggttaaccgcaatggctccttcaccttccgcgccaccaaggtcggcagcgatacgctgatcgcgcagatcatccgcatggtagaagaagcgcaggccgacaagctgcccattcaggcgctggtggacaaggtgaccaactggttcgtgccagccgtgatgctggcggcacttgtcaccttcgccgtctggttcgtctttggacccgatccggccttgaccttcgcgctcgtcaacgcggttgcggttctcatcatcgcctgtccctgcgccatgggccttgccacgccgacgtcgatcatggtcggcaccggtcgcgccgccgaaatgggcgtgctgttccggcgcggcgatgcgctccagacgctgcgtgacgccgatgtcatcgcggtcgacaagaccggcacgctgacactcggcaagccgaaactggtgcattttaatacgacccagggtttcgatgcggatgaggtgctgcggctcgtcgcctcgcttgagaaccggtctgaacatccgattgccgaggcgatcgtcgaggctgcaaaacatggtggcctgacgcttgccgaagctgaagctttcgaggcgacccccggcttcggtgtcgcggcgacggtcgatggtcgcagggtagaggcgggtgctgaccggttcatggtgaaactcggttatgatgtcggggcctttgccacggatgccgagcggatgggcagggaagggcagtcgccgctttatgccgc

SEQ ID NO: 37937 - DNA, 772 bp, Agrobacterium tumefaciens
atgactaagttcaaactcgagtacatctggctggacggatacaagccggtcgcaaacctgcgcggcaagacacagatcaaggaattcgatgaattccccacactcgagcagttgccgctttggggttttgacggctcctccacccagcaggccgaaggccactcatcggattgcgtgctgaagcccgttgcgatctacccggatccggcccgcaccaacggcgcgctcgtcatgtgcgaagtcatgatgcccgatggcgtcaccccgcacgcttccaacagccgcgccacgatcctcgaagacgaagacgcatggttcggtttcgaacaggaatatttcttctaccaggacggccgcccgctcggtttcccggaacagggttaccccgctccgcagggtccgtattacaccggcgtcggcttcaagaacgtcggctcggttgcccgcgaaatcgttgaagagcacctcgatctctgcctcgaagccggcatcaaccatgaaggcatcaacgccgaagtggccaagggccagtgggaattccaggtattcggcaagggctccaagcgcccatcagaccagatctgaatcgcacgtcactggctattgcgtctttgataacagtccggaatgcacgtaaagttccaatacgagtcgctatgcaatcccgcctcaaacggctcaggcatgcattgcagcttatcaacgtagttcatgcattaagttggcggcaaagatgtatttcaaagccctcatgtccgctttatgcgagaat

SEQ ID NO: 37938 - DNA, 723 bp, Agrobacterium tumefaciens
ccactgaacggaaagatcgcacttgtcacgggtggatcgcgatctattggcgcatcaattgcccagcgtctcgcagcggatggcgctcaggttgccttcacctatcgtggatcacctgcgaaggctgaggaagttgctgtcgccatagaaaaaacgggcgcgcgcgcgctggctattgccgcggatgccgctgatccggacgcgatacgcgctgccgttgccgcgacggtcgataagttcggcggcctcgacattttggtgaacaatgccggtattgcctttgccggtccgatcgacgaaatcgccttcgatgactatcaggcaatgctcgcaatcaacgtaaccggcgttttcgttgccacgcaggaggccgtacgccatatgaaggatggcggccggatcatacatattggcagttcgatcacgaaatatgccggggttcctgggctgtcagcatacggcctcaccaaaggggcagtcgccggtttcaaccgcagtttggctcatgacctcgggccacgcggcatcacagtcaacaccgtgcatccaggcccaaccgacactgatatgaaccctgttgatggtgagtttgccgctatgcagatctcgcgtatcgcggcgggccgctatggaaagccccgggaaattgcgaacgtggtggcattccttgcaagtccggaagcctcgtttgtaacaggtgccgacatccgggccgatggtggt

SEQ ID NO: 37939 - DNA, 437 bp, Agrobacterium tumefaciens
atcctcaatggtccgaacctcaatttgctcggccagcgccagccggagatttacggctacgagacgctcgccgatgtcgaggccgattgccgtgccatcgctgaagccgccggccacgagctgttttttgcccagagcaaccgggaatatgagctgatcgactggatccacgaagcccgcggcaagccgcgggcatcgtcatcaatccgggcgcctttacccatacgtcggtggcgatcctcgatgcgctgaacgccttcgaggcgccggtaatcgaagtccatatttccaacatccacaaacgcgaggtcttccggcaccattcctatgtgtcgacccgtgccgaaggcgtgatcgccggtcttggcatcgaaggttatggggtggcgctacgccacctcatcaaccttttttcccgatcctcgtaatatgctcgg

SEQ ID NO: 37940 - DNA, 1978 bp, Agrobacterium tumefaciens
cgcgaccaggtgcggccggcacacgattatctttccggcctcaacccggaacagcgcgaggccgtggaaacgcttgacggaccggttctcgttctcgccggcgccggcaccggcaagacccgcgttctgacgacccgcatcgcccatattctcgccaccggccgcgcctatccaagccagatccttgccgtgaccttcaccaacaaggcggcccgcgagatgaaggaacgtatcggcgtcctcgtcggcggcgctgtcgagggcatgccgtggcttggcaccttccactccatcggcgtcaagcttctgcgccgccatgccgagctcatcggcctgaaatcggatttcaccattctcgacacggatgatgtggtgcggctgatcaagcagctcattcaggccgaaggtcttgatgacaagcgctggccggcaaaacagttcgccggcatgatcgacggctggaagaacaaggggctgacgccaccggatattcccgagggtgacagccgcgcctttgccaacggcaagggccgcgaactttacgccgcctatcaggcccggctgaaaacgttgaacgcctgcgatttcggtgatctcttgctgcacccgatcagcatcttccgccgccatacggatattctgaaagagtatcaccagaagttccgttatattctggtggacgaatatcagggacaccaacacggcgcaatatatgtggctgcggctgcttgcccagcgcgccaaggacgagccgcagaatgtctgctgcgtcggtgacgacgaccagtcgatctatggctggcgcggcgcggaagtggacaatatcctgcgcttcgacaaggattttcccggtgccaaggtcatcaagcttgagcgtaactaccgttccaccgaacatattctcggcgctgccggccatctgatcgcccacaacgagggccgtctcggcaagacgttgtttaccgagcgcagcagtccggacgatgaaaaggtcgtggtgcacgccgcctgggattcggaagaagaggcccgcgcggtcggagaggaaatcgagcaactccagcgtaagaactacaagctgaacgacatggccatcctcgttcgcgcttccttccagatgcgcgaattcgaagaccgcttcgtgacgcttggcctcaattaccgcgtcatcggcggcccgcgcttttatgagcgcctcgaaatccgcgatgccatggcctatttccggctggtctgccaaccggccgacgatctcgccttcgagcggatcgtcaatacgccaaagcgtggccttggcgatacgacgatccgtaacctgcacgactatgcccgcgcccgcgatatcccgatgctggcagccgccgccgacatcatcgagaccgacgagttgaagccgaaagcgcgcaaggcgctgttcgatgtggtgcaggatttccgccgctggcagggcctgctggaaaacaccgaacacaccacgcttgccgaacagattctcgacgaaagcggctataccgccatgtggcaggccgacaagacggccgaagcaccgggacggcttgagaacctgaaggaactcatccgctcgatggaatccttcgaaagcatgcgtggatttctggaacacgtcgccctggttatggatgcggaacagaatgccgagctggatgccgtctccatcatgacgctgcattccgccaagggtctggaattcgacaccgtcttcctgcccggttgggaagaaggcctgtttccccaccagcgggcgctggacgaaggcggtcgctccggtctggaggaagaacgtcgtctggcttatgtcggcatcacccgcgccaagaagctctgccatatctggttcgtctcgaaccggcgcattcacgggctgtggcaatccaccctgccctcgcgtttcctcgacgaactgccgcccgcccatgtggatgtcgcggcttccgacagcaattatggcggttatggc

SEQ ID NO: 37941 - DNA, 1706 bp, Agrobacterium tumefaciens
gaccggcatttgaagacgcatggcgagcgcacggcgatcctctgggaaggcgacaatccctatatcgacaagaagatcacctataaccagctctatgattatgtctgccgtctggccaatgtgctgaagaagcacggcgttaagaagggtgaccgcgtcaccatctacatgccgatgattcccgaggcggcctatgccatgcttgcctgcgcccgcatcggtgccgtgcattccgtcgtctttggcggcttctcgcccgaagcgctggccggtcgtatcgttgactgcgaatcgaccttcgtcatcacctgcgatgaaggcgttcgcggcggcaagccgatcccgctcaaggaaaataccgacaaggcgatcgatatcgccgccaagcaatatgtcatcgtcaacaaggttctggtcgtgcgccgcaccggcggcaagaccggctgggcgccgggccgcgacatctggtatcatcaggaaattgcgaccgtgaagccggattgcccgccggtgaagatgcgggcggaagatccgctgttcatcctctacacttcaggctccaccggcaagcccaagggtgtgttgcacaccacgggcggctatctcgtctatacgtcgatgacgcatgaatatgtgttcgattacaaggatggtgaagtcttctggtgtacggccgatgttggctgggttaccggccattcctacatcgtctacgggccactcgccaattgtgcgacaacgctgatgttcgagggtgttcccaacttcccggatcaggggcgtttctgggaggtcatcgacaagcacaaggtcaatatcttctataccgcgccgacggcgctccgatcgctgatgggggcgggcgaccagttcgttcagcgctcgtcgcgcgaaagcctgcggcttctcggaacggtgggtgagccgatcaatccggaagcgtgggagtggtattaccatgtggtcggcgaggacaagagcccgatcgtagacacctggtggcagacggaaacgggcggcattctcatctcgccgttgccgggtgcgaccgatctgaagccagggtcggcaacaaggccgttcttcggcgtgcagccgcagcttgtcgatgccgagggcaatgtgctggaagggccggcggacggcaatctctgcatcatcgacagctggccgggccagtcgcggtccgtttatggggatcaccagcgattcgtcgacacctacttctcgacctacaagggcaagtacttcaccggtgacggctgccggcgcgacgaggacggttattactggatcacaggtcgcgtcgatgacgtgctcaacgtctccggccaccgcctaggcacggccgaggtagaatcggcactggtctcgcatcatcaggtttcggaagcggcggtggtcggttatccgcaccccatcaaggggcagggcatttattgttatgtcacgctgatggcggggcagagtggcgattatgcgctgcgcgaggagctggtaaagcatgtgcgcaacgagatcggaccggttgcgacgcccgacaagatccagtttgcgcccggcctgccgaagacccgctcaggcaagatcatgcggcgcattctgcgcaaaatcgccgaggacgatttcggtggcgcttggggatacgtcgacggcttgccgatccggcggtggtggaagatctcatcgccaaccgccagaaccgc

SEQ ID NO: 37942 - DNA, 1746 bp, Agrobacterium tumefaciens
gtggcgctggctcttgcgcgcggcgacgagcagctggcccgtgatctcatggacgagatcatttccggccgttttcagccggcaaccccgacattcctcaacgccggcaagaaaagccgcggcgagctggtctcgtgttttctgctgcgcgtggaagacaatatggaaagcattggccgctcgatcaattcggctctccagctttccaagcgtggcggcggtgtggcgctgtccctgaccaatattcgcgaattcggggcaccgatcaagcagatcgaaaaccagtcttccggcgtcattcctgtcatgaagcttctggaagacagcttttcctacgccaaccagttgggtgcacgccagggcgcgggcgcggtctatctgcatgcccaccaccctgatatcatgcgtttcctcgataccaaacgcgaaaatgctgacgaaaaaatccgtatcaagaccctgtcgctcggcgtcgtcatccccgacattaccttcgagctcgcccgcaacaatgaggatatgtacctgttctcgccctatgatgtggagcgggtctatggcgtgccgttgacggagatctcggtcaccgaaaaatatcacgagatggttgccgacagccgcatccgcaagaagaagatcaaggcacgtgaattcttccaggtgatcgccgaaatccagttcgaaagcggttacccctacatcatgttcgaggatacggtgaaccgcgccaatccggtcgccggccgcatcagcatgagcaatctctgctcggaaattttgcaggtcagcgaagcgagcgagttcaacgccgatctctcctatagccatatgggcaaggatatctcgtgcaatctcggctcgctcaacattgcctctgccatggactccgctgatttcggcaagacgatcgagacctccatccgggcactgaccgccgtatcggacatgagtcatatttcctccgttccttcggtggaaaagggcaatgatgccagccacgccatcggccttggccagatgaacctgcacggttatctggcgcgtgagcgcatcttctacggttcggaggaaggtatcgacttcaccaatatctatttctacaccgtgacctatcacgccatccgtgccagcaaccggctcgccgtggaacggggccagagtttcaagggctttgagaactccaaatatgcctcgggcgactatttcgacaaatataccgaccgggaatggttgcccgcgacggaaaaggtccgcgacctgttcgaaaaggccggtattgccattccgacgcaggaagactggacggcgttgaaacaggacgtcatggcatcaggcctctataaccagaaccttcaggccgtgccgccgacgggctcgatctcctatatcaaccactccacttcttccattcatccgatcgtttcgaaaatcgaaattcgtaaagagggtaagatcggtcgcgtttattacccggcttcctatctctcgaacgataatctcgaatattatcaggatgcctatgagatcgggccggaaaagatcatcgacacctatgcggcggccacccagcatgtcgatcagggcctgtcgctgacgttattcttccgcgataccgccacgacgcgcgatatcaaccgggcgcagatttacgcctggagacgaggcatcaagaccatctattacattcggttgcgccagatggcgctggaaggcacgcaggttcagggctgcgtttcctgcacgctc

SEQ ID NO: 37943 - DNA, 750 bp, Agrobacterium tumefaciens; identical to SEQ ID NO: 35359

SEQ ID NO: 37944 - DNA, 1164 bp, Agrobacterium tumefaciens
atgagcaaagcgcagatcgtcggctgggcgcattcgcctttcgggaagtcggcccttgaaaataccgagcaactgatggcttcggtcgtggcgccggccatagaccatgcgggcgtcgatgtcagcgatatcgacggcattttcgtcggcgtgatgaacaatggcttctcgaaacaggattttcagggcgccctggtagcgatgggagatgagcgcctcgcctatacgcccgcagtgcgtttcgaaaatgcctgctcaacaggatcggccgccctctacagcgccatggacttcatcgaagccgggcgcggccgcatcgcactcgttgtcggcgccgaaaaaatgacggcgctgccgaccgcagatgtgggcgaaatcctgctctccgcctgttaccgtgcggaggaggccaatattcccggcgggtttgccggccagttcggccgcatcgcacaggcgtattttcaacgttatggcgaccgctcggaagagctggcgatgattgccgcaaagaaccacgccaatggcgcggtcaatccctatgcccatatgcgcaaggatttcggcttcgatttctgcaatacggcttccgacaagaacccctacgtcgcaggcccgctgcgccgcaccgactgctcgctgatttctgatggcgctgccgcgatcattttggccgacgaagaaacggcagccacactcaaccgcgccatcggcttccggggccgcaagcatgtcaacgacatcatggcattgacccgtcgcgatccgttggccttcgaaggcgcgcgccgcgcctgggccggctcgctggaacttgccggcgcaacgctcgacgacctctctttcgttgaaacgcacgactgcttcaccattgccgaacttatcgaatatgaggccatggggcttgctaagcccggtgaaggatatcgcgttgtccaggatggaacggcactgaagaccggacgcctgccaatcaacccatcgggtggattgaaatcgaaaggtcatcccgtcggagcgaccggcgtttccatgcatgtcatggcggcgatgcaattgatgggcgaagcaggcgacatgcaaattcccaattcctcgctggctggcgtgttcaacatggggggcacggcggttgccaattacgtctcgatcatggagcgtgtg

SEQ ID NO: 37945 - DNA, 385 bp, Agrobacterium tumefaciens; identical to SEQ ID NO: 35366

SEQ ID NO: 37946 - DNA, 926 bp, Agrobacterium tumefaciens
gcctacacctatgtcgatcactcctatgacgtgatcgtggtgggcgccggtggcgccggtctacgcgcaacgctcggcatggcggaacagggtttccgcacggcctgcatcaccaaggttttcccgacccgctcccacacggtcgcggcgcagggcggcattgccgcatcgcttaccaacatgacgcccgactgttggcagtggcacctttacgacaccgtaaagggctccgactggctgggcgacgtcgatgcgatgcaatatctcgccatggaagcgccgaaggcggtctatgagctggaacattacggcgtgcccttctcgcgcaatgccgagggcaagatttaccagcgcccgttcggcggtcacatgcagaattacggcgaaggcccaccggtacagcgcacctgtgctgccgccgaccgtaccggccacgccattctgcacacgctctatggccagtcgctgcgcaacaatgcggaattcttcatcgaatatttcgcgctcgacctcatcatggcgccagatggtcgttgcacgggcgtcgttgcctggaacctcgatgacggcacgatccatcgattctccgccaagatggtggtgctggcgaccggcggttacggccgcgcctatttctcggcgacctctgctcacacctgcaccggcgacggcggcggcatgattgcccgtgccggcctgccgcttcagaacatggaattcgtacagttctcatccagcctgcatcttatggtgcagcctgcttcatcatcgaaggcgcgcgtggcgaattcagttccttagtcaactcacaagtcgaacgcttcacacagcgttatgcaccatagttgaacatccttgcctcacgtgacggtgtctattcgtgcgtgagaatgataatccgtcaagctgtcggcgccggccagttc

SEQ ID NO: 37947 - DNA, 1456 bp, Agrobacterium tumefaciens
atgatcaagctaaaaaatgcggcgctgttgcgtgatgcctgcctggtgaatggtcgctggctgaaagccgcggatggcaagacgattgcggtggaaaatcccgccaactcgatgatcatcggtcacgttccttcattgtcggcagatgaggttaaagctgcagtcgagtcagcaggcaaggcattttccgagtggagccgccgttctgcgaaggaccgcgctgccatattgcgtcgatggtttgatctcatggtggcgaacgctgacgatcttggtgcgttgatgactggcgagcaagggaaagcccgttgcggaagcaaagggcgaagccctttatgcggcatctttcgtggaatggttcgcggaggaagccaaacgtgtttatggcgataccattccttcgccgaccacggacaagcgcattaccatcctgaagcagccgatcggtgtctgcgccgcgatcacgccatggaacttcccggccgcgatgatcacccgcaaggcggccccggcacttgccgcaggctgcgcgatgatcgtcaaaccggctgagcagacccctctcaccgcacttgctctgggtgttctcgccgaagaagcgggcgttcccgccggtgtcttccaggtggtgacgggcgccgcacgcgatatcggcaaggtgtttaccgaaagcgacacggtgcgaaagatctcctttaccggatcgactgaagtcggtcgtctgctgatggcgcaatcggccccgacgatcaagaaactgtcgctggaacttggtggcaatgcgcctttcatcgtctttgatgatgccgatctggatgcggccgttgagggcgcgatcgtgtcgaaataccgcaatgccggacagacctgcgtgtgctccaaccggatctatgtccaggatggtgtttacgacgcattcgcggaaaagctggtctaaatggttgaaagcctgtctgtcggtgagggcactgaacctggtgttctgataggtccactgatcaaccaggatcccgtggcaaagcttgaggatcacgttgctgatgcccttggcaagggagcaaagatcgtcatcggtggaaagcgtcatgctcttggaggcacattctacgaaccaacggttctgactggtgcaacccaggccatgaaggttgcccgtgaggagacctttggacccgtcgccccgctctttcggttcgggacggaagacgaagcggtcgccatggcgaacgataccgaatttggtctggcggcctatttctacaccgagaatgtccgccggacatggcgtgtcgcagaagcgctcgaatacggcatggtgggccacaatacaggcctcatctccaacgaagtcgcaccattcggtggcgtgaagcagtccggcttgggccgcgaaggctcgcactacggcatcgatgaatatcttgaaatcaaatacctgtgctcggccatcggctga

SEQ ID NO: 37948 - DNA, 822 bp, Agrobacterium tumefaciens
atgaccatcaaccctttcgaattccgcaccgttccctccatgcaggttgcctggggtggcgcccatcgcctcggagagattctttccggcaggtttcaggcgcgcaaggcgctgctgattaccgatgcaggtctcatcaaggccggcctcatcaagccgattgctgacgcccttgcggccagcggctttaacgtcacgatcttcgacaaggtcgttgctgatccgccagagcacatcgttgccgactgcgtcgagtccgcaaggcagatcggcgtcgatatcgttattggtcttggcgggggctcatcgctcgacatcgccaagctcgtggctgtccttctggtttccgaccagacgcttgccgacatgtacgggatcggaaacgttaagggatcacgcctgccgctcgtgctggtgccgaccacggccggtaccggttcggaagtcacaaacatctccatcatcaccacgggagaaaccaccaagatgggggtcgtttctccgcagctttacgctgatttcgttcttctggatgctgaactgacggtgggactgccgcaggtccatacggctgccaccggtatcgatgccatggtgcatgccatcgaggcttacaccagcaaacacaagaagaacccgctatcagatgctctggcgcgcgaggcactgcggctgctcggtgcaaacctgatcgccgcctgcaggaacggggccgaccggaaagcccgtgaaggcatgcttttgggtgcgacattggcaggtcaggctttcgccaactcaccggtggccgccgtccacgcgctcgcttatccgctgggcggc

SEQ ID NO: 37949 - DNA, 885 bp, Agrobacterium tumefaciens; identical to SEQ ID NO: 35360

SEQ ID NO: 37950 - DNA, 906 bp, Agrobacterium tumefaciens; identical to SEQ ID NO: 35395

SEQ ID NO: 37951 - DNA, 744 bp, Agrobacterium tumefaciens
ctcaagggcaaaaccgtcatcatcgccggcggagcaaaaaatctcggcgggttgattgcccgcgattttgctgcccagggtgcgggcgccatcgcgatccattacaacagcgcggcaagcagggccgatgccgatgcaaccgttgccgccgtaaaggccgcaggcgctgaggcaatcgcccttcaggccgatctcaccacggcaggcgccgtcgaaaagctatttgccgatgccgtcgccgccattggccgcccggatatcgctatcaataccgtcggcaaggtgttgaaaaagccgatcctcgaaacatcggaagccgaatatgacgaaatgaccgccgtcaacgccaagtcggccttctttttcctgcaacaggccggccgccacgtcagtgacaatggcaagatctgcacgctcgtgacgtctctcctgggcgctttcacaccgttttacgccagctatgccggcaccaaggccccggtggagcattttacccgcgctgcggccaaggaattcggcgaacgcggcatctccgtgacggcgattggtcccggaccgatggatacgccgttcttctacggtcaggaaacgccggaggcgcagggctatcacaagaccgcggctgcactttccgccttctcgaaaaccggtcttaccgatatcgaggacattgttccctatattcgctttctcgtaacggacggctggtggatgaccggccagaccattctcgtcaatggcggt

SEQ ID NO: 37952 - DNA, 1635 bp, Agrobacterium tumefaciens
cagaatgatttcttgcgcctttacacccacgacatgaccaccgatgcccgcaacggcaaggtcgatcctgttatcggccgcgatgatgagttgcgccagctcgttgatattctgacccgccgccgacagaacaatcctattctggtgggcgaggccggcgtgggcaagaccgcggtcgccgaagcgctggcgttggaaatcgcctccggcaacgttccggagaaactgcgcaatgtctgcctgctgaacctcgatatttcgctgctgcaggccggtgccggcgtgaaaggtgagttcgagcggcgcctgcacggcgtgatcgatgcggtcaagcgttcggccgaaccggtcatcctgttcatcgatgaggcccatggccttgttggcgcgggtggtgcggcgggccagggtgatgcggcgaatattcttaagcccgcactcgcacgaggcgaggtgcggaccgtcgcggcaacgacgtggagtgaatacaagaaatatttcgagaaggatgcggcgctgacgcgtcgtttccagccagtgcatgtgcgcgagccggacgaggcgactgcgatacggatgttgcgcggtgtggcggatactttcgtcagccatcacaacgttaccgttcgtgatgaggcgatcgtggctgccgtgcaattatccgcgcgctacatgcccgctcggcaattgccggacaaggcggtcagcctgctcgataccgccgccgcggccgtttcgctggcgcggcagacgttgccagagcggttacgtgccatggaaagcgagcgacaccttctgtctgacgaactgaactggcttctgcgtgaaccgcaggatgaggacatgcaaaaccgcatccagtcgatacgcgacgagcttgaacggcttgaggccgggatcgatgatctgcgcggccgttatgacgcggaaatggctgaactggcggcgctcagtgaagagcagccggccgaaaccggcgcgtcgaatgtttcgcacctgcggcctgccacggagatgcggcccgcaaatgccgaaagacttgttccgacagtggttgatcgtgaagcgatcgccgccgtcgtctcgcgatggaccgggattccgctcggcaaacttctggcggaccagatcgaaagcgcccgcactctggatgtgcgcatgcggcagcgcgtggttgggcaggatgccgcaattacccggattgccgatgccatgcgcaccgcccgtgccggattgtccgatccgcgccgtccgccggcggtgtttttccttgtcggcatgtccggaacgggcaagaccgaaacggcgctgtcgctggccgatcttctctatggcggcaacagccatctgacgacgatcaacatgtcggagttcaaggaggagcacaaggtttccctgcttctcggctcaccgcctggctatgtcggtttcggcgaaggtggggtgctgacggaagcggtgcgccgccggccgttcggcgttctgcttctcgatgaaatcgacaaggctcaccccggcgtccaggatattttttatcaggtgttcgacaagggcgtgcttcgcgatggcgaaggccgcgacgtcgatttcaagaacaccacgatcttcatgacggccaataccggttcggaattg

SEQ ID NO: 37953 - DNA, 1164 bp, Agrobacterium tumefaciens
  unsure (1)..(1164): unsure at all n locations
tacatgcacaacttcctgacctcgcaaccggnacctcaacctgcataaccctgagtgcaggaggaactgcttaatatcacccgcttctggctgaagcgcggcgtcgatggtttccgcctcgacactatcaacttctatttccatgatctggaattacgagacaacccggcgctggcaccggagcgccgcaatgcctcgaccgcgcctgcagtcaatccctacaatttccaggaacatctctacgataagaaccgcccggaaaacatcgccttcctgaagcgcttccgcgcggtgctggacgaattccccgatatcgccgccgttggcgaagtgggcgacagccagcgcggtctcgaaatcgtcggtgaatacacctccggcgatgacaagatgcagatgtgctatgccttcgaattcctcgcacccgatgcgctcaccccccagcgcgttgccgatgtgcaggcggattttgcgcgcgcagcaccagagggctgggcctgctgggccttctccaaccatgatgtcgtgcgccatgtcagccgctggggcgagcatgtcgaggacaaggatgccttcgcgaagctgctgtcggcactgctgatgacgcagcgaggctccgtctgcatctatgagggcgaggaactgggcctcactgaagccgatattgctttcgaggacttacaggacccctatggcatccagttctggccggaattcaagggtcgcgatggttgccgcacgccgatggtgtgggatgcgggccatgcgcaggccggcttttcgacttcggacaagatctggctgcccattccggccgagcacaagcagcgcgccgtcagcgcccagcagggcaacgaggcgtcggtgctggagcattaccgccgcttcctcgccttccgcaaacagcacccggctttcgccaagggcggcatcgaattccagccgcttgagggagacgtgctgagctacacccgcaagctgggcaacgaaaccattctgtgccttttcaatctgtccgcaacgccggcaaatgccacgctgccgaaagggaactgggaggttctcgaaggccatggctttgcaagcggccttgaaggcacaagcgtagaacttccggcatggggcgctttcttcgcccgttacgcctgatagagcagggaggaa

SEQ ID NO: 37954 - DNA, 828 bp, Agrobacterium tumefaciens
atggcattgaaaagtttcaatccgaccacgccgagccagcgtcagctggttatcgtggaccgcgcttcgctctacaagggcaagccggtaaaggctctcacccagggcctcagctccaagggtggccgcaacaaccagggccggatcaccgtccgtttccagggtggcggtcacaagcggacctatcgtctggtagacttcaagcgtcgcaagtttgacgttgaaggtaccgttgaacgtctggaatacgaccccaaccgcaccgcgttcatcgcgctggttacgtataccgacggcgaacaggcttacattctcgcgccacagcgtctcgctgctggtgacaaggtgatcgcctccgacaaggcagtggacgtgaagcccggcaacaccatgccgcttcagtacattccggtcggttcgatcatccacaacgtcgagatgaagcctggtaaaggcggtcagattgcccgctccgccggtacgtatgtccagctcgtcggccgcgatgccggtatggccatcctgcgtctcaactcgggcgaacagcgtctggtacacggctcgtgccttgcatcgatcggcgctgtttctaactcggaccacggcaacatcaacgacggcaaggccggtcgttcccgttggcgcggcaagcgtccgcacgttcgcggcgtcgtcatgaacccggtcgaccacccgcacggtggtggtgaaggtcgcacgtcgggtggtcgccacccggttactccgtggggcaagcccacgaagggcaagcgcacccgttcgaacaagtcgaccgacaagttcatcatgcgctcgcgccatcagcgt

SEQ ID NO: 37955 - DNA, 1275 bp, Agrobacterium tumefaciens; identical to SEQ ID NO: 35328

SEQ ID NO: 37956 - DNA, 1440 bp, Agrobacterium tumefaciens
actcccaaacccgttgtcctgactattctcgatggctgggggctgaacgaggacacatccagcaatgcgccggttctggcgaatacgccgaccatggaccggcttttcgccacctgcccgaatgcaacgctgaccaccttcggcccgaatgtcggcctgcccaccgggcagatgggcaattccgaagtcggtcacaccaatatcggcgccggccgcatcgtcgccatggatctcggccagatcgatctggcgatcgaggatggcagctttttccgcaatgcggcgatgcttgatttcgccgccacggtgaaggccgcaggcggtgtggcgcatctgatgtgcgtcgtttccgatggcggcgtgcatggtcatatcctgcacggccaggcggcggtgaagctgatggtcagccacggtctgaaggtcgtggtgcatgccatcaccgatggccgcgatgtcgcgccgcaatcggcggaagatttcgtggcggcgcttgtggcaagcctgccgcagggcgcgagtatcggcacagtgatcggccgttattatgcgatggatcgcgacaatcgctgggagcgcgtcgagaaagcctatgacgccatggttctcggtaagggcgaacacgcgcgggatgcggtgagtgccgtggcccagagctacgcgaacaaagtcacggatgaattcatcctgccgacggtgatcgatggctacgaaggcttcaaggctggcgacggcctgttctgcctgaatttccgcgctgaccgtgcccgtgaaatcctgctcgccatcggcgcggatgatttcgacggttttgcgcgcgaaaagcccgtgctttcggcgctgctgggcatggtggaatattcgacgcggcacagtgatttcatgacgacggcttacccgaagcgcgatatcgtcaacacgctcggcgcctgggtggcaaagcagggtctgacgcagtttcgcctggctgaaacggaaaaatacccgcatgtcaccttcttcctgaatggcggcaaggaagagccggaagtgggcgaggaccgcttcatgccgaaatccccgaaggtcgcgacatacgatctgcagccggaaatgagcgctgccgaggtcacggagaaattcgtcgaggtgatcggcaagggttatgacctgatcgtcaccaactacgccaatcctgacatggtcggccataccggtgatctgcaggcggccatcaaggcgtgcgaagccgtggatcgcgggcttggtgccgtcgttgctgctctcgaaaaggtgggcggcgcgatgctcgtcattgccgaccacggcaattgcgaaaccatggtcgaccccgtcacaggtggcccgcatacggctcacaccaccaatccggtgccggtgatcctgtttggcggcccggaaggcgcaaaagtacatgatggcattctcgccgatgtcgcg

SEQ ID NO: 37957 - DNA, 1254 bp, Agrobacterium tumefaciens; identical to SEQ ID NO: 35399

SEQ ID NO: 37958 - DNA, 1596 bp, Agrobacterium tumefaciens
gtccgcaatatgagtttcgacatcgcaccacgcgaaacggtggcgatcgtctgcgaaagcggctcgggcaaaagtgtgacgtcgctgtccatcatgcggctgctcgataggaaaaccagccgcattgagggcaaggtcatgctcggcgggcgcgacttgctggcgctgccggaagaggagatgcgcaaggttcgcggcaaggacatttcgatgatcttacaggagccaatgaccagcctcaacccgatctttccgatcggcaagcagatcgccgaagcgctcaccgtgcatcaggatatctcgtcatccgccgcaaaggccgaggtcatccgtcttctggaaaaagtccgcattcccaatgcggcgagccgtttcggtgattatccgcaccagttttcgggcggcatgcgccagcgcgtgatgatcaccatggcgcttgcctccaagccgaagcttttgatcgccgacgagccgacgacggcgctcgacgtcaccattcagggccagattctcgacctcatcaagcaattgcaggaagaggagggcatgtcggtcctgttcatcacccatgatatgggtgtggtggcggaagtggcggaccgtaccatcgtcatgttccgtggcgatgtggtagaaaccggcacgacggatgacatcttccatcgcggccagcatccctatacgcgcgccctgctttcggcggtgccgaagttgggctcgatgaggtcgcggttgctgcccgcccgtttcccgattatcgacatcaagaccggcgagagcccgccggtggtggagacgaaggacacggtgtcaggcggcaagacgcccattctctcggtcaaggacctgacgacgcgtttcgatatccgttccggccttttcggccgcaaatccggcgccgtgcatgcggtggagaaggtttcctttgatctcgcagaaggtgaaaccctgtcgctggtcggcgaatccggttgcggcaagtccaccacgggccgatcgatcacccggctgatcgagccgacatcgggtaatgtcacgcttgatggttacgaggtgctgaaactcgaccgaacgacgctgcggaccatgcgccgcagcgtgcagatggtctttcaggatcccttcgcttcgcttgatccgcgcatgagcgtcggcaccgcgatcatggaacccttcatggagcaccgcctcggacagaaagcgcaggcgcgcgaaaaggcggcggatttgctggaaaaagtcggcttgagccccgacatgatgaagcgtttcccgcatgagttttccggcggccagcgccagcgcatcgccattgcccgctcgctgatgctcgatcccaaggtcatcgtcgccgacgaggcggtttcggcgctcgatgtctcgatcaaggcgcaggtctgcaacctgctgctcgacctgcaacagagcctcaatctggccttcctgttcatttcccatgacatggcggtcgtggaacgcgtcagccatcgcgttgcggtgatgtatctcggcgagatcgtcgaaatcggcccgcgcgcagccgtcttcgacaatccgcagcatccgtacacgaaaaaactgatgtcggccgttccg

SEQ ID NO: 37959 - DNA, 1230 bp, Agrobacterium tumefaciens
gcagagcgcgttgccaagcgccaggcaacttttggagcttcctccgtactcttttatgagcagccgatcgagatggtgagcgcgcagggcgcctatctgtatgacgccggcggacgcaagtatctcgacgtctacaacaacgtaccgtcggtcggccactgccatccacgggtggtcgaggccatcgcccgacaggtcggcgaactcaacatccacacgcgctatctcaaccgcgtcgtcgaggcttacaccgaaaatctgctatccaaattcccggcaggcctcagcaatgtcgttttgacctgtacgggcagcgagagtaacgacctcgccctgcgcatcgcccgcattgggaccggggccgaaggcttcatcgtcaccgaggcagcctatcacggcaacactgcgctggtgacggaagtctccccctcgtcgctgcgcaagcgcaaacccgccgcatttgtggcaatcattccagcgcccgccgctcgtgatggcatgagcgtggcctcaaacttcgccgcgtccgtggaacaggcaatcaacgagctcaattcacgaggcattaaattcgctgcgttgatcgttgacacaatcttttccagtgacggcatctatgccgatcctgcaggtttcctgaaggaggcggttgacgtggtgcaccgagccggcggcctgttgatcgccgatgaggtccaaccgggcttcggccggacgggaggcagcctttggggcttcgagcgtcacggtgtcacgcccgacattgtcacgatgggtaagccgatgggcaatggcttccccatgggcggcgtcgtaacacgacttgacctgctccagaggttctgcgaggaaaccggttatttcaataccttaggaggcaatccggtagctgccgccgcaggccatgcagtgctgcgagtgattaaccagtaaggtctgatcgaacgctcggccactgtcggcggttacttcaagcagtcgctccaggctttgcaaagtcggcattcggaaatcggcgatgtgcggggcgccggccttttcatcggtcttgattttgtcgaccccgccacgggggagccggacagcacacgcgctacccatgcgatcaatcagttgaggcacaacagtatattgatcggggcagcgggcaaatatggcgcgacgctgaagatccggccgccactgtgtttttcgaacgaggatgtcgacctcttcaccggcaccctggac

SEQ ID NO: 37960 - DNA, 738 bp, Agrobacterium tumefaciens
ttgaagtcattgcaaggcaagaccgtcatcgttaccggcgcaagccgaggaattggcaagggcatagcactgcgcttcggggaggccggcctgaatgtcctcgtcgtgtcgcgcagccaggtcgatgccgacagggtggcatccgaaatcggagtaaacggttcggggtttgcggcggatgtcagtacagaggagggctgcaaggcgatggtcgatgctgccgtaacccgctatggcggggttaacgtgctgtgcgcaaatgccggaatcttcccggcggcgaagctgggggaaatgtcggcggccgatttcgaccacgtgatctcaaccaatctcaaaagtacctttctcagcgtttccgcggtgttgccggcgatgacctcggccggtgcgggccgtatcatcatcacctcgtcgatcactgggccgatcaccggttatccgggctggtcgcattatggggcaagcaaggccggccagcttggcttcatgcgtactgccgcgattgagctggcgccaaagaacattacggtcaatgccgttatgccaggcaatatcatgactgaggggctcgagggcaacggtccagattatatcgccacgatggaggcctccgtgccattgcgtcgtctgggtatgccggcggacatcgcgaacgccgcgctgttttttgcatcggaggaggcagcctatatcaccggccagtcgatcgtcgtcgatggcggtcagatcctgccg

SEQ ID NO: 37961 - DNA, 816 bp, Agrobacterium tumefaciens
ttcgtaaagaacaaggacggcgtcgaaatctatttcaaggactggggcccgaaggatgcccagccgatcgtgttccatcacggctggccgctgtcctccgacgactgggatgcgcagatgctgtttttcgttcagaacggttaccgcgtcgtggcgcatgatcgccgcggccacggccgttcgcagcaggtgagcgacggccacgacatggatcattatgccgccgacgcgtccgccgttgccgaacatctcgatctcaggaatgcggttcatatcggccactcgaccggcggcggtgaagtggcacgttatgtcgcgaaattcggccagccgcagggccgtgttgccaaggccgtgcttgtctccgccgttccgccgctgatgctgaagacgccttccaatcccggcggcctgccgatcgaagtcttcgacagcttccgcaagggcgtggccgagaaccgcgcgcagttcttcctcgacgtgccggccggtcccttctacgggttcaaccggccggatgccaaaatctaccccggtgtcatccggaactggtggcgtcagggcatgatgggcagtgccaaggcccattatgatggggtcaaggccttctcggaaaccgaccagactgaagacctcaaggcgatcacggtgccgacgctcgttctccacggcgatgacgaccaggtcgtgccgatcgcagattcggccgaattgtcagtcaaacttctgaagaatggcacgctgaaggtttacaagggctatccgcatggcatgctgacgacccatgcggacgtcatcaacccggatctgttggcc

SEQ ID NO: 37962 - DNA, 1657 bp, Agrobacterium tumefaciens
atgtaccgttacgacgaattcgatcacgcatttgttgaaggccgcgtggcgcagtttcgcgatcaggtcgagcgccggttatcgggcgagttggccgaggacgcattcaagccgctgcgcctgatgaatggtgtctatcttcagctccacgcctacatgctgcgcgtcgccattccctacggtacgctgaattcgcaacagatgcggatgcttgcccatatcgcccgcaaatatgaccggggttatggccatttcaccacccgccagaacatccagtacaactggccgcgcctctcggacacgccggatatcctctctgaactggcaagcgtggaaatgcacgcactgcagacgtcgggtaactgcattcgcaacgtgaccgccgatcatttcgcgggtgctgccgcagacgaagtcgccgatccgcgtccctatgcggaaatcctgcgtcaatggtcttccgtgcatccggaattctcgttcctgccgcgcaagttcaagatcgcggtgacgggtgccgagcgcgaccgcgccgccattcaggtccacgatatcggcctgcatctgaaaaagaacgacaagggtgagatcggttttgccgtttacgtcggcggcgggcagggccgtacgccgatgatcgccaagaagattcgcgacttcctgccggaagaggacctgctgtcctataccacggccgtcatgcgcgtttataacctgcacggccgccgcgacaacaaatacaaggcgcgcatcaagattctcgtacatgaaaccggcgcagaagaactggcccgccaggtcgaggttgaattcgcggagctgaaaaacaccgaattgaagctgccggatgccgatattgccgccatcaccgcctatttcgccccgccggcgctgaaagaccgccctgaaggctgggaaagcctggcgcgctggaagcgtgcggatgaaggttttgcccgttttgtcgagcagaacgtcgcgccgcacaagcacccggactacggcatggtgacgatttcgctgaagccgatcggcggcattccgggcgacgcgaccgacgagcagatggaactcgtcgccgacatcgccgccgaatatgcctttgacgaaatccgcatcagtcacgagcagaacatcatcctgccgcatgtggcgctggccgatctcgagccggtctatcgtgcgctcgtgggcgcgggactggcgactgccaatgccgggctgatcaccgatatcattgcctgtcccgggctggactattgcgcgcttgccaatgcccgctccattccggtggcgcaggagatctccacccgtttcggcgcgcccgaacgtcaggccgagatcggcgagctgaagatcaagatttccggctgcatcaacgcctgcggccaccaccatgtcggccatatcggccttctgggcgtggagaagaagggtgccgaactctaccagatcacgcttggcggatcgggtgatgaaaacacctcgattggtgaaatcattggcccgcggtttcgagccggaaaaagtgaccgacgcggtggaaaccattgtcgacacttatctgggcttgcgcctttcgaaggaagaaaccttcctcgaagcctatcgccgcgtcggaccgcagccgttcaaggacgcgctctacggttccgcc

SEQ ID NO: 37963 - DNA, 772 bp, Agrobacterium tumefaciens
atgagattgaacaacaaggtcgcgctgatcaccggcgcccgcccgcggcatcggccttggtttcgcccaggctttcgctgctgagggcgcaaaggtcatcatcgccgacatcgatatcgcccgcgcaactacctcggctgcggccatcggtcccgcagccaaggccgtgaagctggatgtgaccgaccttgcccagatcgacgcggtggtaaaggcggtggatgaggaattcggcggcatcgacattctcgtcaacaatgcggcgatcttcgatatggcgccgatcaacggcattaccgaagagagctatgagcgggtgttcgacatcaatctcaaggggccgatgttcatgatgaaggccgtctccaatgtcatgatcgcccgcgcacgcggcggcaagatcatcaatatggctagccaggccggccggcgcggcgaggcgctggtgacgctttattgcgcctccaaggcggcgatcatttccgccacgcaatcggcggcgctggcgctcgtcaagcatggcatcaatgtcaacgccatagcgccgggtgtggtggatggcgagcattgggaagtggtcgatgcgcatttcgccaagtgggaaggtttgaagccgggtgagaaaaaggccgcggtggccaaatccgtgccgatcggccgttttgcgacgccagacgacatcaagggactggcggtgttcctcgcctccgccgacagcgactatattctcgcccagacatataatgtcgacggcggcaactggatgagctga

SEQ ID NO: 37964 - DNA, 933 bp, Agrobacterium tumefaciens; identical to SEQ ID NO: 35354

SEQ ID NO: 37965 - DNA, 732 bp, Agrobacterium tumefaciens
aacgatccgacccatcagttcttggtgcagccgatcattccgatcgaaattggcggcgtcgatttttccttcaccaatgcgtcgctgttcatggttgcgaccgtggctgctgcgtccggttttctttatttcgcaacgtcgaaccgcggtctgatcccgacccgcatgcagtccgttgctgaaatgtcctatgagttcatcgcctccatgctgcgcgaaggcgccggcaagaagggtatggtgttcttcccattcgttttctcgctgttcatgttcgtgctgacggcaaaccttctcggcatgttcccgtatttcttcacggtgaccagccagatcatcgtcacattcgcgcttgcctgcctcgtcatcggcacggtcatcgtttacggtttttacaagcatggcctgcatttcttcggcatcttcgccccgtcaggcgttccgaaggcgcttttgccgcttgtcgcgtcgattgaaatgatctcgttcctgtcgcgccccatcagcctttcggttcgtcttttcgcgaacatgctggctggccacatcacgctcaaggttttcgcaggcttcgtcgcctccatgggtgcgctcggcgcactcggcgtcggcggcgctgtcctgcctctcatcatgacggtcgcaatgaccgctctcgaatttctcgttgccttcctgcaggcttatgtgttcgcggtactgacttgcatgtacctgaacgatgccgtgcat

SEQ ID NO: 37966 - DNA, 780 bp, Agrobacterium tumefaciens
cgtggcgtgctgatgatctgccacggccttgtcgagcacgccggccgctaccgccgttttgccgatgtcatggcgaaacagggtttcgaggtctatgcccatgatcatcgcggccacggccgcaccaaagcggcggatgcgcctctcggccgcttcgcctggaaggacggcgcggaaaaggtcgtttccgatgtcatggcgatacgcgtcatggtcggtgaaagacatcccggcctgccggtcattctgttcggccactccatgggcggcctcgtggcactcaacgccgccgtcaaccacccggatgccttcgatggtctgtcgatctggaattccaatctcaatcccggcgtcatgggccgcatcgcacaggtcgtgctccggcttgaaaagatgctgaagggatcggacgtgccgagcgccatcctgccgaaggcgaccttccgcgcctggaatgcaaaaatgccggaaaaacgcacccatgccgactggctgagccacgacaaggcggccgtggatgcctatgtggaagacccgctctgccagttcgaggccagcgtttcgctctggcaggatgttttcgacctgtcctatcgcgcgccaaaactcatcgagcgcctaccaaagaccttgccgcttctcctcgtcagcggcgatcaggatgcagccaccaatgatggcagggagatcgtgtggctggccgaacgttttcgccacgcgggcttcagtcatgtcgaacacacgatctacaagggaatgcggcacgagacgctgaacgag

SEQ ID NO: 37967 - DNA, 921 bp, Agrobacterium tumefaciens
atgctggcgattttctgtgacactcccggtcaattaaccgccaaggatctgccgaaccccgtgcgcggcgaaggtgaagtcctggtacgtattcgccggattggcgtttgcggcacggatctgcacatctttaccggcaaccagccctatctttcctatccgcggatcatgggtcacgaactttccggcacggttgaggaggcacccgctggcagccacctttccgctggcgatgtggtgaccataattccctatatgtcctgcgggaaatgcaatgcctgcctgaagggtaagagcaattgctgccgcaatatcggtgtgcttggcgttcatcgcgatggcggcatggtggaatatctgagcgtgccgcagcaattcgtgctgaaggcggaggggctgagcctcgaccaggcagccatgacggaatttctggcgatcggtgcccatgcggtgcgtcgcggtgccgtcgaaaaagggcaaaaggtcctgatcgtcggtgccggcccgatcggcatggcggttgctgtctttgcggttctcgatggcacggaagtgacgatgatcgacggtcgcaccgaccggctggatttctgcaaggaccacctcggtgtcgctcatacagtcgccctcggcgacggtgacaaagatcgtctgtccgacattaccggtggcaatttcttcgatgcggtgtttgatgcgaccggcaatccgaaagccatggagcgcggtttctccttcgtcggtcacggcggctcctatgttctggtgtccatcgtcgccagcgatatcagcttcaacgacccggaatttcacaagcgtgagacgactctgctcggcagccgcaacgcgacggctgatgatttcgagcttttgcttcgcgccttgcgcgaagggaaggtgccggaggcactaattacccat

SEQ ID NO: 37968 - DNA, 894 bp, Agrobacterium tumefaciens; identical to SEQ ID NO: 35084

SEQ ID NO: 37969 - DNA, 768 bp, Agrobacterium tumefaciens
gtgaagctcgctacctacaacgtcaacggcatcaacggtcggctggaggttttgctccgctggctcgccgaggcaaagcctgatgtcgtgtgcctgcaggaattgaaggcgccaaacgacaaattcccgcgccgcgagatcgagcgcgcgggctacggtgcgatctggcgcggccagaaatcctggaatggcgtggcaatccttgccagggatcaggaaccgcgtgagacacgacgcggccttcccggagatcctgacgacagccacagccgctatatcgaggctgccattgatggcatcgtcattggctgcctgtatcttccgaacggcaatccagcacctgggccgaagtttgattataaacttcgctggttcgagcgcctgtactcctatgccgcggaactgttcgaactcgatgttcctgtggctctggtcggcgatttcaatgtgatgccaaccgatctcgacgtctataaaccggagcgctggcgggatgacgccctgtttcggcctgaggtgcgcgcagcttatgccgaactcattgccatgggctggacggacgccgtcaggctgctgcatccggaagagcggatctatacgttctggaagtatttccgcaacgccttcgcacgcgatgccgggctgcgcatcgaccatttcctgctgagcccatcgctgcgggaacgactgcaaacctgcggcgtagacaagttcgcgcgggcctgggagcacaccagcgatcatgcgcccgtctggattgaactggat

SEQ ID NO: 37970 - DNA, 1119 bp, Agrobacterium tumefaciens
cgcattctcgacttcatcaagacccgacgtcccgaaggcccttgcctcgtggttgatctcgacgtcgtgcgcgacaatttcaacgcgttccggcattccctgccgaacagcgcgatctattatgccgtcaaggcaaacccggctcccgaaatcctgaagctgctcgcttcgctcggctccaacttcgattgcgcctccgtggctgaaatccagatggcgctcgatgccggtgcaacgtccgaccggatttccttcggcaacaccatcaagaaggaacgcgacgtcgcccgtgctcacgcgctcggcatcgatctcttcgccgttgatagccatgaggaagtcgagaaggttgcccgtgccgcccccggcgcgcgtgtgttctgccgcgtgctgacggatggcgaaggtgctgaatggcctctgtcgcgcaagttcggctgcgtgccgcagatggctgtcgatgttctggtttatgcgcatcagatgggtctggaatcctacggcgtttccttccatgtcggttcgcagatgatgaatctcgacgcatgggatgcagcacttgccgatgccaagcgcgtctttgcgtcgcttgccaagcagggcatccacctgcagatggtcaacatgggcggtggtttcccgaccaagtacctgcgcgacgttccggctgccgaagaatacggccaggcgattgacacggcgctgcgcaagcactttggcaaccagatcccgaagacgatcatcgagccgggccgcggcatggtcggcaatgccggcgtcatcaaggcggaagtcgttctcgtgtcgaagaagtccgacaacgacaaccaccgctgggtgttcctcgacatcggcaagttcggcggtctcgccgagacgatggacgaggcaatccgttacccgatccgcaccgagcgtgatcaggacgagatgcagccctgcgttctggccggcccgacctgcgacagcgccgacgtgctgtatgaaaagaacatgtatccgctgccggtctcgctgaccatcggcgatgaagttctgatcgaaggcacgggtgcttacacgacgacctattcggcggttgcctttaatggcttcgagccgctgaaggcttacgtcatc

SEQ ID NO: 37971 - DNA, 837 bp, Agrobacterium tumefaciens
aagttttacatcgatggcaaatgggtccttcccagcggctcagacaaggtcgccgtcattaatcctgccaccgagctggaatttgcagaaatagcgctcggtaatgatgaacacgttgcgctcgctgttgcagctgcaagaggcgctttcgccggctgggctcgaaccggtccggcagaccggtcggaacttctcaatcgcgtccatcagctgatgcaacagagattggaacttctggcgcaagctttgacgatggaaatgggcgcggcgatcaattatgcccgaagcgttcaagttccccttgctgccgaacatatcaaggtggctcgcgacaatgcggccagctattcgtttctttcgcaacgggggcatacggcgatcctccgcgagccgatcggcgtatgcggcctgatcacaccgtggaactggccgttgtaccagataaccgcgaaggtcggcccggctttggcggcgggatgcacggtggttttgaagccgagcgagctttcgccccttagtgcgttgctgtttgccgaaatcatcgaagatgccggctttccgcctggcgttttcaacctcgtcaacggcgaaggcaccatcgtcggcgctggcttgtccgcacatcccgacgtggacatgatttccatcaccggctcgacccgggccggaattttggtcgcacaggcggcggctccgacagtaaaacgggtggcccaggaactcggcggaaaatcgccgaacatcatccttgcggatgccgatatgacgcgggccgtgcctttgggcgtcgctgcggcgtttcgaaatctggggcagtcctgcagcgcgccgacccgc

SEQ ID NO: 37972 - DNA, 690 bp, Agrobacterium tumefaciens
atgactgccattaccgatatcatcgcgcgcgaaattctcgacagccgcggcaatccgaccgttgaagtcgatgtttacctcgaagacggctccatgggccgtgcggccgttccgtccggcgcctccactggcgcgcatgaggcggttgagctgcgcgatggcggcaagcgttatctcggcaagggcgtggaaaaggcggtcgaagccgtcaataccgaaatcttcgacgccatcggcggtttcgacgctgaaaaccagatccagatcgatcagatgatgatcgcgcttgacggcacgccgaacaagtcgcgcctcggcgccaacgccatcctcggcgtctcgcttgccatcgccaaggctgcggctgaagcctccggcctgccgctttaccgttatgttggcggtccgaacgcccatctgcttccggttccgatgatgaacatcatcaacggcggcgcgcatgccgataaccccatcgacttccaggaattcatgatcctgccggttggcgcggaaaacatcctcgaagccgtgcgtatgggttcggaagtgttccacacgctgaaaaaagaactgtccgcacagggccacaacaccaatgtcggtgatgagggcggttttgcaccgggcctcgagagcgcgccggcagccctcgatttcatcatgaagtcgatcgaaaaggctggctac

SEQ ID NO: 37973 - DNA, 1419 bp, Agrobacterium tumefaciens; identical to SEQ ID NO: 35381

SEQ ID NO: 37974 - DNA, 1041 bp, Agrobacterium tumefaciens; identical to SEQ ID NO: 35382

SEQ ID NO: 37975 - DNA, 882 bp, Agrobacterium tumefaciens
tttaccggccacggcggcaaacagcttcgttatgcgatctttcgcgccacccgctccattgcccgcggaacagtggttctgctgcacggcaggaacgaatgtatcgagaaatatttcgaaacggtcgccgatctgacggccatgggcttctgggtcgcgacattcgacacgcgcgggcagggcggttccgaaaggctcctgaaaaagcccggcgtcgggcatgtgcggcgcttttccgattatcagcgcgatatcagcctgtttctcgagcaggttgtcctgccggatacgcggctgcccttcttcatgatcgcccattccaccggcgcgcttgcggccctcgcggccgcgcccggcctgtcgaaccggatcgaccgtctggcgctgtgttcgcctttcatcgagctggatagtcagcaatcggttccacggtccgtcatccggctggttgcgacggccttgagccttgtcggcctgggcagggttcagctcggcagggaccagcgcgagcgggatttcgacggcaatccattgacctcggacgccagacgttttgcaaggaatctgaccctgcaccgacagtttccggaactgttcatcggcgcgccgacggcgcgctgggtctatgaagcgctgaagaccatggggcgagtgacccgccaggatcacctgacgaacatcaccgttccgaccctcattctggcgccgatgctggatacgattacgccctataaggcgcaggaagagctttcgcgcaatttccgggcagcacagcttcttccgataaccggcgcgcgccacgaattgctgcatgagcgcgacgttttccgcaaacaggcgctggcggccatcgacgcgtttttcgcgccggagtgatggccg

SEQ ID NO: 37976 - DNA, 675 bp, Agrobacterium tumefaciens; identical to SEQ ID NO: 35361

SEQ ID NO: 37977 - DNA, 1209 bp, Agrobacterium tumefaciens; identical to SEQ ID NO: 35118

SEQ ID NO: 37978 - DNA, 783 bp, Agrobacterium tumefaciens; identical to SEQ ID NO: 35437

SEQ ID NO: 37979 - DNA, 1053 bp, Agrobacterium tumefaciens; identical to SEQ ID NO: 35308

SEQ ID NO: 37980 - DNA, 1254 bp, Agrobacterium tumefaciens
tttggctatatcgacggcgtgctgcacgccgaaaacgtgcccgtgcccgagatcgccaaggcggtcggcacgcccttctacgtctattccacagcaacgctggagcgccactacaaggtgttctcaggcgctttcgcggatgtggacgccatggtctgttacgccatgaaggccaattccaaccaggcggtgctgaagacgctggcgaaactcggtgccggcatcgacgtggtctccggcggcgaattgcgccgtgcactggctgccggcgtgcccgcaagccgcatcatgttctccggtgtcggcaagaccgtggcggaaatggattacgcgctggaagccggcatctattgcttcaacatcgaatccgaaccggaactggaagtcctcaacctgcgcgccgtcaaggccggcaagcgggcgcatgtctccttccgcatcaatccggatgtggatgcgcgcacccacgccaagatttccaccggaaaaaaagaaaacaagttcggcatttcctatgagcgggcgcgtgcggtctatgcccatgccgccaccctgcccggcatcgaagtcaccggcatcgacatgcatatcggcagccagatcaccgaattgcagcctttcgaagatgccttccggctgctgcgcgaactggtggaagtgctgcgtaccgatggccatgcgatcagccacgtcgatattggcggcggcctcggcattccctaccgcgacgacaacaatccgccgccgctgccggatgcctatgctcatatcgtcaagaacgagctgaagagcctcaactgcaagatcgtcaccgagcccggccgcctgattgtcggcaatgccggcattctggtgacggaagtgatctatgtgaaagatggcggcgacaaaaccttcgtgatcgtcgatggcgccatgaacgaccttattcgcccgacgctctacgaagcctatcacggcatccgcccggtggtgcagccttcagagaacgcgccgcgcatcaaggccgatatcgttggtccggtctgcgaaaccggcgattatctggcgctcgaccgcgagatggcggcaccgcagccgggtgatctcatcgccgtcagttcagccggcgcctatggcgcggtgcaggccggcacctataattcgcgtctgctggtgccggaagtgctcgtcaagggcgacaggttccacgtcatccgcccgcgcggtacctatgaggaactgatcgccctcgattccgtgcccgcctggctc

SEQ ID NO: 37981 - DNA, 1359 bp, Agrobacterium tumefaciens
cagaaatcctccaaccagatgtggggcggacgttttgcttccgggccatcagccatcatggaagagataaatgcctccatcggcttcgacaagaagctttatgcccaggacatccgcggctctatagcgcacgccaccatgctggcggaaaaaggcattatttcgcaggaagataaagagaagatcgttcacggcctgaacacgatcctgtcagagatcgaagccggcaccttcgaattctcgcgcaagctcgaagatattcacatgaacatcgaggcgcgccttgcaaccctcatcggcacggcggccggccgcctgcacaccgcgcgctcgcgcaacgaccaggtggcgctcgatttccgcctgtgggttaaggaagaattgcagaagaccgagggcatgttgacagccctcatcgccgccttcctcgaccgcgccgaggaaaatgccgataccgtgatgcccggcttcacccatctgcagacggcgcagcccgtcaccttcggccaccattgcatggcctatgtggaaatgttcggccgtgaccgtgcccgtgtgcggcacgccatcgagcatctggacgaaagcccgatcggcgcagccgcgctggccggcaccggctaccccatcgaccgccatatgacagccaaggcgctcggtttccgcgagccgacccgcaactctatcgacaccgtctccgaccgcgatttcgcgctggaattcctgtcgatcgcttcgatctgcgccacgcatctgtcgcgtctcgccgaagaaatcgtcatctggtcgacgccgcaattcggtttcatccgcctctcggatgccttttccaccggctcttcgattatgccgcagaaaaagaaccctgacgccgccgaactggtgcgcgccaagactggtcgcatcaacggctcgctggtggcgctgctgactgtcatgaagggcctgccgcttgcctattccaaggacatgcaggaagacaaggaacaggttttcgactccgccgaaagcctggaattggcgattgccgccatgaccggcatgatacgcgacctcgaggtgcgcaaggaccgtatgcgtgcggccgccggttcgggttattccacagccaccgatctcgccgactggctggtgcgcgaggcgggcctgccgttccgcgatgcccaccatgtgaccggcaatgccgtggcgctggcggagaaaaagggctgcgatctggccgatctttcgctggaagaattgcaggccatccaccccgacatcaccaacggtattttcgacgttctctcggtcgaggcatcggtcgccagccgcacaagctttggcggcaccgctccttcggaagtcaggaagcagatc

SEQ ID NO: 37982 - DNA, 874 bp, Agrobacterium tumefaciens
aaaaacatcggtgtcatcggagccggtcagatgggatgtggcattgcgcatgtttccgccattgccggctaccgggtccatatctacgatctttcgaaagaaggcatcgaggccggccttgccacgatcaacggcaatctcgcccgccaggtgaccaacaacaagctttccgatgatgcccgcaagcaggcgctggcgctcatcagtggatcgaccgacgtcaatgatctggcgccgatggatatcgtcatcgaggcagccacggaaaacgaagagatcaagcgcaagatttatgcgcaggtctgcccggtcctgaaacccgaggcgctgctcgccaccaatacgtcttcactttccatcacccgacttgcttccgccactgaccgccccgaacagttcatgggcatccatttcatgaacccggtgcccgtcatgaaactggtcgagctggtgcgcggcatcgccaccaacgaaaaacccttcgacgcggcgaaagcctatgtgcggacgcttgaaaaggcgatcaccgtcgccgaggatttcccggccttcatcgtcaaccgcatcctgctgccgatgatcaacgagggcgatctacacgctgtatgaagggcgtcggttcggtggaagccatcgataccgccatgcggctcggcgcgaacacccgatgggtccgctgcaacttgccgatttcatcggtctcgatacctgtttgtcgatcatgcaggtgctgcatgacggtctctccgacagcaaatatcgcccctgcccactactggtcaaatatgtcgaggcgggctggctcggccgtaaatccggccgtggcttctacgattaccgcggcgaaacgccagttccgacgcgttaaagatca

SEQ ID NO: 37983 - DNA, 1581 bp, Agrobacterium tumefaciens
cttgttggcgtcgatgtcgggaccggctcggcgcgggccggtgtctttgatgtcgcgggcaagcttctcgccaccgccaagcgcccgatcagcatgcaccgggaggatggcggcattgccgagcaatcgagcgcagaggtgtggcaggcggtttgtgatagcgttcgcgacagcgtttcacgcgccggtatcgatccggcggaggttaccggcattggcttcgacgcgacctgttctcttgtggttcgcggacccggtgacgtgaccctgccggtaggtgctgccgatcatcccgaacgtgatatcatcgtctggatggaccaccgtgctgtcgagcaggctgaacgcatcaacgccggcaagcatgccgtcctgaaatatgttggcggccgcatttcaccggaaatgcagacgcccaagctgttgtggctcagcgaaaacaggccggatatctatgcccgtgccgaacacttcttcgacctgacggattttctgacctggaaggcctccggggcgcttgatcgctccgcctgcacggtcacctgcaaatggacctatctcgcccacgaaaaccgctgggatgcggaatatttcaccaagatcggccttggcgatctggcggagcagggctttcgccgcatcggtgaaagcgtggtccatcccggcacggcactgggtaatggcctgaccgaagaggccgccaaggccatgggtctggtcgcaggaaccgccgtcgccgctggcctgatcgacgcccatgccggcggtgtcggtacggtggctgcgggtggtgatgcatcacgatgcctcggttatgttttcggcacctcgtcctgcaccatgacgaccaccactgagcccgcctttgtgccgggtgtctggggtccctattattccgcaatggttcctggcgcatggctcaatgaaggcggccagtccgccgccggtgcggccatcgattaccttgtgcagttgcacccggcctttgccgaggcaaaagcgcttgccgacaaggacggcaaagcattgccagtctggcttgccgaccgcgcgctcagcctcgccgcatccgcttccgccgcagtgaagcttgccgaagattttcatatggtgccggaattccttggcaatcgcgcgcccttcgccgatccccatgctcgcgccatcattgccggttatggcatggagacgggcgtggattccctcgtcgcgctctatgtggcggggcttctcggcctcggttacgggcttcgccagatcatcgaaacacaggcccgcaacggcgcgccggtggaaaccatcagcgtcagtggcggagcaggcgctcatccgcttgccaggcagttgctggcagatgcgaccggcctcccggttgaactgaccgaatgcgaggagccggtgctgcttggatctgccatgctcggcgccgttgccgctggaacctatccggacctgatggctgccatgccggcgatgtcgcgtatcgacagcagtgcaatgcccgatcccgattttcagaagattcaccaggcgcgttacgacgcgtttctggcgctgcagaatgcggcgcgtgccattcgc

SEQ ID NO: 37984 - DNA, 714 bp, Agrobacterium tumefaciens; identical to SEQ ID NO: 35171

SEQ ID NO: 37985 - DNA, 711 bp, Agrobacterium tumefaciens; identical to SEQ ID NO: 35408

SEQ ID NO: 37986 - DNA, 678 bp, Agrobacterium tumefaciens
aaagtggctattgtaacggcaggtggcagcggcatgggggcggccgtggcgaaacgcctggcggcggacggttacaggctcgcgatcctgtcctcctccggcaagggcgaggcgctggcgaaggaactgggcggtatcggtgtcaccggctccaaccagtccaatgacgaccttcagcgactgacggatcagacgctcgagaaattcggtcgcatcgacgtgctggtcaatagcgccgggcatggcccacgtgcctccattctcgatattaccgacgagcaatggcacaccggtctcgatgtctacctgatgaacgtcatccgcccaacgcggatcgtcgcgcccatcatggtgaagcaaaaggccggtgcgatcgtcaacatctcgacggcctgggctttcgaaccgagcagcatgttcccgacatcggcagtgttccgggccggccttgcctcctacagcaagattttcgccgatacctatgcggccgacaatgtgcgcatgaacaatgtcctgcccggctggatcgacagcctgccggctacggaagaacgccgcgacagcgtgccgatgcagcgctacggcaagagcgaggaaatcgctgccaccgtggcgtttctcgcgtccgaaggggcagggtatattaccgggcagaatatccgggttgatggtgggctg

SEQ ID NO: 37987 - DNA, 2709 bp, Agrobacterium tumefaciens
ttgaagatatcgaaaatacttgttgccaaccgatccgaaattgcgatccgcgttttccgggcagcgaacgagcttgggatcaaaaccgttgcgatttgggcggaagaggacaagctgtctttgcaccgcttcaaggcggatgaatcctatcaggtcggcaggggtccgcatctcgccaaggatatgggaccgatcgagagttatctttcgatcgaggaggttatccgcgtggccaagctctccggagcggatgcgatccatcccggttatggtcttctgtccgaaagccctgagttcgtggaggcctgcaacaaggccggcatcaccttcatcgggccgacaccggacacgatgcgccagctcggcaacaaggtcgccgcccgcaatctggcgatttcggttgatgtccccgttgttcccgccaccaatcctctgcctgacgatatcgcggaagtggagcgtatggccgaggaaatcggttatcccgtcatgctcaaggcctcctggggcggcggtggccgcggcatgcgcgccattcgcaaaaaggaagatctcgcccgtgaggtgacggaagccaagcgcgaggcgaaggccgccttcggcaaggacgaggtttatctggaaaagctcgtcgagcgcgcccgccatgtcgagagccagattctcggcgatacgcatggcaatgtcgtgcatctgttcgagcgggattgttcgatccagagacgcaatcaaaaggtcgtcgagcgcgcgccagcaccgtatctgtccgaagcgcagcgccaggaactggccgcctattccctgaagatcgcagccgcgaccaactacatcggcgccggcactgtcgaatatctgatggatgccgataccggcaaattctacttcatcgaggtcaatccgcgtatccaggtggagcataccgttaccgaagtcgtgaccggcatcgatatcgtcaaggcgcagatccatattctcgaaggagcggccatcggcacggcggaatccggcgtgcccaagcaggaagatatccgcctcaacggccatgcgctgcagtgccgcatcacgacggaagacccggaacacaatttcattccgtactatggccgtattaccgcctatcgctcggcttccggtttcggcatccgtctggatgggggcacgtcctataccggcgccgtcatcacccgttattacgatccgctgctcgtcaaggtcacggcctgggcgccggagccggatgaagcgatcagccgcatggatcgcgcgttgcgcgaatttcgtatccgcggcgttgcgaccaacctgaccttcctcgaagccatcatcggtcacgacagtttccgcaacaacacctatacgacgcgcttcatcgattcgacgccggagttgttcgcgcaggtcaagcgtcaggaccgcgccaccaagcttctgacctatctggccgatgtgaccgtcaatggtcacccagaaaccaagggtcgtgcgaagcctgcggacaaggcggcaaagcccatcgtgccctatatcgatgcgccgacgcctgacggcaccaagcaattgctggacaagcttggccctaagggctttgcggactggatgcgcaacgaaaagcgcgtgctggtcacggatacgaccatgcgcgacggacaccagtcgctgctggccacccgcgtccgtacccatgatatcgcccgcgttgccagcgtttattccaaggcgcttccgcagcttctgtcgctggaatgctggggcggtgcgaccttcgacgtctcaatgcgcttcctgaccgaagacccgtgggagcgcctgtcactcattcgcgaaggtgcgccgaacctgctgttgcagatgcttctgcgtggtgccaacggcgtcggttacaagaactatcccgataatgtcgtgaagtatttcgtccgtcaggcggcaaggggcggcgtcgatctttttcgcgtcttcgactgcctgaactgggtggagaatatgcgggtgtcgatggatgcgattgccgaggagaacaagctctgcgaggcaaccatctgctacaccggcgatctcttgaattcggcacgtccgaaatatgatctcaaatattataccaacctcgcggtcgagctggaaaaggccggcgcccatatcatcgccgtcaaggatatggcgggcctgctgaaaccggccgccgccaaggttctgttcaaggcgttgcgcgaggcgaccggtctgccgatccacttccacacccatgatacgtcgggcatttccgccgcgaccgttcttgcggccgtggatgccggcgtcgacgccgtcgatgccgcgatggatgccttctccggcaatacgtcgcagccctgcctcggctcgatcgtggaggcgctctccggatcggaacgcgatacgggtctcgataccgaatggattcgccgcatttccttctattgggaagccgtgcgcaatcaatatgcggcgttcgagagtgacctcaaagggcctgcctcggaagtctatctgcatgaaatgccgggtggccagttcaccaacctcaaggaacaggcacgttcgctgggtctcgaaagccgctggcacgaggtggcgcaggcctatgccgatgccaacaggatgttcggcgatatcgtcaaggtgacgccgtcctccaaggtagtcggcgacatggcgctgatgatggtgagccaggacctgacggtggccgat

SEQ ID NO: 37988 - DNA, 1176 bp, Agrobacterium tumefaciens
ggtgccgtcaagcccccggtattcctgacgtcgaccttcgtcttcaaatcggcagaggatgggcgtgacttcttcgactacgtttccggccgcaaggagccgccggcgggcaagggtgcgggtctcgtttactcccgttttaaccaccccaacagcgagattgtcgaggatcgccttgccgtttacgaacgtacggagagttgtgcgcttttctcgtccggcatgtccgccatttccacgacgcttttcgccttcgtccggcccggcgacaccgtgctccattcccagccggtgtatggtgggactgagacgctgctggcaaagaccttccataattttggcgtctcggcggtgggttttgccgacggtgtcagcgaggcatcggtgatggccgccgcagagaccgcgatggcgaagggcagggtgtcggtcattctgatcgaaacgccggccaacccgacaaatagcattgtcgatgttgcgatgatgaggcgtgtcgctgacgtgatcggcgaaaaacaaggccacagaccgatcatcgcctgcgacaacacccttctcggcccagttttccagcagcccatcgagcacggcgccgatatttcgctctattcgctcacgaaatacgtcggcgggcattccgacctcatcgccggggcggcgctcgggcggaaggatgtcatgaagcaggtgaaggccctgcgcggagcgatcggcacgcagctcgatccgcactcctgctggatgctcggacgttcgctcgagacgctgcaaatccgaatggagcgggcaaacagcaacgcgaaaatcgttgcggaattcctgaaagcgcatccgaaggtcgagaaaattcattatttgccgttcagcgatccggcatctgcagtcggcaaggtgtttgccgctcaatgctccggtgcgggatcgaccttctcgttcgacattgttggcgggcagccggcgtctttcaaattcctcaatgcgctgaccatattcaaacttgccgtgagcctcggcggtacggaatccctcgcgtctcaccccgcaacgatgacgcattcaggcgttcccgccgatgtccgccagcgcattggtgtactggattccacgattcgcctgtcgatcggcatcgaacatcccgatgatcttatcgccgatctgacccttgctttggac

SEQ ID NO: 37989 - DNA, 950 bp, Agrobacterium tumefaciens
atggctctggcgacaagggcgtctggtggagctgaccgaaggaaacccgtgagggcgcgcgccggccacgcggcctgcatctcgtgtcctgccacaaaacacagcttttggggttctcgatccgcaatgccgcctcgtggacgatccatccgcagggctgcgaggatctgacggccgccggcctcaccatcatcgcgccgcatgacagtcccaataccgatggtttcaaccctgaaagctgccgtaacgtgatgatatcaggcgtgcgcttttccgtgggtgatgactgcatcgcggtgaaggcgggaaaacgcgggcctgatggtgaggacgatcatttggcggagacacgcggtatcagcgtgcgccattgcctgatgcagcgcggccatggcgggctggtcatcggttcggaaatgtccggcggggtccatgatgtgacggtggaagattgcgacatgatcggcacggatcgcggcctgcgtctcaagacgcggcgcggtcgcggcggtatggtcggcaacatcaccatgcgccgggtgttgctggacggtgtgcagactgcactttccgccaacgcccattatcattgtgatgccgatgggcatgatgactgggtgcagtcgcgaaacccggcgccggtcaatgacggcacgccgttcgtcgacggcatcaccgtggaagatgtcgaaatccgcaatctcgcccatgcggcaggtgtctttctcggtctgccggaggctcccatccgcaacatcgttgtccgcaacctcaccatcgtctcgcatgatccttcggctgttgcgacgccgccgatcatggccgaccgcgtgcgccccatgcgccatgaggcgatcgtcttcgagcaggcggatgtcgtctgcgatgatccggcgcttctgaatgacgcccccgtttccatttcgtcatatttcgattgagaaaagcca

SEQ ID NO: 37990 - DNA, 1444 bp, Agrobacterium tumefaciens
  unsure (1)..(1444): unsure at all n locations
atgaatgtcctttcggtttcatccgaaatttatcccctgatcaagaccggagggctcgccgacgttgtcggcgcgctccccatcgcgctcgaagcccatggcgtcagaacgcggacattgatacccggctatccggcggtgaaagccgccgtgacggaccccgtcaaatgttttgagttcaccgacctgcttggcgaaaaggccgatctgctcgaagtccaacacgagaggctagaccttttgatcctcgacgcgcccgcctattacgagcgttccggcggcccctatctcggccagaccggcaaggattatcctgataactggaagcgttttgcggcgctgtcactggcggcggcgcggatcggcgccggtgtgctccccggctggcggccggatatggtgcacgcgcatgactggcaggccgccatgacgcctgtctatatgcgttacgccgaaacaccggaaattccgagccttctcaccatccacaacattgcctttcagggccagttcggcgcaaacatcttcagcaaacttgccctgcccgcccacgccttcggcatggagggcatcgaatattacaacgacgtcagcttcctcaagggcggcttgcagacggcaaccgcgctcagcacggtcagcccatcctatgcggaagaaatcctgaccgcggaattcggcatggggcttgaaggggtgatcggcagccgcgcccatgtgctgcacggcatcgtcaacggcatctactgctatgtctggaacacgggcaccgaccatctgatccacgacaattattcngcccgacatcccaagaacagtgccctgaacaagaaggcggtcgccgaacatttccgtatcgatgatgatggcagcccgctattntgcgtcatctcccgcctcacctggcagaagggcatccacctcatggcggaagcggtggatgagatcgtctccaatcgagcgccgcctggtcgtaatgggcgcgggcgatgtggcactggaaggcgcgcttcttgcggcggcatcccgccaccatgnacgcgtcggtgttgccatcggttacaacgagccgctgtcgcatctcatgcaggcgggttgcgacgcgatcatcattccctctcgcttcgagccctgcggcctgacccagctttacgcgttgcgttacggctgcattccggtcgtcgcccgcaccggcggccttgccgacaccgtgattgacgccaaccatgccgccctcgccagcaaggcggcaactggcgtacaattttcacccgtcacacttgacggtctgaaacaggcgatccgccggaccgtccgttattatcacgacccgaaactgtggacacaaatgcagaaactcggaatgaaatccgatgtttcctgggaaaaaagcgccggtctctacgccgcgctttatagccagcttatttcgaaaggccattga

SEQ ID NO: 37991 - DNA, 1626 bp, Agrobacterium tumefaciens
atgatcaagactatcaagacgacgccttatcaggaccagaagccgggcacatccggcctgcgcaagaaggtgccagtcttcgcccaggaaaattatgccgagaacttcatccagtcgatcttcgacgcgcttgaaggttttgagggccagacgctggtgatcggcggcgacggccgttattacaaccgcgaagtcatccagaaggcgatcaaaatggccgccgccgccggtttcggcaaggtgctggtcggtcagggcggcattctctcgacgcccgccgcctccaacgttatccgcaaatacaaggccttcggcggcatcgtgctttccgccagccataatcccggcggcccgaccgaagatttcggcatcaaatacaatatcggcaatggcggcccagcaccggaaaagatcaccgacgcgatctatgctcgctctaaggtcatcgacagctacaaaatctctgatgcagccgatatcgatctcgacaagatcggcagcttcaaggtggatgaactaacggtcgacgttatcgatccggttgccgattatgctgcgctgatggaagagctgttcgattttggcgccatccggtctctcatcgccggcggcttcaaggtcgtcgtcgattccatgagcgccgtcaccggcccctatgccgttgagatcctcgaaaagcgtctcggcgctcccaagggctccgtccgcaacgcaacaccgctgcccgatttcggcggccaccatcccgatccgaaccttgtccatgccaaggagctttatgacgacgtcatgagcccggaaggcccggatttcggcgcggcttccgatggtgatggcgaccgcaatatggttgtcggcaagggcatgttcgtcactccctccgatagtctcgcgatcatcgccgccaatgccaagctggcgcccggttatgccgccggcatttccggcatcgcccgctcgatgccgaccagtgctgcagccgaccgcgtcgctgaaaagctcgggcttggaatgtacgaaaccccgaccggctggaaattcttcggcaatctcatggatgccggcaaggtgacgatctgcggcgaggaaagctttggcaccggttcgaaccatgtgcgtgaaaaggatggcctgtgggccgtgctttactggctgaacattgtcgcggcgcgcaaggaaagcgtgaaggacatcgtcaccaagcactgggcggaatatggccgcaactattattcgcgccacgactatgaggaagtggattcggatgccgccaatacgctggtggccatcctgcgcgaaaaactcgcgacactgcccggcaccagctacggcaatctgaaggtcgcggcggcggatgattttgcctatcacgatccggtcgaccagtctgtcagcaagaaccagggcatccgcatcctgttcgaaggcggctcgcgcatcgtgctgcgcctttccggcaccggtactgcgggcgcgacgcttcgactctacgtcgagcgttacgagccggatgcggcccgccacggcatcgaaacgcagtcggcgctcgccgatctgatttccgttgccgataccatcgccggcatcaaggcccataccggccgcagcgaaccgactgtcattacc

SEQ ID NO: 37992 - DNA, 2667 bp, Agrobacterium tumefaciens
agtgcccggcagcggcttgcctccgatcccgcaagctcggcctgggtgtcggccaatgccggctccggcaagacccatgttttgacccagcgcgtcatccgcctgcttttggccggatgccgcccctcggcgatcctctgcctcacctataccaaggccgcagcatctgaaatgtcgagccgcgtgttcgacaggctggcagaatgggcaacgttgccggattccgatctcaaggaccgcatcaccaccatcgaaggcaaggtgcccgatcgtatcaagctcgccgaagcgcggcggctgttcgccaaggcgctggaaacaccgggcgggctgaaaatccagaccatccacgctttttgcgaagccctgctgcaccaattcccgctggaggccaatgtcgccggccatttctcggttctcgatgatcgcgccgccaccacgcttctggccgaggcgcgccgttcgcttctgacggcggtttcgactgaggacgacgcggaattggtgcaggcgctcgcctatgtgctcgatcttgccgatgaaagcggcctggaagcgctgctttccgccatcatcgccaatcgcagcgcgcttcgctcgttcctgcacgaggcaaaacagtcgggcggcctcgatgtccgtttgcggcaggagatgcaaattgctgccggggagaccgaggaaacggcggctgaagccttctggcccctgcccggtctttccggccttgtgctcgacacctaccttacgcttgccgatgaggtgggcggatcacgtgtcatcgaggtcgcttatgcgctccgggaagcaaaacggcagccggacccggtgcggcggatggaactcatcgaagccgcgctgctgacggccaagggcgagaaaaaatcggacgcctatgtcatcaacaagggcatgcagaaatccgcgcctgatctcgttgatgcgctgacgctggcccgcgaccatgtcgtggcctgccgcaatcgctatcgtctggtgcgcatgctggtggcaactaaaagtgcccttgtgctggccgaacggttgatcggcgatttcgaagacctgaaaaagcagcgaagccagctcgattttgaagatctgatcgagcgtgccgccaatctgctcaatcgcgatacggcaggtgcatgggtgcattacaagctggatcagggcatcgaccatattctggtcgacgaggcgcaggataccagcccggtgcaatggtcaatcatccagtcgctggcggcggatttcttcaacggtgaaagcgcccgcatggggcggcgcacactctttgccgtgggtgacgaaaaacagtcgatctattcctttcagggcgcgcgaccggaacggttctcgcaggagcgcgatgagaccaaaaggcgtgtcgatcaggtggagcaggccttccaccgcatccgcctgccgctctccttccgctccaccgaagatgtgctggctgccgtcgaccaggtcttttcagacccgaaaaacgcgagcggcctcagcgccgacaatgagcccgtcgaacaccgctccaaccgcgccggccatcccggcaccgtggaagtgtgggatatggtggcaccggaaaccaccgaagatgaagaggactggaccgcccccttcgacgcgctgcgggaaagcgcgccggccaccatcgtcgcccggcgtatcgccgcgcgcattgccgatatgatcggaaaccaaaccatcatcgaaaagggcgtggagcgtgccgtcgaacccggcgatattctcgtgcttgtcagaaaacgcgctgccttcgtcaacgcgctgacccgcgagttgaagcggcgcaagaacattcccgttgccggtgccgaccgcctccgcctgaccgatcacatcgccgtgcaggatcttctggcgctcggccggttcgtggtgctgccggaggatgatctttcgctggcggccctgctgaagagcccgcttttcaacctgacggaagacgatgtcttcgagatcgccgcgacgcgatccgaggcggagagtgtgtggcagaggctgcaagtcctttcgggcgaagaaaccagccgtctatccatcgtcaccgacaagcttcggcatttcatttcactgtcgaaaaccgccacggtgcatgattttttcgcggcggttctgaccctgcatgacggccgcaaaaaatttcttggccgtcttggcaacgaggcgagcgacgttctcgacgagttcctctccttcgcgctggatcacgaaagaaccggcctgcccggtcttcaggcttttctctcggttctggagaccgattcacctgaagtgaagcgcgagcaggacaaggatcgcggcgaagtgcgcatcatgaccgtgcatgcgtccaaggggcttgaagcaccggtggtctttgtcgtggatggcggctcgaaggccttcaaccacagccatgtgccgaaactgcgcttcgtggagggggatggcgatgcctttccggtctggctgcccggcagcggtttttccaatcatctcattcgctcggatgaggaacgcctgaaaacggccgcggaagatgaatatcgtcggctgctttatgtggcgatgacccgcgccgccgatcatcttgtcgtctgcggttatcgcggccagaaggaaaatcccgaatgctggcacgctatcgtcaag

SEQ ID NO: 37993 - DNA, 906 bp, Agrobacterium tumefaciens
aagaaaatactcgttctgggcggcgcgcatatcgacaggcgcggcatgatcgagaccgagacggcgcccggcgccagcaatccgggctcgtggatggaagaggccggcggcggtggtttcaacgccgcgcgcaatctttcccgcctcggttttgaagtccgcatcatcgccccgcgcggcggcgacgtcaccggcgaagtggtggcggaagcagcaaggcaggcgggggtggaagacacgccgtttaccttcctcgaccgccgcacgccgagctacactgccattctggagcgtgacggcaatctggtgatcgcactggccgacatggacctctacaagctctttaccccgcgccgcctgaaggtacgcgcggtgcgcgaggcgattatcgcaagcgactttctactctgcgatgccaatctgcccgaggatacgctgacggcgcttggcctcattgcccgcgcctgcgaaaagccgctcgccgccatcgccatttcgccggccaaggcggtgaagctgaaagcggcgctcggcgatatcgacatcctcttcatgaacgaggcggaagcccgcgcgctcaccggcgaaacggcggaaaatgtccgtgactggccaaatatcctgcgcaaggctgggctttccggcggcgtcgtcacccgcggcgcaagcgaagtcgtggccttcaacgggacggaaaaagccatcctccacccgcccctcatccgcgaggtgaaggatgtcaccggcgccggcgatgccatggcctccggttatctcgccgccattgccgagggaaaaacaatcagggaggccctgagacagggggcggcggcggcggccattaccgtgcagtcatccttcgccaccttccaggacctatcaaaagacagtgtcgaagccatgttg

SEQ ID NO: 37994 - DNA, 1333 bp, Agrobacterium tumefaciens
atgtccaatctcgcggccatcgatgccgcccatcaccttcaccccttttccgacatgggcaagctgaatgccgccggcacccgcatcatcgagcgcgcggaaggggtcttcatctacgacagcaccggcaagaaatatctcgatgcctttgccggcctctggtgcgtgaatatcggttatggacgccgcgagatcgccgatgtcgtgcagcgccagatgaacgagctaccttactacaacgcctttttcggcaccaccaccccgcccgcgacgcttctggcgcaaaagatcgcctcgcgcgccgggccgaagatgaaccatgtgttcttcaccaattccggttcggaagccaccgacacctggttccgcatggcgcgggtctactggaagggcgcttggccatcccacgaagaccagggtgatcgcaagacgcaacggctatcatggctcgacggtagccggcgcttcgctcggtggaatgaaatggatgcatgaacagggcaacctgcccatcgaaggcatcgcccatatcggccagccctattggtatgccgagggtggcgatctctcacccgccgaattcggcctgaaggtggctcgggaactggacgccaagatcgatgaactcggcgaggaaaatgtcgccgctttcgtggccgaacccattcagggcgcaggtggtgtcatcgtgccgccggagacctactggccggaaatcgcccgcatctgcaaggcgcgcaacattctgctggtgtccgacgaggtgatctgcggtttcggccgtctcggttcgtggttcggataccagcattttggcgtggagccggatctcgctcccgtcgccaagggactgtcatcgggttatctgccgatcggtggtgtcatcgtttcagaccgggtggcggaggtgatgctttcagaggtcggtgatttcaaccacggtttcacctattccggccatcccgtctgtgctgccgcggcactggaaaacctccgtatcattgaggatgaggggctggtggagcgggtacgtgacgatatcggcccctatttctccgagggctggaaaagccttgccgatcatgaactggtgggcgaggccgtgaatgttggcctgatgggcggtttgcaactgacggcggacaaggcaacccgcagacgtttcgccaagccggacgatatcggaaccgccgtgcgcaaccattgccttgcaaacggcctcgtcatgcgtgccacgggagatcgcatgctggcctcgccggcgctgaccgtcagccgttccgaagtggacgagatcatcgagacgctgcgccaggggctcaaccacctgcgc

SEQ ID NO: 37995 - DNA, 498 bp, Agrobacterium tumefaciens
gtcaccatcatcgttgcggtctccgagaacggcgtcatcggccgcgatctcgacatgccatggaagctgtcgaccgatctgaagcgcttcaaggcgatgacgatgggcaagccgctcatcatgggccgcaagacgtttctgtctgtcggcgaacgtcccctcccgggccgtccgcatatcatcgtcagccgaaatgccgattaccggcctgaaggcgtcgacgtcgtttcgtcgctggacgaggccgtgaagcttgcaaaaacgaaggctgtggaactgggcgtggacgaggtttttgtcgccggcggtggcgagatttaccgtcaggccatgccctttgccgatcaactttccgtcacccatgtggcggtaaaactcgatggcgacactttttttccggaaattgatcccgccgtttttgagaaaaccgaagaaaaggccgcgtccgcaggggaaaaggacaattatccggttctgtttaccacttatgtgcgacga

SEQ ID NO: 37996 - DNA, 870 bp, Agrobacterium tumefaciens; identical to SEQ ID NO: 35252

SEQ ID NO: 37997 - DNA, 717 bp, Agrobacterium tumefaciens
gattttaacggccggacagtggtgatcaccgccgccggtcagggtatcggccgggcgacggcggagcgtttcatatcgctcggcgcgcgcgtcatcgccaccgatatcaacgagcaggcgctttccaccctgaagggtgcggaaacgcgggttctaaacgtgcttgacggtgatggcgtcgaggatttcgcagccgatatcggccatgccgacgtgctgttcaactgcgccggcttcgtccattccggcaccattctcgattgtgaagagaaggactgggatttctccttcgacctcaacgccaaggcgatgtatcgcacctgccgcgccttcctgcccggcatgctggaaaagggcaagggcgcgatcgtcaacatgtcatcggttgcgtcaagcgtgaagggcgtgccgaaccgtttcgcctatacggcttccaaggcggccgtggtgggtctcaccaaggccatcgccgccgatttcgtcaccaagggcattcgctgcaacgccatttgccccggcacggtcgatagcccgtccttgcatgaccgcctgcgcgccaccggcaattacgaacaggcgttggcagatatcatcgcccgccagtcgatgggccacatcgccacaccggaagaaatcgcagcgctcgtcacctatctcgcttccgacgaggcaggtttgaccaccggccagattcatgtgatcgatggcggctggacg

SEQ ID NO: 37998 - DNA, 507 bp, Agrobacterium tumefaciens
gacgcactggatgtggcccgcgcactcatcggtgcggaatttcgcgtcggcaaagccggcggcattattgttgaaaccgaagcctaccatcccgacgatccggcatcccacgccttcaatgggcagaccccacgcaacagggcaatgttcggccctgccggccatctctatgtctaccggtcctacggcatccactggtgcgccaacttcgtctgtgcccccggctccgccgtgcttctgcgcgccatcgagccgctgaccggtatagatatgatgaaactgcgccggggaaccgataagctcaaacttctctgctcgggcccgggcaagttgtgccaggcgatggcgattaccggagagatggatggagcaccgctcaacgcaccaccatttctgctgcgtctgccaaaggaagccgccgcgatcagcaccggcaggcgcatcggtatcagccgtgcagtggattatccctggcgtttcgggctggaaggctcagctttcgtcagc

SEQ ID NO: 37999 - DNA, 750 bp, Agrobacterium tumefaciens
aaagttgctctcgtcaccggtgcaggttccggtatcggtcgcgccgccgccctccatctggccgcggcaggcttttcggttggcctgctcgggcgcaccgaatccgaattgcagaccgtggctgctgagatagaggccgcatccggctcttcgagacttcttctcgccgatgtctcggatgaggcggccatgcgtcatgcggtagcaacgcttgtggacgatttcggtcggctggatgtcgtggtggcgaatgccggggtgaacggagtctgggcgcccatcgatgagttgaagccttccgactgggacgacacgatccgcatcaacctgcgcggcacctatctcaccgtccacgccagcgtgccgcatctgaaagcggccggcggcgggtccatcgttatcgtgtcgtccatcaacggcacccgcacgtttacctcgcccggtgcgaccgcctattccgtgacaaaggcgggacagcttgccatggcccagcaactggcgctggagcttggccgccaccggatccgcgtcaatgcggtgtgcccgggcgagatcgaaacggcaatcaatgagaacaccgacatccgcgggagggaaaggaccgaagtgccggttcgttttccggcgggcgacattccggtgacgggcggtgtcgccgggacgagcgaggatgtcgccgaactcatcggttttctcgcctcggatgcatcgcgtcacattaccggcacaccggtatggatcgacggcggt

SEQ ID NO: 38000 - DNA, 1191 bp, Agrobacterium tumefaciens
ttcgatatcagcgaaaacgatctattgatcggcggactttcggtgcgcgatatcgttgcagaaaccgggaccccgtgttttctctatgataacagcgccatgcgccaagcctatcgcgatctcgaaacggcgctttccggttttgccgatatctattattcggtgaaggccaatcccctgcccgccatcatctcacttttccgcgaagaaggcgccggcgcggaaatcgcctccgttggcgaatatcgcgccgctgtaaaggccggcgtcgcgcctgataacatcatcttcgccggccccggcaagagcatggccgaattgcgcgaagtgatcgagggcggtatcggtgaaatccacatcgagagtgcggaagaaatcgcccgtatcgaggcgatcaacaggccggtcaaggcgtcgatccgcatcaatccggtgccggatgcgcaggcgggcgccatgcgcatgggcggcaaggccacggccttcggtttcgacgaggaggaactggaaaacgtcctgaagctctttgcgaacgtcagacatatcgatctcgttggtatccatatttacggcggcacgcagatcctcgatgccgacatgcttgtctcccaatggcgacacgccatcgctcttgcaggtcgcatggcgcaaatgctcggcaaaccgctcgaaaccatcgatctcggcggcggcctcggcattccctatttcgccggggaaacatcgctcgatctcgccaaggtggctgccgccattcccgatctcaaggcgcttctaaaggcgcatccgctgatcgccgatgcccatgtcatagtcgaacccggccgcttcctcgccggccctggcggcctctatgtggtagaggtcaactcggtaaagacctcgcgcggcaccaccttcgtggtcacggatggcggcatgcaccaccacctggcagcctccggcaatctcggccagatcgtcaaacgcaactaccccatcgtcgcaccggccatgatgcaggcggcacacgatgagacagccaccatcgtcggcccgctctgcaccccgctcgatacgctcgcccgcaatgcgaccctgccgaaactgaacgccggcgatctcctcgccatcctgcaatccggtgcctatggcgcgagcgccagcccaggcggttttctcagccatacggtagcgaaggaagtgctggtg

SEQ ID NO: 38001 - DNA, 798 bp, Agrobacterium tumefaciens
gttccagccctcggacttggcacctggaatatgggcgagacgagatcatcggcagacgacgagattgaaagcatccgcaaggcgatcgatctcggcatgacgttggtcgacaccgcggaaatgtatgccgacggccggtcggaagaagtggtcggcacggcaatcgccggccgccgcgacgaggtgtttctggtcagcaaggtctatccctggaatgccagcgcgagaggcactgcggaagcgtgcgagcgcagcctcgcaaggctcggcaccgaccacatcgacctctatctgctgcactggcgcggcgagcacccgcttggcgaaaccgtggccgcgttcgaaaggctgaagagcgacggcaagatcggcaactggggcgtctccaatttcgataccgacgatatggaggagcttttcaccgttccagagggcaaaaactgcgccgccaatcaggtgctctataacctctcccggcgcggacctgaattttcccttctgccctggtgccaggagcacggcgtgccgctgatggcctattcccccatcgagcagggccgtatcctgaagaaccacgaactcattcgcatcgccaaggcttatcaggcaaccccggcgcagctggccttggcctttcttttggatagggacggcgtcatcgccattccaaaatccgccagcgtgtcccgtatcgtggaaaatcgcggcgccaccgatcttgaaataaccgaggaagactggaccgccctcgacgccgccttcccgccgccgacgcgcaagacgtccttggaaatgctc

SEQ ID NO: 38002 - DNA, 1005 bp, Agrobacterium tumefaciens; identical to SEQ ID NO: 35347

SEQ ID NO: 38003 - DNA, 600 bp, Agrobacterium tumefaciens
gatgtgacaagcgacgccgatgcgcaggcggcaataaaggtagccgcttccgccaaaggcggccttcgtattctcgtcaattgcgcgggcatcggcaccgcgggtcgaattctcggtcgcgaagggccgcaaccgcttggcgatttcgaacaggtcatccgcgtcaacctgatcggcaccttcaacatgatgcggcttgcggccgctcacatggctgagagggaacaggatgaaggccaagacagtcgccaagacaatggtgtgatcgtcaacacggcgtcggttgccgctttcgagggccagatcgggcaagcggcctatgccgcgtcgaaaggcggcatcgtttcactcgccctgcccgcagcacgcgaacttgcccgcttccgcattcgggtgaacaccgtggcgcccggcattttcctgacccccctgcttcagggattgccgcaggaggttcaggagagccttgcgggccagataccccacccttcccggctcggcgatccagccgaattcgccgatacggtgcgctttctcatcgagaacgattacatgaacggtgaagtcatccggctggatggcgcgatccgcatgcagccg

SEQ ID NO: 38004 - DNA, 1248 bp, Agrobacterium tumefaciens; identical to SEQ ID NO: 35386

SEQ ID NO: 38005 - DNA, 873 bp, Agrobacterium tumefaciens
gacgttcattattatacccatggcaagatcggccacttcgtcgtcaacgcacccatggtgctcggccatgaagcctccggtacggtgatcgaaaccggttccgacgtcacccatctgaagatcggtgaccgcgtctgcatggagcctggtatccccgatcccacatcgcgggcctcgaaactcggcatctataatgtcgatcccgctgtccgcttctgggcaacaccgccgatccatggctgcctgacgcctgaggtcatccaccccgcggccttcacctacaagctgccggataacgtctcctttgccgaaggggcgatggtcgaacccttcgccatcggcatgcaggcggcactgcgggcgcgcatccagcccggcgatatcgccgtcgtcaccggtgccggtcctatcggcatgatggtggcgcttgccgcattggcgggcggttgcgccaaggtcatcgttgccgatctcgctcagccgaagcttgatatcatcgccgcttatgacggcatcgagaccatcaatatccgcgagcgcaaccttgccgaagcggtttcggccgccacggatggctggggttgcgatatcgtcttcgaatgctcaggtgcggcacccgccatactcggcatggcgaaactggcgcgaccgggcggtgccatcgtgctcgttggcatgccggttgacccggttccggtcgatatcgtcggccttcaggccaaagagctgcgggtggaaacggtattccgttacgccaacgtctatgaccgcgcggtggccctcatcgcctccggcaaggttgatctcaagccattgatttcggccaccattcccttcgaagacagtatcgccggtttcgaccgtgcggtggaa

SEQ ID NO: 38006 - DNA, 1219 bp, Agrobacterium tumefaciens
gaataatccggccagcaaatccggaggcatacagtgagcgaacgcgcagcatttcattggcaggacccttttctgctcgaagaccaactgaccgacgacgagcgaatgatccgcgacagcgccgaggccttcggcaaatccgaactgctgccgcgcatctcggaagcctatctttccgaaaccaccgaaccggaactcttccgtctgatgggacgcaccggcctgctcggcgtcaccctgccggaagaatacggcgcagccaatgccagctatgtggcttacggcctcgtcgcccgcgaggtggagcggatcgacagtggttaccgctcgatgatgagcgtgcagtcctcgctcgtcattcacccgatcttcgcttacggctcggacgaacagaagaagaaatacctgccgggcctcgtttccggtgaactgatcggctgtttcggcctcaccgagccggatgccggctccgatcccggcggcatgaagacccgcgccgaaaagatcgagggcggttatcgcctgcgcggttcgaaaatgtggatttccaacgcgccgatcgccgatgttttcgtcgtctgggcgaaatcggaagcgcatgacaatgagatccgtggtttcgtgctggaaaagggcatgaaaggtctttccgcccccaagatcggcggcaagctttcgctgcgcgcctccattacaggcgaaatcgtcatggatggcgtggaagtgggcgaagatgcattgcttccgaatgtttccggactgaaaggcccgttcggctgccttaaccgcgcccgttacggcatttcctggggcgtgatgggggctgcggaagattgctggttccgttcccgccaatatgggctcgatcgcaaacagttcggcaagccgctatccggcacgcagctttaccagaataagctcgccgacatgcagaccgaaatcgcgctcggccttcaggcatcgctgcgcgtcgcgccggctgatggacgaacataagatggcgccggaaatcatctccatcgtcaaacgcaacaattgcggcaaggggctgaatatcggccgccaggcccgcgacatgcatggcggcaatggcattcagatcgcatatcacgtcatgcgccatgcccagaatcttgaaacggtgaatacctatgagggcacgcatgacgtgcacgcgctgatcctcggccgggcgcagacgggcattcaggcgtttttc

SEQ ID NO: 38007 - DNA, 1660 bp, Agrobacterium tumefaciens
gatccgcttggcccctatccgcagaaattgaatgagcgtctccttcactggtgtcgttcggcaccggagcgcacatggatggccgaccgtcagggtcgcgagccatggcgccgggtcagctacgccgaggctctcgacaagatacggcgtatcggccagttccttctcgatcatgacctttcggtcgagaggccgctgctggtgctttctgaaaattccatcgagcatgcgttgatggtgcttgcggcccagcatgtcggtatcgcctcggctgccatcacgccggcctatgccacgtcggccgatctcaccaaactcgccgacatccgcgggcagatcaccccggggatggtttttgccgaggatgcgacgccctttcgccgggcgctcggcgaggttttcgacgacggtacaccgctggtcggcctccgcaacctgccggaagatcgttccaatacgtttcatttcgaaaccctgcttgaaacggagccgaccgaagcggttgatcgtgctttcgatgcggtcgggccggataccgtcgccaaattccttttcacgtcaggcacgactggttcgcccaaagcggtcatccagacgcaacgcatgttgtgctccaatcaggaaatgattgccgattgttatggctactttcgcgaggagccgccggtcgtcgttgattgggcgccatggaaccacacggccgcggggaacaaggtgttcaacctcgtcctctataatggcggtacctattatatcgatcgcggcaagcccagcccggcgcagatcggccagacactggacaatctccgggacatatcgcccacctggtatttcaacgttcccgctggccacgaaatgctggtccaggcaatgcgcaaggacgaggcgctgtgccgcagcttttttcgcgacctgaagatgctgatgtatgccggtgccggcatggcgcagcacacatgggatgcgctgacggagctttccatggcaacggtcggccatgcggttctcatgggtgccggcctcggctcgacggagacggcacccttctcgctgttctgcaccgaaccgcaggacaagcccggcaatatcggtatcccggcgcagggcgtgacgatgaaactcgtgcccttcgatggccggtacgaattacggctgaaaggcccgaacatcacgcccggttactggcgtaatggcgaattgacggcggcagccttcgacgaggaagggttctatcgaatcggcgataccgtcaaattggcggtcgcggacgatccgcgccgcggcttttatttcgatggccgcatggcggaaaacttcaagctgcagaccggcacctgggtggccgtcgggcctttgcgcgcgcaattagtcaacatgttcgccgggctgatccgtgatgccgtcataacgggcgaaaaccgggccgaactgggcgctctcgtcgtgccattcataccggcgctacgtgagcttgttcgcggttcgcaacatctctccgatgcggagatcatccggcacccgagtgtcagggcgcagattgtcgcgaagctttcggcgcatcaaaaacaggcgagcggttccgcaagccgcgtcatgcgcattctcgtgatggaagacgcgctgcgcttcgagaaggcgaggttacggacaagggatcgat

SEQ ID NO: 38008 - DNA, 1260 bp, Agrobacterium tumefaciens
tggaaacagatgcgtcgtatcgttgtaacaggaatgggagccgtcagccctcttggcgcgaatgtggatatctcatggtcgcggctccttgctggccaaagcgggatccggcgactgaccgacgatgtcgtcggagatcttcctgcgaaagtgggaggcgttgtcccttctctcgccgaagacccagaaagaggattcgatccggacaggatcattgcacccaaggatcagcgcaaggtcgaccgcttcatcatcttcgcgctggcggcggcggaagaagcgctcgtgcaggcaaactggaagccggtctcgaatgaagacaggttgcgaaccgcgacaatcatcgcatccggcatcggcggtttccctgccatcacggaagccgtgcgaaccgttgatcaacgcggtgtacgccgcctctctcccttcacgataccgtcgttcctcgtcaatctcgcagccgggcaagtctcgatccgccacggtttcaaaggtccgctgggagcacccgtaacggcgtgtgctgccggcgttcaggcgatcggcgacgctgcacggcttatccggtccaatgaagccgacattgcggtttgcggtggaacggaagcttgcatgaacatcgtcagcctcggcggcttcgcggcggcaaggtcgctttccaccggtttcaacgagacgccgaccaaggcgtcgcgtcccttcgataccgcgcgtgacggcttcgtcatgggtgaaggcgcgggcgtactcgtcatcgaggcactcagccacgctctcgcccgcggagccaccccgattgccgaactcgttggatacggcacgacagccgacgcccaccacatcacgtcaggccccgaggatggaagtggggcacgcagggccatggagattgccatcgcgcaagcgggcatcgcccctcatgagattggtcatctgaacgcgcatgcgacatcgacgccggttggggacctcggagaaatcagggccatcaagagtgtgtttgggcaacgaaagtcggttgctgtcagtgggaccaagtcggcgacggggcacctgcttggcgcggccggcgggctggaagccatcttcacgattctagcgctcaaaaatcggatcgcccctccgacactgaacctgaacgcgccggatacggaattggacgggatcgattttgttgcaaacctgacacgatccctggacgctgaatatgccatatccaacggctgaggttttggcggcgtcaatgccagcgttcttttc

SEQ ID NO: 38009 - DNA, 1662 bp, Agrobacterium tumefaciens; identical to SEQ ID NO: 35265

SEQ ID NO: 38010 - DNA, 1642 bp, Agrobacterium tumefaciens
atggcaaggcaagaagcgaacgagcagtttcagatcacgtcgtttctggacggcgcgaatgcagcctatatcgagcagctctatgcccggtacgaagaggatccctcttccgtgtcgccggagtggcagagcttcttcaaggcactgtccgataatccggaagatgtgaagaaggcggccaagggcgcctcctggaagcgtgccaactggccgatcccggcgaatggcgaactggtctccgcactcgacggtaactgggccacggtcgaaaaggccattgagaaaaaggtccaggcgaaggctgaagccaagagcgccgatacaggcaagcccgtcagcgaagccggaagtgctgcaaggcgacccgtgacagcgttcgcgccatcatgatgatccgcgcctaccgcatgcgcggccacctgcacgccaagctcgatccgctcggcatcgccagcgccgtcgaggattacaacgagctttcgccgaagtcctatggcttcgaggaaagcgactacgaccgcaagattttcatcgataacgtgctcggcctcgaatatgcgaccgtgcgcgaaatggtcgagattctcgagcgtacctattgctcgacgctcggcgtcgaattcatgcacatgtccaacccggaagaaaagggctggattcaggaacgcatcgaaggcccggacaagggtgtggatttcacgccggaaggcaagaaagccattctgtccaagctggtcgaagccgaaggttacgagcagttcctcgacgtgcgtttcaagggcaccaagcgtttcggcctcgatggcggtgaatcgctgatcccggcactcgagcagatcatcaagcgcggcggccaggacggactggaagaagtcgtgctcggcatggcccaccgcggtcgcctgaacgttctgaccaacgtgatgggcaagccgcaccgcgccgtgttccacgagtttaagggcggttcgttcaagccagacgacgttgaaggttcgggtgacgtgaagtaccatctcggtgcctcctccgaccgcgaattcgacggcaacaaggttcacctgtcgctgacggccaacccgtcgcaccttgaaatcgtcaatcctgtcgtcatgggcaaggcccgcgccaagcaggaccaactggccaagacatgggacggcgacatcattccgctgtccgaacgcgccaaagtgctgccgctgcttctgcacggcgatgccgcttttgcgggtcagggcgtggttgccgaaattctcggtctttccggcctgcgtggccatcgcgttgccggcaccatgcacttcatcatcaacaaccagatcggcttcacgaccaatccggccttctcgcgctcgtcgccttatccgtccgacgttgcgaagatgatcgaagcgccgatcttccacgtcaacggtgacgatccggaagcggtggtctatgcggcgaaggtcgcgaccgaatatcgcatgaagttccacaagcctgtcgtcatcgacatgttctgttaccgccgcttcggccataacgaaggcgatgagccggcgttcacgcagccgaagatgtacaaggtcatccggggccacaagaccgtcgcccgtatctatgccgaccgcctgatccgggaaggcctgatcaccga

SEQ ID NO: 38011 - DNA, 897 bp, Agrobacterium tumefaciens; identical to SEQ ID NO: 35126

SEQ ID NO: 38012 - DNA, 1185 bp, Agrobacterium tumefaciens; identical to SEQ ID NO: 35127

SEQ ID NO: 38013 - DNA, 595 bp, Agrobacterium tumefaciens
gacgccatggtctgggcgctgcagaagttctccggcctgccgaagaacaaggtcgtcggcatggctggcgttctcgacagcgcacgcttccgcctgttccttgccgaagaattcaacgtttcggtccaggacgtcaccgcccttcgttctcggcggtcatggcgacaccatggtgccgctcgcccgttattccaccgttggcggcgttccgcttaccgatctcgtcaagatgggctggttgaccgccgaacgtcttgagcagatcatccagcgcacccgtgacggcggcgcggaaatcgtcggcctcttgaagaccggctcggcctattacgcgccggccgcttcggctatcgaaatggccgaatcctacctcaaggacaagaagcgcgttctgcccgctgctgcccacctttcgggccagtatggcgtagacgacatgtatgtcggcgtgcccaccatcatcggtgccggcggtatcgagcgcgtcatcgagatcgaactgaacaaggaagaagaagccgccttccagaaatccgtcggcgctgtcgctggtctttgcgaagcctgcatcaacatcgctccgtcgctgaagtaa

SEQ ID NO: 38014 - DNA, 1616 bp, Agrobacterium tumefaciens
atgaacgagcttggggttcataatcctgccaatggagttgcggaactcggactgggcgaggcctcccgcgtcttttataacctcaatgagagcgaattatacgaacacgcgatccgtaacggcgaagccgaactgaccatcgacggcgcgctgcgcgccgtcaccggccagcatacgggccgctcgccgaaggataaattcgtcgttcgtgatgcttccaccgaaaacaccatctggtgggacaacaacaagccgctgtcgccggaaaatttcgagctgctgcgtcaggacatgctggcccatgccgccggcaagacgctttacgtgcaggatctgatcggcggtgccgatgaggaaaatgcgctgccgacccgcgtcgtcaccgagcttgcctggcattcgctgttcatccgcaatctactgatccggccgaagcgggagacgctttcgggcttcagccagaagctcaccatcatcaacctgccaagcttcaaggctgatccggcccgtcatggcgttcgctcggaaacggtcattgcctgcgatctgacgaatggcctcgtgctcatcggcggcacgtcctatgccggtgaaaacaagaagtcggtcttcacggtgctgaactacctggtgtcggccaagggcgtgatgccgatgcattgctcggccaatgtcggtccctgagggtgattccgccgtgttcttcggcctctccggcaccggcaagaccacgctctccgccgacccggcacgcacgctgatcggcgatgacgaacatggctggggcgaacacggcatcttcaacttcgagggcggctgttatgccaaggcgatcaagctttcgtccgaggccgagccggaaatctacgccgcgaccaatcgtttcggcacggttctcgaaaacgtcgtgctggatgaaagccgggttcctgatttcaacgacaactcgctgacggaaaacacccgcagcgcctatccgctgcacttcattccgaatgcatcggaaacgggcattgccggccatccgaagacgatcatcatgctgacggcggatgccttcggcggtgctgccgccgatcgcgcgtctgacgccggaacaggccatgtaccacttcctctccggttacaccgccaaggttgccggcacggaaaagggcgtgaccgagccggaagccacattctccacctgcttcggcgcacccttcatgccgcgtcatccggcggaatacggcaacctgctgcgtgagctgatcggcaagcacggcgtcgattgctggctggtcaataccggctggaccggcggcgcctatggcatcggcaagcgtatgcccatcaaggcgacgcgcgcgcttctgaccgccgcacttaccggcgacctgaagaatgcgcaattccgcaccgatgcgaatttcggtttcgccgtaccgctgtcgctcgacggcgtcgatggtgcgatccttgatccacgttccacctgggccgatggcgcagcttacgacgcgcaggcgaagaagctggtatcgatgttcgtttcgaacttcaccaagttcgaagatcacgtcgacagcaaggttcgcgacgcagccccgggccttctgctcgcggctgaatgaata

SEQ ID NO: 38015 - DNA, 1326 bp, Agrobacterium tumefaciens
tggccggtgccgctgctcgagcgtcttcttccaagacatatgcagatcgtctacgcgatcaacgccaatacgctgctctttgcccgcaaggaaaagaagatggcggatcagcagatccgctcgatctcgctgatcgatgaaggcggcgagcgccgtgtgcgcatgggcaatctcgctttcatcggctcgcattccatcaatggcgtttcggcgcttcatactgagttgatgaaggaaacggtttttgccgacctgcacagcctctatcctgaacggatcaacaacaagaccaacggcatcaccccgcgccgctggctgatgcagtgcaaccccggcctcaccgggttgatccgggaagcgatcggcgacgatttcctcgacgatgcggaaaagctcatcgcgctcgaccgtttcgccgacgatgccggtttccgtgagaaattcgctgaagtgaagcgcctgaacaaggtgcgcctcgccaacaccgtggcacagcgcatgggcatccgcgtcgatccttcggccatgttcgacatccagatcaagcgcatccacgaatataagcgccagcttctgaaccttatcgaaacggtggcgctttacgaccagatccgttcccacccggaactggattgggtgccgcgcgttaagttcttcgcaggcaaggcggcgccgagttatcacaacgcgaagctgatcatcaagcttgccaacgatattgcccgggtcatcaacaacgacccggccgtgcgcgggcttctgaagggtggtgtttattccgaactacaacgtctcgcttgcggaaatcatggttcccgccgccgatctttccgaacagatttcgaccgccggcatggaagcgtccggcaccggcaacatgaaatttgccctgaacggcgcgctcaccatcggcacgctcgatggcgcgaatgtggaaatgctcgaacatgtcggcgctgacaacatcgtcatcttcggcatgacggcggaagaagtctccagggctcgcgccgaaggccataatccccgcgccatcatcgaagggtctgcggaattgtcgcaggcgctgtcatcaatcgcgtcgggtgtgttttcaccggatgaccgttcgcggttttccgccctgatggatggcatctacaacagcgactggttcatggtggctgccgatttcgacgcctatgccgatgcacagcgcaaggtggacgcgatctggagcgatcaggatagctggaacacgaaagcagtgcgcaacacggcgcgtatgggctggttctcgtccgacaggacgatccgccaatatgccaccgagatctggagagcctg

SEQ ID NO: 38016 - DNA, 1353 bp, Agrobacterium tumefaciens
atgaaagagtacgacgcgatcttcatcggagcgggacaggccggaccgttcctcgcagcacgcatggcggcgatgggccgcaaggtcgtcctgatcgagcggaaatttctcggcggaacctgcgtgaacgccgggtgcatgccgacaaagaccctggtcgccagcgccaagaccgcgcaggtcgcacggcgtgcatcggaattcggcgtcaggattgatggtgagcccgttgtagacatgaaagccgtggcagctcgtgcgaggaaggtgacgcttgacgcaagaagcggcctagcatcatggtttgatagtctggagacgatggatgtcgtctatggccatgccagattcgtgggcgcgaaggtcgtgtcggtgggcggttcgctatacactgcaccacagatcttcattaatgtgggcgcgcgaccacacatccccgatgtccccggattggcaaatgtgccttatcttaccagcacatcggtgatcgcgctcgaagagttgccgaagcacctggtggtgctcggcggcagctacatcggactggagttcgcgcagatgtatcggcgcttcgacgcacaggttacggtcatcgagcgcgggcagtatctggcgtcccgggaggatgaggatatttcgcaagccatcgcggatattctgaccagggatggcattaaggtccttttgagccataagatcgtgtccgtgaccacggatagcgccgagattaccgtgcggactgatcagggcgacgtccgcggcagccatgtcctggtcgccgtcggacgccagccgaataccgacgatcttggcctcgaccaagctggcgtcgagactgatcggcgtggttacatcacggtggatgaacgacttcagacaaatgtcgaaggcatctgggcgctcggcgactgcaatgggcgaggggccttcacccacacatcttacaatgatttcgagatcgccgccgcgaacctcctcgatggcggcgaccgcaaagtgtcagaccgcatcctcggctatggcctttacatcgatccgccactcgggcgtgttggcatgacagagcgccaggcgaaggaggcaggccaccggatcaaggtcgcgacccggcctatgaaccgcgtcggtcgagccgtcgagaagggtgagacgctcggcctcatgaagctcgtcaccgaggctgataccgatcgagtgctcggtgccgcctttctcggcgtcgggggtgacgaggcggtttacggcgttctcgacgccatgaacctcggggcaaccactgaaaaactcagatgggcagtgccgatccacccgaccgtcggagaactggtgccgacactgatcagcgacctcaag

SEQ ID NO: 38017 - DNA, 2440 bp, Agrobacterium tumefaciens
atgagcctgacgcgcaagccgctggcgagccaccaccggatcgtcatcaagatcggttcggcgcttctggtggaccggaaaagcggcctgaagaaagactggctggatgccatctgcgaggatatcgcggcgctgaaaaaaaacggcgcggatgtccaggtcgtgtcttctggcgccattgcgcttggccgcaccgtgctcggcctgccttccggtgcactgaagctggaagaaagccaggcggcggcggcagtcggccagattgcgctggcgcgggcatggtcggaaagcctgtcgcggcatgagatcgtcgccggtcaaattctattgacgctatccgataccgaggagcgtcggcgttatctcaacgcgcgtgccaccatcaatcagcttttgaagatcggcgccattccgatcatcaatgaaaacgacacggtggcgaccactgaaatccgttatggggacaatgaccgtctggccgcgcgcgtggccacgatgacgggtgccgatctcctggtgctgttgtcggatattgacgggctctacaccgccccaccgcatctcgatcccgatgcgaaatttcttgagacgattgccgatatcacgcccgaaatcgaagccatggcgggtggggcggcctccgagctttcgcgcggcggtatgcgcaccaagatcgatgcgggcaagatcgcgaccgctgccggttgtggtatgatcatcgcttccggcaagacgctcaatccgctgaaggcaatcgaaaacggcgcacggtcttcatggtttgcaccctccggcacgccggtgacggcccgcaagacctggattgccgggcaattgcagccggccggcgaaatccatgtggatgccggggccgaaaaggcgctttatgctgggaaaagcctgcttcccgccggtgtgcggcaggtgaagggcaatttcggacgcggcgatgccattgccatcatcggcgtcgaaggccgtgaagtggcgcgcggtcttgcgggttacgatgcacaggaagcgcgcctgatcatcggccacaagtccaacgagatcgagacgatcctcggttatgtcggacgggcggcgatgatccatcgcgacgaccttgtgatgactggcgctgccgtcaaagtgaaacatgcaaagaaggatgaggtccatgcctgaacaggccgtgaagcagagccatgatatcgatgcgctgatgatgaccatcggcgctcaggcgaaagctgcttcgcgaccgttgtccatcgccggcacggaccagaagaaccgtgcgctgcttgccatggcatctgccattgaggcttcgaaggaggcgatccttgccgccaaccgcaaagatctggcggctgcggaaagcgccggccttgccgcttcgttcgtcgacaggctgacactcaacgatgcgcgcatcgccggcattgccgaaggcatccgctcggttgccgcgctggccgatccggtgggtgaagtcatcgccgcctgggatcgccccaacgggctgaaaatcgagcgcgtgcgcacgccgctcggcgttatcggcgtgatctacgaaagccgcccgaatgtgacggcggatgcgggcgcgctgtgcctcaaggccggcaacgccgtgatcctgcgcggcggctcggattcgcaacattcatcgcgtgctatccatgcctgtctcgtgcagggcctgaggatcgccggtcttccggagaatgccattcaactcgtgccggtaaccgaccgcgcggctgtcggcgctcttctcagcgggcttaaaggtacggtcgatgtcatcgtgccgcgcggcggcaaaagcctggtggcgcgggtgcagtctgaagcccgtgtgccggtcttcgcgcatctggaaggcatctgccatatctatgtcgacaaatccgctgatctcgacatggcaaaagccatcgtcgtgaatgcgaagatgcgccgcaccggcatttgcggggcggccgaaaccctgctggtggatgcgtctgccgtctccagtcatctcgagccagtcgtcaaagccctgcttgacgcgggttgcgaagtacgtggttcgcagccggttcgtaatgtggttgaggggctggaggccgctacggaagaggactggcgcaccgaatatctcgatgcgatcatttcggtcgccgtggtggatggcatttccggcgcgatcgagcatatcggcacctattcgtccaatcataccgaggcggtgatcgccgaggacccggatgtggtcgcgcggtttttcaacgaactcgattcggccattctgctgcacaatgcctcgacgcaatttgccgatggcggcgaattcggcatgggcgcggaaattggcatcgccaccggcaagatgcatgcgcggggccctgtcggcgtcgagcagctcacctcgtttaaataccgtgtgcatggcaccggccagaca

SEQ ID NO: 38018 - DNA, 588 bp, Agrobacterium tumefaciens; identical to SEQ ID NO: 35156

SEQ ID NO: 38019 - DNA, 780 bp, Agrobacterium tumefaciens
ctcaaagcccgcattattccctgcctcgacgtgaaagacggacgtgtcgtcaagggtgtgaacttcgtcgacctgatcgatgctggcgacccggtcgaggcagcaaaagcctatgacgcggcgggagcggatgaactctgcttcctcgacatcaccgcgtcctcggacaatcgcgacaccatcttcgatgtcgtctcacgcactgcggaccattgcttcatgccggtgacggtcggtggcggcgttcgtagcgtcgcggatattcgtaagctgcttctatgcggtgcggacaaggtctctatcaactccgcagctgtcaaggatcccgacttcgttgcgcaggcggccgacaagttcggcaaccaatgcatcgtcgtttccatcgacgccaagcgggtttccaaagatggcgaagctgaccgctgggaaatttttacccatggcggacgccagccaactggtatcgatgccgtggaattcgccatcaagatggttgaacggggtgccggcgaattgctcgtcacctcgatggatcgcgacggcaccaagagcggttatgatatcggcctgacgcgcagcattgccgatcaggttcgcgtgcccgtcatcgcctcgggcggcgttggtacgcttgatgatctggtggcaggtgttcgcgatggccacgcgacggcagtgcttgccgcttccatcttccacttcggcacctattcgatcggtgaagccaagagctacatggccgaacatggcattgccatgcgtctcgactgattgcaggaa

SEQ ID NO: 38020 - DNA, 627 bp, Agrobacterium tumefaciens
  unsure (1)..(627): unsure at all n locations
atggcagttgtgattgacgggaaggcgaaggcggcttcggtaacggaggcggtccgcaaatcggcagaagcgctcgaggcggagaagggcgtgaagcccggcctcgcggttgtcatcgtcggaaatgatccggccagccacgcttacgtgaactccaagagcaagatggcgaagcaatgcggtttcaactccatccagcacacgctgccggaagaaacgacgcaggcggcactcttgaagctggtcggcgaactgaacaccgatgcgtccatccacggcattctggtacaactgcccctgccgaaacatttcaattcggatgagatcatccagtcgatcctgcccgagaaggatgtcgatggcctcagcgtcctgaatgccggcaagctcgctaccggcgatctcgccaccggtctcatttcctgcacgccagctggcgccatgctgcttgtgcgtggcattcacggtgatgacctttccggcctcaacgccgttgtcatcggccgctcgaacctgttcggcaagcccatgggccagctcctgctgaacgccaacgccacggtgaccatggcgcattcgcgcaccanagatcttgtcaccgtctgcaagacggncgatattctcgtg

SEQ ID NO: 38021 - DNA, 1152 bp, Agrobacterium tumefaciens; identical to SEQ ID NO: 35464

SEQ ID NO: 38022 - DNA, 690 bp, Agrobacterium tumefaciens
aaacattttctcgacctgtcggccgttggcccgcaggacctgcggacaattcttgacgatgcgcgcgcgcgcaaggtcgccacgaaggcgggaacggcggaaaagccgctggccggcaagatgctggccatgatcttcgaaaagccgtccacccgcacccgcgtttccttcgatgtgggcatgcgccagctcggcggcgagacccttttcctgtcgggcactgaaatgcagctcggtcgtgcggaaacgatcggcgataccgccaaggtgctgtcgcgttatgtggatgccatcatgatccgtaccacggatcattcgcgcctgctcgagcttgccgaacacgcgacggtgcctgttatcaacggcctgaccgatgatacccatccctgccagatcatggccgacatcatgacgttcgaggaacatcgtggtccggtcaaaggcaagaccattgcctggacgggcgacggcaacaacgtgctgcactctttcgtcgagggctccgcacgtttcggttaccgcatgacgatggcggtgccgatgggttccgaaccgcatgacaagttcatgaactgggcccgcaacaatggcggcgagatcgcgctgtatcatgatgcggacaaggcggtcgcgggtgcggattgtgtcgtcaccgatacctgggtgtccatgaaccaggagcacaaggcg

SEQ ID NO: 38023 - DNA, 1065 bp, Agrobacterium tumefaciens
gtccatgtgccgctcggcgagcgcgcctatgacattctgatcgggccgggactgatcggcagggcgggcggcgaaatctcggcgcggctgaagggcagacgcgcggcgatcatcaccgacgagcatgtcgcgccgctttacctcgaaggcctgatggacggtttgcagacggatggcattgaggccgtttctctgacgctgccggccggagagaagaccaagagcttcgagcatctcgtcaccgtctgcgatgcggttctctccgcacgggtggagcgcaacgatgcggtgatcgcactcggcggtggcgtcatcggcgatctcgccggtttcgccgcaggcatcgtgcgccgcggcgtgcgcttcgtgcagataccgacctcgcttctgtcccaggtcgactcctccgtcggcggcaagaccggcatcaacacccgccacggcaagaaccttgtcggcgttttccatcagcctgatctggtgttggcggatacggcggtgctcgatacgctgagcccgcgggaattccgcgccggttatgctgaagtggtcaaatacggtttgatcgacaagccggatttcttcttctggctggaaaagaactgggatgacatccgcactggcggcccggcccgcatcgaggcgatcgccacgagctgccaggccaaggccgatgtggtggtggccgacgagaaggaaaacggcgtgcgcgcccttctgaacctcggccacaccttcggtcacgcgctggaggcggcgacgaattacgacagcaagcggctggtgcacggcgaaggtgtcgccatcggcatggtgctggcgcaccagttctccgcccgcctcaacctcgccagccccgatgatgccgcgcgtgtcgaggcgcatctgaaggccgtcggtctgccgaccacgatgaaggatattcccggcgaattgccgccggtcgaaaccttgatggcggcgattgcgcaggacaagaaggtcaagggtggcaagctcaccttcatccttacccacggcatcggccagtccttcgtggccgacgatgtggcgtcgtcggaggtg

SEQ ID NO: 38024 - DNA, 702 bp, Agrobacterium tumefaciens
atgatcgaggctgcctatcagcatcacggcctgacctggcgttatatcaatctggaggtcagccccgaaaacctgaaggatgccgtggcgggtgcacgtgcgatgggctgggccgggttcaactgctccattccccacaaggtcgcggtcatccagcatctcgacggcctgggggaatccgccgagatcatcggcgccgtcaacaccatcgtccggcggggcgacaggctgatcggcgaaaacaccgatggcaagggtttcgtcaaggcgcttcgcgacgtcatcgacccgaaggacaagaaggtcgtgctgttcggcgccggcggcgcggcgcgcgcggtgtgtgtcgaggtggcactcgccggtgccgcgcatatcaccgtggtcaaccgcaaccgggaacgtggtgaaaccgtggcgcggctgattgacgaaaagacgccggccaccgccaccttcgccgcatgggaagacgccttcgccattcccgaagagacggatatcgtcattcacgccacctcggtaggcctttatcctgatatagacggcttgcccgacatcgatctgaagacgctgcgtccctccatggtcgttccgcatgtgatccatcatctgacgtgaaccgggctgataccgtgtgctagagacgatcaatcagcaaccatggctgatggtcacagcatgctggtcaatcattgtgtc

SEQ ID NO: 38025 - DNA, 792 bp, Agrobacterium tumefaciens; identical to SEQ ID NO: 35176

SEQ ID NO: 38026 - DNA, 1290 bp, Agrobacterium tumefaciens; identical to SEQ ID NO: 35369

SEQ ID NO: 38027 - DNA, 1397 bp, Agrobacterium tumefaciens
acaaaattcaagacattcgcattgaccagccaggcactcggctgaatcgggagagacccatgttaagcaattcactgatcgaactggaccgcgcccatctggtgcaccctgtctcctccttccgcggccatgaaaagctcggcgtgcgggtgctgaaatctgcaagcggcgccaccgtcaccgatatgaccggccatcagctgatcgatggttttgccggcctctggtgcgtcaatgccggttacgggcacgacagcatcgttgaagcggcggcaaagcagatgcgtgaattgccctatgccaccgcttatttctacattggcatcgacccgacgatccggctggcctcggaacttgccgaccgcgcgccgggtgatctcaaccacgtctatttcacgcttggcggttccgatgccgtggacagcaccatccggttcatccggtattactggcatgcgaaaggccagccgcagcgcgaccagttcatttccatcgaacaggggtatcacggctccaccaccgccggctccggcctcactgcgctacccgctttccacgcgggtttcggcgtgccctatgactggcagcacaaaattccgtcgcattatgcctatcgcaatcccgccggcagcgatccggccgccatcatcgcatcctccctgcaaattctgaaggacaagatcgaggccatcggcccggaccgcgtggccgccttttatgccgaacccatccagggatcgggcggcgttctggtgccaccgccgggctggatcaaggccatgcgcgagctctgcagttcctatggcattctcttcgtcgccgatgaagtcatcaccggcttcggccgcacgggaccgctctttgcctgcgccgacgaggacatcgtgcctgatttcatcacggccgcaaaaggcctcacgtcaggttatgtgccgatgggcgccgtcttcatggccgaccatgtttatgatacaatagccgacttcgcgggcgaggccgccatcgggcacggatatacctattccgcccaccccgtcagcgccgctgtcggtctggaagtgctgaaactttatgaaggcggactgctggagaacggccgtcgcgccggtcaacggctgatggccggccttgaaggattgagaaaccacccgctggtgggtgatgtgcgcggccggggcatgctcgccgccattgaactcgtgaccgacaaggacaagaaaacgcccttgccggccgcagccgccctcgcgcgaaaaggtttcgaccgcgcctgggaaaacggcctcatcgtacgcgccttcgcgaacggcatcctgggttatgcgccgccgctctgctgcaccgatggcgaaatcgacgccatcgtcgagcggacgctgaaaacgctcgatcagacg

SEQ ID NO: 38028 - DNA, 906 bp, Agrobacterium tumefaciens
cttgcggcgattaccgtgccgttccttgcctatctcggtgctggcgatcatgcgctgatcgttgattccgtctatttccccacccgccgtttctgcaacaccatgctgaagaagctgggcgtggaggtggagtattacgatcccgcgatcggggctggcatcgaggcgcttatccgaccaaatacgaagctcgtgcatctggaagcgccgggttccaacaccttcgagattcaggatgtccggctgatcactgacatcgctcaccggcatgattgcgtggtgaccatggacaatacctgggcgacgccgctttatttcaagccgctcgatttcggcgtcgatgtctccattcacgccgccaccaaatatccctcgggccattccgacgtgctgatgggcttcgtttcggccaatgaaaagtactggaaagcgctttatcaggccaacaccaatctcggcatctgcgtcacccccgacgatgcctatcagatcctgcgcggcatgcgcaccatggggatcaggctggaacaccatcagaagagcgcgctggatatcgcgcaatggctcgagggtcgcgacgacgttgtgcgcgtgctgcatccggccttgccgagctttgccgggcatgaactctggaagcgtgatttcaagggcgcgagcggtgtcttctccttcgtattgaaggcggaagagggcaaatacaaacagacggcatctgccttccttgatgcgctgacgttcttcgggctcggctattcctggggcggctacgaatcgcttgccgtatcggtatcgctcgtcgacagaacgattgcgaagggcccgtcggaaggaccggtcatccgtctgcagatcgggctcgaggatgtcgccgatctcaagaaagacctcgaggccggtttttca

SEQ ID NO: 38029 - DNA, 1707 bp, Agrobacterium tumefaciens; identical to SEQ ID NO: 35317

SEQ ID NO: 38030 - DNA, 735 bp, Agrobacterium tumefaciens; identical to SEQ ID NO: 35412

SEQ ID NO: 38031 - DNA, 927 bp, Agrobacterium tumefaciens; identical to SEQ ID NO: 35413

SEQ ID NO: 38032 - DNA, 1038 bp, Agrobacterium tumefaciens; identical to SEQ ID NO: 35414

SEQ ID NO: 38033 - DNA, 612 bp, Agrobacterium tumefaciens; identical to SEQ ID NO: 35227

SEQ ID NO: 38034 - DNA, 1005 bp, Agrobacterium tumefaciens; identical to SEQ ID NO: 35371

SEQ ID NO: 38035 - DNA, 552 bp, Agrobacterium tumefaciens
cagaaagtcgcaatgctgaccgcgggtggcctcgcgccctgtctctcttcggccgtgggtggcctgatcgagcgctatagcgacatcgcgcctgaaatcgacatcatcgcttaccgctccggttatcagggcgtgcttctgggcgagcgtatcgagatcaccaaggatatgcgcgaaaaggcgcatctactgcatcgttacggcggctcgccgatcggcaacagccgcgtcaagctgaccaatgccgccgattgcgccaagcgcggcctcgtcaaggaaggcgacaatccgttgcgcgtcgccgctgaacggctggcggctgacggcatcaccattctccatactatcggtggcgacgacaccaacaccaccgccgcggaccttgccgcctatctcggcgccaacggatatgacctcaccgtcgtcggcctgccgaagacggtggataatgacgtcgtgccgatcaagcagtcgctcggcgcctggacggccgcggaagtcggtgctgccttcttcgacaatgtcagcaacgagcagagcgcggcaccgaaa

SEQ ID NO: 38036 - DNA, 1734 bp, Agrobacterium tumefaciens
atgaaaaaagtgctgattgccaatcgcggcgagatcgcggtgcgcatcatccgggcctgtcgcgattacggcctgcaatcggtcgccgtttatgccgaccccgatcaggacgcgcttttcgtccggctggcggatgaagcctatgcgctggagggcgtgcgtcccgccgagacctatctcgatatcagcaagctgatcgcgattgccaaacgcgccggtgctgatgccgtgcatcccggttatggtttcctgtccgaacgcgccgaatttgcccaggctgtcatcgatgccggactgatctggatcggtcccgaccctgatgtcatcgaggcattgggcgacaaggtcatggcgcggcgcatcgccaccggtgttggcgcaccgctggttgccggcagcgatggccccgtttcttccgccgccgaagtcaccgcctttgccgaacagcacggcctgcccgtcgccatcaaggcggcccatggcggcggtggacgcggcctgaaagtcgcgtggaagatggaagagatcgcagagctctatgaatccgccgtgcgcgaggcgaccgtcgccttcggccgcggcgagtgttttctggaacgtttcctcgatcggccgcgtcatatcgaggcgcaggttattgctgacaagcacggcaatgtgctggtgctcggcacccgcgattgctcgctgcaacgccggaaccagaagctgatcgaagaagcacccgcccccttcctgtcggatgaacaacggcagaagatccatgatgcccgccaaggcgatctgcgctgcagccggttattccggcgccggccaccgtcgaattcctgctcggagtcgatggcacgatttccttccttgaggtcaataccccgcctgcaggtggaacatcccgttaccgaggaaaccaccggcattgatctcgtcatcgagcagtttcgtattgccgaaggccataagcttcgtgtgcttgaaacgccggaaccgcgtggccattcgatggagttccgtatcaatgccgaagatccgggccgcggctttctgccgacaccaggcttgatctcggttttcgatgcgccttccggtccgggcattcgcatggatagcggcgtcatcagcggctcaagcattcccggcgtgttcgattcgctgatggcaaagctcatcgtcaccggggttgaccgcgatcaggttctgcgccgtgcccgccgtgcgctgagggaattccgcatcgagggcatcgctaccgttctgccgttccaccgcgccgcgatcgagacggaggatttcatcggtactgacgggttcaaggttcacacccgctggatcgaaaccgatttcgccgccatgcccgatgcgatggagcgaccggcaccggccgacgacccttctatcacccgcacctatctcgagatagacggcaagcgtgtttcggttggcctgcccagcattctgctctccagcctcggcactgtcagcggtggcaatgcatccgctcccagtgctgcggtcgagaaaaaggaaggcgaaatgaccgcccccgtttccggcaccctgcaatctttcaaggtgaaggacggtgaaacggtttccgaaggtgatcttctggccgtcatggaagccatgaagatggagacgcagattgtcgccaccagggccggaaaggtccgcttgatcgtcaaggaaggcgattatctgcaggcgggagcaacccttatcgatatagccggctaa

SEQ ID NO: 38037 - DNA, 1182 bp, Agrobacterium tumefaciens
atgagcaataaatggcgcccggcaacccagctcgttcacggcggtacgctacgctcaccctatggtgaaacgtcggaagcgatctatctgacccagggtttcgtttacgaaaactccgaagccgccgaagcccgcttcaagggcgaaacggatggcttcatctacgcccgctacgccagcccgaccaatgacatgttcgaaaagcgcatgtgcctgctggaaggcgcggaagacgcgcgcgcgcttgcctccggcatggccgccgtcaccgccgccatcatgtgccagctgcgcgccggcgatcacatcgttgccgcacgagcccttttcggctcctgccgctgggtggtggaaacgctcgcaccgaaatacggcatcgaatgcacgctgatcgacggacgtgatctcgacaattgggaaaaggcgatccagccgaacaccaagctgttcttccttgaaagcccgaccaacccgacgctcgaagtggttgatattgccggtgtggcgaagctcgccaaccagatcggcgcgaaagtggtggtcgataacgtctttgcgacgccgcttttccagaagccgctcgaactcggcgcccatatcgtggtttattcggccaccaaacatattgacggccagggccgctgcctgggtggcgtgatcctctccgacaagaagtggatcgaagaagagctgcaggactatttccgccatacgggcccggccatgtcgccgttcaacgcctggacgcttctgaagggcatcgagaccctgccgcttcgcgtcaagcagcagacggagaatgccgcgaagatcgccgatttcctcgccgatagcggcaaggtcgccaaggtcatctatcccggccgcgccgatcatccgcaggcggatatcatcgcacggcagatgtccggaggctccactttggtggccttcgaactgaagggcggcaaggacgcagccttcaagttgcagaacgcgcttgagatcgtgaagatttccaacaatctcggcgatgccaagagcctcatcacccatcccggtacgacgacacacaagaacctctccgacgaggcgcgtgccgaactcggcatttccggaggcaccctgcgcctttcctgcggcatcgaggataccgacgatctgctggaagatctcgcaaagggtcttgcggccgtttccgcc

SEQ ID NO: 38038 - DNA, 957 bp, Agrobacterium tumefaciens
cgcatgcggcgcaatcgcaaggcggattggacgcgccgtctggttcaggaaaatcgcctgaccgttgatgacctcatctggccggttttcatcgtgcctggcagcaatattgtcgagcccattccggctatgcccggtgtcaaccgcatgagcgtcgaccggctggtggaagcggcgaaggaagccgccgatctcggcattcccgcaatcgccacctttcccaatatcgagatggagctgcgcgacgagaccggctcgaatgcgctcgaagccaacaatctcatcaatcaggcgacgatcgccgttaaaaaagccgttccaaatatcggcatgatcaccgatgtcgcgctcgatcccttcaccagccatgggcatgacggcattctgcggggcgacgagatcgtcaatgacgaaaccgtcgagcaggtcgtcacggccgccatcctgcaggcggaagccggttcggacattatctccccctcggagatgatggatggccgtatcggcgccatccgtcgcggtctcgatgccgccgggcaccagaatgtcggcatcatggcctatgcgacgaaattctcctccggctattatggtccctatcgcgaggcgatctccaccgccggcctgctgaagggcgacaaaaacagctattacatcagccccgccaacggcatggaagcgatccgcgatgcggcgcttgacgtcgaggaaggcgccgacatgctgatggtcaagcccggcctgccctatctcgacatctgctggcggctgaaggagaatttcggcctgcccaccttcgcctatcaggtgtccggcgaatatacccagatcaaggccgcggccatgaatggctggatcgacggcgagcgcgtgatgatggaaacgcttctctgtttcaagcgtgcgggttgcgacggtattctcacctatttcgccatcgaggcagcacgcaaactg

SEQ ID NO: 38039 - DNA, 750 bp, Agrobacterium tumefaciens; identical to SEQ ID NO: 35363

SEQ ID NO: 38040 - DNA, 1308 bp, Agrobacterium tumefaciens; identical to SEQ ID NO: 35146

SEQ ID NO: 38041 - DNA, 2145 bp, Agrobacterium tumefaciens
gagacggacgcagacggcattgccctcgtcacctgggacatgccggaaaaatccatgaacgtcttcacggcagaggttcttgaggaactgaacgccattgtcgatgccaccgttgccgatggcgcggttaagggtgtcgtcttcacttcgggcaaaagcagcttttccggcggtgccgatctgtcgatgctgaagtccatgttcgccctttataatgacgaaaaggcgaaaagccccgacgctgccgcggcgaagctgttcgaactcgtcggtcgcatgacgggcctgttccgcaagatcgagaccaatggcaagccgtgggtctcggccatcaacggcacctgcatgggtggcgcatttgagctttcgcttgcctgccatggccgcgtggcctccagtgccaagagcctcaagatcgcactgccggaagtcaaggtcggcatcttccccggtgccggcggtacccaacgcgtatcgcgcctgaccgacgcgcaatcggcgttgcagatgatgacgacagggcaatccctgaccggcgcgcgcgccaaggccatggggctggtgcaccaggtggtcgagccggatcaactggtcgcaaccgcaaagcagatgatcaaggacggcctgaagccggtggcaccctgggatgagaagggcttcaaggcccccggcggcggcatctggacgccggccgcagcccagctctggcctgccgctcccgccatcctgcgccgcgaaagcgccggcaactacccggctgcacttgccatcctgaaatgtgtttatgaaggcctgcaattgcccttcgacacggcgttgaaggtggagcagcgttatttcaccgaaatccttcgctcgaaggaagccttcggcatgatccgctcgctgttcatttccatgcaggaactgaacaagggtgcgcgccgcccggcaggccagccgaagacggagttcaagaaggtcggcgtcgtcggcgcgggcttcatgggcgctgccgtggcttacgtcaccgccgcagccggcattcccgtgacgctggtggatcgtgaccaggacgcggccgacaagggcaagggccattgcgaggagagtgtgaaggccgccatcggcaagggcaggctgacgcaggaagagggtaaggccctgctcgacctcgttaccccgacatccgattacgccacactcgccgatgccgatctcgtcatcgaagccgtcttcgaggatcgtgacgtgaagaaggccgtcatcgaggccgtggaagccgtgttgcccgaaggtgcgatctttgcctccaacacctccactttgccaatgacgggcctggcgaagaactcgaagcgcccggcggatttcatcggcatccatttcttctcgccggtcgagaagatgatgctgacggaagtgatcctcggcaaggaaaccggtgacaaggcgctggccgtcgcgctggattacgtggcgaagatcaggaaaacgccgatcgtggtcaacgatacgcgcggtttcttcgtcaatcgctgcgtgctgcgctatatggcggaaagctacgacatgctgatcgaaggcgtgcccgccgccatgatcgaaaatgccgcgaaatttgccggcatgccggtcggtccactggcgctgaatgacgaggtggcgatcgatctttcctacaagatcctgaaagccactgtcgccgatctcggcgaaaaggccgtcgatccgcgtcatatggaactggtgaagaagctggtggaaggcgacggccgctttggccgcaagaacgccaagggcttttacgactacccgccaaagcccgccaagaaatccctctggcccggcctgaaggacctctatccgcagcagaagcctgaagacgtggatatggatgtgctgaaacagcgcttcctcgtcaccgtggcgctcgaagccgcccgcacggtggaagaaggcatcgtcaccgatccgcgtgaggcggatgtcggctccatcctcggtttcggcttcgcgccctataccggcggtgcgctgtcctacatcgacggcatgggcgtgaagaatttcgtcgctctggccgagaagctcagcgaagcctatggcccgcgcttccagccgacgccgctcctgaaggacatggcggccaagggcgagaccttc

SEQ ID NO: 38042 - DNA, 1207 bp, Agrobacterium tumefaciens
accgacgtttacatttacgaccatgtccgcactccgcgcggacgcggcaagaaggatggcagcctgcatgaggtgccttccgttcgcctggccgccaaaacgctggaagccatccgcgatcgtaacgggctcgacacctctgctgtcgatgacatcatcatgggctgcgtcgatcccgtcatggatgccggtgcggtgatcccgaaggctgccgccttcgaggccggttactccaacagggccccgggcatgcagatctcgcgcttctgcgcctcgggtctcgacgccatcaatttcgcggccggcaaggtcaaggcgggctcggacgatatcgtcattgccggtggcgtggaaagcatgtcgcgcgtcggcatgggcatgtcgggcggcgcttggtacatggatccctcggtgaacttccccgcccttcttcatgccgcagggcgtttaggctgatctcatcgccaccaaatatggtttctcgcgtgacgacgtcgacgcctatgctgtcgaaagccagaagcgtgcggcgcatgcctgggaaaacggctatttcaacaagtccgtgattccggtgaaggaccagaacgggctgacgatcctcgaccgcgacgagcatatgcgccccggcacggacatgcaggcgttggcttcgctcaacccttccttccagatgccgggcgaaatgggcggtttcgaagccgttggcatcatggcgcatccggaagtggagcgtatcaactacgtgcaccatgcgggcaactcgtccggcatcgtcgatggcgctgccgccgtgctggtcggctccaaggcgggcggcgaggcgatgggcgtgaaaccgcgtgcccgcatcaaggctttcgccaatatcggctccgacccggcgctgatgctgaccggcccggtggatgtgaccgagaagcttctgaaaaagaccggcatgtcgattgccgatatcgatcttttcgaactcaacgaagccttcgccgccgtggtcctgcgttacatgcaggctttcgacatcagccacgaccggatgaacgtcaatggcggcgccatcgccatgggccatccgctgggtgccaccggggcgatgatcctcggcacggtactggatgagctggagcggcgcgatctgaacaccgcgctcgtcacgctctgcatcggcgcgggcatgggcacggcgacggttatcgagcgcgtttga

SEQ ID NO: 38043 - DNA, 1536 bp, Agrobacterium tumefaciens
caaaatctcgtcgctgtcgatgtcggtacggcgagcgcccgggccgggattttcgatccagccggccggctgctcgcgcgctccattcatcccatcctcatgcagcggccgcgtgaaaaccacgccgagcacgattccaccgatatatggaatgccgtctgcattgccgtgaaggcggcgcttgccgatgccggcgtgctgccgcaaagcattgccgccattggttttgacgccacctgctcgctggtcatccgcgatgagcggggggagccggtttcggtttccacgaccgatgacgaccgtttcgacaccatcgtctggcttgaccaccgcgccatcggcgaggccgaccggctgacggcctcgggccatcgggtgctcgatttcgccggcaacagcgtctcgccggaaatgcagatgccgaagctgatgtggctgaagacgcatatgccgcaaagctggtcgcgcatgtccttcgccttcgatctcgcggatttcctgacctggaaggcgaccggctcggcacagcgctccaattgcacgcagacggcgaaatggaacttcctggcgcaggaacatcccggctggcaggcggattatctggcctttgccggactggacgacctgaaggagcgggcaggcctgcctgaaactaccgtcatgccgggcggcgccatcggcccgctttcgcccgaggccgccgcagaacttggtctcgataccggctgccaggtggcggcgggcatgatcgatgcctatgccggtgcgctcggggctctgggtggatgccttgccgaggatgtcggtaaacatgtcgcgctgatcgccggcacgtcgagttgccttgtcgccatgtccacgcagccgatgcccggccgcagcctgtggggaccctactggcaggcggtgctgcctggccactggctggtggagggtgggcaatcggctaccggcgcgctgctcgaccatatcgtgcgcatgcatgcggcgggtggcgagccggatacggcgttgcatgcccgcatcgttgcgcgcgtcactgaattgcgcgaactggagggggaggcctttgcggaccggctgcatgttctgcctgacttccacggcaaccgttcgccgcttgccgatccgcatgcggtcggcgtcgtcagcgggctgacgctcgatacctccttcgacagtctctgccgtctttattggcgcaccgcgatcgcgatcgcgctcggcgcgcgccacgtgctcgatgccatggagcgtttcggttatgcggtggaaacgctgcatgttaccggcgggcatgtgaagaacccgctgttgatggagctttacgccgatgtgacgggcaagcgcatcgtggttcccgcgaccgccgatgcggtgctgctcggcacggcgatgacggcggcgacggccgggggcgtgcatgcgagcctggcggcggcaggggccgccatgtatccgggcaatgcggaaatctcgggcaatccggcgctggcggcgcattacgagcgggattatcgccgtttcctcgccatg

SEQ ID NO: 38044 - DNA, 729 bp, Agrobacterium tumefaciens
tcgatgagtgaactagcaggtaaacgtgcgctcgtgactggtgcgtcccgcggcattggagccgcgattgcgatcgctctggccgagaaaggcgccgacgttgcgatcacgtacgaacgcgccgctgatcgggcagcgcaagttgtcgcaacgatagaaggcaaaggacgcaaggccttggctatccaggctgatagcatggacccagaggcggtcaagcggtcggttgatcaagcggcgcaagcgttgggcggcctcgacatattggtgaacaatgcggctatcgcgatctacaaggacgtggcggatttcaccgtcgccgagatcgacgcgctttttgctgtcaacgctcgttccccaatcttggcatcacaagccgcgatgccttatcttggcaaaggtggtcggatcgtcacaatcggctccgcaggcgcggaacgcattgtcgggccatcgacggtttattcaatgaccaaatcggcacttcaatcatttacccgcggtctggcgcgagaacttggcccccgtgacatcactgtcaacctcattcagccgggatcaaccaacaccgaaatgaatccggccgagggcgagttcggagatttccagcgtgccctaataccgctcggccggtacggcgagccggaggatgtcgcggcagcggtagcgttcctcgcatctggcgcggcccgacaaatcaccggaaccatcctgaccgttgatggcggc

SEQ ID NO: 38045 - DNA, 867 bp, Agrobacterium tumefaciens
ttgaaattcgaaggtatatataccccggcgattacaccgctcggtcatgacggagagatcgaccgcgacgccttcgcagctgtcctcgagtcgctcatggaagcacgggtgcacggcatcatcatcggtgggtcgacgggcgaatattacgcgcagacggcccaggagcgcttcgatctggcagcctacgccagacaagtgatcggtacgcggctgccgctcgtcgtcggaaccggcgccacccgtaccgaagattccattgaatatgccaaggcggccaaggaaatcggcgctgacgccattctcgtttcctctccgccctacgcgctgccgaccgagcgtgaaaacgccgtccacgcgcttgcggttgatcgcgcggcgaaccttccgatcatgctgtacaactaccctgctcgcatgggtgtggtgatgggggaggaatatttctcccgcgtcggcaaatcgaagaatgtcgtcgccatcaaggaaagctctggcgacatgggcaatctgcatctcctcgcccgcaagttcccgcagattgcgctgtcctgcggctgggacgaccaggcgttggaattcttcgcctggggcgcgaaaagctgggtctgcgcgggctcgaatttcctgccgcgcgagcatgtggcactctacgaagcctgcgtcgtcgaaaagaacttcgacaagggacgcgcgatcatgaccgcaatgctgccgctgatggattttctcgaatgcggaaaattcgtccaatccatcaagcatggatgcgaaatcatcgggcttcgggccggatctgtccgggctccgcttcgccccctcaattccgatgaaaaacgaactctccagactgtcgttaccacgttg

SEQ ID NO: 38046 - DNA, 1464 bp, Agrobacterium tumefaciens
gccgaatacaaggcgattgcctcagaccttcagttcccggccaatgccttcattgacggggctttccggcccgccggttccggcaagaccttcaagacgatcaatcccgccaccggcgaaacgctcgccgatatttcggcctgcgacgtgagtgacgtggactatgcggtcggcaaagccagggcggcattcgacgacggccgctggcgcctgctgccacctggcgaacgcaaggccattttgctcacattcgcaaaactactggagcagcatcgccacgaactagccgtcatggaaagcctggacagcggcaagccggtttccgaatgccagaccgtcgacattcctgacacgatccacaccatccgctggcatgcggagctcatcgacaagctgtatgacaataccgcaccggtgggatcgaacgcccttgcactcgtggtgcgcgagccggttggcgtcctccgctgcgtgctgccgaggaactttcctttgctgatgctggcctggaagatcggcccggcgctcgcctccggatgttcggtgatcgtcaaaccggccgaggagacaacgctgacgaccctgcgcgtcgccgaactggcgcatgaagccgggattccggctggcgtcttcaacgtcgttccgggcggcggcaaggaggtcggcgagccgatcggcatgcatatggatgtcgatatggtagcgtttaccggatcgacgccaacgggacggcggttcctgcgatatgcggccgactccaacctcaagcgcatcgtccttgaatgcggcggcaaaaatccggcggtggtgctggatgatgcggaagacctcgacctcgtcgccgagcaggtggtcaacggcgcattctggaacatgggcgaaaactgctcggcctcgtccaggctcatcgtccatgcaaaaatcaagtcaatgctgctgcagcggatcggcgcctatatgcgggaatggaggatgggcgatcctctcgatccgcaaaaccgcgtcggcgcgctcgtcagcaaagcccatttcgataaggtccactccttcctcgaggacgtgaaggcagaaaatcttaccatcgttcacggtggcaagaccgagaagggaatcttcatcgaacccacggtcgtcgatgccgtgccccctgcaagccgtcttttccgggaagagattttcggcccgatcctgtcggtgacgaccttcaacacgctggcagaggcggtagctcttgccaacgacacgaattacggccttgccgcatccgtctacaccggaagccttcgcaaggcgatcaagctctcgcgcgaaatccgggcgggtgtcgtcacggtcaattgcttcggcgaaggcgacgcaacgacgccgtttggcggctacaaggaatccggtttcggcggacgcgacaaatcgatcttcgcgcacgataattattgcgaactcaaaacgatctggatcgacgtc

SEQ ID NO: 38047 - DNA, 860 bp, Agrobacterium tumefaciens
gattccaacgaagtgttggtcgactgccagaacgtctggaagatttttggcgcgcgcgcttcgaccgccgtgaaggcggtggccagaggtggattgtcaaagaagcaggtgctggaggatttcgactgcgtcgtcggcgtatgcgacgccagccttcaggttcatcgtggcgaaatcttctgcatcatggggctttccggcagcggcaaatcgaccttgatccgtcttctcaatcgcctcatcgagccgagcctcggaaaaatcacggtgaagggcaaggatatcgccaggctgaatgctgccgaattgcgcgaattgcgcgcccgccccatcgccatggtgtttcagagcgtagcgctgctgccttaccgcactgtgctcgaaaactgccggtttcagtctcgaggttcgaggcgtagcgaaagacgagcgcaaccgtatagcacgcgccgcgcttgaaaaggtgggccttgccgactcgcccgccccggtatccccacgaattgtcaggaggcatgcagcagcgcgtcggacttgcccgcgccctggctgccgacccggaaatcattctcatggacgagccgttcagcgcgctcgaccctcttatccgtcggcagctccaggacgaatttcggcaattgaagaagtcgctcgtcaagtccgctgtcttcatcacccatgacctcgaggaagcaatccgcatcggcgaccgcatcgccatcatgaaggacggcgttatcgtgcaggtgggaaccgcccaggagatcgttacgaaacccgcagatgattacgtctccgatttcgtagcgggcatctccagaattcatctggtgaaggcgcatacggtcatgcagccggtt

SEQ ID NO: 38048 - DNA, 672 bp, Agrobacterium tumefaciens
atttccgcagtcctgattaccggcgcctccacgggcattggcgccacctatgccgagcggttcgcccgacgcggacatgatctcgtgttggtcgcccgagacatggcgcgcatggaggcgctcgcgagtcgtctgagccaggaaaccggtgtaaggatcgatattctaccggccgatctcacccaggcgacggatcttgtaaaggtcgaaaccaggctgcgtgacgatgagcgcattggcattctcgtcaacaatgcaggaacggccatcggcggaacctttgtcgaccagagcgtcgatgacatgaccaggctcgttgcgctcaacgcgaccgcgctcgtccggcttgccggtgccattgctccgcgtcttgccaaggccggcgagggagcaatcgtcaatatcggttcggtcgttggcctcgcgcccgagttcggcatgacggtttacggcgcgaccaaggcttttgttctgttcctgtcgcaggggcttgcgcacgaactcggaccgaagggcgtctacgtccaggctgtgcttcccgcgacgacccggaccgagatatgggatcacgtcggtgccgacgtcaacaccttgaacaacgtcatggaagtaggcgatctcgtggatgcggccctggtcgggttcgaccgccgcgagccggtcaccatcccg

SEQ ID NO: 38049 - DNA, 1818 bp, Agrobacterium tumefaciens
ctgaaggaaatcgccgcccacaagaaaaccgacgccgcccttcaggacgccaaggaaacggcagaggccgccaaccgcgccaagagccgttatgtcgtcggcctcagccacgagctgcgcacgccgctcaacgccgttctggggtacgcccagatcctcgaacgtgacgagacaattcctgccccccggcaatcggccatcaaggtcatccgccgctccgccgatcacctttccggtctgatcgacgggcttctggatatctccaagatcgaggccggccgtctgcaggtctattccaacgagatcaatatcaaggacttcctcgatcaggtcgttgatatgttccgcccgcaggcgcaggcaaaggggctggaattccgccacgagcgcaccgccgctctgccgcaatatgtccgcaccgacgaaaagcggctgcgccagatcctcgtcaacctgctctccaacgccatcaagttcaccgatgagggcagcgtcaccttcgatgtcgcctatcgcagccaggtggcaagtttcaccgtctccgataccggccgcggcattgccgaaaaggatctcgcccgcatctacgaacccttccagcgcggcgaggccgaaagcgtgcggccgatgcccggcctcggcctcggcctcaccatcaccaggcttctgaccaacacgctgggcggcgaaatttccgtctccagcgaaaaggacaatggctccaccttccgcgtccgcctgatgctttccgccgtccaccggccaagcaccgcccctgcgccggaaaagaccatccgctcctattcaggcccacgccgcaccatcgtggtggtagacgacaacgaggatcaccgcgagctgatgcgacaggtgctttcaccgctcgacttcgtggtgcttaccgcccaatcaggccccgagtgcctcaccctcatcgaaggcgtgaaacccgatcttttcctcatcgatatttccatgcccggcatgaccggctggcagcttgtgacgaagctgcgcgaggctggtcagaccgcgccgcttatcatgctctcggccaatatcggtgatggggcggtcgcgggtgcgggcgacgacaaccacaatgacgccatcgccaagccggtcgatatccgtcacctgtgcgaccggcttgccgtccatcttggcctgaaatggatctacgagacggacctgccctcggcacccgttacccagccgccagcgcaggtcgttcatcccggtgcaattcacatcaaggatttgcagcggctcggcgaaataggctacatacgcggcatagaggctaaactcgccgatcttgcccgcaacacggacaacctgcccttcacgcaagagctcggcacctatgtgcaggccttcgatctggccggttaccgcccattttctcaagcggtttgaagacaacgacaggggagacggcggggcatgagcggtcaggtagcagcggctcccagagacctcgtcctgctggtggatgacagcccggacgcgctgggtttcctgaccgatgcgctggaacagtcaggcttttccgccctcatcgccacttcgggtcaggcagccctcaacattgccgaacgcatcacccccgatatcatcctgctcgacgccgtcatgcctgttatggacggtttcgagacctgccgccgcctgaaggccaatgcggcggtggcgcaggtgcccgtcatcttcatgaccgggttgaccgaaacagaacatgtggtgcgggcgctggaatccggcggggtcgactatctgaccaagccgatcaacatcgatgagttgcgcgcccgcatc

SEQ ID NO: 38050 - DNA, 1173 bp, Agrobacterium tumefaciens
gcgattgtggcaatgttgctggttgcgggcacaacctcgctcagcgcgtggatcatgcgtgacattgtcaacagcgtctatttgaaacaaggtttcgatgtcgttcttgagattgcctttgccgttgcagccatcttcatcgtcaaggggctcgctaccttcgtgcaaagctactatcttagcaaagcggggaacagcatcgttgccgaacaacaacgcaagatctacgatcggcttctgaagcagggcgtgtccttcttccagaacctgccatcttcagaactccttgtccgcgttacttacaacgctcaggctgcgcgcagcgtgatcgacacgatcgtgacatctttcgtccgcgacctattttcccttcttggcctgatcatcgtgatgtttgcccagaatttccttctgagcgcgatttccatgattatcggccctgtggcgatatttagcgttcgtctcgtgctgcggcgcgttcgaaagatcatggaggcggaacttgcttcactgggcgaaatcgtcaacgtcgtgcaggaaacgagtattggcgttcgcgttattaaggcattttcgcttgagaaactaatgcgccagcgcatgaacaaggccgtgtccgacgtcgagcatcgtgcaaacggcattgcgaagcttgaagcagcaaccagcccgatcatggagaccctgtctggcctcgccattgcagtcgtcatcgccgtttccggttataccgtgcttgaaaaaggcggatcaccgggtgacctgatggcctttatcaccgctttgcttcttgcttacgaaccagcaaagcgtctggcccgcatgcgagtccaaattgaaggcggcatgatcggcgtgcgcatgatgttcgaggttttggacgctccattgacacttgccgagaaaaaggatgcccagccgctccccaaggcaagcggcaatgtggaactcaagaacgtcagcttcgaatatgttgctaaccagcctgttctgaaggacgtcagcgtcctcttcgaaggtggtaagatgactgcgctggtcggaccttccggcagcggcaagtcgacgatcatcaacctcatgatgcgtctttatgatccgcagagcggttccgtcgagatcaacgggatggatttgcgcgacgtgtccttcgccagcctgcgcgagcatgtt

SEQ ID NO: 38051 - DNA, 757 bp, Agrobacterium tumefaciens
atgcggattgtgatgatcggttcgggttatgtcggcctcgtgtccggcgcgtgttttgcagattttggccatgatgtggtctgcgtcgacaagatgccggagaaaatcgaggctttgaaaagcggccatattccgatcttcgagccgggtctggaaaccatcgtcgccaacaacgccaaggctggccggttgagcttcacgacagatctttccgccgctgtcgccaatgccgatgtcgtcttcatcgcggtcggtacgccttcgcggcgcggggatggacatgccgatctcggttatgtctacgcggcagcgaaagagatcgcccatgctcttgatggtttcaccgtcatcgtcaccaaatccactgttcccgttggcaccggcgacgaggtggagcgcatcattcgcgaggaaaacccctcggccgattttgccgtggtttccaacccggaattcctgcgcgaaggggctgccatcgaggatttcaagcggccggaccgcattgtcgtcggcctctcggatgagcgcgcacgccctgtgatgaccgaagtttaccgcccgctttacctcaaccagtcgccgctgatcttcacctacaaggcgcgattccgaactcatcaaatatgccgccaacgcctttctggcgatgaagatcaccttcatcaacgaaatggctgacctctgcgaaaaggtcggcgccaatgtgcaggatgtttcccgcgggattggtctcgatggccgtatcggctcgaaatcc

SEQ ID NO: 38052 - DNA, 1497 bp, Agrobacterium tumefaciens
  unsure (1)..(1497): unsure at all n locations
gacgtgaaacaggaagccgcggctctgctcgacaagatgggtgttgcccgcgatctttataccggcggcgacatggcgtccttcagccccgtgacgggtgagcagatagcaagcctcaggaccgtgtcggtagagggtgtcgcagccgtggtcgacaaggctgatgcggcgttcaggacctggcgtaatgtgccggcgccgcgtcgtggcgagttgatccgcctgcttggcgaagaactgcgcgccttcaagaccgatctcggccgtctcgtctcgctggaagcgggcaagatcccgtccgaaggtctcggtgaagtgcaggagatgatcgatatctgcgatttcgctgtcggtctctcccgccagctttacggtctcaccatcgccaccgaacgtcccggccaccgcatgatggaaacctggcatccgcttggcgtcgtcggcgtcatctcggccttcaatttccccgtcgccgtctggtcgtggaatgccgcacttgccctcgtctgcggtaattcggtggtctggaagccttcggagaagaccccgcttacggcgcttgccgtgcagggcatcttcgagcgcgccgccgcccgctttggcgatgcgccggaaggtctgtcccaactgctgatcggtgaccgcgccgtgggtgaagccatggtggattaccccaaagtgccgctcgtctccgccaccggctcgacccgtatggggcgcgatgtcggtccgcgtctggccaagcgctttgcccgcgccattctggaacttggcggcaacaatgccggcatcgtctgcccgtctgccgatctcgacatggcgctgcgcgccatcgccttcggcgccatgggcaccgccggccagcgctgcacgacgcttcgccggcttttcgtacatgacagcgtttatgaggagctcgtgccgcgcctgaaaaaggcttacgcgtctgtctccgtcggcaatccgctggaaagttccgcactcgttggcccgctggtcgacaaggcgggccttgacggcatgcaaaaggcgattgaggctgccaagtcggccgncggcgttgtgcatgacggcgaccgcgtcgataccggtgcggcagatgcctattacgtgaaacctgcactcgtcgaaatgccgaagcaggttggccccgttctggaagagaccttcgcgccgatcctctatgtcatgaagtatagcgatctcgatcaggcgatcgacgcgcataatgccgtcgccgcgggtctttcctcgtccatcttcacccgtgacattcaggaatcggaacgtttcctgtcgtcggaaggctcggattgcggcattgccaacgtcaatatcggcacatcgggtgcggaaatcggcggcgcgtttggcggcgagaaggaaaccggtggcggccgtgaatccggttcggattcttggaaggcctatatgcgccgcgccaccaacaccatcaactattccaaggcgctgcctttggcgcagggcgtttccttc

SEQ ID NO: 38053 - DNA, 756 bp, Agrobacterium tumefaciens; identical to SEQ ID NO: 35093

SEQ ID NO: 38054 - DNA, 1290 bp, Agrobacterium tumefaciens; identical to SEQ ID NO: 35092

SEQ ID NO: 38055 - DNA, 1675 bp, Agrobacterium tumefaciens
gtcagcgttgccaagcgctggctggcatcctatccgcggggcgtgccttcagagattcccgcctcggcaaatgcctccctcattgaccttctcgaaaagagctgcaagcaatttgccgaccgcaaggcccttttccagcatgggaaaatccctgacctaccgggaactcgacgctgacacccgtgcggtcgccgcatggctgcaatccagaggactggaaaaaggcgaccgggttgcggtgatgatgccgaacatcctgcaaaatcccgtcgcggtttatgggattctgcgggcgggcatggtcgtggtcaatgtcaacccgctctataccccgcgcgaactggagcaccagctcaaggactccggcgcgaaagccctgttcgtgctggagaacttcgcccatgtggcgcagcaggctgtaccgaaaaccgccgtccggcatgtggtcgtcgcagcaatgggcgatcttctcggcctcaagggacatatcgtcaatctggtggtgcgcaaggtcaagaagctggtgcccgcccatgccattcccggctcgatcagcttcaaggccatgctgaaggaaggccagggggtttccctgaaaccggtcggccttacggcgcaggacatcgccttcctgcaatataccggtgggacgacgggcgtatccaagggcgccgtcctcacccatgccaatctccttgccaacaaggcgcagatcagcctgtggctcgacgctgccttcaacggccgcaaggaccgccccgaggttctcaacttcatctgcgcgctgccgctctaccatatcttcgcactgacggtgaattcactgatgggcattgcgctgggcggccataatctgctgatcgccaatccgcgcgacattcccggcttcgtaaaagagctttcgcattaccagccgcatatcttccctggcctcaccacgcttttcaacgcgttgatgaacaatgaagagttccgcaaacttgacctgtcgtcgctcatcttcgtactcggcggtggcatggcagtgcagaggccggtggccgaacgctgggtttccgtggtcggctgccctatcaccgaaggttacgggctgtcggaaacctcgcccgtcgccaccgtcaatcggctcgatgctgcggaattcagcggcaccatcggcctgcccatctcctccaccgaaatcgatattcgcgatgaggacggcaacagtctgccaacaggcgaagtcggcgagatttgcattcgcgggccgcaggtcatggccggttactggcagaggccggatgaaaccgcgaaggcgataacggcagacggcttcttccgttccggcgatatgggcttcatggacgaacgcggttacaccaagatcgttgaccgcaagaaggacatgatccttgtttccggattcaacgtctatccgaacgaggtggaagaagtggccgccagccatcctggtgtcctcgaatgcgccgcgatcggcgttccggacgaacattccggcgaaaccgtcaagcttttcgtggtcaagaaggaccagtccctgacggaagcggagctcaaggccttctgtgccaagaacctgacgaattacaaacggccgaaaatcatcgagttccgcaccgacctgccgaaatcgaatgtcggcaagattttgcggcgcgaattgcgcaatctg

SEQ ID NO: 38056 - DNA, 1560 bp, Agrobacterium tumefaciens
gatctgcgcgccgcttttgcggccgacgaccagagattcagccgtttcagcgtcaaattcgatgacctgctgatggattactccaaatgtgccgtcaacgaagagatcgtcacgcttctcgaacagctcgcgcgcgaaggcggtgtcgaggccaagcgcgaggagatgttctccggcaaggccatcaacttcaccgaagaccgcgccgtgctgcataccgccctgcgcaatcgttccaacacgcccgttctcgttgatgacaaggacgtgatgcctgatgtgaacggcgttctggcagccatgggcaagtttgccgatgcgatccgttccggctccctgaaaggtgcgaccgggaaaaagattaccgacgtcgtcaatattggtattggcggttccgatctcggccctgttatggcgacgctggcgcttgcgcccttccatgacggcccgcgtgcgcatttcgtttccaatatcgacggcgcgcatattgccgatacgctgaagcttctcgatccggaaacctctctcttcatcatcgcatcgaagaccttcaccaccatcgagacgatgacgaatgccgccaccgcgcgccgtttcatcgccgaaaagctgggcgaaggcgccgtcaagcatcacttcgcccgccgtctccaccgcgctggacaaggtcgccgccttcggtatcgaaagcgaacgcgcatcttcggtttcttgggacttgggtgggccggacgttattcgatctggtcggccatcggcctgccgctgatgatcgccatcgggcctgacaatttcggcaagttcctggatggcgcgcatgccatggatcgccacttccgcgaggcgcccatccgcgaaaacctgccgatgctactcggcctcatcggcttctataaccgtaacgtgctggactatccgacacgcgcgatcctgccctatgaccagcgcctgtcgcgtttaccggcctatcttcagcagctcgacatggaatcgaacggtaagggtgcgaccatcgacggcacgccggacgaatgccagtccggtccggtcgattagtgcgagcccggcaccaatggccagcacgccttctaccagctgatccatcagggcacgagcgtcattccggccgaattcatgatcgccgccaatggctttgagcccgaactgcgccatcagcaccagcttcttatcgctaattgcctggcgcagtcggaagcgctgatgaagggacgtacgcttgccgaagcgaaggcccagctcacctccaagggcatggaagacagccaagccgatttcatcgcgccgcaccgtgtcttcaccggcaatcgcccctccatcaccttcgtttacgacaagctgacgccctttgcgctcggccggctcatcgcgctctatgaacatcgcgttttcgtggaaggtgtgctgttccgcatcaactcctttgatcagtggggcgtggagcttggcaaggaactggccaccggcctgcttcccgtcgtggaaggcaaggagagcgccgccggccatgacagctcgacacaagggctggtgaaggcgctg

SEQ ID NO: 38057 - DNA, 920 bp, Agrobacterium tumefaciens
atgatcctgtgttgtggtgaagccctgatcgacatgctgccccggcagacgacgctgggtgaggcggcctttgccccttacgcatgcggagcggtcttcaacacggcaattgcgctggggcgtcttggcgtaccttcagcctttttaaccgtactttccgacgacatgatgggcgatatcctgcgggagaccctgcgggccagcaaggtggatttcagctattgcgccaccctgtcgcgccccaccaccattgcgttcgttaagctggttgatggccatgcgacctacgctttttccgacgagaacaccgccggccggatgatcaccgaggccgaacttccggccttgggagcggattgcgaagcgctgcatttcggcgccatcagccttattcccgaaccctccggcagcacctatgaggcgctgatgacgcgcgagcatgagacccgcgtcatctcgctcgatccgaacattcgtcccggcttcatccagaacaagcagtcgcacatggcccgcatccgccgcatggcggcgatgtctgacatcgtcaagttctcggatgaggacctggcgtggttcggtctggaaggcgacgaggacacgcttgcccgccactggctgcaccacggtgcaaaactcgtcgttgtcacccgtggcgccaagggtgccgtgggttacagcgccaatctcaaggtggaagtggcctccgagcgcgtcgaagtggtcgatacggtcggcgccggcgatacgttcgatgccggcattcttgcttcgctgaaaatgcagggcctgctgaccaaagcgcaggtggcttcgctgagcgaagagcagatcagaaaagctttggcgcttggcgcgaaagccgctgcggtcactgtctcgcgggctggcgcaaatccgcctttcgcgcatgaaatcgg

SEQ ID NO: 38058 - DNA, 624 bp, Agrobacterium tumefaciens
ctcgtcctcgtgggggccggcaatatgggcggcgccatgctttcgggctggctgaaaaagggtgtgccgggatcgaaggtcatcgtcatcgaccctcgcccctccgacgccatgcgcacgacgatagcggaagccggcgcgacccacagcgaaagcgtgcctgagggcgtcaaggccggcattcttttcgcggcggtgaatccggatatgatggatgccatattgccgtcgctgaagcccctgctgggtccggaaacggtcgttgtctccatcgcggccggtaccaccatcgccactttcgtttcgcatttcggtgcggtcgctgccgtgcgcgccatgcccaatacgcctgccatggtcggccgtggcgtcaccggcgcttatgccaacgatcttgtcacagccgagctgaaaacctgtgtggacgggttgctgaaggtcagcggtccggtcgaatgggttgaggccgaaagcgacatcgacgcggtgaccgcggtttcgggaagcggcccggcctatgtcttctatctggtggaatgcatggcggaagctggccgcaaggccggtctgccggccgacgtggccatgcgtctggcgcgcgaaaccgtggccggtgccggtgaa

SEQ ID NO: 38059 - DNA, 1173 bp, Agrobacterium tumefaciens; identical to SEQ ID NO: 35132

SEQ ID NO: 38060 - DNA, 528 bp, Agrobacterium tumefaciens
atgcccgtcgtccgtggaaaaaacatcgagccgctctacaccgccgagcagatcgccgagcgcaatcgcgatatggccaagcacattgccggtggcccgaccaaggatttgctggtcattgccgtactcaagggatcgttcattttcgcggccgatcttatccgcgcgctgcatgatagcggccttgctcccgaagtcgaattcatcacgctttcgagttacggcgccggcacggtttcccaaggggtgcggatcgtcaaggatatcgacagcgatgtgaaggaccgcgatgtcctgctgatcgacgacattctcgaatccggccgaacgctgcgtttcgccaaggaactgctttacgagcgcggcgcgcgcaacgtcaccattgccgtgctgctcgacaagaaggtcaagcgcaaggaagatctggaggccgactatgtcggtttcgaatgtcctgactatttcgtcgtcggttacggcatggatgtggcttatgccttccgcgaactgccttttgtcggcgtcgtg

SEQ ID NO: 38061 - DNA, 2379 bp, Agrobacterium tumefaciens
  unsure (1)..(2379): unsure at all n locations
gtcatcatcgctgcgggcctgttctttgccattggcggctggcagctcgtcgccctcggtggcagcccctatttcatcatcgcaggtctttcgctcatcgtttcgggcctgctgatcctgctgcgcaagccggcaggcgcgcttcttttcggtcttgttttcatcctcaccggcgtctgggctgtatgggaagcgggccttcatttctggccgctgatttcccgtctgctggccatcggggttggcgcaaccgtcgttgccctgtcatacccgctgctgcgccgtgcagccggcaaaacgccggcatatggctcttctttcgcggtagccgctgttctcgccatcgcttccggggccggttttgccggcatgttcgtggcgcatccgaccgttgccttcaatggcgagccggcggcgctgacgccggtcaagccggaaacggagcagaagaactgggaacattacggcaatacgtccggcggcagccgtttcgtggcgcttgatgaaattacccgagacaacatcaagaacctcgaagtcgcctggacctaccacaccggcgataccccgatcagccccggcgccaacggtgcggaagaccagcagacgccgctgcaggtaggtgacaccgtgttcctgtgcacgccgcacaacaatgtcatcgctctcgatgccgataccggaaccgagaagtggaaggcggaaatcaattcgaaatcctccgtctggatgcgttgccgcggccttgcctatttcgatgccaaggcgccgctgaagcaaccgactgcgccgggctccacgcccgtcacggccgcggttgtggccgaaggcgcactttgccagcgccgtattctgatgaacaccatcaatgcggaactcatcgcgcttgatgcggacacgggcgcgttttgccctgacttcggcacaaatggccgcgtcgatctgaagatcggtatgggagatgcaccggacccgcaatatgtcctgacctcggcacccacgctggccggcacgaccgtcgttgtcggcggccgtatcgccgataacgtgcaggtggacatgcccggcggtgtgatgcgcggtttcgacgtggtcacgggcgagcttcgctggctttttgaccccggcatcccgatatcaccaagctgccgcctccgggccagacttacacacgttccacgccgaacgtctgggcatccatgtcctacgatccggacctgaacacggtcttcatgcccgtcggcagcccttcggtcgatctttatggcgcgacacgcacgccgctcgaccataaatatggtgcctccatgctggcgctcgatgccacgaccggccgcgaaaagtgggtataccagacggttcataacgacctctgggacttcgacgtgccgatgcagccgagcttcgtcgatttcccgaaggctgacggaaccagcgttccggcgctggtcttcggcaccaaggcggggcagctctacgtgctcgaccgcgcgacgggacagccgctgaccaaggtggaagaggtttccgtcaaggctgccaatattcccaatgagccctacgcccccacgcagccgcgttccgtcggcatgccgcagatcggtgcgcagacgctgacggaagccgatatgtggggtgcgaccccgttcgaccagcttttgtgccgcatcgccttcaagggcatgcgttatgaggggctgtatacggcgcccggcacggacctctcgctcgccttcccgggttcgctcggcggcatgaactgggggcggtctgtcgaccgatccgaccaccaacactatcttcgtcaacgatatgcgcctcggtctctggatcgagatgaaggaagccgcccccaccaaggccgttgccagcggtggcgaaagcgtcaataccggcatgggcgtcnttcctataaanggcacgggcgtgggggtnaacaanaacctcttcctntcngctctcngcatcccatgccaggctccgccctatggcaccatgaccgcgatcgacatgaagacgcagcagatcaagtggcaggtgccggtcggcaccgtcgaggatacgggtccgctcggtatcaagatgggtctgccgatcccgatcggcatgccgacgctcggcggcacgctcgccacccagggcggcctcgtcttcatcgccggtacgcaggattattatctgcgcgccttcgatacggcgaccggcaaggaagtctggaaggcccgccttccggtcggcagccagggcggaccgatgagctacaagtctccgaagacgggcaagcaatatgtcgtcatctcggccggcggtgcccgccagtctcccgatcgcggcgactacgtcatcgcttatgcattgcccaactgatccttttggttc

SEQ ID NO: 38062 - DNA, 732 bp, Agrobacterium tumefaciens
ctcaaaagcaagcgggcgctcatcaccggtggcaccagcggcatcggacttgagacagcacgtcaatttatcagtgagggtgcacgggtagcagtcacgggaaccaaccccgagacgctggatgctgcacggcgggagcttggcccgagtgcattggtcatcaaggcagacgctgccgacgtggatggccagaaggtcgtcgctgaaacgatcagggaggcgttcgggggcctggacgtcgtcttcatcaacgcaggcgtcgcccttctcaagcctttggaagcatgggacgaaaaaggctttgatagggtcttcaacatcaacgtgaaaggtccgtattttttgctgcaggcactgctgccgatactggccaatccggcttctatcgtgctgaacacctcggtaaatgcccacatcggcatgcctaactcgagtgtctacgccgcctcgaaagcggcactgcagtcattcatccgcaccttgtccggcgaactgatcgcgcgcggcatccggctgaatgcggtgagcccaggtcccatctctacaccgctctatggtaagcttggtttcactgagactgacctgaaaaatgtcgctgaaagcattcaaaatctggtcccggccggccgctttggcgaaccgtccgaaattgcaaaggcagtagtgttcctggcatcggacgaagccgcctacacggtcggtagcgagatcatgatcgacggtggcatgggc

SEQ ID NO: 38063 - DNA, 939 bp, Agrobacterium tumefaciens; identical to SEQ ID NO: 35486

SEQ ID NO: 38064 - DNA, 1758 bp, Agrobacterium tumefaciens
  unsure (1)..(1758): unsure at all n locations
tatagcgcgccggtggatgatatcgcctttacactcaagcatgtggcgggtcttgaagacgcgctctcacagggtgtgctgggagacctgagcgaagatctcgttgatgccattcttgaggaagccggccgtttcgccaccggagaggtagccccgctcgccgatattggcgaccgtcagggcgcgaagctcgcagacggcaaggtcacgacgccggatggctgggccgatctttaccgccgctgggcggaagcgggctggaacagcctgaccgcgcccgaagaattcggcggccagaacctgccgcacatgctgaatgtcgcggcactcgaaatgtggaattccggctccatggcctntgcgctggcgccgacgctcaccatgggcgcggtggaagccatcgttacccacggcagcaatgatctgaagcgcatgtgtctggggaaactcgtatccggcgagtggaccggcaccatgaacctcaccgaaccccatgcgggatcggacctgggcgtgttgaagacccgggcggagcgtaatggtgacggcacctaccgcatcttcggccagaagattttcatcacctggggcgaacacgacgcggcggataatatcatccacctcgttctcgcccgtctgccggatgcgccgaccggtacgcgcggcatctcgctgttcctggtgccgaaattcctgcccgatgaaaacggcgcaccgggcagccgcaacgacctgttctgccattcgctggagcacaagctcggcattcacggctcacccacctgcacgatgatcttcggcgacggcaaattcggtgacgaaaagggcgctctcggctggctgatcggcgaggaaaacaagggcctcgcctgcatgttcaccatgatgaacaacgcccgccttgcggtcggcatgcagggcgtggcgatctgcgaagcggcgacccagaaggcgatcgaatacgcgaaagagcgcacgcagggcaaggcgcccggctggcagggttccggcatgagcccgatcatcgaacatcctgacatcgccaggacgcttctgaccatgaaggcgctgacgcaaggatcgcgggcgatttccttcagctgcgcccatgccatcgacatggcgcatgcgaccgaagacgcctcccagcgcgctcactggcaggaacgagctgcccttttgacaccgattgccaaatccttctccaccgatgccggtgtcgatgtcgcctccatgggcattcaggtgcatggcggcatgggcttcatcgaggagacaggtgctgcgcgttatctgcgcgatgcccgtatcgcgccgatctacgagggtaccaacggcattcaggccatcgatctggtgctgcgcaagctgccgctctccgagagcgcgcaggtgcgcggtttcatctctgagctgcgtgagattcccgcccggacggccgagtctaaccgcgatgatcttggcgagaccgcccgttatcttgaagccagcctcaacgatctggaaacgacgaccgactggttgctctcccgcatcaaggcgggcgaaaccgaaaccgcgcttgctggtgccacggcctatcagcggctcttcggtctggcgctcaccggtgcctatctcgccaagggcgcattggtctccgtcgatgatggccggagcgggcatcgcgcagcactttgccggttcacggcggaaaacctgctggcggaaacggcggcgctgaaggatcgcgttatatcacgccccccaagccttgcc

SEQ ID NO: 38065 - DNA, 1233 bp, Agrobacterium tumefaciens
gctgccttcctgacaaccaagagagaagtttccgaagacgtcaacgcgacggttcgcgacatcatcaacgatgtccgtcatcgcggcgatgcggcccttgcccattattcccagaaattcgacggcattgattttaccagggtttcgatgcgcgtgacggcggatgaaatcgacgccgcgttttcggcagtcgacagggccgtcatcgaggcgcttgaactcgcagcccggcgtatcgaaaaacaccatgcgcggcagatgccgaaggatgacatctacgaggacgatatcggcgtgggcctcggctcgcgctggaccgccatcgaggccgtggggctttatgtacccggcggcacggcgagctacccgagctcggtgctgatgaatgccgtaccggcaaaggtcgccggcgtggagcgtatcgtcatggtcgtgccggccaatggcggtgcggtcaatcccgcggtactcgctgcggcacgtattgcaggcgtcgaggaaatctaccgtattggtggcgcacaggctgtcgccgcacttgcctatggcacggagaccatcgcgccggtcgccaagatcgtcggcccgggcaatgcctatgtggcggccgccaagcggcaggtcttcggcactgtcggtatcgatatgatcgccggaccttccgaagtgcttgttattgccgacaaggacaatgatcccgactggctggccgccgatcttctggcgcaggcggagcatgatcgcggtgcccaatccattctcatcaccgataatgccgacctcggcaaggcggtgggggcagccgtcgagcggcagctgaagcttctttcgcgttccgagacggcggcggccagctgggccgatttcggcgcgatcattctggtcgaaaaactcaccgacgccattccgctcgccaaccgcattgccgccgagcatctggagcttgccgtcgatgacccggatgccttgatggcccacatccgcaatgccggggcgattttcgtcgggcgtcatacccctgaggtgatcggcgattatgtcggcggttccaaccacgttttgccgacggcacgctcggctcgcttctcctccggcctttcggtgctggatttcgtcaagcgcacgtcgatcctgcggctcgggcccgagcagttgcgccagcttgcgccggcggcgatcacccttgcccactcggaggggctggacgcgcatgcgcgctcggtctccattcgc

SEQ ID NO: 38066 - DNA, 1230 bp, Agrobacterium tumefaciens; identical to SEQ ID NO: 35449

SEQ ID NO: 38067 - DNA, 560 bp, Agrobacterium tumefaciens
attttaactggaaataccatgaccgttatcgcttcggagctttccgctgccatccgttccattcccgactatccgaagccgggcatcatcttccgggacatcacgacgctgctcggcaacccgcgcgcatttcgccgcgccgtcgatgaactcgtgcagccctatgcgggacgaagatcgacaagatcgccggcatggaagcgcgcggcttcattctgggcggggcggtggcgcatcagctttcggccggtttcgtgccgatccgcaagaagggcaagctgccgcacaccaccgtgcgggtcgcctacagcctggaatatggtgtcgacgaaatggagatgcatgtggatgccgtacagccgggcgagaaggtcattcttgtcgacgacctgatcgccaccggcggcaccgccgaaggtgccgtgaagctcttgcgacagatgggtgcggaaatcgtatccgcctgcttcgtcatcgacctgcctgatctcggcggccgcaagaagctggaagatcttggcgtcgacgtgcgcacgctggtagaattttctggccattga

SEQ ID NO: 38068 - DNA, 1128 bp, Agrobacterium tumefaciens
gtcaaagccgctatattgcgagagatgaatatgtctcgcccttacgccaccagcaggccgcttgcgatcgaatagattgagcttgccccgcccggccccggcgaagtcctcgtccgcatccgcgccgcaggcctttgccattccgatctttccgtcaacaacggcgaccggccccgcccgatgccgatggcgctcgggcacgaagcggcgggcgtcgtcgaggcattgggcgaaggcgtgcgcgatcttgagcccggcgatcatgtggtcatggtcttcatgcccagttgcggacattgcctgccctgtgcggaaggcaggcccgctctgtgcgagccgggcgccgccgccaatgcagcaggcaggctgttgggtggcgccacccgcctgaactatcatggcgaggtcgtccatcatcaccttggtgtgtcggcctttgccgaatatgccgtggtgtcgcgcaattcgctggtcaagatcgaccgcgatcttccatttgtcgaggcggcactcttcggctgcgcggttctcaccggcgtcggcgccgtcgtgaatacggcaagggtcaggaccggctcgactgcggtcgtcatcggacttggcggtgtgggccttgccgcggttctcggagcccgggcggccggtgccagcaagatcgtcgccgtcgacctttcgcaggaaaagcttgcactcgccagcgaactgggcgcgaccgccatcgtgaacggacgcgatgaggatgccgtcgagcaggtccgcgagctcacttccggcggtgccgattatgccttcgagatggcagggtctattcgcgccctcgaaaacgccttcaggatgaccaaacgtggcggcaccaccgttaccgccggtctgccaccgccgggtgcggccctgccgctcaacgtcgtgcagctcgtcggcgaggagcggacactcaagggcagctatatcggcacctgtgtgcctctccgggatattccgcgcttcatcgccctttatcgcgacggccggttgccggtgaaccgccttctgagcggaaggctgaagctagaagacatcaatgaagggttcgaccgcctgcacgacggaagcgccgttcggcaagtcatcgaattctgaaaccggcta

SEQ ID NO: 38069 - DNA, 846 bp, Agrobacterium tumefaciens; identical to SEQ ID NO: 35218

SEQ ID NO: 38070 - DNA, 576 bp, Agrobacterium tumefaciens; identical to SEQ ID NO: 35436

SEQ ID NO: 38071 - DNA, 936 bp, Agrobacterium tumefaciens
tccgccgccgctgccgtcggctgctccgaaggcgaaatattcctggcatcaacaggcgtgatcggcgagccgctggacgcttcgaaatttgcaggcgttctcggtgatatgaacgtcagggcggaagccgatttctggcaggaagccgccaaggcgatcatgacgaccgacacctatcccaaggtttcgacccgcaccgccgagatcggcggcgtgatcgtcacgatcaatggtatttccaaaggtgccggcatgatcgcgcctgatatggcgacgatgctctccttcgtcgtgacggatgccgacatcgaacccgccgcgctgcaatccctgttgtccgccggtgtcggcccgaccttcaattccgtgacggtcgatagcgacacgtccacgtcggacacgctgatgctgttcgccacgggtgcggcggctgaggacggtcaggtaaaggtgacgagcgccgatgacgagcgcctgtcctccttccgcgccgcgctcaacgatctcctgaggggggggcgctgcaggtggttcgcgacggcgaaggcgcgcgcaagatggtggaagtcaccgtgacaggtgctggaaaacgatgccgctgccaagaaaattgccctttccatcgccaattcgccgctggtgaaaactgccgttgcaggtgaagacgccaattggggccgcgtcgtcatggctgtcggtaaatcaggcgaaatggctgaccgtgaccgcctcgccatctggtttggcggcgtgcgcgtggccgtgaacggtgaacgcgatccggattattcggaagcggagaccaccgccgtgatgcggctggaagatattacggtgaaggtggatatcggcctcggccaaggcacggccacggtctggacctgcgatctgaccaaagaatatgttgcgatcaacggcgactaccggagctgaccg

SEQ ID NO: 38072 - DNA, 1017 bp, Agrobacterium tumefaciens; identical to SEQ ID NO: 35277

SEQ ID NO: 38073 - DNA, 744 bp, Agrobacterium tumefaciens
aatttgttcgatctttccggccgccgcgccctgatcacgggttcgtcccagggcatcggtttcgcgctggcgcaagggctttcggaagccggggcgcaagtggtgctgaacgggcgcgacgaagcgaagctgaaagccgccgctgccggcatcaagggcgcgagaacacttgccttcgacgccacagatcatggcgcggtgcgcgaggctatcgaccgcttcgaggcggaggttggcgcgatcgacattctcgtcaacaatgccggcatgcagcaccgcacgccgctcgaggattttccggccgatgccttcgagcgcctgctgcaaaccaacatcgcctcggtattccacgtcggacaggccaccgcgcgccacatgatttcgcgcgggcgcggcaagatcatcaatatcgccagcgttcagacagcacttgcccgccccggcatcgcaccctacaccgccaccaagggcgccgtcggcaatctgactaagggcatggcgacggactgggcaaaatatggcctgcagtgcaatgccatagcacccggttatttcgataccccgctaaacgccgcccttgtcgcagacgagacgttttcggcctggcttgaaaagcgcacgccggccggacgctggggcaaggtggaagagcttgtcggcgcctgcattttcctgtcgtccgacgcctcgtccttcgtgaacggccatattctctacgtcgacggcggcatcaccgcctcgctt

SEQ ID NO: 38074 - DNA, 1023 bp, Agrobacterium tumefaciens
gtcgcccacggggcaaaggatgtgcgcatcgaagaccggccggaggaaaagccgggtccgggcgaggtgcggctccgtctggcgaggggcgggatctgcggcagtgatctgcattattacaatcatggcggtttcggcgccgtgcggcttcgtgaacccatggtgctgggccatgaggtttccgccgtcatcgaggaactgggcgaaggcgttgaggggctgaagatcggcggtctggtggcggtttcgccgtcgcgcccatgccgaacctgccgcttctgccaggagggtctgcacaatcagtgcctcaacatgcggttttatggcagcgccatgcctttcccgcatattcagggcgcgttccgggaaattctggtggcggacgccctgcaatgcgtgccggccgatggtctcagcgccggggaagccgccatggcggaaccgctggcggtgacgctgcatgccacacgccgggccggcgatttgctgggaaaacgtgtgctcgtcacgggttgcggccccatcggcattctctccattctggctgcgcgccgggcgggtgctgctgaaatcgtcgccaccgacctttccgatttcacgctcggcaaggcgcgtgaagcgggggcggaccgtgtcatcaacagcaaggatgagcccgatgcgctcgccgcttatggtgcaaacaagggaaccttcgacattctctatgaatgctcgggtgcggccgtggcgcttgccggcggcattacggcactgcggccgcgcggcatcatcgtccagctcgggctcggcggcgatatgagcctgccgatgatggcgatcacagccaaggaactcgacctgcgtggttcctttcgcttccacgaggaattcgccaccggcgtcgagctgatgcgcaagggcctgatcgacgtcaaacccttcatcacccagaccgtcgatcttgccgacgccatctcggccttcgaattcgcctcggatcgcagccgcgccatgaaggtgcagatcgccttttcctaagcg

SEQ ID NO: 38075 - DNA, 1554 bp, Agrobacterium tumefaciens
agatccgtcgccctgctgcatgtgctgccggcgctgctctggctgccgcaggcgggcctgctggccttttcagttggaaaaattgccgatggcgagccgatgatggcgatcgtgccggccgccgttgcggtccttatcctcgggcttctcaaggcgtggctggaaaaagtcgcggcgcggctgtccttccgggccgcgcgcgcagcactttcgcagcggcggttcgaggcgttgcaggccgtggcgaaggtttccccgctcgatctgtcgcgcacggcctcgggtgaggcggcaggtatcgtggcggaggctgcggaagcgctggtgccctatctttcccggttccagccggcgcgcatgaaagccaccatcgttcccctggttttcgtgctcgccatcctgccctttagctggattgcggcgcttgtgcttctgctcgccatgcccaccatcccgcttttcatggccctgatcggctggcaggcaaaggccgccagtgaaaagcagctggccgagacgggcaacatcaacgccttcctgctcgatcggctgcgcgggctggaaacgatccgcacgctcaaggccgttgacctgacggcggcgcgcctcgatgccgatgcgcagaacctcaagaagcggacgatggccgttctgaggatcgccttcctctcctccgccgtgctggagctttttgcggcgatcggcgttgccatgaccgccgtttatatcggtttccacctgctcggttttctcgatttcggcgcgtggggcgaaaagcttacgctggccgaaggcctcttcatcctgctgcttgcacccgcttttttcgagccattgcgcgaactctccgccgtctggcacgaccgcgcggccggcgaggcgtcacttaatgcgctcgccacattaacggccggcggtgctgccatcgtgggtgagggcgcggatgtggtgcgcgcgccatcttcgacacccggcctgctggagatggaaaacctttccttcgcttacccgaatgctccgcctgtcatccggaatttcaacctgacggttcagcagggcgagagagttgcgattcttggggcttccggttgtggcaaatccactatactctccttgattgccgggctggccgaggcgggtgagggcgtaatcaggatcggcggcgtcacgcttgatgacgcaacggctgatgggctgcgcggaacgatcggctgggtcagtcagaagccattcttttttgccgcgtccatgaaggcgaatattggttttggccgcttggcggtcagcgaggccatggtggaagaggtcctgcaccgcaccggactggatggattgacgcaggcgcgccggcatttgcagatcggagacggcggaaatggcatttcgggcggggaggcggtgcggctcgccatagcgcgcgctttcgccgatccggcaacgcagcttgttctggccgatgagccgaccgcgcatctcgaccgggaaacggctgctctcgtcacggataacctgctgcaactggcaaagggcaggacattgatcgtcgcgacccat

SEQ ID NO: 38076 - DNA, 795 bp, Agrobacterium tumefaciens; identical to SEQ ID NO: 35388

SEQ ID NO: 38077 - DNA, 1014 bp, Agrobacterium tumefaciens; identical to SEQ ID NO: 35387

SEQ ID NO: 38078 - DNA, 2004 bp, Agrobacterium tumefaciens
atgagctgctgcgcaccgggaacggaaggttcgctggagctcggcgaaccgcttaatccgccatcgtcggaggagttgctgctggcgagccgcgatctggggcaggggttgcgccagaccgatcttagcgtgcccggtgtttattgcggcgcctgcatcaccaccatcgagaccgcgctcggccgtctcggccaagtggagcgggcgcgggtgaacctgtcttcgaaacgtgtggcggttgtctggaaagaagaggtcaatggcgtcaggaccgatcccgccgacattgcccgcgccatccttgcgacgggatatcgcatacatcttttcgccagcgggcaggatgcttcatacgccttgcgctcgcagctgatcagggcggtggcgctgtgcggctttgcttccgccaatatcatgcttctgtcggtctccgtctggtcgggggcggatgccgcgacgcgtgacatgttccactggatatcggcgatgatcgccgcgccggcgctgatctatggcgggcgtttcttttaccagtcggcctggaacgcgctgaaacacggccgcaccaacatggatgtgccgattgcgctcgccatcacgctctcctatgccgtttcgctgtgggagaccattcatcacggcgaacatgcgtggttcgatgcgaccgtgtcgctgctgttcttcctgctgatcggccgcacgctggaccatatcatgcgcgacaaggcgcgctccgccattgccggattggcccggctttcgccgcgaggggcaacggtgatcgatgcagacggggtccgggactaccggccgcttgcggatatcgaacctggaatgtcgattgcgattgcggcgggtgaccgggtggcggtggatgccgtggtggtctgcggcagcagcgatctcgacatgtccatcgtcaatggtgaaagcgcgccgcgccgcgtcgtggccggcgacagcctgcaggccggcacgctcaatctcaccgggtcgcttgtcgcccgggtaaccgcgtccgcaaaggattctttcctgtcggaagtgatcgggttgatggaggcggccgaaggcgggcgcgcgcgttaccggcgtatcgccgaccgtgccgcgagctattattcgcccgtggtgcatcttctggcgctggtgacgtttctcggctggggcattttcggcggtgactggaaacaggcgatgctgatcgccattgctgttctcatcataacctgcccctgcgcgctcggccttgctgttccagtcgtgcaggtggtggccgcaggaaggctttttcggcgtggcatcatggtcaaggaaggctcggccatggagcgtctttcggagatcgataccgtgctgttcgacaagaccgggaccttgaccgtcggcaagcctaggctggtcgagaccgcagatgtgaagccggccatcatggcgattgcggcggggctcgctgcccattcgcgccatcctctctcgaaagccctgcatgccgcctataatggtgccttgccagcctatgaggcggtgcgggaaattccggggtcgggtgtcgaggccgagacggaagccggcacttaccggctcggcaatcgccgtttcgcctgcccggatgagacacggatcaacaatggcgatgcgcggtcggaagtggtgctgtctctcgacggccggcatctggcgagcttcggcttcgaggacaatccgcgcgcgggtgctattgcggcattgcgcagcctgtctgtgcggggccttgcgcaggaaatcgtctcgggtgaccgggccgccgccgtcagtgcgatggcgcagcggctggggatcggcaactggcgcgcggacctgtcgccgaaggacaaggcggcgcgctgtgccgcgcttgccggcgaggggcacagggtgctgatggtcggggatggtatcaacgacgcgccagcgcttgccgccgcccacgtatctatggcgcccgccaccgccgccgatattggccggcagcccgccgacttt

SEQ ID NO: 38079 - DNA, 630 bp, Agrobacterium tumefaciens; identical to SEQ ID NO: 35152

SEQ ID NO: 38080 - DNA, 1026 bp, Agrobacterium tumefaciens
gtctcctcgacgctggtcattgcctcgccgatcaccgcccgcttcgttgaccgtatgaaactgcctggtaaagtcgccttgttcgatgccattcctggcgagcctgagatatccacgctcgatgcagcgctggcagcggcacgcgtggccaaacctgatgtcgtcatcggtctcggtggcggttcggtgatggatgtggccaagctggtcgccgccctctgggatggcgaacagacacttgccgatgtcgcaggccccaacaaagtggcaggccgccgaacccggctggcgcagattgcgacgacagccggcaccggctcggaagcgggcatccgctcgctgatcaccgatccaatcaagggcaacaagatcgcggtcgaaagcccgcatctgatcgccgatctcgcggtgcttgaccctgaattgacctattccgtgcctcctacggtaacggccgcaacgggcgtggatgccatggcgcattgcgtcgaagccttcaccagcaaacgctcgcatccgatgatcgacggttttgcccgcatggggtttcacctcgtcggtaaatttctgggtcgcgcggtacgtgacggatcggatcgtgaagcacgcgaaggcctgatgctggcttcctattacggcgggatctgccttggacccgtcaatacggcggcaggtcatgccatcgcctatccgcttggaacgctgctgcacctgccacatggattggccaatgcaatcgtgttcccgcatgtactggctttcaatcagcccgttgtttcggccaaaacggcggaagttgccgaagcgctcggtcttggggctggtctgtcgcagacacagttgcaagatagcgctcgtggcttctgttccgatcttgggatcgagatgtcacttgcgaaacatggtgcggccgaggctgatttgtcgcgctacgctgccgatgcgcatgccatccgtcgcttgatggacaataatccggcggatatgagcgttgatgacgtcctcgacgtctacaaggccagcttc

SEQ ID NO: 38081 - DNA, 744 bp, Agrobacterium tumefaciens; identical to SEQ ID NO: 35201

SEQ ID NO: 38082 - DNA, 1340 bp, Agrobacterium tumefaciens
atgctgtcatcgtcgaataccccgctaacaggtcccaacgaccggcaaacgtccatcgcgttctttgaacgcgcctccaccgtttttccaggcggtgtcacacgcgcgacaattgagctggatccccacccgatctttgttgcctacggggaaggcgcgtttgtgaccgacgtcgacgggcaccgtatgctggatctaaacaataacttcacaaccctgatccacggacatgcctatcccccaataactgaagcgattgccggactactaagaacaggcagttgctttgctaatccgatgaaccatgaaatcgatctggccgaattgctagtaggcaggattccggctgttgagcaggtccgcttcgtcgcgagtggaacggaagccgttatgtttgccatcaaagccgctagagcaacgaccggccgggtcgcactcgctcgggtggagggtgcgtaccacggcgcatatgactgggcggaggcgggccagcacgcatcgtcgaatacgccctgcgccgcctatccaggaatgccagcaagcgtcatagatgacgtcgtgctcctccaatttaactgccccccacacgctgcgagcaacagatcgcgatgaatgccgggcgccttgcggctattcttatcgatccgatgcccagccgggcaggcctcatagagccaacagaggagttcatcgcaactatcaacaaggtggcgaagcaacatgggatcgtcattatcgcggatgaagtcctgaacctccgccagggcttcgctggagcttcagcgcgctacggtctgaagccggatctcgtcacaatggggaagatcatcggcggtggctttccaataggggcagtcggtggacgtcgggagatcatgtcggcctttggcaagcaaggaagtaaggcgccattgacgcaaggcggaacctttgctgcaaatcccgtgtcgatggtcgctggccgtcttgcgatggaagccctgacgcaagatgctttccaacgtctcgaacatatgggcaacctggttcgcgaggggttgaggtcacgcatcgaacgtcacggcgcaaatctgagcgtgacgggagcggcttcgctttttcgaatacacgccaagaaagtggcgccggtttcttatcaggacagcattccgacagcttcggaagacgtcgttttgaaactgctgcgcaggcactttgcaaacaatgggatcttgatgccctacggcgccgctgcgtcgctatcaacgcccatgacggacaatgacatgggtgacattgtttccgtctttgacgatttcctcgtgaatctcgatcgacatgcctgggaggccgcataatgg

SEQ ID NO: 38083 - DNA, 1467 bp, Agrobacterium tumefaciens; identical to SEQ ID NO: 35103

SEQ ID NO: 38084 - DNA, 1725 bp, Agrobacterium tumefaciens
ctcggctttgttttcaaccattggagccaccgaaaggcgctcgtgggtttcatcatcgtgctggtggttgccagcacgctcgccgaagtgatggtgccggtcttttccggccggatcgttgatgccatcgctggtgacaatgggggtgccaatgcgggtgatggcgctctgcgcgctttcgtcatcgtggttgcgcttggctttaccagtgttgtgctgcgctggttcatcttcaacggcatcatccggctgacgctgaagaccatggctgacgtcaccaataacggcttccacaaggtgcagcgtttctccaccgactggcacgccaacagcttcgccggctcgacggtgcgcaagatcacgcgcggcatgtgggcgctggattcgctcaacgacctgctgctcgttgcgctcctgccctccatcgtcatgctggtgggcgccaccgtagtgcttggcagttactggccggtcatgggcctgatcgtcggcctcggctcgctgatctatatcggtgtcacggtcgggctttcgatgggttatgtgtcgccgccggcgcggcttgccaatgcctgggacacccggcttgccggcgcgctgtcggatgcgatcagatgcaacgcggtggtcaaagccttcggtgccgaaacccgtgaagatacacggcttggtcatgtgctggtgaaatgggacaatcggacgcgcagaacttgtaaatgtggaacgctgaacggcactatccagagcttcatgatggtatcgatgcaggcgggcatcctcggcaccggcctcatcatgtggcagaagggtctggcgacagcgggcgacatcaccttcgtgctggcgatgtttttcgtgttgcagggctatctgcgcgatgtgggccaggatatccgcaacctgcagcgcgccgtcaatgacatggaagagctggtgctgctcgacaagatgccgctgggtgtcgaagacaggccggacgccaagcggatcaatatcggcaagggcgagatcgtcttcgatcatgtcaccttccagtatggcgcgcatgcaaccccgctttatgaggacttctcggtcaccatcaagccgggcgagcgtgtgggtctggtcggtcactccggttcgggcaagacaaccttcgtcaagctcatccagcgcctttacgacataaaggcgggggctatccgcatcgacgggcagaacatcgccgatgtcacgcaggcgagcctgcgcggccagatcgccatcgtgcagcaggaacccatcctgttccaccgcacgctggcggaaaacatcgcctatggccggccggatgcctcgcgtcgtgagatcgagcaggcggcgaaacaggcgagcgcccatgatttcatcatgtccctgccgaagggttatgagaccatggtgggcgaacgcggtgtcaagctgtcgggcggcgagcgccagcgcgtcgccattgccagggcgttcctggcggatgcgccggtgctgatcctagacgaagcgacgtcaagcctcgacagcgaaagcgaagtgcagatccagcaggcgatggaacggctgatggatggccgcaccacgctcgtcattgcccaccgtctttccacggtccgggcgctcgaccggctgctggtgttcgacaagggcaggattgtcgaggagggcgaccatcaggcgctgatccgcctccatgacggcatctaccgccggctgttcgagcggcaggcg

SEQ ID NO: 38085 - DNA, 957 bp, Agrobacterium tumefaciens
ggcaagggcctgctcgcagccgatgaatccacaggaacgatcaaaaagcgtttcgacagcatcaacctggaatccaccgagaccgcccgccgcgattatcgcgaaatgctgttccgctctgacgacgccatgaagaagtacatctccggcgtcattctttatgaagaaacccttttccagaaggctgccgatggcacgcctttcgttgatatcatcaaggccgccggcagcctgccgggcatcaaggtggatatcggcgccaagccgatggctttccacccgcatgaattcatcaccgaaggccttgatggcctttatgagcgcctgcgcaagtatcatgaagccggcgcgcgtttcgccaagtggcgcggcgtcatcaccatcggtgagcagcgtccgagctggggctcgatcaaggcaaactcccagtctcttgcccgttatgctgccctctgccagcaggccgatatcgtgccgattgttgagccggaagtgctgatggacggcgagcctggcacgcatgacatcgaccgctgcgccgaagtcacgcaatgggttctccagaccgtgtttgcggatctgttcgatgcccgcgtcaacctcgaaggcatgatcctcaagccgaacatgatcatcgatggcaagaacgctcgcaaggcttcggtcgaggaagtggcggaaaagaccgtcaaggttctgaaggcgacggtaccaactgccgttccgggcatcgccttcctttccggcggccagtcctccgaagaagctacggcgcatctctccgccatgaatgccggttacgacctgccctggtcgctgacctattcctacggccgcgctcttcaggataccgctctcaagacctggggcggcaaatcggaaaacgtcgccgccggccagcgtgccttcacgcaccgcgccgccatgaacagccttgccgccaagggcaactggaaa

SEQ ID NO: 38086 - DNA, 1182 bp, Agrobacterium tumefaciens; identical to SEQ ID NO: 35296

SEQ ID NO: 38087 - DNA, 690 bp, Agrobacterium tumefaciens; identical to SEQ ID NO: 35473

SEQ ID NO: 38088 - DNA, 768 bp, Agrobacterium tumefaciens
ccggaggctccatcgggaagacgagccctcatcacgggcgcatcgagtggccttgggatcgaatttgccgagctgctggcagcgcagaagatgaacctcgtgctcgcagcccgtcgaaaggagccgatggaaaaacttgccgaggaccttcgccgaagacatggcgtcgacattcttgtcgagcctatcgaccttgccgcacccggagccgccgctcgcctgaaagacagcctgaacgagagggcgatacagatcgacatactggtgaacaatgccggatacgggctacagggtgagtttctgaaaaccccgatcgagcgcaccaccgacatgattcagctcaacatcacggcgctgactgaactcagctatgttttcggccgggacatggccgccaggggatcgggagagattcttctgatagccagtctactggctttccagcctgtccctacctatgccgcatatgcggccacgaaatcttacgtgctgtcatttggtgaggctttgcacgacgaacttcgcacgcaaggcgtggtcgtcaccagcctttgcccggggcacactgaaacaggatttgatgccgctgccggcgctcaggtctcgccaatgttgcgcctgctcaccatgaaaccccgtcccgttgcagaagccggacttgaagctctcgccaaaggcaaggcgtccgttattgccggtttcatgaataaggtggttgcgttttcaactcgtctgaccccgcgttccatgcagcgggcttccatgcgc

SEQ ID NO: 38089 - DNA, 1704 bp, Agrobacterium tumefaciens
ggggagcgcttcgtctcgtcgagtttttcccaaagaccactcggaggagttatcatggcagacaatcattatgatgcgattgttgtcggctcaggcatcagtggaggctgggccgcgaaggaactcacgcaaaagggcctgaaagtcctgatgctggagcgtggccgcaatatcgagcacgtcaccgactaccagaatgccgacaaggaagcctgggattatccccatcgcaaccgcgccacgcaggagatgaaggcgaaatatcccgtcctcagccgcgattacctgctggaagaagcaacactcggcatgtgggccgatgagcaggaaacgccctatgtcgaggaaaagcgcttcgactggttccgcggttatcatgtcggcggccgctcattgctctgggggcgccagacctatcgctggtcgcagaccgattttgaggccaatgcgaaagacggcatcgccgtcgactggccgatccgttatgaagacgtctccccctggtatgactatgtcgagcgttttgccggcatctccggcagccgcgaggggttggatattcttcccgatggcgaattcctgccgcccattccgctcaatttcgtcgagcaggatgtcgccagccggctgaagaaggctttcaagggtacgcgccacctcatcaattcgcgctgcgccaacattacccaggagcttcccgatcaggagcgcaccccctgtcagttccgcaacaagtgtcggctgggctgtcccttcggcggctatttcagcacgcaggcctcgaccctgcctgcggccgtcgccaccggtaatctgacgctgcggcccttctccatcgtcaaggaaatcctctacgacaaggataagaagaaggcgcgcggtgtcgagatcatcgatgccgagacgaacctgacctatgaatataccgccgacatcatcttcctgaacgcctcgacgctgaactcgacatgggtgctgatgaattcggcgaccgatgtctgggaaggcgggcttggcagcagctccggtgaactcggccataatgtgatggaccaccatttccgcatgggcgcgaccggccaggtggacggtttcgaggacttctatttcaagggccgccgtccggcgggcttctacattccgcgtttccgcaataccggcgatgacaagcgcaaatatctgcgcggtttcggttatcagggatcggccagccgttcacgctgggagcgggaaatcgccgagctaaacatcggtgccgactataaggataccctgaccgagccgggcggctggaccattggcatgaccgccttcggcgaaatgctgccctatcacgataaccgcgtgaagctcgatcatgacaagaaggacaaatggggcctgccggtcctttccatgaatgtcgagatgaagcagaacgaactcgacatgcgtgaagatatggtcaatgacgccgtcgagatgttcgaggcggtcggcatcaagaacgtcaagccctcgcggggtacctacgcccccggcatgggcattcacgaaatgggaacggcccgcatgggacgcgacccgaaaacctccgtcctcaacggcaacaaccaggtctgggatgcacccaatgtcttcgtcaccgacggtgcctgcatgacctctgcctcctgcgttaacccgtccttgacctacatggcgctgacggcgcgtgctgccgag

SEQ ID NO: 38090 - DNA, 1911 bp, Agrobacterium tumefaciens
ctcagcaccgggaacatagcacccctcagcaaggcacaggtttcggcgctgtcgacgacacagttcgctgccatgtcgaccgaccagatcaaggccctcacctccgatcaggtcgccggtctcagctccgcgcaggttgcgacgctcagcagcgacgaactggctctcttctccaccgatgagatcaaggcgatcggcgccaacgccgttgccggcctgtctgccgcagccctggcggcgcttaccaccgacaacgctgcagcactgacgaagacccagatcgcgggtctgtcttcgacacagctgaatgcactgacctccgccaaccttgcaaccttctctgcagatgagatcaaggccatcagcaccaaggcgctggccggtctcgatgttaccaagctcagcaccggcaacatcgccgcgctgaccaaaacccaggccgcatcgctgtcctcaacacagttcgcagccatgtcgaccgaccagatcaaggccctcacatccgagcaggtcgccggtctcagctccgcgcaggttgcgacgctcagcagcgacgaactggctctcttctccaccgatgagatcagcgccttcagcgccaatgcggtcgctggcctttccacagcagccctggctgccctcaccaccggcaatgcaaccgcactgacgaagacacagatcgctggtctgtcttcgacacagctcaatgccctgacatcaggcagcatcgccactttctccgccgatgaagtcaaggccatcagcaccaaggcactggccggcctcgatgtgaccaagctcagcaccggcaacgtcgcagccctcagcaaggcacaggtttcggcgctgtcgacgacacagttcgctgccatgtcgaccgaccagatcaaggccctgacatccgagcaggtcgccggtctcagctccgcgcaagttgcgacgctcagcagcgacgaactggctctcttctccaccgatgagatcaaggcgatcggcgccaacgccgttgccggcctgtctgccgcagccctggcggcgcttaccaccgacaatgcatccgcactgacgaagacccagatcgcgggcatgtcgtccacgcagatcaatgccctgacctccgcaaaccttgccaccttctctgcagacgagatcaaggcaatcaccaccaaggctctcggcggtctcgatgtcaccaagctcagcaccggcaacatcgccgcgctgaccaaagcgcaggttacatcgctttcctcgacgcagtttgcagccctgtcgaccgaccagatcaaggctctcacctccgagcaggtttcgggcctcaactctgcccaggttgcgacactgagcagcgacgaactcgctctcttcaccaccgacgagatcaagtcgatcgccgccaacgccgttgcgggtctctctgctgcggcgctggcagcgcttaccaccgacaatgcatccgcactgacgaagacgcagattgctagcctctcatccacgcagctcaacgccctcacctctgcaaatctcgctaccttcacggcagacgagattaaggcggtcaccaccaaggcgctggccggtctggatgtcactaagctcagcaccggcaacgtcgccgcactcagcaaggcacaggtttcggcgctgtcgacgacacagttcgctgctatgtcgaccgaccagatcaaggctctcacctccgatcaggttgccggcctcacctctgctcaggttgcaacactgagcagcgacgagcttgccctgttctcgacagacgagatcaaggccattggcgccaacgccattgccggtctttccactgcggccattggcggcctcagcagcgcgcaggctggagcactttcggcccagcagatgaaggtcatgaacgatgcccaggtcgaggcggtc

SEQ ID NO: 38091 - DNA, 1994 bp, Agrobacterium tumefaciens
  unsure (1)..(1994): unsure at all n locations
ccagacatgacgtcgatcattgcttccctgaatgtcaatcagatcagatatctctcgacagaggcggtcgcagcctggacaaccgaggacgtcgcgtcactctccacaacgcagatcaaggcgctctcatcggatcagatcgcggcattggatgtggaggatgtgaaaatcctcaactctcagcagctgagcgccatttcacagggcgccattgttggtttgacgctcgaccaactcaacattctcgatcaatacgccatcaaaagtctgagtgcgagccaggtttccgcgctgacgaccacccagtttcatgccctgacgacggatcaggcagaagccctgacctcttcccaggtgcgcgttctcagctccgcacaacttgcggcgctgagcgcagaggatatcgcaaccttctcgaccgctgacatggcggcgatcaacggccaaagccatgccgggcctcggcacggaggtgatcgcaggacttaccccggatcagatcgcggctctgaacatcagcgcgatcgcaagcctgacgaccgaacagatcgcgatcctgagcccgcagcaggcggaagccttgacccctgcccaggtgagggtgttgagctcgcttcagctcgctgccctcggcacagacgatatcgccaccttctccgcggccgacatcgctgctattaccggcaaggccataacgggcctgagcatcgaggcaatcgcggaactgacgtcggatcgcgtcgccgctctgaatgcaagcgcgattgccggcctgacgaccgagcagatcgaggccctgagtaccgctcagatagccgccttgacgacagcgcagatcgcagcactcaaaacgacccatgtcgcggccttgagtacgagccaggtcgaagccctgtcaccgttacaggtacagtcgctgactgcgtcgcagctcgcggtcctgagcgcagaggacatcgcaacattctccaccgccgacatcgccgcgatcacgggcacagccatgccccgcctgagcacggaggcgatcggtactctgacgctggatcagatcgccgcgctgacgacagcccagctgaacgccctcagttcggcacagttccaggccctgagcgccggtcaggtcgaggccctgtcggccactcacattgcggccctgagcaccggcgtgatcgctagcctgacagccgatcagatcgaagccttcagcacccggcaggtcgaggccctctccgcggcacaggtgaagctgctgaactcggctcaaattgcagccctgagcccggatgatatcgcgacattttcgaccgccgatattgcggcgattgccggcaaggcaatatcaggcctgagcaccggcgcaatcgccgcgctgaccaccgctcagatcgccgccctgacgaccggcgcgatcgccagtctgaccgacgaccagatcgaagccctgagcaccagtcaggtggcagccctctccccgacacaggtgaaatcgctgagttcaacacaactcgctgccctgagcgtggaagatctcgcgaccttctcgagcgctgatcttgccgcgattaccggtaaggccatgtcgggcttgaacacggatgtcattgcagcactgaccgccgctcagatcgccgccttcggcgccagtgcgatcgccggcctgacgtccgatcaggtagaagccttgagcggcagccaagtcagccttttgtccaccacgcagatcaaggcgttgagttcaacgcaggtcgccgccttgggtagcgatgtcgctgccttgtccaccagccagaccgccgtattgagtgcggcaagcatcaagggcctgaccccggagcagattgcaatcctgcgccccgatcagttttcggctttgaccacggcccagatcgcggctctcagctcgggacagataacggcgatgggcgccagcaacatcgcatcgctttccatggcccagatcgcggncataagcacgtcaagcatgaccggac

SEQ ID NO: 38092 - DNA, 720 bp, Agrobacterium tumefaciens
atcaccggcggtgcatccggcatcggtttctccactgcgcagctcctgatggcgcgcggctggcagccatggttgctggatctcaagcgcgaggcgctggatatagcctgcgaaaaactcggtatcgatctctggcgcggcatagtctgcgatgttgcggacgaggcatcgatagagatggctttcgccgccctgacggctaacggtgccgatcatgcggttgatctggtcgccgtcgtcaacagcgccggcatcggtatcgacaagctgtccgtcgacacaagcgtcgaagaatttcgccgtatcgttgatgtcaatctcgtcggcagcttcgcggtagcgcgcgctgccgcacgttactggctagagcgcgatgttgccggctcgatcgtgaatatcagttctgtttccggcatgtgtggaaatcgtggccgcagcgcctatggcgcttcgaaaggcggcgtcaatcttctgacgatggtaatggcaaacgagctggggcaatcaggcattcgtgtcaatgcaattgctcccggtccggtcgatacccccctcacccaggcagttcatactgaaaatgttcgcgaccaatggcatagccgcgttccgatgcatcgctatggcaggacggacgagatcgcctctgccgtggctttcctcgtgtcggatgacgcaagctacatcaacggacaggtgcttgccgtggatgggggcttcatt

SEQ ID NO: 38093 - DNA, 1965 bp, Agrobacterium tumefaciens
aaaatactgatcgccaaccgtggcgaaatcgcctgccgcatcatccgcaccgcagccagtatgggcatccgcaccgtcgcggtctattcggatgccgaccgcgacgccatgcatgtggcgctggccgatgaggccatcgccatcggccccgcacctgcgcgcgcctcctatctcgacggcgaaaagatcattgccgccgcaaaggcaagcggcgcagaggccatccatccgggctatggttttctttcagaaaatgccggtttcgccgaagcctgcgcttctgcgggcctcgttttcatcggccctccaccagaagcaatccgcgccatgggcggaaaaagcgaagctaaggcgctgatggcaacggcaggcgttcccatcgttcccggttatcacggcgatgaacaggccgagaaacgactggcaagcgaggcggacaagatcggttacccggtgctgctgaaagcctcggcaggcggcggcggcaagggcatgcgcgtcgtccggcagaagcacgactttgctgcggagcttgccggcgccaaacgcgaagcactggccgccttcggcaatgaccgcatgctgatcgaaaaatacctggagcggccgcgccatgtggaagtgcaggttttcgccgatggccacggcaattgtgtttcgctttttgaacgcgactgctcgatccagcgccggcaccagaaggtgatagaggaagcccccgcccccggcctgcccgatgacttgcggcaacgcatgtatgacgcggcaaccgccgccgcccgtgccatcgattatcgcggcgcgggaacgatagaattcctccttgatccatccggcttctatttcatggaaatgaacacgcgccttcaggtcgagcatccggtgacggaatatattaccggtctcgatctggtcgaatggcagctgcgcgttgcgaatggagaagccctgcctaaagactgggccgatctccgcatcaacggccatgccatcgaggcacgcatttatgccgaagacccggcgcatgatttcctcccgtcgattggcacgatcagccacctcgtctttcccgatgaaggtcctcacctccggatcgacagcggcatccgcgccggcgacgccatcaccgtgcattacgatccgatgatcgccaagctgatcgtctgggatcatgaccgacccgccgccgtgcggcgtctaaaggtggcgcttgaaaagctggcaatttgcggcgtcaccagcaatgccacctttctggcgcggcttgcggggctcgaaactttcgcagcggccgatctggataccggcttcatcgcccgcaacgaggcagacctttttgctccgcaggccgtgggcgacaatgagatcgcactggcggcactcggcttccttctcagccgtaaaaacgcgagcaccaacccgcaagcgcaggccgaccctcatagtccctggaataccgccaacgccttccgactgaatgcgccggcgcgtgagacgctgcatttcaccatgcagaaccggccgatcgaccttggcgtagcccatgaggcagacagcttttcgctggagatgggcggacacacgatccgcgcttatggcgacctctctgacaacggccgctttcgcgcgaccatcaacgaccggacatggaaaggctatttctttgcagagagtgatagctacgcactttttctgcacggcgaacactatcgcatcagccagccagacccggtcgatatcgcagattcttctggccatacgggcggtctggaggcgcccatgccgggcgttatccgcgccgtgctcagccagagtggcgcggcggtcgagaccggtgatgcacttgtcgtgatggaagcgatgaagatggagcataccatccgcgcacccgcgaaaggcatcgtcaccgccgtcaactgcgccgaaggcgacatggtcgtcgccggtgcggtgctggtggatttc

SEQ ID NO: 38094 - DNA, 819 bp, Agrobacterium tumefaciens
cgttttgcaccaagcccgaatggcccgctgcatctcgggcacgcgctttccgccttcctgaaccatgatatggcgcaggacaatggcggccgcttcctgctgcgcattgaggatatcgaccagacccgctgcacgccggaactggagcaggcgatctatgatgatctcgactggttgggtctcgactgggaaaaaccggtgcggcggcaatcggaccatttcgacgcctaccgcgtgtcgctggacaggttgatcgatgcgggccttgcctatccggcttttctcagccggggtgaaacaaaaaccatcgtcagggccttcgaggccgatggcgggctctggcctcgcgatccggatggcgcgccgctctatccatccatggaccgcgaaaggcccgacgcggaacgggcagcgctgcttgcctccggtcggcaccacgcatggcggctcgacatggaaaaggcgatccgcgccgttggcagctccctgttctggcaggagagcggcgatggcgagacgggacgcatcgaggcacttcccgggctctggggcgacgtggtgctgtcgcgttccgacgcgccttcgagctatcatctttccgttgtggtggatgatgcgctgcagggcatcacccatgtggtgcgcggcatggatctgttccacgcaaccgccattcaccggctgcttcagcatctgctggacctgccgcaaccgacctatcaccatcaccggctgctcctcggtgcggacggccgcaaactttcgaaaagcgaaggaagcacggggctctccacccttcgtgcagaaggtgccgggccc

SEQ ID NO: 38095 - DNA, 804 bp, Agrobacterium tumefaciens
atcatcatcaccggatgttcctctggcatcggcgcctattgcgccggcgcgcttcagcgggacggctggcgggtttttgccaccgtgcgccgcatcgtcgacatggccgcgctcgaaaatcagggcatcgaaaccctgatcatggattacaccaagccggaaaccatcgccgcgctggtggacaccgttgcagcccggaccggcggccgcatcgacgcgctcttcaacaacggcgcctatggccagccgggcgcggtggaagacctgcctgtcgaagcgctgagagcccagttcgaaaccaatgtcttcggttggcacgatctgactcgacgggtcattcccttcatgcgcaagcgtggttcgggccgtatcgtgcattgctcctccattctcggcctcgtgccctatcgctatcgcggcgcctataccgcctcgaaattcgccatcgagggcctgggcgtcacgctgcgcatggagcttcagggcagcggcattcatgtgagcctgatcgaacccggtccgattacctcgaaattcacggcaacggcgcttgcccacgtcaaggacaagatcgatctggaaaattcggcccatgcggcggaatataaacgccaactggcgcgcatggatgggtcaggccccgtcaaccgccacaaactcggccccgaggccgtttatgccgtactgaaacatgccctgaccgccgccagaccgaaaccgcattatcccgtcacggttccagccaaacaggggctgttactgaaacggctcttgcctgccggactgttctatcgtctgctgcgc

SEQ ID NO: 38096 - DNA, 1519 bp, Agrobacterium tumefaciens; identical to SEQ ID NO: 35303

SEQ ID NO: 38097 - DNA, 768 bp, Agrobacterium tumefaciens
cggacagttatcgtgacaggctccacaagcggcatcggccttggcattgcgcaaagatttgcgcgggagggcgccaatatcgtgctgaacggttttggcgacgacgacgagatcgaaaaactgcgccttctgctggaagccgaaagcggcgggcgggtgctttaccatcccgccgatatgacgaaaccggacgagatcgccgatctcatccagtcctcacacgaaaaactcggctcggtggatgtgctcatcaacaatgccggtattcagcacatcgcgcccatcgaggagttcccgacggaaaaatgggactggatcatcgccatcaatctgaccagttcttttcacaccatgcgtgccgcgataccgctgatgaaaaaggcaggcaaaggccgcatcatcaacatttcctcagcccacggccttgtcgcctcgccgttcaaatcggcctatgtggcggccaaacacggcatcatgggcttgacgaaaacggcagcgctcgaacttgcgcaaacgggcgtcaccgtcaacgccatctgtcccggttacgtgctgacgccgctggtggaaaagcagataccggaaatggccaaggtgcgcggcatcagcgaagcggcggtgaagaacgacgtgatgctggaattgcaggcgaccaaacaattcgtcaccgtcgatgacgtcgccgccgctgcgatatttctggcaagcgacgccgcaagcaacatcaccggcacccatatttccgtagacggcggctggacggcacaa

SEQ ID NO: 38098 - DNA, 912 bp, Agrobacterium tumefaciens
caaacaaaacctttccgaatcggcacacgcggcagcccgctggcgctcgcgcaggcttatgagacccgcagccggctgatggcggcacacggtcttccggaagagatgttcgaaatcgtcgtgctctccaccaagggcgaccggatcaccgaccgcgccttgtcggaaatcggcggcaagggcctgttcacggaggaactggaaaaccagctcctgtccggcgaactcgatattgccgtgcattcctccaaggacatgccgacggttttgcctgagggcttgcatctttcagctttcctgccgcgtgaagacatgcgcgacgccttcattggtcgcacggcaccgaagcttctggagctgccgcagggcgccgttgtcggctccgcctctctgcgccgccaggcactgatccgccgcctgcgcccggatctcaacgtcatcgttttccgcggtctggtcgacacgcgtctgcgcaagctcgaagaaggccaggcggatgcgacgcttcttgcctttgccggcctgaagcggctcggcaaggacaacgtgccgacggaaattctcgatccaaaagaattcccgcccgctccggcccaaggcgcgatcggggtcgagagccgcatcggtgacgcccgcatggataaattgctggctcccataaacgacaggcccacttatgacgccgtgacctgtgagcgtgcctttctggcagcgcttgacggttcctgtcgtacccccattgccggttacgccacctgcgaaggtgataacctgcatttttccggcctgatccttacccccgatggccagacaagccacggcgtcgaaatctccggcaaccgcagggacgccttgatactggggaaaaaggccggcgaagaggtgcgcgccaaagcgggcagcaatttcttc

SEQ ID NO: 38099 - DNA, 1440 bp, Agrobacterium tumefaciens; identical to SEQ ID NO: 35475

SEQ ID NO: 38100 - DNA, 1179 bp, Agrobacterium tumefaciens; identical to SEQ ID NO: 35418

SEQ ID NO: 38101 - DNA, 1200 bp, Agrobacterium tumefaciens; identical to SEQ ID NO: 35256

SEQ ID NO: 38102 - DNA, 309 bp, Agrobacterium tumefaciens
agcggcatgaaactggtggtggtcggcgcagcgggccgtatgggacaggcactgatccgtctcattcaccagacacccggcgttcagctgcatgccgcagtggcgcgtgaaggttcggcttttgttggccgcgatgccggcgagatcgccggtcttggccccatcggcatcgaaatcaccagcgatcccttacaggcatttctgcatgccgaaggggtgatcgatttcacctcaccggcaaccagcatcacctttgccggccttgccgcgcaggcccgtatcgtgcacgtcgtcggcacgactgggttg

SEQ ID NO: 38103 - DNA, 1341 bp, Agrobacterium tumefaciens
ctggtggtgttcggcgccacgggtgatcttgcctataagatgatctttccctctctctacgccatggtgaaacgcggcgcgctgcaaacgcccatcatcggagtcgctttcgacgattggccgcgtgagcagctgatagcgcgggcgcgcgatgcggtcgccaaccatttggacaagatcgatgaagccgtcttcgaaaaattcgccgcacagctgacctatgtctccggcgattatcgcaacgaagcgacattcgaaaagctgcgcacggcgcttggcgggcaccagcatccgctttattatctcgccattccgccttccctgttcgaaaccgtggtaaccggcctcaacaggacgggcatcgccgcttcggcccggctcatggtggagaaaccctttggccgtgaccttgcctccgccgaagccttaaatgaagcgttgcacgcggttttcgcagaggatgctattttccgcatcgaccatttcctgggcaaggaagccatccagaaccttctttattttcgttttgccaatgcctttctagagcccgtgtggaatcgcgaccacgttgagagcgtgcagatcaccatggccgaagatttcggcatcagggggcgcggcaagttttatgacgaagtcggatgtatccgcgatgtgatccagaaccatctgatcaatgtgctgttgctgctggccatggagccgccagccaccagcgcctcggatgatctcgtcgatgaaaaagtgcagatactgaaagccatgccgccgctcacccgcgatgatgtggtgcgcggacagttcagaggttatctggacgagccgggtgtcgcctcggcgtccaaccgggaaaccttcgccgccgcccgctttcgcgtcgccacctggcgctggaatggcgtgcctttcttcatccggtccggcaagaacctgccggcgcatgcaaccgaagtcgtggtccgcttcaagcggccgccaattgcgctctttggcgatgtcgagacaacgcccgccaattatgtgcgcttccgtctgggcccggatatcgcgatcggaatcggtgcgcgtcgcaaggcagctggcgatggcatgcgcggcgaggccgtagaactcggcgcggtcgatgacggtatcggtgacatggcgccttatgagcggctgatcggcgatgcgatggccggcgagcgtcagctctttacccgccaggatgcggcggaactggcctggaagatcgtggagcctatcctcgatgatcccgccgtgccgcctgtctatgaggtgggaagctggggcccggcggaaatggcagggtttggcccgccaggcggatgggttgatccc

SEQ ID NO: 38104 - DNA, 1194 bp, Agrobacterium tumefaciens
ggagccgtcgtggcgagcctgtcgatcccgtggggagcctccaagggcgatgacgatcttggcggatatcatttgatatggccgcgggatctggtggaagccgccggcgggtttctagcggccggtgatcacgatgaggctttggccatccttgattatctgcgccaggtgcagcaaccctcggggcggtggccgcaaaatctctggctggatggcaagccctattggccgggcgttcagatggacgaatgcgcctttccgatcctgcttgcggatatgctgcatcggcacggccacctcgaccacgccgcaagggcggattacatgccaatgatccgcagcgctgcggcttatattctggcaaacggcccgacgaccggcgaggacaggtgggaggaagatgcaggctacagcccgtttacgcttgccgtcgagatcgccgcgctgcttgccgctgctgatctgttggatatggagggcgatgcggccgaagccacgcatctgcggcagacagccgattgctggaatgagcagatcgaaaggtggacgtttgccggtgaccagaccatgtgcgcgcagcttggtatttcgggccattatgttcgcatcgcttctcccggtaccaccgatgccgttcagctctcgggcatgacgcctatactcaaccagacaccggatcgcgctttcctgccaacaagcgatgtcatcagccctgatgcacttgcgctggtccgcttcggcctgcgcgcaccggacgatccccacattctcgcaaccgtcaaggcgatcgatcattgcctgcgcgccgagctgccgcaggggccggtctggtacaggtacacgggcgacgggtatggtgagcacgctgatggaacagcatttgacggcacgggtcagggcaggccatggccccttctgaccggcgagcgcgcccattacgaacttgctgcgggcagacgcggggcggcggaagctttgctgaccacaatggaaaaatcggcggggcagagcggccttttccccgagcaggtctgggatcaacccgatcttcccgacagggagctgttttatggctccccgtcgggcagcgcgatgccgctggtctgggcgcatgcagaacatatcaagcttctgcgttcgcttgccgatggctccgttttcgacatgccgccgcagggtgtggagcgctacatc

SEQ ID NO: 38105 - DNA, 1749 bp, Agrobacterium tumefaciens
tatatgtggccagagggtcggtgggacctgaagatgcgggtgatctgggcaaccgtgttcctcatcgtcgccaagctggtgctgatcgcggttccctatttcttcaaatgggcgacggatgcgctgaacggcaagctcgacatggcagggctggttccggccttcctgctcggcgcggtggcgctggtcatcgcctataatctgacgcggctgatccaggtcgggctcaaccagctgcgcgattcgctgtttgccagcgtcggccaacatgcggtgcgccagctcgcctatcgtaccttcgtgcacatgcaccggctttcgctgcgtttccatctggagcgcaagaccggcgggctgtcgcgggtcatcgagcgcggcacgaagggcatcgaaaccattgtccgcttcaccattctcaataccgcaccgaccttcatcgaattcctgctgacggccatcatcttctgggcgtcctatggtttttcctatgtgctggtcaccgtcgtcaccgtctgggcctatatctggttcacggtcagggccagcaactggcgtatcggcatccgccgcgccatgaatgacagcgataccgacgccaataccaaggcgatcgattcgctactcaacttcgagaccgtcaaatatttcggcaatgaggaaatggaggcacggcgtttcgacgtcgccatggagcgttacgaaaaatcggcgatctcgatctggacctcgctcggctggctgaactttggccagggcgtgattttcggcatcggctccacgatcatgatggtgatgtcggcactggccgtgcagcgcggcgagcagaccatcggcgatttcgtgttcgtcaatgcgctgctgctgcagctttccgtgccgctcaatttcatcggcttcgtttatcgcgaaatccgccagggcctgaccgacatcgaacagatgttcgatcttctcgaggtggaggccgaagtcaccgacaggccggatgcgaagccgcttgcggccggtcccggcgcgatctccttccgcgacgtgcattttgcctacgaccctgaaagaccgatcctcaagggcgtttccttcgatgtgccggcgggcaagacggtggcgatcgtcggcccttccggtgcgggaaaatcgacgatctcgcggctgctttatcgtttctacgatattcaggagggcgccgttaccatcgacgggcaggatattcgcgacgtgacgcaaaagagcctgcgctcgatgatcggcatggtgccgcaggataccgtgctgttcaacgacaccctcgcctacaatatccgctacggtcgcccctccgccaccgacgaggagctgaaggcagcggcggatgcagcgcagatcagcgccttcatcggcaaactgccggacggttacgccaccatggtcggcgaacggggactgaagctttcgggtggcgaaaagcagcgcgtggcgattgcccggaccattctcaaggcaccgccgatcctgatcctcgacgaggcgacctcggcgctcgatacgcataccgagcaggaaatccagagcgccctcgacatcgtctcgaaaaaccgcaccacgctggtcatcgcccaccgcctctccacggtcatccacgcggacgaaatcatcgtgctgaaggaaggactgatcgccgagcggggaacgcatgcctcgctgatggcgcatgatggcctctacgcctcgatgtggagccgccagcgcgaggcgatccgcgccgaagag

SEQ ID NO: 38106 - DNA, 783 bp, Agrobacterium tumefaciens; identical to SEQ ID NO: 35451

SEQ ID NO: 38107 - DNA, 1008 bp, Agrobacterium tumefaciens
atgaaggcggcggttgtccgcgcatttggaaaaccgctgaccatcgaggaagtgccaataccggatcccggccccggtgaaattctcatcaactacaaggcgacgggcgtttgccacaccgacctgcacgccgcaacgggggattggccggtcaagcccaacccgcccttcattcccggacatgaaggtgcaggttacgtcgccaagatcggcgctggcgtcaccggcatcaaggagggcgaccgcgccggcacgccctggctctacaccgcctgcggatgctgcattccctgccgtaccggctgggaaaccctgtgcccgagccagaagaactcaggttattccgtcaacggcagctttgccgaatatggccttgccgatccgaaattcgtcggccgcctgcctgacaatctcgatttcggcccagccgcacccgtgctctgcgccggcgttacagtctataagggcctgaaggaaaccgaagtcaggcccggtgaatgggtggtcatttcaggcattggcgggcttggccacatggccgtgcaatatgcgaaagccatgggcatgcatgtggttgccgccgatattttcgacgacaagctggcgcttgccaaaaagctcggagccgacgtcgtcgtcaacggccgcgcgcctgacgcggtggagcaagtgcaaaaggcaaccggcggcgtccatggcgcgctggtgacggcggtttcaccgaaggccatggagcaggcttatggcttcctgcgctccaagggcacgatggcgcttgtcggtctgccgccgggcttcatctccattccggtgttcgacacggtgctgaagcgcatcacggtgcgtggctccatcgtcggcacgcggcaggatctggaggaggcgttgaccttcgccggtgaaggcaaggtggccgcccacttctcgtgggacaagctcgaaaacatcaatgatatcttccatcgcatggaagagggcaagatcgacggccgtatcgtcgtggatctc

SEQ ID NO: 38108 - DNA, 633 bp, Agrobacterium tumefaciens
atgaaactctactacatgcccgccgcttgctcgctctcaccacacatcgttgccaacgaactggagttggatatcgaatttgtcagggtgaacttcaaagatcataagactgaagggggccaagattattacgacatcaatcccaatggctacattccggccctggacgtggggaacggcgcgatgcttttcgaggggccagccatcgtccaatacatggccgatctgaagcctcaatccggcctcgctcccgccaacggcactttcgagcgttacaagctgcaggagatgctgagtttcctatcgaccgaaatccacaagggcttcattccacttctttatgcgaaacaggcgggtgcatatctcgaaacagcaacgccgaagctggaaaagcgctacgcatggatcgacaatttgctggcatcgcagcgttttttgatgggcgagaatttcacggtcgccgatgcatatctgttcgctctcacaagctggggacaagcgtcatggctgaagtcatactatggtgcagatatccatttcgacgatcttctcaacctcagaggctggtatgaacgcgtaaaagaacgggatgcggtgaagcagtccatacttgaagaaggcttatcgctgagc

SEQ ID NO: 38109 - DNA, 729 bp, Agrobacterium tumefaciens; identical to SEQ ID NO: 35178

SEQ ID NO: 38110 - DNA, 1333 bp, Agrobacterium tumefaciens
ttcgatacggttctcattgccaacaggggtgaaatagcagcgagaatccagcgggcctgccatgaactcgggctaaaaaccgttgcaatatgctccgaggcggacaggggcgcatcctatgtccagactgccgatagttttctttgtatcggcccttccgctgcgggcaaaagttatctcaacaaggatgccatcctgctcgcggcgcggttgacatcttcaggagcgatccatcccggttacgggtttctatcagaaaataccgccttttcggacgccgtcgaaaaagccggccttgttttcatcggaccgggcgcatcgtcgattgcgacgatgggcgacaagatcgctgctaaacgggcgatgattgctgctgctgtgccgtgtgttcccggccctgatacggcattgccggatgatccggctgccgtcgaaagcattgcgcaggaaatcggttatcctgtcatcgtcaaggctgccggtggcggcggcgggcggggtattgcgggttgtgccggatgccggatctctgcatgaggcgattcccacgacacgcgaggaagcccgtcaggctttcggctcgccggcgctctacatggagaaattccttcagcatccccggcacattgaaatacaggtgctgtgcgacacccacggacatgccgtttggctgggacatcgcgactgctccatgcagcgtcgccaccagaaggtggtggaagaagcgcccgcgcccggcatttcgcctgacgtgatccggtccgtcggacaagcctgcgtcgaggcctgccagcagatcggttatcgtggagtcggaacgtttgaattcctctacgagaacggggccttctatttcatcgagatgaacacgcgtctgcaggtcgagcatcccgtcaccgaaatgaccagcgggatcgatatcgtccaggcgcagatcagggcggcacagggggaggaactggttctacgccagcaggatgtaaaatgcgaaggccacgccttcgagtgccgcatcaacgcggaagatccgcagacgtttctgccttccgccggggtcgtgacgggtcttgcctggccgcaggggcaaggtattcgtgtcgatacccatattcatgggggttacagggtttctccctattacgattcccttgtcgccaagctcatcgtccatgcgccaacccgcagcgaggcgatggcgaagatgcgcgaggcacttgccgggacatcgattgaaggcatttcgaccaatctgccgttcctgcgcgcgctgtttgaggacgacgctttcgtgtgtggtgaaacggacattcattatctggagaaatggctcaag

SEQ ID NO: 38111 - DNA, 1417 bp, Agrobacterium tumefaciens
cagtgctatatcgacggacgtttcgaggatggtgaggccagcttttccagcctcgatcccgcaaccggccagccctgggccgaaatgccggaaagtcgcgaggcggatatcggccgtgtggtcgaggccgcgcatcgggcgctttacgaggatactgtctggtcgaaactgacggcgacgcagcgcggcaagctcctctacaggctggccgatctcgtcgcggaaaatgcgaagacgctcgctgaactcgaaacccgcgataccggcaagatcatccgcgaaacgtcggcgcagatcgcttatgtcgctgactattatcgctattatgcgggcctcgcggacaagatcgaaggcgcctacctgcccatcgacaagccggatatggatgtctggctacggcgcgaaccggtcggcgttgtcagcggcgatcgtgccgtggaacagtcagctgtttcttgccgccgtgaatatcggtccggcgctggccgccggctgcactatcgtcgtgaaggcatcggaagatgggccggcaccgcttctggaatttgcccggctggtgcatgaggccggttttcctgccggtgtcgtcaacgttgttaccggtttcggcgcgtcatgcggcaacgccctcaccacgcatccgaaggtcgcccatatcgccttcaccggcggcccggaaacggcccgacatatcgtccgcaactcggccgaaaaccttgcctccacatcgctggaactcggcggcaaatcgccgatcctcgtttttgccgatgccgatctcgaaagtgccgccaacgcccaggtggcaggcatttttgcagcgaccggccagagttgcgtggctggttcgcggctgatcatcgaaaaaagcgtcaaggaccggttcctccagattctggcggcaaaggccgaggcgatccgcatcggttcgcctttggatatggcgacggaagtggggccgcttgcaacggagcgtcagaggaagcacatcgtttcgctggtttccgcctcggtagatgccggcgcgaaggtggtgacgggcggtgagcctgtggagggtgaaggctatttttaccggccgaccattctcgattgtgacggcattcgctcgccttccttggaaaaggagtttttcggccctgttctttcggtcgtttccttcgaaaccgaagcggaagccatttcgcttgccaatgacacggtctatggccttgcgtcgggcgttttcacgcagaacctgacacgggctcaccggctgatgaaggcgatccgcgcgggcatcgtctgggtgaatacctatcgcgctgtttcgccgattgcgccctttggcggcttcggcctttcgggcgacggccgtgagggcgggcttgcggcggcgctcgattacacacgcaccaagaccatatggctcagaact

SEQ ID NO: 38112 - DNA, 1119 bp, Agrobacterium tumefaciens
cttatcggcggcgccagcctatttcgatcacccgccgtggtaaaatcgcttggcgtccatcgccccttgctggtctgcgatacagtattgcacaagcgcggccatagcgatgcgcttttgcaggcgctggccgaggaaggcatcgaggccgccgtgttctcggacgtcgtggaagacccgacggatatatccatcgccaccctggtgaaacgcatttccgatggcggccatgacagtctcgtcgcacttggtggcggcagcgccatggatacggccaaggcgggcgccatcgttgcaacgagcggggaggatttgcgcgccctgaaagtgccgcggatcgtggatttcgccgtcatgccggtgattgccattccgacgacggccggtaccggttcggaagtgacccgcgccgccgtcgtcaccgacacggctgccagcgaaaaaatgctgatcctcggcaccgccgctttgccggtcgcggccatcatcgattatgagctgacgctgacatgtccttaccgtgtcacggtcgataccggcatcgatgcgctgacccatgcgctggaagcgctggtcaaccgcaatggtaacgcccattccgaggcgctggcgctttccgccctgaagctgatcggcgccaatcttgaaaaagtggctgataaccctgatgaccgggatgcgcgtgaagcgatgatgctgggcgcgacccatgccgggcttgccgtctccaatacatcgaccgcactgatccatggcctcagccgtccagtcggcgcgtttttccatgtaccgcatggcatgtcgaatgcgatggtgctgccgctggtcacgcagttttcgctgaattccgctcttccgcattatgctgcggccgcgcgggcgctcggctccgccgccgcgacagatagcgatcaggtctccggtgcgaagctggtggaggctttcctcggcctgaacaggcggttgaaggtgccgaccccacaagagttcggtatcgacaggagccgctatctcgatcttgtgccggaaatggtgcggcagggccttgcttcgggtacgccggcaaataacccccgagtgcccacagttgccgaaatgacgaggctatatgaactcgcc

SEQ ID NO: 38113 - DNA, 819 bp, Agrobacterium tumefaciens; identical to SEQ ID NO: 35402

SEQ ID NO: 38114 - DNA, 1254 bp, Agrobacterium tumefaciens
agctatcatttccgcccgcccttcggctggatgaacgacccgaacggctttggccgcttcgagggcaggccacatctgttctatcagcattattcgcacgggctgcgctggaacaccatgcattggggccatgcggtctcctcggattatctgcgctggcggcatctaccgatcttccttttcccctccgaggacctgacgacgcggccggacaaacgcggcggcgcctattccggctcgaccattccgctggtggaaggctcaggcatccgggtctttttcaccgagcaggtgcaggaccgtattcccgagcagcagatccagcttaccgccacctcgtctgatctcatcatggccgggcaggcagacgtcattctcgcccaccgcccggatgggcaggggctgacgcctgacttccgcgacccttacgtgtttcgtggccccgatggcttgtggaaaatgctgctcggcagccagagcgatggcggcggcgtgatcctgctttacgagacgctggaccccacggccgcctccggctggacctatgtgggcaagctgtgggtggagacacgttacaagaccacggccatcgaatgcccctgcctgctgcccctcgatggccccgccaatgcccgttccacaaggtgggtgctgatctacgggctgatgcattcggaagacccggagaccggccgcaagaacctgaccatggccgatgtcggctggtttgacggcaaggtcttcaccaaggaatttggtcaggagctggatttcggcaccgataattacgcctttcaggcctttctggatggcgacagcattatcggcatcggctggctggcaaactgggcggatgccaatccggaaatcgatttccccacctccatgaccctgccgcgccgaattcactacgcgaacggcgaacttctgaccccgccgatcggcgcggcggaaagcctgcgcagccatattctcgaccgcacgcggctggcggccggtgagcgcgtcaccttcatcaacggcgcggtggaaatattgatcgaacttgcctcgtcagacgcggccttcgagctggcgctcgatcatccgaccgtcacgctcggtctcgtctccgacgagacgggcctgtggatccgccatgaggacgggcgcgacggtgcttcgccgcactacattgccaaggggcgcgcgccgcatcccgcatccgcattttcctcgactaccggctccatcgaggtctttgcaaatcgcggc

SEQ ID NO: 38115 - DNA, 1923 bp, Agrobacterium tumefaciens
ctgtgggtgccgccgcgggaaaggctggagcactcggcgctttttgctttcgcggcgaaaaccgcaccgctgcacggtctggctgccgatgattatgccggcctcttgcgctggtccatcgacgccccggatgagttttacgatgcgctgtgggacgaactcgcgatcatcggcacgcgcggcgaggcggcattcaaagccggcgcgacgatccgggacgccgagttttatcccggcgcgcggctcaattatgcggaaaacctgttgcgcgatgccgatgaacggttggccatcatcgcctatcgcgacgatggcacacgacgcgagataagccgcaggaagctctatgatgaagtgtcgcgcatggtgcaggcgctggtccatgcgggcgtgaaggagggcgaccgtgtcggcgccatcgtcacgcatgatatcgaggcgatcgtcagctatctggccgtgagcgccatcggcgccatctggtcgtcctgctcgccggatttcggcccggcaggggcttcggaccgtctgtcgcagatcgacccgaaaatcctgatcgccgtgccggaatatggttatgccggcaaacgcattgatgtcggcccgaccatccgcgccgtggcggaaagtgcgaggcctgaaaagatcgtgctgattggtgattccgttgccgaaagcctcgccgatcttggctgtttgacgcttgcggatttcgtcgcgccctatgcggcgggcgagattgccttcaaccgtctgcccgtgaaggcgccgctggcgatcctttattcttccggtacgacgggcaagccgaaatgcattacccattccggcggcgggctgcttcttcagcacatgaaggagcagaagctgcaatgcgatatcaggcagggcgaacgcttcttctatttcaccacctgcggctggatgatgtggaactggcaggtttccggtctggcactcggcgcgacactggtgacctatgacggtaatccgggctatccaaataccgcgcggctgattgaccttatcgatgccgagggtattgccactttcggcacgtcggcgaagttcattgacgcctgcctgaaagcgggcctgcagccgcgcgagagccatgacctctcatcgttgcggacaatcctttccaccggctcgccgctcatcccgcaatccttcgattatatctatcgcgactggagggcggatctgcatctcgcctccatttctggcggtactgacatctgcgcctgttttcttggcggcaatccgctgcagtcggttcatcgcggtgaattgcagggcgcgatgcttggcatggatatcgatacgctcgatgatgaaggccgttccgttcgcggcgtcgccgctgaacttgtctgccgcaatgctcacctgtccatgccggtcaaattctggggcgatgaggacggctcacgttatcaggccgcctatttcgaccgttttcccggtatttgggcacatggtgattttgccgaactgcgcccctccggcggatatgtcatccatggccgctcggacacgacgcttaatcccggcggggtccgtatcggtacggcggaaatctatcggcaggtggaaaccgtgcctgatgtcgaggaggccattgccgtcgggcaggatattgacggcgaccagcgggtgatccttttcatacgcatgaaggaaggcgcggtcctgacggaggagctggaaaagaccattcgcagccgcatccgtttaggtgcgacgccgcggcatgtgccggcaaggatcatcgccgtcagcgccattccccgtacccgttcaggcaagatttccgaaatcgcggtgcgcgaaaccattcatggccggccagtgaagaataccgatgcactcgcaaatccggaatcgctcgaacttttccgcaacctgccgcagctgaag

SEQ ID NO: 38116 - DNA, 768 bp, Agrobacterium tumefaciens; identical to SEQ ID NO: 35072

SEQ ID NO: 38117 - DNA, 2353 bp, Agrobacterium tumefaciens
tcgggggtttcatttatggcagtcaccgtcactgcggtcattcttacgctgatcggccttgcgctgttcggcttcggctctcagctcgtcatgttgggcgggagcttttattatcttctttccggactggcctttctgttgacggccgttctgctgttcaagcagcaatcgcgccgcccttcacgtttatgccgttttcattgtcgcgacgcttgcctgggcagtctgggaagtcggatttgactggtggcagcttggaccgcggggcggcgtcattattctcattggtctttggctgctggtgccgtgggtcaggaaaccgcttggcttttcaagcccgaccggtctgagttacagccctaacgcttggccgctggtgctttccgttctcgcctcctttgcagttgccggctactccatggcgcaggacccgcatgatcaggcgggttcgttaccgcaggagatcgcatctgcggcacctgtctatggcggcgaagtgcctgacggtgactggcatcaatatggccgcacaccctatggccagcgttattcgccgctgacgcaggtgaatgtggacaatgtctcgcagttgaaggaagcctggcgttatcagacgggggacgtgaagctgcctgatgatgtgggtgagaccacctatcaggtcacgccactcaagatcggcaatacgctttatatctgcacgccgcataattgggcgatcgccatcgatgccgccaccggcaaggaaaaatggaaatacgaccccaatgtcggtctcaatcctgatcgccagcaccagacgtgccgtggcgtttcctattatgccgaaccgaacgccgctgccggcacggcctgcgcccagcgcgtctacctgccgacctcggacgcgcggctgatcgcgctcgatgcggccaccggccaggtctgcacctcctttgccgatcagggtgtgctgcatcttgaacagggcatgaagtacaatcccgccggttattattattcgacctcgccgccggtcatcgcggctggcaaaatcatcatcggcggcgcggtgaacgacaattattcgacgcaggagcagtccggcgtcatccgcgctttcgatgtgaatagcggtgctctcatctggaactgggattccggcaacccgcagaagaccgagccgatcgcggcgggtgagacctatacgaccaactcacccaacagctggtcggtgctgagttatgacgaaggcctcggcctcgtctacgtgccgcttggcaaccaggtgccggaccagcttggcatgggccgcagcgagaatgtcgagaaatattcctcctcgattgtcgcgctcgatatcaatacgggcaaggaccgctgggtgcgccagacggtacatcacgatctctgggacatggatgtgccggcccagccggtgctgctcgacatcaccaaggatggccagacggttccggccctcgtgggtcccaccaagcagggcgacatctacgtgctcgacaggcgcaccggtgagccgcttctgccgattaccgaggaaccggcgccgaccggagccatccctgaagacttcacatccccgacgcagccaacctcggcgctgtcgttcaagccggaaccgctgcaggaaaagaacatgtggggcgtctccatgttcgaccagctcgcctgccgcatccgcttccatcagctgaattacaagggccgctatacaccgccttcgctcaacggctcgatcatctatcccggcaatttcggcacgttcaactggggcagcgtggcggtcgatcccgagcgtcaggtgatgttcgggatgccaacctatctcgccttcacctcgcagctcgtgccgcgcgccgacattccgccgaagggacaggatgaaaagggcagcgaacagggcctcaaccgcaatgacggtgcgccctatggcgtctttatggggccattcctcggtccgctaaaaatcccctgccaggccccgccatggggttatgtcgcgggtgccgatctgcggaccggcgatgtcgcctacaagcataagaacggcacggtctatgacatgacgccgctgccgctacctttcaaggtgggggtgccgggcattggcggaccgatgatcaccaagggcggcgtcgccttcctcggtgcggccgtcgacaactatctgcgcgcctatgatctcaccacgggcaaagagctctgggaagcgcgtctgccagccggcggtcaggcaacgcccatgacctactcgctcgaaaacggaaaacaatatgtagtgatggtcgcgggcggccacggttcggttggtaccaagcccggtgattacgtcatcgcgtatacgctgccctga

SEQ ID NO: 38118 - DNA, 1719 bp, Agrobacterium tumefaciens; identical to SEQ ID NO: 35482

SEQ ID NO: 38119 - DNA, 963 bp, Agrobacterium tumefaciens
acacgttcttcccgcatggccggttttggtcatgccgttccggcccgttgcgtcgacaatgccgaaatagaggccagtctggggctggaagccgggtggatcgagcgacggaccggcattcgctcccgttattgggcggaggcgggcgacacgctgagcggtcttgccgaaagggctggccggatggcgctggaggatgcgaagatcaatgccgatgacatcgcgctgacgctgcttgccacctccacgccggatcatcttctgccgccttccgcgccactgcttgcgcataggctgggtttgacgcgctcgggtgcgatcgatcttgccggggcctgttccgggtttctttatgcgcttaccctcgcggatggttttgtccgcacctacggccgcgccgtcctcgtcgtcgccgccaatattctcagccgccgcatcaatccggcggaaagggcgagcgccgtcctgtttgccgatgccgccggtgccgtggtgctgaccccgtgtccggaggtgaaacggggggtgttatcggccgatctcgttgccgatggcagcggttacgatctcatccagatcgcggcaggcggcagcagccagcccttttctgccggtatgattgcagaagatgccctgatgacgatgcgcgatggccgggaggttttctctcgcgccgtggcgctgatgacaaacacctctcagcgcgtgctgcatgaggcggaactgaccgcagccgatatcagccgtttcgtgccacatcaggccaatgcccgcatgtccgacgccgtttgcggtaatctcggaatcgagcgggaaaagacggtccgcaccataggaagcttcggcaattcttccgctgctaccatcccgctttcgttgtccatcaccaatgccgagcggccccttgcgggcggcgaaaccccgcttctcccggcggcgggtgcaggcatgacgggcggggcg

SEQ ID NO: 38120 - DNA, 1200 bp, Agrobacterium tumefaciens
gtctggcatcccttcacccagcatgggctggaaccgccgatgaaacgtgtggtctcagcggacggggcgtttctggtggatgaggatggcaatcggctgttcgacgcgatttcatcctggtgggtcattacccatgggcaccggcatccggcgatcatggcggccatccgcgccgcgaccgagaccctggatcaggtcatctttgccgaattttcccatgaaccggctgagacgctcgcccgggggctgatcgagcttgctcctgctggactaagccatgtgttttattccgatagcggttcaccgccggtgaaagtggcgctgaaaatggcgctcggttatttccacaattgcggtgaaaagcgcgatcgcatcgtggtgatggagcatggctatcacggcgataccatcggcaccatgtcgacaggcgagcgcggcgtgttcaacgccgcctatgaaccgctgcttttcggcgttgaccggttggcctttccggaagtgggcagcgagcagtgcacattggatatgtttgaggcttactgccgttcgggccgtgtcgccgcgctgctggtcgaaccattggtgctcggtgccggtggcatgaaggtctacgccgccaatgttctagccggactgaaacagattgcagaaagccatggctgtctcgtcattgccgatgaggtgatgacgggctggggcaggaccgggaccgtcttcgcctgcgagcaggcggcaatctcaccggatattctctgcacttccaaggggctgaccggtggttcgctgccgctggcggcgacgctgtgcagcgcgcagattttcgatgctcatttttcgaccgaccgccgcaagacctttttccattcgagttcctatacggccaatccgatcgcctgcgccgccgccgtcgccaatcttcaggtctggcgggatgaaccgattctccagcgcatcgggcaggtgcaacagacgctcggcgatcatatcaggcgctttgccgatgatggccgtttcgccaacatccggcaggcaggcaccattgccgcgcttgatctcgtggtgccggcgggtggctatctttccgaggccggtccacgcatgcgccagctgttccgcaggcgcggctttctcatccgcccgctcggcaacgtgctttacctgatgccgccctattgttcgacggctgacgatctgacgcgc

SEQ ID NO: 38121 - DNA, 1035 bp, Agrobacterium tumefaciens
cgggaggggatcgatttcacctccaacgactatctcgggcttgccgaagcgccgcgcctgaaggcggcgattgctcacgccattggcaaaggcgtgccggtgggcgccggcggttcacggctgctgcgcggcaatcaccccgaacatgaggcgctggaatcggaagcggcggcgtttttcggggccgaaaaagccatctatttcggcagcggttttgccgccaatgtcgcgcttttttccaccctgcctttgcgggacgatattgttctccatgatgccctgatccatgccagcgtgcatgatggcattgcggcgggcaaggcgaaggcggtggccgtgccgcataatgaggtggaggctttccagcgggagataatccgctggcggcaggcgggtggtagcggccggccgtggatcgcggtcgagagcctttattccatggatggcgattgcgcgccgcttgcagccctggccgatcttgccgaacggcatggcggttttctggttgtcgatgaagcacatgccaccggcgtcttcggccccggtgggcgtggtcttgccgcgcaactggaaggccggagcaatgtgctggcccttcatacctgcggcaaggcgctcggtgcctccggtgcgcttttgagcctgcctgcggttcttgccgattatctcgtgaaccgcgcccgcggtttcatctattccaccgcgccttcgccgctgatggcggcggcggtgcgggaggccttgcgcatcgtcgcggacgaaccctcaaggcggtcgcgactggccgagttggtaggttttgccggcgaagaattgcaaagccagctgggtgtgacacccagcggttcgcagatcctgccggtgatgatcggcgacaatgcccgctcactgaagattgctgcacggctgagccaaggcggtttcgatgtgcgggcgatccgcccgccgacggtaccggaaggcacggggcggctacgcatcgccatcacgctcaacgtggatgaaagccagattgccgccatggtcggcttgctt

SEQ ID NO: 38122 - DNA, 1296 bp, Agrobacterium tumefaciens; identical to SEQ ID NO: 35472

SEQ ID NO: 38123 - DNA, 1114 bp, Agrobacterium tumefaciens
atcaccgttgaagaagccaagactgctgaaaccgaactcgaagtcgtcgaaggcatgcagttcgaccgcggctacctgtcgccttacttcgtaaccaacccggaaaagatggttgcggacctcgaagacgcttacatccttctgcacgaaaagaagctctcgaaccttcaggccatgctgcctgttctcgaagccgtcgttcagaccggcaagccgctcgtcatcatcgctgaagacgtcgaaggcgaagctcttgcaacgctcgtcgtcaacaagctgcgtggcggcctcaagatcgctgccgtcaaggctcctggcttcggcgatcgccgcaaggccatgctggaagacatcgccatcctgaccggtggtaccgtcatttccgaagacctcggcatcaagctcgaaagcgttaccctcgacatgctcggcaagtcgaagaaggtttcgatctccaaggaaaacaccacgatcgttgacggtgccggccagaagtccgacatcgaaggccgcgttgcccagatcaaggcacagatcgaggaaaccacttccgactacgaccgcgaaaagctgcaggaacgtcttgccaagctcgctggcggcgttgccgtgatccgcgttggcggttcgacggaagttgaagtgaaggaaaagaaggaccgcatcgacgacgctctcaacgcgacgcgcgctgctgttcaggaaggcatcgtaccgggcggcggcgttgccctgctgcgttcttccacgaagatcaccgtcaagggtgtgaacgacgatcaggaagccggcatcaacatcgtgcgcaaggctctgcagtctctggttcgccagatcgcagaaaacgctggtgatgaagcttccatcgttgttggcaagatcctcgacaagaacgaagacaactacggctcccaacgcccagaccggcgaatatggcgatctgatcgctctcggcatcgtcgacccggtcaaggttgtacgtaccgctctgcagaacgcagcttcggttgcttcgctgctgatcaccaccgaagcgatgatcgccgagcttcctaagaaggaatcggcaatgccgcagatgcccggcggcggcatgggcggcatggacttctaa

SEQ ID NO: 38124 - DNA, 1028 bp, Agrobacterium tumefaciens
atggtttggcaaccggccgaaaaccgatacgcatccatgaaatacaatcattgcggcaagaccggcctgaaactgccggcgatttcgctcggcctctggcacaatttcggcaacgacacgccgcaccagacgaaacaggctatttgccgccggccttcgatctcggtatcacccatttcgatctcgccaacaattacggcccaccgcccggtagcgccgaaaccgccttcggtgaaatcctgaagacggatttcagaggctaccgtgacgaaatgatcatctcgtccaaggccggttacaacatgtggcccggcccttatggcgaatggggcagccgcaaatatctgatctcatcctgcgaccagagccttaagcgcatggggctggactacgtcgatatcttctattcccaccgtttcgaccctaacacaccgcttgaggaaacctgcggcgcgctggaccagatcgtgcgctccggcaaggcgctctatgtcggcatctcctcctacaactcgaagcgcacccgcgaggccgccgctatcctgaaggatctcggcacgccctgcatcatccaccagccgagctattcgatgatcaaccgctggatcgaggaagacggtcttgtcgatacgctggaagaactgggtatcggctccatcgtcttttcgccgctggcgcagggcatgctgacgacgaaatatctgggcggtgtgccggatggcagccgtgcctcacagagcaagtcactcaacccggccttcctcaacgagcgcaatgtcgaaaacatccgcgcgctgaacagcattgccgagcggcgtggccagacgctggcgcagatggcaattgcctgggttctgcgcggcggccgcattacctcagcattgattggcgcaagccgtgtcgaacaggtcgaggactgcgtgaaagcactcgataatgccgagttctctaccgaggagctggccgaaatcgaccgttacgccaaggatgcggatatcaacctctgggcaaaatctgccgaacgcgtc

SEQ ID NO: 38125 - DNA, 1314 bp, Agrobacterium tumefaciens; identical to SEQ ID NO: 35264

SEQ ID NO: 38126 - DNA, 726 bp, Agrobacterium tumefaciens
tttaccaacagaaccatcgttgtcgccggggccggccgggatatcggccgggcatgcgccatccgtttcgcacaggaaggcgccaatgtcgttcttacctataatggcgcggcagagggcgcggccacagccgttgccgaaatcgaaaagcttggtcgttcggctctggcgatcaaggcggatctcacaaacgccgccgaagtcgaggctgccatatctgcggctgcggacaagtttggggagatccacggcctcgtccatgttgccgacggcctgatcgcccgcaagacaatcgcagaaatggatgaagccttctggcatcaggtcctcgacgtcaatctgacatcgctgttcctgacggccaagaccgcattgccgaagatggccaagggcggcgcgatcgtcactttctcgtcgcaggccggccgtgatggcggcggcccgggcgctcttgcctatgccacttccaagggtgccgtgatgaccttcacccgcggacttgccaaagaagtcggccccaaaatccgcgtcaacgccgtttgccccggtatgatctccaccaccttccacgataccttcaccaagccggaggtgcgcgaacgggtggccggcgcgacgtcgctcaagcgcgaagggtcgagcgaagacgtcgccggtctggtggccttcctcgcgtctgacgatgccgcttatgtcaccggcgcctgctacgacatcaatggcggc

SEQ ID NO: 38127 - DNA, 1407 bp, Agrobacterium tumefaciens
  unsure (1)..(1407): unsure at all n locations
gaattgagcgaacacgatatcggggaattgcggttctcgttgaagaacaggctgggtgaggctctactgttgacctctcaggaagacatgctgcgttattgccgcgactggcacggcgacgtcaccagctcggccgtggccgtcatccgcccccgctcaaccaaggaagtgtccgatacggtgatcgcctgcgccgaactcggcctcgccatcattccccagggcggaaatacggggctggtgctcggcggcattcccgatgcgcccaaacatcaggtggtgctaagccttgagcgtatgaacgcgatccgcaccatagacagcgatgatttttcggccgtagtcgaagccggctgcatcctctcggaattcaaggatgcagttcaggacaagggcatgtttttcccgctgtcgctcggcgcgcagggcagctgccgcattggcggcaacgtctccaccaatgccggcggcatcaatgtcctgcgttatggcatgacccgcgaactggttttgggtcttgaagtggtcctgccggatggcaccatctggaatggcctgtcgaccctgcgcaaagacaatcgcggcatcgacctgaagcagcttttcatcggtgcggaaggaaccctcggcatcatcaccgcggttgccgtcaaactttaccccaatcccgaacatgtcgagacggcgctgctcggcctcaattcgcttgatgacgccatcaagctttaccgccgcgcccgccgcgaatgctgcgacctcatgtccgcattcgaattcatgccgcccgtcgccttcacgctggcgatcgaggctattcccgatctgaagatgccgatcgccggcgattatcccgcctatgtgctgatggagatttccggctcagggctggtggatacggccgaccttatggggcgtttcctcgagggcgtgatggaagatggcctggtgctggacggcgtcatcgcttcctcccgcgcgcaggcgcagtcgctctggctgttccgcgagggcatgaacgaaggccaggcgctgcgcggcagccatatgcgcaccgatatctcggtgccgctctccaaactcgcggctttcgtggcccaggcggaagccgaactggcggaaaaactccccgaatgccttgcggtttcntacggtcacgtcggagacggcaatgtccacctcaacgtgctgccgcccaacggtgcaacactggaggagcgtgaggcctttatctacaagtccaagacactcgtgaacgaagtcctcgaccgttacgtcggcagcatcagtgccgaacacggcattggccgcctgaaacgctccgatttcgaaagccggctatcggatgtgcagcgtcggatgatcacgggtttgaaaaatgccttcgatcccgatttgcgaatgaatccc

SEQ ID NO: 38128 - DNA, 2636 bp, Agrobacterium tumefaciens
atgcatattctcgccaccacatcctcgtctctggacgacctgatcgagccggttgatctcaaccagccgcgttcggatgtggtggtgctgtctttttcggcaagcgatcttgccgggcttgagcgggcgtggggaaaggcgggagagaccctcccctccctctctgccgcgaacctctccgaacttcggcacccgatgtcggtcgatctctggatcgaaaaaacggcggaacatgcccgcgttattcttatccggattctcggaggcgcggagcgctggcgctatggggtcgatcagctggctattctggcgcgcaggcggggcatcaagcttctgcttttgccgggggagtgcagtgaaagggatgaaaagctcgaggcggcctcaactgtcgataagccgatgctggcctccgttctctccttcttccgcgaaggtggaagggagaatatgggccgccttgccgctggcctttctgttctggcgggcggtggagaatggccggatataaaggctgaccccctgccgaaagccggcttctatcggccggatctgggtgtcgttgggcaggacgaggcttgtgccgggttccctgccggtgcgtccgttctgcccatcctcttttaccgctccatgcttctggcggaagatgctgcacccgtcgatgcgctgtttcaggcgctctctgcgcgcgggtttgcacccctgccgattttcgtcagcgggttgaaggatggggaagcgatccgttttcttgaaacggtgctgcccgctctccagcccgccgccatcatcgccgctacggcctttgccagccatacggatgataggggcgagacgttgttcgaccgtctcggcgttccggttttccaggcggtgatggcgaccacccggcgcgtcggctgggtggaaaacgcgcgcggcctcaatccgtccgatcttgccatgcatgtcgtcttgcctgaactggacgggcggattctcaccggggcgatttcgttcaaacaggcgcggacagatggcggtgtcagtcttgtgaatgtgccggaggcggatcgtatcgagcaggtggcgaaccgcatcgcggcctttctgcgactgaaatctgcgccaccgcgggatcgccgcatcgtcattctgatgccggattatcccggtgccgcgccggggcgcaccggttatgccgttggtctcgatgtgccgcaaagcgtgctcgaaatgctgcgcgatctcgccgaggccggttatgcggtggaggatattcctgaaacggcgcgggcgctgctcgatcgtatcgagagccaggaagcgaccgtcgatctttccacctatcgggatttttttgcaggtttgactgagaccgcctccagctcgatgaatgcgacgtggggagctgcggaacaggacgacgcttttgccgatggcgctttccattttcgcgttgcccgcttcggccaggtcttcgtcgcgctcgcgccggatcgggggcggaacgaggatcggcgggtggattatcacgaccctgccctgccgccacgccacgcgctcgtcgccttcggcgcatggatgcaaagtgttgtggcgacgcatgccatcgtgcatgtgggcgcgcatggcacgctggaatggttgccgggcaagacggttgcgctttcccgcgattgtttcccggaaatcgtcaccggcccgctgccggtggtctatccattcatcgtctccaaccccggtgaggcggcggttgccaagcggcgcatcgcggcggttaccatcggccatgtgccaccggtgcttgtcaatgccgggctttcgccggaacagttggcgctggaacagctggtcgatgaatatgcgcaggcggatggccttgatcgtcgccgccgtgaccggctggcgaagctgatcgttgaaaaggcgctggaaaccgggctggcggccgaagcgggcgttggcgcgaaggatgatgccgatgcggccctttcacgcattgatgcctttctctgcgacctcaaggattttgccatcaaggacggtcagcatgttttcggtcgttcccccgaaggcgaggccgatcctctccgtcttcagagcgcgaaggccgagaaagccgcgctgcttgcggcgctcgatggccggcacatcgcccccggtccttccggtgcacctgcgcgagggcgtctcgacgtgctgcccaccggccgcaacctttatgctgccgatccccgtaccatgccgacgccgacagctttcgatctgggccgcatggcgggcgaggaagtgcttcgccatcatctgcagtcccatggtgattggccgaaacatctggtgttcgatctctggggcagtgccagccttcgcaacggcggcgaggatgtggcgcaggcgctgcatctgatgggggcaaggccaatccatgatcctgccacgggccgggtcaccggcatcgaggttctgccaccggcgagcctcggccgcccgcgggtcgatgtgacgtttcgcatttccggccttttccgcgacatgtttccggcgctcatcgcgcttctcgatgcggccgccaaggcggttgcgcggcgggacgaagcgccggccacaatccgctgcggaagagcggcagcgctgggcatattccgcgcgct

SEQ ID NO: 38129 - DNA, 975 bp, Agrobacterium tumefaciens
cacggcggcaatctcggcaaggcgcgcctgatgtttcggcaagcacctgaaccgtggatcgacctttcgaccggtatcaatccgcactcctacccgcattcgcccattcccgccagcgcattcgcccgcctgccggaacccggcgccgccgaggagctgaaacagctggcggcggcccatttcggcgcgccttccgcgcagcatgtcacgctttctcccggcacccagatgttgatgccgctgctggcgcagatcgccatcaatcgtggagcccaaagcggtgccgtgctttcacccgcctatgcggaacatgcccgcaccgcccgcatggcggggctgaccgtcaccgaagtggaaaacatcggcgatctctcagcttacggctatgcggtggtggtcaatcccaacaatcccgatggtcgcatcacggaccgcgaagctttactcgcgctagccggaacgataggccgcaaaggcggtctgctcgtcgtggatgaagccttcatcgaaacgggcggggccgaaagcctggcggttgcaaccaatggcgaagcgctggtggtcctgcgatccttcggaaaattttacggcatggcgggcgtgcgcctgggtttcgcaattgcgcatcccgagatcgctgccgaactggaagcgaggcttggcccctgggcggtttccggtccggcactgcatatcgcgacagaagctctggcggacagggagtggcaatcatccatgcgtctacggctcgcggaggaagcgaggcgcatgaacgagttgctggaaaaggcaggactgaaaatcgccggcggcacttccctgttcacgctggtgcgggacgagcgcagcagggcactgttcgggcatctcggccgtcgcggcattctggtgcgcatctttgacgaaaggcctgatgacatgcgtttcggccttcccggcagcgaagcggattggcagcgcgtcgaagaggcgctg

SEQ ID NO: 38130 - DNA, 915 bp, Agrobacterium tumefaciens; identical to SEQ ID NO: 35220

SEQ ID NO: 38131 - DNA, 1203 bp, Agrobacterium tumefaciens; identical to SEQ ID NO: 35158

SEQ ID NO: 38132 - DNA, 1404 bp, Agrobacterium tumefaciens
tcctccgatatccttgaccgcttcaccgccatcgttggcgaaaaaaatgcggtgcgcgacctggcggaaatggcaccgcgcctggtggaaaatcgcggactttatcgcggcgcttcccccctgctcctcaagcccggttccgtcgaggaggttgccgccatcctgaagctcgccagcgagaccggcacgcccatcgtgccgcaaaccggcaataccggccttgtgggcggccagacgccgcgcgctgacggcaccgatatcatcctatcgctggagcgcatgaaccgcatccgcgacatcgatcccgttgccaatatcatcgtcgccgatgccggctgcattcttgacgacattcacaaggccgccagctccgtggagcgcatgttcccgctatcgctcggttctcaaggctcctgccgcatcggtggcaatctcgccaccaatgcaggcggaacggcggtgcttgcctatggcaatatgcgccagctgtgcctcgggctcgaagtggtcctgccaaccggcgaaatctggaacgggctgcgccggctgaaaaaggacaatacgggttacgatctgcgcgatctcttcatcggctccgagggcacgctcggtgtcatcaccggcgcggtgctgaagcttttccccaagccgctcggccatcaggtcgcttttgccggtcttgcctccaccgaggatgccctgaaactgttcgaaatggcctccaacctctgcggcacggcgctgaccggctttgaactcatgccacgaatcggcgtcgagttcaccgccaggcacattcccggcgtgcgcgaccctctggggcagccgcatgactggtacgcgctcatcgatatctccacctccgattcggccgagacggcggacacgatgatgcaatcgctgctggagcgtggttttgaggccgggctggtcgaggatgcggtgatcgcctcatcggaagcgcagcgtcaggcgctgtggcacatgcgtgaaagcatgtcggacgcgcagaagccggagggcggatcgatcaagcatgacgtttccgttccggtgtcgaaaataccggaattcatgactactgcggaaaaggccgtgctcgccgccattcccggcgcccgcatctgcgccttcggccatctcggcgacggcaacatccactacaatatctcccagccagtcggtgccgacaaggccgaattcctcggccgctggcgagacatgaacgagatcgtgcacggtatcgtgctgtcgctcggcggctcgatttcggccgaacatggtatcggccagctgaagcgcgacgaactggccgccatccggcccggcattgaaatggagttgatgcatcgcatcaagcacgccttcgaccctgcgggtatcatgaaccccggcaaggttttg

SEQ ID NO: 38133 - DNA, 306 bp, Agrobacterium tumefaciens
ttcctgaaaaagctggaggtgaagacaccaagcctcagccagacggtcggcaatctgtccggcggcaaccagcaaaaaatcagtgtcgccaaatggctcgccgccgatgtcaaactgctgatcgtcgacgaaccctccgtcggcatcgacatcaagaccaaggcctatctgcatgatctgctgcgcgagctggcagataacggcaccgccattctcgtcattaccagcgacatgccggaaatggtggcgctggccgatcgcatcgtcgtgatggaccaatacagagtgaaaggcatcgtggaaaac

SEQ ID NO: 38134 - DNA, 552 bp, Agrobacterium tumefaciens
acgctctgggcaagcccagttcggcgacttcgccaacggcgcgcaggtggtgttcgaccattgcatgtgctcgggtgaacgcaagtggctgcgcatgtccggtctcgtctgccttctgccgcatggttatgaaggccagggcccggaacattcgtccgctcgtctggaacgctggttgcagatgtgcgccgaagacaatatgcaggtcgccaacgttacgacgccggctaactacttccatatcctgcgccgccagatgaagcgtgacttccgcaagccgctgatcctgatgacgccgaagtcgctgctgcgtcacaagcgcgccacctcgtctctggcggaactggccggcgagtcctccttccaccgtctcctgtgggacgatgctgaagtcatcaaggacggcccgatcaagctgcagaaggatgcgaagatccgccgtgtcgtcatgtgcaccggcaaggtctattacgatcttctcgaagagcgtgaaaagcgcggtatcgacgacgtctacctgctgcgcgtcgaacagctttatccgttcccggc

SEQ ID NO: 38135 - DNA, 168 bp, Agrobacterium tumefaciens
cctttgcttggtgtccgcgacctctcagtccgatatcacagccggagcggtgaagcggttgccgtcgagaacctttccttcgacatcgccgccggcgaggctgtcgctctggtcggcgaatccggttgcgggaaaagcacgactgcccttgcgctgtccaacctcctg

SEQ ID NO: 38136 - DNA, 1313 bp, Agrobacterium tumefaciens
gaaaatggcggcatcatcctgttcatcgatgagatgcacaccctggtcggcgccggcaaggccgatggcgccatggatgcgtccaacctgctgaaacctgcgcttgcccgcggtgagctgcactgcgtcggcgccaccacgctcgatgaatatcgcaagcatgtggagaaggatccagcccttgcccgccgtttccagcccgttctggtggatgaaccgaacgtcgaggatacgatctcgatcctgcgcggtctgaaggaaaaatacgaacagcaccacaaggtccgcatctcggattcggccctggttgcggctgcgacgctttccaaccgttacattaccgaccggtttctgcccgacaaggcaatcgacctgatggacgaggccgcttcgcgtcttcgcatgcaggtggattccaagccggaagaactggacgaactggatcgtcgcatcatccagctgaagatcgagcgcgaagccctgaagcaggaaacggaccagtcctccgtcgaccgtttgaggaagctcgaggacgaactggccgatacggaagaaaaggcagatgcgctgacggcccgctggcaggcggaaaagcagaagctcggccacgccgccgacctgaagaagcggctggatgaagcccgaaacgaactggcaatcgcccagcgcaatggccagttccagcgtgccggcgagttgacctacggcatcattcccggcctcgaaaaggaactggcagcggcggaagcccgcgatagcagcggtgccggttcgatggttcaggaagtggtgacgccggacaatattgcccatgtcgtctcccgctggaccggcattccggtcgacaagatgctggaaggccagcgcgaaaagctgttgcgcatggaagacgagctcgccaagtccgttgtcgggcagggtgaggccgttcaggcggtgtccaaggcggttcgccgttcgcgcgccggcctgcaggatcctaaccggccgatcggttcgttcatctttctcggcccgacgggtgtgggcaagaccgagctgaccaagtcgctcgcccgcttcctgttcgacgacgaaaccgcgatggtccgcctcgatatgtcggaatatatggagaaacactccgttgcccggctgatcggtgcacctccgggctatgtcggctacgaagagggcggtgccctgacggaagcggttcgccggcggccctatcaggtcgtgttgttcgatgagatcgaaaaacgcatccggatgtcttcaacgtactgctgcaggtgctggatgatggccgcctgaccgatggccagggccgc

SEQ ID NO: 38137 - DNA, 1356 bp, Agrobacterium tumefaciens
ctggcaaaacccgctgaggagactccgctgatcgccgcgcagggtgtgcgcctgctccatgaggcgggcgttccgcaagacgccgtgcagcttctgccgggcgatggcaagacgggtgcggcgctggtcggctcaccactgacggcgggcgtgatgttcaccggctccactgaggtggcgcggctcattcaggggcagcttgccggccgggttctggccaatggccagccggtgccgctgattgccgagaccggtggtcagaacgccatgatcgtcgattcctccgcgcttgccgaacaggttgtcgccgatgtcatcgcgtctgccttcgacagtgccggacagcgctgctcggcactgcgcatcctctgcctgcaggaagatgtggcggaccgcacgctgaccatgctgaaaggcgcgctgcacgaattgcgcatcggccgcacggatcagctctccgtcgatgtcggccccgtcatcaccgccgaggccaagggcatcatcgaaaagcatattgacggcatgcggtcgctcggtcaccgcatcgagcagattgcgcttgcgggggaaaccggcaagggcaccttcgtaccgccaaccatcatcgagatgaaatcgctcgccgatctgaagcgcgaggtcttcgggccggtgctgcacgtcatccgcttcaagcgcgatcatctcgaccggctgatcgatgagatcaacgccaccggctacggcctgaccttcggcctgcatacgcgtctcgacgatacgatccagcatgtgctctcccgcgttgcggccggcaatctttatgtgaaccgcaacatcatcggcgcggtggtcggtgtgcagccctttggcggacgcggcctttccggcaccggccccaaggccggcggtccgctttatctcggccgcatgacggagaaagcgccaaagatagaccgcatcgccagccagcaggatcaggctgcggtcgatctcgcccgctggctggatgaaaatggtcagactgttgcggcagaagccgcacgccaggcggctgcgctttcaggccttggctttgagaccgagctggccggccccgtcggcgagcgcaatgtctatgcgctgcatccgcgcggcaagatcctgctggtgccggcaaccgaacaggggctttaccgtcagcttgcggcagcgctatctaccggcaactctgttgtcatcgacaatgcttcgggactggaaaaggcgatctacggcctgccggcaagcgtgacctcgcgcatcgtctgggcggatgactgggaaaaatcggcacccttcgccggtgcgctggtcgagggcgatgcggaacgcgtggttgcgatcaacaggaagatc

SEQ ID NO: 38138 - DNA, 720 bp, Agrobacterium tumefaciens; identical to SEQ ID NO: 35042

SEQ ID NO: 38139 - DNA, 876 bp, Agrobacterium tumefaciens; identical to SEQ ID NO: 35120

SEQ ID NO: 38140 - DNA, 1090 bp, Agrobacterium tumefaciens
ggcaaggttacccaggttatcggcgctgttgtcgacgtggcgttcgaaggcgaactgcctccgatcctgaacgcgctcgaaacacagaacaatggcaaccgcctcgttctggaagtcgcgcagcatctcggcgaaaacgtcgtgcgcacgatcgccatggactcgaccgaaggtctggttcgcggtcagtccgttgctgacacgggcgcaccgatcgaggttcctgttggtctggaaacgctcggccgcatcatgaacgtcatcggcgagccggttgacgaagccggtccgatcgtaacggccaagaagcgcgccatccaccaggacgcaccgtcttacgtcgagcagtcgacggaaggccagatcctcgtcaccggcatcaaggtcgtcgaccttctcgctccttacgccaagggcggcaagatcggcctcttcggcggcgccggcgtgggcaagacggttctcatcatggaactgatcaacaacgtcgccaaggcgcatggtggttactcggtattcgccggcgtgggtgagcgtacccgcgaaggcaacgacctttatcacgaaatgatcgagtcgaacgtcaacaagctcggtggcggcgaaggctccaaggctgcgctcgtgtacggccagatgaacgaaccgccgggcgcccgcgctcgcgtcgctctgaccggtctgacgatcgctgaaaacttccgtgatgaaggccaggacgttctgttcttcgtggacaacatcttccgcttcacgcatgctggttctgaagtgtctgctctgctcggccgtattccttcggccgtgggttaccagccgacgctggcaaccgacatgggccagatgcaggaacgcatcaccaccacgaacaaggttccatcacctcggttcaggcaatttacgttcccgccgacgacttgaccgacccggcgccggcaacctcgttcgcgcatcttgacgcaacgacggttctgtcgcgttcgatcgctgaaaaggtatttacccggctgttgacccgctcgactccacctcgcgcatgctctacccgatgattctcggcgaggagcactacgaagttgcccgttagggt

SEQ ID NO: 38141 - DNA, 750 bp, Agrobacterium tumefaciens; identical to SEQ ID NO: 35359

SEQ ID NO: 38142 - DNA, 634 bp, Agrobacterium tumefaciens; identical to SEQ ID NO: 37869

SEQ ID NO: 38143 - DNA, 1434 bp, Agrobacterium tumefaciens; identical to SEQ ID NO: 35289

SEQ ID NO: 38144 - DNA, 672 bp, Agrobacterium tumefaciens; identical to SEQ ID NO: 37855

SEQ ID NO: 38145 - DNA, 879 bp, Agrobacterium tumefaciens
ttcaagggatcaattcccgccctcattaccccgttcacggacaatggttccgtggacgaaaaggcctttgccgcccatgtggaatggcagatcgccgaaggcagcaacggccttgtgcccgtgggcacgacgggggaatccccgacgctctctcacgatgagcacaaacgggtcgttgagctgtgcatcgaggttgcggcgaaacgggttccggtcattgcgggtgctggctccaacaataccgatgaagcaatcgagcttgcgctgcacgcgcaggaggccggtgcggatgccctgctggtcgtcactccctattacaacaagccgacgcagaagggcctgttcgcgcatttttccgctgtcgccgaagcggtgaaactgccgatcgtcatctacaatatcccgccgcgctcggtggtggacatgtcgccggaaaccatgggtgcgctggtcaaagcgcataagaatatcatcggcgtcaaggatgcgaccggcaaactcgatcgggtttccgaacagcgcatttcctgcggcaaggattttgtccagctgtcgggcgaggatggcacggcgctcggctttaacgcccatggcggcgtcggctgcatttcggtcaccgccaatgtcgcgccgcgcctttgttccgagtttcaggcggcaatgcttgccggtgattacgccaaggcgcttgagtatcaggaccgcctgatgccgctgcacagggcgatcttcatggagcccggcgtctgcggcaccaaatatgcgctgtcgaagacacgcggcggcaatcgccgggtccgttcgcccttgatgagcacgctggaaccggcaacggaagcggcgatcgatgcggcgctgaagcatgccggcctgatgaac

SEQ ID NO: 38146 - DNA, 294 bp, Agrobacterium tumefaciens; identical to SEQ ID NO: 35446

SEQ ID NO: 38147 - DNA, 876 bp, Agrobacterium tumefaciens
atggatatccgcgccgcggaaatttccgcaattctgaaagatcaaatcaaaaatttcggcaacgaggcggaagtctcggaagtcggtcaggtgctttccgtcggtgacggtatcgcccgcgtttatggcctcgacaatgttcaggccggcgaaatggtcgagtttcccggcggcattcgcggcatggcgctcaacctcgaagccgacaacgtcggtgtggttatcttcggctcggaccgttccatcaaggaaggcgacaccgtaaagcggactggcgctatcgttgacgttcccgtcggtccggaactgcttggccgcgtcgtcgacgcgctcggcaacccgatcgacggcaagggcccgatcaatgccgccaagcgttcgcgcgttgacgtcaaggctcccggcatcattccgcgcaagtcggtccatgagccgatgtcgaccggcctcaaggccatcgacgcgctcatcccggttggccgcggccagcgcgagctcgtcatcggcgaccgccagaccggcaagaccgccatcattctcgacacgatcctgaaccagaaggccattcacgacaatggtcctgacggcgacaagctttattgcgtctacgtcgctatcggtcagaagcgttcgaccgttgcccagttcgtaaaggttctggaagaacgcggtgcgctgcagtactcgatcatcgttgccgcaacggcttccgatccggctccgatgcagtacctcgctccgtttgccggttgcgccatgggcgaatatttccgtgacaacggcaagcacgatctcatcggttacgacgacctttccaagcaggccgttgcctatcgtcagatgtcgcttctgctgcgtcgtcctccgggccgcgaa

SEQ ID NO: 38148 - DNA, 540 bp, Agrobacterium tumefaciens; identical to SEQ ID NO: 35122

SEQ ID NO: 38149 - DNA, 846 bp, Agrobacterium tumefaciens
gaaaacaacattttcgatctttttgtcatcggtggcggcatcaatggctgcggcattgcccgcgatgcggtgggcagggggtattccgtggcgcttgcggaaaagggcgattttgcctctggcacctcgtcagcggccaccaagctcatccatggcggcttgcgttacctcgaacattatgaattccgcctcgtacgcgaggcgctgatggaacgggaaatcctctgggccatggcgccgcatgtcatctggcccatgcgtttcatcctgcccgtgcagaagggcggcgtgcgtccatcatggatggtccggctcggcctgtttctttatgacaatctcggcggccgcaagctcttgccgccgacgcggacgctcgatcttcgcaaggacccggctggcaaaccgctgaagcctgttttcgccaaggctttcgaatattccgacggctgggtggatgatgcccgtttcgtggttctcaatgcacgcgatgcggcggatcgtggcgcgacgatcatgaaccgcacacgggttgtttcggcgcggcgcgaaggcaggctgtggctcatcgagacgctggacgaaaaaaccggccggccggccatgcacaaggcccgcatgctggtcaatgccgccggcccgtgggtggacaatgtgctgtcaggtgtgttcggccgcaatgacgtgcacaatgtccgcctcgtgcagggtagccacatcatcgtgcgcaggaagttttccgatccgcgcgcctatttcttccagaatccggacaaccgcatcatcttcgccattccctatgagcaggattttacgctgatcggcaccacggaccgcgactataagggc

SEQ ID NO: 38150 - DNA, 1377 bp, Agrobacterium tumefaciens
  unsure (1)..(1377): unsure at all n locations
atgaccgatccccaaacgcttgcagcccgtttccccggtgatttcctgttcggcgtcgcgaccgcctcgttccagattgagggtgcaaccaaggcagatggccgcaaaccctccatctgggatgccttctgcaacatgccaggccatgtcttcgggcgtcacaatggcgatatcgcctgcgatcattacaatcgctgggaagaggacctcgatctcatcaaggagatgggtgtcgaggcctatcgtttctccatcgcctggccgcgcatcattcccgacggtttcggaccgatcaacgaaaagggtctggatttttacgaccgactggttgatggctgcaaggcgcgcggtatcaagacctatgcgacgctttaccattgggatctgccgctgaccctgatgggcgacggcggctgggcctcgcgctccaccgcccatgctttccagcgttacgccaaaaccgtcatggcccgtctgggcgaccggctggatgcggtggcgaccttcaacgaaccctggtgcgcggtgtggctcagccatctctacggcatccatgcgccgggcgagcgcaacatggaggcggccttagcggccatgcaccacatcaatctcgcccatggtttcggcgtcgaggcgtctcgccatgtagcgccaaaagtgccggtggggctggtgctgaacgcccattccgncattccggcttctaacagcgaggccgatctcaaggctgccgaacgggcgttccagttccacaatggcgcgtttttcgatccggtcttcaagggcgaatatccggccgagatgatggaagcgcttggtgatcgcatgccagtcgtggaggcggaagacctcgccatcatcagccagaagctcgactggtggggcctgaattattatacgccgatgcgcgttgccgacgacgcgacgccgggtgctgaattccccgccacgacgccggctccggcggtcagcgaggtgaagaccgatatcggctgggaggtctacgccccggcgctcaagtcgctggtggagacactctacaagcgttacgacctgccggaatgctacattaccgaaaacggcgcctgctataatatgggcatcgaaaacggcgaggtgaatgaccagccgcggctcgattattacgccgaacatctcggcatcgtcgccgatctcatccgcgacggttacccgatgcgcggatatttcgcctggagcctgatggataatttcgaatgggcagagggctatcgcatgcgcttcggcctcgtgcatgtggattatgacacgcaggtgcgtacgctgaagaacagcgggaagtggtatagtgctttggcttcgcgttttccgaaggggaaccatggtgtggtgaagggg

SEQ ID NO: 38151 - DNA, 2611 bp, Agrobacterium tumefaciens
ggcgtgcacaccggcgacagcatcaccgttgcctcctgctttgacgctgatcgacaaagaataccagatgatgcgcaacgcatcgattgcggtgttgcgcgagattggcgtcgagaccggcggctccaacgtgcagttcgccgtgaacccgaaggatggccgtctggtcgtcatcgaaatgaacccgcgcgtttcccgctcctcggctcttgcttccaaggcaaccggcttcccgattgccaaggtcgccgccaagctcgctatcggctatacgctggacgagctggaaaacgacatcaccggcggcgccacgcctgcgtccttcgagccctccatcgactacgtcgtcaccaagatcccgcgtttcgccttcgagaaattcccgggcgcctcgccgatcctcaccaccgccatgaagtcggtcggtgaagtcatggccatcggccgtacctttgccgaatcgctgcagaaggcgctgcgtggcatggaaaccggcctcaccggtctcgatgaaatcgaaatccccggttacgaggaaggcgaaggttccaagaacgccatccgtgccgccatcggcacaccgacgcccgaccgcctgcgcatggtcgcacaggcgatgcgcatgggaatgagcgaagaagaggtccacgaaaactcgaagatcgatccgtggttcatcgcccagcttaaggccatcgtcgacatggaggcccgcattcgcgagcatggcctgccgcaggatgccgaaaacctgcgcatgctgaaagccatgggcttctccgacgcccgcctcgccagcctgacgtccaagcgcccgaaggaagtggccgagctgcgtaacagcctgaacgttcgcccggtcttcaagcgcatcgacacctgcgctgcagagttcgcttcgcccactgcctacatgtattcgacctatgagacgcccttcgtcggcgctgcccgctcggaagcgcaggtttccgaccgcaagaaggtcgtcattctcggcggcggtccgaaccgtatcggccagggtatcgagttcgattattgctgctgccacgccgccttcgccctgaaggatgccggcttcgaagccatcatgatcaactgcaacccggaaaccgtttcgacagactacgacacctccgaccgcctctatttcgagccgctgacggccgaagacgtgatcgagatcatgcgcgccgagcaggaaaagggcgagctggtcggtgtcatcgtgcagttcggtggccagacgccgctgaagctcgccgaagcgctggaaaagaacggcatcccgatccttggcaccgcgcctgacatgatcgaccttgccgaagaccgcgaccgcttccagaagctgctgatgaagctcgatcttgcccagccgaacaatggcatcgcctattcggtcgagcaggctcgcctcgtcgcctcggaaatcggtttcccgctggtcgtgcgtccgtcctacgtgctgggtggccgcgccatgcagatcatccattcggaaggccaactccagacctatctgctcgacaccgttcccggtctcgtaccagaggatatcaagcagcgttacccgaacgacaagaccggtcagatcaacaccctgctcggcaagaacccgcttctgttcgacagctacctgaccaacgccgtcgaagtcgacgtcgatgcgctgtgcgacggcgaaaacgtcttcgtctcgggcatcatggagcacatcgaagaggccggcatccattcgggcgactcggcctgctcactgccgtcccgttcgctcagcaaggaaaccctcgatgaactggaacgccagacgacggcgcttgccaaggcactcaaggtcggcggcttgatgaacgtgcaatacgccatcaaggacggcacgatctacgttctcgaagtcaacccgcgcgcctcgcgtaccgtgccttttgttgccaagaccatcggcgcgccgatcgccaagatcgccgcccgcgtcatggccggcgagaagcttgatgcggcgattgccgcttatggcgagaagcccgatccgcgcaacctgaagcacatcgccgtcaaggaagccgtcttccccttcgcacgcttccccggcgtcgacatcctgctcggaccggaaatgcgctcgaccggcgaagtcatcggcctcgacaccgatttcgcactggccttcgccaagagccagctcggcgccggcgtcgacctgccgcgctccggcacggtcttcgtttcggtgcgtgacgaggacaaggaaggcgtgctttccgccatccgcattctcgtggaaagcggcttcaaggtgctggcaaccggcggcacccagcgtttcctcgccgaacagggcatcaacgccgaaaagatcaacaaggtgcaggaaggccgtccgcatatcgaggacgccatccgcaaccgtcaggtccagctggtcatcaacaccaccgacagcaacaaggcgatctcggatagcaagtcgctacgccgcgcaacgctgatgcagaaggtgccttactacacgacgatggccggtgcggaagcagcagcgcttgccatcaaggcgctgaaggccggcaatctggaagtgaagccgctgcaaagctacttcaactaa

SEQ ID NO: 38152 - DNA, 510 bp, Agrobacterium tumefaciens; identical to SEQ ID NO: 35476

SEQ ID NO: 38153 - DNA, 1185 bp, Agrobacterium tumefaciens
gcctacaagccgaagcttttgatcgccgacgagccgacgacggcgctcgacgtcaccattcagggccagattctcgacctcatcaagcaattgcaggaagaggagggcatgtcggtcctgttcatcacccatgatatgggtgtggtggcggaagtggcggaccgtaccatcgtcatgttccgtggcgatgtggtagaaaccggcacgacggatgacatcttccatcgcggccagcatccctatacgcgcgccctgctttcggcggtgccgaagttgggctcgatgaggtcgcggttgctgcccgcccgtttcccgattatcgacatcaagaccggcgagagcccgccggtggtggagacgaaggacacggtgtcaggcggcaagacgcccattctctcggtcaaggacctgacgacgcgtttcgatatccgttccggccttttcggccgcaaatccggcgccgtgcatgcggtggagaaggtttcctttgatctcgcagaaggtgaaaccctgtcgctggtcggcgaatccggttgcggcaagtccaccacgggccgatcgatcacccggctgatcgagccgacatcgggtaatgtcacgcttgatggttacgaggtgctgaaactcgaccgaacgacgctgcggaccatgcgccgcagcgtgcagatggtctttcaggatcccttcgcttcgcttgatccgcgcatgagcgtcggcaccgcgatcatggaacccttcatggagcaccgcctcggacagaaagcgcaggcgcgcgaaaaggcggcggatttgctggaaaaagtcggcttgagccccgacatgatgaagcgtttcccgcatgagttttccggcggccagcgccagcgcatcgccattgcccgctcgctgatgctcgatcccaaggtcatcgtcgccgacgaggcggtttcggcgctcgatgtctcgatcaaggcgcaggtctgcaacctgctgctcgacctgcaacagagcctcaatctggccttcctgttcatttcccatgacatggcggtcgtggaacgcgtcagccatcgcgttgcggtgatgtatctcggcgagatcgtcgaaatcggcccgcgcgcagccgtcttcgacaatccgcagcatccgtacacgaaaaaactgatgtcggccgttccggtgccggatccggcccgacgccagatc

SEQ ID NO: 38154 - DNA, 1176 bp, Agrobacterium tumefaciens; identical to SEQ ID NO: 35287

SEQ ID NO: 38155 - DNA, 1497 bp, Agrobacterium tumefaciens; identical to SEQ ID NO: 35358

SEQ ID NO: 38156 - DNA, 873 bp, Agrobacterium tumefaciens; identical to SEQ ID NO: 35276

SEQ ID NO: 38157 - DNA, 819 bp, Agrobacterium tumefaciens
atggcattgaaaagtttcaatccgaccacgccgagccagcgtcagctggttatcgtggaccgcgcttcgctctacaagggcaagccggtaaaggctctcacccagggcctcagctccaagggtggccgcaacaaccagggccggatcaccgtccgtttccagggtggcggtcacaagcggacctatcgtctggtagacttcaagcgtcgcaagtttgacgttgaaggtaccgttgaacgtctggaatacgaccccaaccgcaccgcgttcatcgcgctggttacgtataccgacggcgaacaggcttacattctcgcgccacagcgtctcgctgctggtgacaaggtgatcgcctccgacaaggcagtggacgtgaagcccggcaacaccatgccgcttcagtacattccggtcggttcgatcatccacaacgtcgagatgaagcctggtaaaggcggtcagattgcccgctccgccggtacgtatgtccagctcgtcggccgcgatgccggtatggccatcctgcgtctcaactcgggcgaacagcgtctggtacacggctcgtgccttgcatcgatcggcgctgtttctaactcggaccacggcaacatcaacgacggcaaggccggtcgttcccgttggcgcggcaagcgtccgcacgttcgcggcgtcgtcatgaacccggtcgaccacccgcacggtggtggtgaaggtcgcacgtcgggtggtcgccacccggttactccgtggggcaagcccacgaagggcaagcgcacccgttcgaacaagtcgaccgacaagttcatcatgcgctcgcgc

SEQ ID NO: 38158 - DNA, 906 bp, Agrobacterium tumefaciens; identical to SEQ ID NO: 35395

SEQ ID NO: 38159 - DNA, 1026 bp, Agrobacterium tumefaciens
ctcgcccattatggcgacaggtatggacgcaagcgcgtcttcgccttctccatcctcctgatggcgctctccacactcggcatggcgctgatgccgacctatgccaccatcggcgtggcggccccgatcctgctcatcatcctgcgcatgctgcagggcgccgccatcggtggtgaagtaccgggagcctggacatttgtcgccgaacatgtgcccttccgccgcgttggcctcgcctgcggtttcctcacctccgggctttcgttcggcatcatgctggggtcgctgatcgcctttgcgatcaactcgctcttcacaccggaagacgtggccggctacgcctggcgcatcccgttcctgcttggcggcgttttcggcctcatcgccgtctatctgcgccgttggctggaagagacgccgatctacatggagatgaagaagtcgaagtccctcacggacaagctgccgcttggcctcgtgctgaagcatcacaggcgtggcgtgatcatttccgccctgctgacctgggttctgtcagcggccatcgtcgtcaccacgctgatgacggccaccttcctgcagaagctctacggttacaccccgacgcaggccttagccggtaccagcttcggcacgctgttcctgatcttcggcgtcatcatcgccggagcgctgatcgaccgcgtcggctccggcatctttttcatgggcgccagcatcttcttcggcatcgccaccttcaccttctacagctatgccggcacctcgctcgaaaccatgttcgtgctttatggcgtgatgggcctttcggtgggcatggccggcgccgtgccctatgtcatggtgcgggccttcccggcatcggtccgcttctccggcctctccttcgcctacaacgtctcttatgccgtcttcggcgggctgacaccgattggcgtaacgacggcgcttgccatcaatccgatggcccacgcctggtatctggtcttcatcgccttcctcgccttcgcgatcggcctctacctc

SEQ ID NO: 38160 - DNA, 870 bp, Agrobacterium tumefaciens; identical to SEQ ID NO: 35252

SEQ ID NO: 38161 - DNA, 1236 bp, Agrobacterium tumefaciens
ttcgatatcagcgaaaacgatctattgatcggcggactttcggtgcgcgatatcgttgcagaaaccgggaccccgtgttttctctatgataacagcgccatgcgccaagcctatcgcgatctcgaaacggcgctttccggttttgccgatatctattattcggtgaaggccaatcccctgcccgccatcatctcacttttccgcgaagaaggcgccggcgcggaaatcgcctccgttggcgaatatcgcgccgctgtaaaggccggcgtcgcgcctgataacatcatcttcgccggccccggcaagagcatggccgaattgcgcgaagtgatcgagggcggtatcggtgaaatccacatcgagagtgcggaagaaatcgcccgtatcgaggcgatcaacaggccggtcaaggcgtcgatccgcatcaatccggtgccggatgcgcaggcgggcgccatgcgcatgggcggcaaggccacggccttcggtttcgacgaggaggaactggaaaacgtcctgaagctctttgcgaacgtcagacatatcgatctcgttggtatccatatttacggcggcacgcagatcctcgatgccgacatgcttgtctcccaatggcgacacgccatcgctcttgcaggtcgcatggcgcaaatgctcggcaaaccgctcgaaaccatcgatctcggcggcggcctcggcattccctatttcgccggggaaacatcgctcgatctcgccaaggtggctgccgccattcccgatctcaaggcgcttctaaaggcgcatccgctgatcgccgatgcccatgtcatagtcgaacccggccgcttcctcgccggccctggcggcctctatgtggtagaggtcaactcggtaaagacctcgcgcggcaccaccttcgtggtcacggatggcggcatgcaccaccacctggcagcctccggcaatctcggccagatcgtcaaacgcaactaccccatcgtcgcaccggccatgatgcaggcggcacacgatgagacagccaccatcgtcggcccgctctgcaccccgctcgatacgctcgcccgcaatgcgaccctgccgaaactgaacgccggcgatctcctcgccatcctgcaatccggtgcctatggcgcgagcgccagcccaggcggttttctcagccatacggtagcgaaggaagtgctggtggaggatggtgcgtttgaggtgatcgggcgctgagagagttgcgac

SEQ ID NO: 38162 - DNA, 1533 bp, Agrobacterium tumefaciens
accatcacgcttcatcccggcgccgtgacgcttgccgatcttgccgccatctactgggaaaacggcacggcaaagctcgaccgttccttcgacgccggcattgaaaaagccgccgcccgcatcgcggaaatcgccgccggcaatgcgccggtctacggcatcaataccggtttcggcaaactcgcttccatcaaaatcgacgccgccgatgtggcgacattgcagcgcaatctcatcctgtcgcattgctgcggggtcggcgtgccgctgcctgaaaatgtcgtgcggttgatcatggcgttgaagctggtttcgctcggccgcggcgcatccggcgtgcggctggaactggttcggctgatcgaggccatgctggaaaagggtgtcatccccgtcattcccgaaaagggttcggtcggcgcttccggtgatctcgcgccgctcgcccatatggccgccgtcatgatgggggaaggcgaggccttttatgagggtgcgccgctgcccgccggcgaggcgctcgccaaagccgggctgacgccggtggtgcttgcggcgaaagaggggttggcgctgatcaatggcacgcagacttcgacagctctggcgctggccgggctgttccgcgcccatcgtgccgcacaggcggcgctcattaccggtgcactttcgacggacgccgccatgggctcatccgcgcccttccatcccgatattcacagcctgcgcggccacaagggccagatcgatgcgggagcggcgcttcgtaacctgctggaaggttcggaaatccgcgtcagccatatcgagggcgacgagcgcgtgcaggatccctattgcattcgctgccagccgcaggtcgacggcgcctgcctcgatcttctgcgccaggtggcgcgcacgctggaaatcgaagccaacgcggtgaccgacaatcccttggtgctctcggataattccgtcgtttccggcggcaatttccatgccgagccggtcgccttcgccgccgatcagacggcgcttgccatttgtgagatcggcgcgatcgcccagcggcgtgtagcgctgctggtcgatccggcgctttcttatggcctgccggctttcctttcgaaaaaaccgggcctgaactccggcctgatgatcgccgaagtcacctccgccgcgctgatgagcgagaacaagcaaatggcgcatccggcctccgtcgattcgacgccgacctcggccaatcaggaagaccatgtctccatggcctgccatggcgcgcgccgcctgttgccgatgaccgacaatctctttgccatccttgggatcgaggcgctctcggccgttcagggtgtggaactgcgcggaccgctgaaaaccagtcctgaattgcaaaaggtgattgctgtgctgcgtgttgtagtcccttcgctggaagaggaccgctatatggcgccggatttgaaggctgcggcggagctgattgcctccggcgcgctggtctcgacgatttcgggcggcattctgccgaagctggaggcttga

SEQ ID NO: 38163 - DNA, 1461 bp, Agrobacterium tumefaciens
ctcaaggcgcagccgaaagcctcgcatttcatcgacggggattatgtcgaggacaataccggcacgccgttcgagagcatcttccctgcaacgggcgaaatgattgcaaaactgcatgcggcaacgcccgccatcgtcgagcgcgccatcgcctcggccaagcgcgcccagaaggaatgggcggcgatgagccccatggcccgcggtcgcatcctcaagcgcgccgccgatatcatgcgcgaacgcaacgatgcgctttccacgctcgagacgctggataccggcaagccaatccaggaaaccatcgtcgccgatcccacctccggcgccgatgccttcgagtttttcggcggcatcgcaccttccgcgctgaatggcgattatatccccctcggcggcgatttcgcctataccaagcgcgtgccgctcggtgtctgcgttggtatcggcgcctggaactatccgcagcagattgcctgctggaaggctgcaccggccctcgtcgccggcaatgccatggtcttcaagccctcggaaaacaccccgctcggtgccctgaagatcgccgaaatcctgatcgaggcgggcctgccaaaaggcctcttcaacgtcattcagggtgatcgcgataccggcccacttctagtcaatcatcccgatgtcgccaaggtctctctcaccggctcggtgccgaccggtcgcaaggtggcggccgccgctgccgggcatctgaaacatgtgacgatggaactcggtggcaagtcgccgatgatcgtcttcgacgacgccgatattgaaagtgccgtcggtggggccatgctcggcaacttctattcttccggccaggtctgctcgaacggcacgcgtgtcttcgtgcagaaaaaggcgaaggcgcgtttcctcgaaaacctgaaacgccgcaccgaggcgatgatcctcggcgaccccttggattacgccacccatctcggcccgctggtctccaaggcccagcaggaaaaggttctgtcctatatcgaaaagggcaaggcagagggtgcaacgctgatcaccggcggcggcattcccaataatgtcgcgggtgagggcgcctatgttcagccgactgtctttgccgatgtcaccgacgacatgaccatcgcccgcgaggaaatcttcgggcctgtcatgtgcgttctggatttcgacgatgaggacgaggttctcgcccgcgccaacgccaccgaattcggccttgccggcggcgtctttaccgccgacctcgcccgcgcccaccgtgtggtggatgggctggaggcgggcacgctctggatcaacacctacaatctctgcccggtggaaattccctttggcggctccaagcaatccggtttcggacgggagaattccgccgcggcgctggagcattatagcgaattgaagaccgtttatgtcagcacggggaaggtggacgcgccttat

SEQ ID NO: 38164 - DNA, 1452 bp, Agrobacterium tumefaciens
atgaccacttccggcgttcgcgtccgcatcgcaccttcccccaccggcgagccgcatgtcggcaccgcttacatcgcgctgttcaactatctcttcgccaagaaacacggcggcgagttcatcctgcgcatcgaggataccgacgccacccgctcgacgctggaatatgagcagaaggttctggaggcgctgcgctggaccggcctcacctggtcggaaggccctgacgtcggtggcccctacggtccctaccgccagtccgagcgcaagccgatgtactggccctacgccgaagaattgctggaaaaaggccatgccttccgctgtttctgcacgcccgagcggcttgagcagatgcgcgaagcgcagcgcgccgctggcaagccgccaaaatatgacggtctctgcctccacctgaaggctgaagaagtgaccacccgcgtcgccgccggcgaagccaacgtcgtgcgcatgaaaatcccgaccgaaggttcgtgcgatttccatgacggcgtttacggcgatgtctcgatcccctgggattcggttgacatgcaggtgctgatcaaggccgacggcatgccaacctatcacatggcaaacgtcatcgacgaccatctgatgaagatcacccatgtggcgcgcggcgaagagtggctggcttcagtgcccaagcacatcctgctttaccgttatttcggctgggaccagccgacgttcatgcatctttcgctgatgcgcaacgccgacaagtcgaagctttccaagcgcaagaacccgacgtcgatctcctattattccgcgctcggctacctgccggaagcgctgatgaacttcctcggcctgttcttcatccagatcgccgaaggcgaagagctgctgaccatggaagagctggccgcgaagttcgatccggaagcgctttcaaaggctggcgccatcttcgatatccagaagctggactggctgaacggccgctggctgcgcgaaaagctcacgcctgaggacttcattgcccgcacgctggaatgggcgatggaaaattcccgcctgaccgaaggcctgaagcttgcccagagccgcatttccaagctcggcgaattgccgaacctcgccggcttcctggtgtcgagcgatgttggcctgacaccggcttcgtttgccgggttgaagagcaaaccggaggaaatccacgaaatcctcaccacggttgccgccgacctcgaaaaaatgccggattggaacgttgaagccatcgaggccgaactgcgcgacattgccgaacgcacgggcaagaaactgcgcgtcgtcaccccgccgctcttcgtcgccgtctccggttcctcgcgctcgctgccgctgtttgacagcatggcgctgctcggccgctccgtggtgcgccagcgcctgaaagtggcgattgccgttgtggccacgatggttggcagcgga

SEQ ID NO: 38165 - DNA, 729 bp, Agrobacterium tumefaciens
tcattgcaaggcaagaccgtcatcgttaccggcgcaagccgaggaattggcaagggcatagcactgcgcttcggggaggccggcctgaatgtcctcgtcgtgtcgcgcagccaggtcgatgccgacagggtggcatccgaaatcggagtaaacggttcggggtttgcggcggatgtcagtacagaggagggctgcaaggcgatggtcgatgctgccgtaacccgctatggcggggttaacgtgctgtgcgcaaatgccggaatcttcccggcggcgaagctgggggaaatgtcggcggccgatttcgaccacgtgatctcaaccaatctcaaaagtacctttctcagcgtttccgcggtgttgccggcgatgacctcggccggtgcgggccgtatcatcatcacctcgtcgatcactgggccgatcaccggttatccgggctggtcgcattatggggcaagcaaggccggccagcttggcttcatgcgtactgccgcgattgagctggcgccaaagaacattacggtcaatgccgttatgccaggcaatatcatgactgaggggctcgagggcaacggtccagattatatcgccacgatggaggcctccgtgccattgcgtcgtctgggtatgccggcggacatcgcgaacgccgcgctgttttttgcatcggaggaggcagcctatatcaccggccagtcgatcgtcgtcgatggcggtcagatcctg

SEQ ID NO: 38166 - DNA, 1230 bp, Agrobacterium tumefaciens
gcagagcgcgttgccaagcgccaggcaacttttggagcttcctccgtactcttttatgagcagccgatcgagatggtgagcgcgcagggcgcctatctgtatgacgccggcggacgcaagtatctcgacgtctacaacaacgtaccgtcggtcggccactgccatccacgggtggtcgaggccatcgcccgacaggtcggcgaactcaacatccacacgcgctatctcaaccgcgtcgtcgaggcttacaccgaaaatctgctatccaaattcccggcaggcctcagcaatgtcgttttgacctgtacgggcagcgagagtaacgacctcgccctgcgcatcgcccgcattgggaccggggccgaaggcttcatcgtcaccgaggcagcctatcacggcaacactgcgctggtgacggaagtctccccctcgtcgctgcgcaagcgcaaacccgccgcatttgtggcaatcattccagcgcccgccgctcgtgatggcatgagcgtggcctcaaacttcgccgcgtccgtggaacaggcaatcaacgagctcaattcacgaggcattaaattcgctgcgttgatcgttgacacaatcttttccagtgacggcatctatgccgatcctgcaggtttcctgaaggaggcggttgacgtggtgcaccgagccggcggcctgttgatcgccgatgaggtccaaccgggcttcggccggacgggaggcagcctttggggcttcgagcgtcacggtgtcacgcccgacattgtcacgatgggtaagccgatgggcaatggcttccccatgggcggcgtcgtaacacgacctgacctgctccagaggttctgcgaggaaaccggttatttcaataccttcggaggcaatccggtagctgccgccgcaggccatgccgtgctgcgagtgattgaggaggaaggtctgatcgaacgctcggccactgtcggcggttacttcaagcagtcgctccaggctttgcaaagtcggcattcggaaatcggcgatgtgcggggcgccggccttttcatcggtcttgattttgtcgaccccgccacgggggagccggacagcacacgcgctacccatgcgatcaatcagttgaggcacaacagtatattgatcggggcagcgggcaaatatggcgcgacgctgaagatccggccgccactgtgtttttcgaacgaggatgtcgacctcttcaccggcaccctggac

SEQ ID NO: 38167 - DNA, 735 bp, Agrobacterium tumefaciens
aatcccttttcgcttgagggccgcaaggcgctcgtaacgggcgcgaatacggggcttggccaggcgattgcggtgggtcttgccgctgccggtgcggaggtggtctgcgccgctcgccgtgcgccggacgaaacgcttgatatcatcgcaaaagacggcggcaatgcgagtgcgctgctcatcgattttgccgatccgctggcggcgaaggatagctttaccgacgccggtttcgatattctcgtcaacaatgccggcatcatccgccgcgccgattccgtcgagttttccgaactcgactgggacgaggtgatggacgtcaatctcaaggcgctgtttttcaccacgcaggccttcgcgaaggagcttttggcgaaaggtcggtccggcaaggtggtcaatatagcctcgctcctgtcgtttcagggcggcattcgtgtgccgtcctacaccgcggcgaaacatggcgttgcaggtctcaccaagcttctggcgaatgaatgggcggcaaagggcatcaatgtgaacgctattgcacccggttacatcgaaaccaacaataccgaggcgctgcgcgccgatgcagcccgcaacaaggccattctggagcgtattccggccggccgctgggggcattcggaagacattgccggggcggcggttttcctgtcatctgcggcggcagattatgtgcatggcgctattctcaacgtcgatggcggctggctggcgcgc

SEQ ID NO: 38168 - DNA, 882 bp, Agrobacterium tumefaciens
cctgaacaaatcaagacggcgctcggctccggtcttttgtctttcccggtcacccatttcgatgccgagggtcgttttgcggcagatagctacagggagcatgtcgaatggctcgccggttacaaggctccggtgctgtttgccgctggcggcacgggcgagttcttctcgctgaagccggatgaaatcccaacgatcgttgccgccgccaaggaagtggccggcgaaacggccatcgtgtccggctgtggttacggcaccgagatcgccgtcgatatcgcccgctccgtcgaaaaggtcggtgccgatggtatcctgcttctgccgcattacctcatcgatgcgccgcaggaagggctttacgcccacatcaagaaggtttgtcagtcggtcggcatcggcgtgatggtttataaccgtgacaattccgtgctgcaggccgatacgctggcgcgtctttgcgacgaatgcccgaacctcgtcggcttcaaggatggcaccggcgatatcggcctcgtgcgccagatcaccgccaagatgggtgaccgtctgatgtatctcggtggcatgccgacggcggaattgtttgccgaagcctatctcggcgctggtttcaccacctattcctcggccgtgttcaacttcgtgccgggtcttgccaatgagttctacgccgccctgcgtgccggcgagcgcgccacctgcgaacgcattctcgttgatttcttctatccgttcatggcgatccgtaaccgcgccaagggttatgccgtctccgccgtcaaggccggtgttcgcctgcagggcttcaacgccggtccggtgcgcgcgccgctgaaggatctgacgaatgaggaaatcggcatgctcgaagccctgatc

SEQ ID NO: 38169 - DNA, 1119 bp, Agrobacterium tumefaciens; identical to SEQ ID NO: 37970

SEQ ID NO: 38170 - DNA, 972 bp, Agrobacterium tumefaciens
gacggcgcggaaattttcaaggcgttgcgcgatgccgccagcgaacgcatcctcattctcgatggtgccatgggcacgcagatccagggtctcggttttgacgaggatcattttcgtggcgaccgttttatcggctgcgcctgtcaccagaagggcaataacgaccttctgatcctgacacagcccgatgccatcgaggaaatccactatcgctacgccatggcgggcgcggatattctcgaaaccaacacgttttcctccacccgcatcgcgcaggccgattacgagatggagaatgccgtctacgatctcaaccgcgagggcgcggcgatcgtgcgccgggcggctcagcgcgccgagcgcgaggatggccgccgccgtttcgtggccggtgccatcggtccgaccaaccgcacggcctcgatctcgcctgacgtcaacaatcccggttaccgcgccgtcagtttcgacgatctgcgcattgcctatggcgagcagatcgatggcctgatcgacggtggtgccgatatcatcctcatcgagacgatcttcgatacgctgaacgccaaggcggcgatcttcgcctgcgaggaacgtttcgaggctaagggcatccgcctgccggtcatgatctcaggcacgatcaccgacctttccggtcgcacgttgtccggccagacgccttcggcgttctggaactcggtgcgccacgccaaccccttcaccatcggcctcaactgcgcgctcggtgcggatgccatgcgcccgcatctgcaggaactgtccgatgtggccgacacctttgtctgcgcctatccgaatgccggcctgccgaacgagttcggccaatatgacgaaacgcccgagatgatggcgcgccaggttgagggcttcgttcgtgacggtctcgtcaacatcgtcggcggttgctggggttcgacgccggaacatatccgggcgattgccgaagcc

SEQ ID NO: 38171 - DNA, 2061 bp, Agrobacterium tumefaciens; identical to SEQ ID NO: 35396

SEQ ID NO: 38172 - DNA, 516 bp, Agrobacterium tumefaciens; identical to SEQ ID NO: 35438

SEQ ID NO: 38173 - DNA, 783 bp, Agrobacterium tumefaciens; identical to SEQ ID NO: 35437

SEQ ID NO: 38174 - DNA, 576 bp, Agrobacterium tumefaciens; identical to SEQ ID NO: 35436

SEQ ID NO: 38175 - DNA, 777 bp, Agrobacterium tumefaciens
atggttgaactcgctctccccaagaattcccagatcagcgaaggcaaggtctggccgaagcctgacggtgccaagaatgtgcgcgaataccgcatctatcgctggaacccggatgacggtcagaacccgcgcatcgatacctattacatcgatgtcgatgattgcgggccgatggttctcgatgcactgctttacatcaagaataatatcgacccgacgctgacgctgcgtcgctcctgccgcgaaggcatttgtggttcctgtgcgatgaacatcgacggcaccaatacgcttgcctgcaccaagggtatggaagagatcaagggtacggtaaaggtttatccgctgccgcatatgcctgtcgtgaaggacctcgttcccgatctgtcgaacttctacgcccagcaccgctccatcgagccctggctgaagacggtgtctccgacgcccgccaaggaatggaagcagagccatgaggatcgtctgaagctggatggtctttacgagtgcatcctgtgcgcctgctgctccacctcctgtcccagctactggtggaatggcgaccgttatctcggccccgccgttctgctgcaggcctatcgctggctgatcgacagccgcgatgaggcaaccggtgagcgtctcgacaatctcgaggacccgttccgcctttatcgttgccacaccatcatgaactgcgcacaggcttgcccgaagggcttgaacccggccaaggcgatcgcggaaatcaagaagatgatggtcgagcgtcgcgtc

SEQ ID NO: 38176 - DNA, 960 bp, Agrobacterium tumefaciens
atggctcgcaaaaaaattgcacttattggttctggcatgatcggcggcacgctggcgcatctcgccagcctgaaggaactgggcgatatcgtcctcttcgacatcgccgacggcatcccgcagggcaagggtctggatattgcccagtccggcccggttgaaggcttcaatgcaaagctctccggcgcttccgattacgccgccatcgaaggcgcagacgtctgcatcgtcaccgcaggtgtcgcccgcaagcccggcatgagccgcgatgatcttcttggcatcaacctcaaggtcatggaacaggtcggcgccggcatcaagaaatatgctccgaacgctttcgtgatctgcatcaccaacccgctcgacgccatggtctgggcgctgcagaagttctccggcctgccgaagaacaaggtcgtcggcatggctggcgttctcgacagcgcacgcttccgcctgttccttgccgaagaattcaacgtttcggtccaggacgtcaccgccttcgttctcggcggtcatggcgacaccatggtgccgctcgcccgttattccaccgttggcggcgttccgcttaccgatctcgtcaagatgggctggttgaccgccgaacgtcttgagcagatcatccagcgcacccgtgacggcggcgcggaaatcgtcggcctcttgaagaccggctcggcctattacgcgccggccgcttcggctatcgaaatggccgaatcctacctcaaggacaagaagcgcgttctgcccgctgctgcccacctttcgggccagtatggcgtagacgacatgtatgtcggcgtgcccaccatcatcggtgccggcggtatcgagcgcgtcatcgagatcgaactgaacaaggaagaagaagccgccttccagaaatccgtcggcgctgtcgctggtctttgcgaagcctgcatcaacatcgctccgtcgctgaag

SEQ ID NO: 38177 - DNA, 1185 bp, Agrobacterium tumefaciens; identical to SEQ ID NO: 35127

SEQ ID NO: 38178 - DNA, 897 bp, Agrobacterium tumefaciens; identical to SEQ ID NO: 35126

SEQ ID NO: 38179 - DNA, 2136 bp, Agrobacterium tumefaciens
atggcaaggcaagaagcgaacgagcagtttcagatcacgtcgtttctggacggcgcgaatgcagcctatatcgagcagctctatgcccggtacgaagaggatccctcttccgtgtcgccggagtggcagagcttcttcaaggcactgtccgataatccggaagatgtgaagaaggcggccaagggcgcctcctggaagcgtgccaactggccgatcccggcgaatggcgaactggtctccgcactcgacggtaactgggccacggtcgaaaaggccattgagaaaaaggtccaggcgaaggctgaagccaagagcgccgatacaggcaagcccgtcagcgaagcggaagtgctgcaagcgacccgtgacagcgttcgcgccatcatgatgatccgcgcctaccgcatgcgcggccacctgcacgccaagctcgatccgctcggcatcgccagcgccgtcgaggattacaacgagctttcgccgaagtcctatggcttcgaggaaagcgactacgaccgcaagattttcatcgataacgtgctcggcctcgaatatgcgaccgtgcgcgaaatggtcgagattctcgagcgtacctattgctcgacgctcggcgtcgaattcatgcacatgtccaacccggaagaaaagggctggattcaggaacgcatcgaaggcccggacaagggtgtggatttcacgccggaaggcaagaaagccattctgtccaagctggtcgaagccgaaggttacgagcagttcctcgacgtgcgtttcaagggcaccaagcgtttcggcctcgatggcggtgaatcgctgatcccggcactcgagcagatcatcaagcgcggcggccaggacggactggaagaagtcgtgctcggcatggcccaccgcggtcgcctgaacgttctgaccaacgtgatgggcaagccgcaccgcgccgtgttccacgagtttaagggcggttcgttcaagccagacgacgttgaaggttcgggtgacgtgaagtaccatctcggtgcctcctccgaccgcgaattcgacggcaacaaggttcacctgtcgctgacggccaacccgtcgcaccttgaaatcgtcaatcctgtcgtcatgggcaaggcccgcgccaagcaggaccaactggccaagacatgggacggcgacatcattccgctgtccgaacgcgccaaagtgctgccgctgcttctgcacggcgatgccgcttttgcgggtcagggcgtggttgccgaaattctcggtctttccggcctgcgtggccatcgcgttgccggcaccatgcacttcatcatcaacaaccagatcggcttcacgaccaatccggccttctcgcgctcgtcgccttatccgtccgacgttgcgaagatgatcgaagcgccgatcttccacgtcaacggtgacgatccggaagcggtggtctatgcggcgaaggtcgcgaccgaatatcgcatgaagttccacaagcctgtcgtcatcgacatgttctgttaccgccgcttcggccataacgaaggcgatgagccggcgttcacgcagccgaagatgtacaaggtcatccggggccacaagaccgtcgcccgtatctatgccgaccgcctgatcgcggaaggcctgatcaccgagggcgatttcgagaaggtcaaggccgactggcgcgctcatctcgagcaggagttcgaggcaggccagtcctacaagcctaacaaggccgactggctggatggtcagtggtccggcctgcgcgccgccgacaatgccgatgagcagcgtcgtggcaagaccggcgtgccgatgaagcagctgaaggaaatcggcaagaagctgtcgaccattcctgaaggtttcaccgcgcatcgcacgatccagcgtttcatggaaaaccgctcgcagatgatcgaaacgggcgaaggcatcgactgggctatggcggaagcgctggctttcggttcgctcgttgttgacggccacaagatccgtctttccggtcaggattgcgaacgcggcaccttctcgcagcgccactcggttctttacgatcaggagaccgaagagcgttacatcccgctggcgaacctcgccccgacgcaggcccgttacgaagtcatcaactcgatgctt

SEQ ID NO: 38180 - DNA, 974 bp, Agrobacterium tumefaciens
atgaacggtgctggcgaaatcaacgcttcgcggcatcgcaaggagaatgagttgaagacgtgccaaatcctgggagctcccgttcaaagtggcgcatcccaacccggatgcctgatgggacctgatgcgtttcggactgccggcttgacgcaagttctgacggagctgggctgggctgtcaccgatctcggagatgcgacaccaacggtcgaacccgaactcagccaccccaattccgcggtgaagaacctcgatgctctggtgggatggacgcgcagtctgtcccagaaagctctggagatggcccgcagctgcgatcttccggtctttctcggcggcgatcactcgatgtctgctggcaccgtctcaggtgtggcccaacgtacagccgagcttggcaaggagcaattcgtcctttggctggacgcgcatacggacctgcataccctccacacgaccgcgagcggcaatctccacggcacacccgtagcctactatacgggccaatccggcttcgaagggctgccgccgctggccgcgcctgtaaatccccgcaacgtatccatgatggggattcgctcagtcgatccggaagagaggcgacgggttgccgagatcggtgttcaagtcgctgacatgcgggttctggacaacaaggggtcgtacgcccgctcgaagcttttcttgaccgcgtgagtaaggtcagcggcagattgcacgtcagccttgatgtcgatttcctcgatcccgcgatcgcgccagcagtgggcacgaccgttcctggcggagcgaccttccgggaagcgcacctcatcatggagatgctccatgacagcggccttgtcacgtcactcgacctggcggagctcaatccgtttctggatgagagggggcgcactgcccgcctcataaccgatcttgcctcgagcctattcggccggcgcgtgttcgacagggtgacaacagcattttga

SEQ ID NO: 38181 - DNA, 1290 bp, Agrobacterium tumefaciens; identical to SEQ ID NO: 35369

SEQ ID NO: 38182 - DNA, 1233 bp, Agrobacterium tumefaciens; identical to SEQ ID NO: 38065

SEQ ID NO: 38183 - DNA, 1224 bp, Agrobacterium tumefaciens; identical to SEQ ID NO: 37932

SEQ ID NO: 38184 - DNA, 1395 bp, Agrobacterium tumefaciens
gatgtagttgtaatcggaacgggtcccggtggttatgtttgcgcggtcaaggcggcacagctcggcctcaaggtcgcagtgatcgaaaagcgcgcgacctatggcggcacctgcctcaatgtcggctgcattccttccaaggcgttgctgcacgcctccgaaaccttcgcgcatgtggcccacggcgttgatacgcttggtatcgaagtcgccgctccgaagctgaacctcgagaagatgatggggcacaaagacggcgtggtgaaagccaatgtcgacggcgttgctttcctgttcaagaagaacaagatcgatgctttccagggcactggcaaggtggtttccgccggcaaggtttccgtcaccaacgacaagggtgagacccaggagatcgaagccaagaacatcgtcatcgccaccggttccgatgttgccggcattccgggtgtcaaggtcgatatcgatgaaaccgtcatcgtgtcctccaccggtgcgattgctctttccaaggttccggaaaaactcatcgtcgttggcggtggtgtcatcggtctcgagcttggttcggtctggtcgcgtcttggcgcgaaggtgaccgtcgtcgaatatctcgacaacattctcggtggcatggatggcgaagtttccaagcagtcgcagcgtctgctcgccaagcagggtctcgatttcaagcttggcgccaaggtgacggccgttgaaaagaccgctgccggtgcaaaggtcgtattcgagccggtcaagggcggcgcggctgaaacgctggaagctgatgtcgtgctgatctccacggggcgcaagccctacaccgaaggtctcggccttgcggaagccggtgttgtgctcgacagccgcgggcgtgtcgagatcgacggccactacaagaccaatgtcgatggcatctatgcgatcggcgatgtggtgtaggggccgatgctggcacgcaagtcgcacgatgagggcgttgcgcttgctgaaatcctcgccggccagcgtggccatgtgaactacgacgtcattccggccgtcgtttatacgcagccggaaatcgcttccgtcggcaatacagaagaggaactgaaggccgctggcgtcgcctacaaggtcggtaagttccccttcaccgccaatggccgcgcccgcgccatgcaggtgacggatggtttcgtgaaaatccttgccgacaaggaaaccgaccgggttctcggcggccatatcgtcggcttcggcgccggcgaaatgatccacgagatcaccgtgctgatggaattcggcggttcttcagaggatcttggccgcacctgccacgcgcacccgaccatgtcggaagccgtgaaggaagcagcacttgccaccttcttcaagccgatccacatg

SEQ ID NO: 38185 - DNA, 402 bp, Agrobacterium tumefaciens
atcctcaatggtccgaacctcaatttgctcggccagcgccagccggagatttacggctacgagacgctcgccgatgtcgaggccgattgccgtgccatcgctgaagccgccggccacgagctgttttttgcccagagcaaccgggaatatgagctgatcgactggatccacgaagcccgcggcaagtccgcgggcatcgtcatcaatccgggcgcctttacccatacgtcggtggcgatcctcgatgcgctgaacgccttcgaggcgccggtaatcgaagtccatatttccaacatccacaaacgcgaggtcttccggcaccattcctatgtgtcgacccgtgccgaaggcgtgatcgccggtcttggcatcgaaggttatggggtggcgctacgccacctc

SEQ ID NO: 38186 - DNA, 828 bp, Agrobacterium tumefaciens
gtcggcctgataggcgccgacatccagctttccaaatcgcccgcgctgcatatgcgtgagggtgcggcccatggcctcgactattcctacgagcttgtggatgtcaccgcccgcaaactgccgcagagtagccttcccgctcttctcgacgagctggaggcgcgcggttttgccgggacgaacatcacccatcctttcaagcaggccgttattccgcatctgcacgaactctccgacgacgcccgcatgttgggcgcggtcaacaccgttgtcttccgggatggacgccgcatcggccacaataccgactggtacggtttttacgaaagcttcgtgcgcggcctgccggatgcaaaacgcgaccgggcacttctggtcggcgcaggtggcgccggcgttgcggtggcccatgccgcgttgaagctcgatattatcaggctggatatcttcgaccgggattttccaagagccgaacgtctcgccgacgagctcaatgcccgttttggtgaaggccgcgccttcgcggtgaaggacccggccgactcgctgccctttgccgatggcctgatccatgccacgccgatgggcatgcccgcgcatcccggcatgccggttgcggccgagctgatcgaacaaaagcactgggtcgccgatatcgtctatatgccgctggtgaccgagcttctggcgactgcggccagcaagggatgccgaaccctgcccggcggcggcatgaccgtgttccaggccgtcggcgcatttcgcctcttttgcggccgcgagccggatgcgaaacgcatgacggcgcatttcacagaactttgcatg

SEQ ID NO: 38187 - DNA, 732 bp, Agrobacterium tumefaciens; identical to SEQ ID NO: 35194

SEQ ID NO: 38188 - DNA, 837 bp, Agrobacterium tumefaciens; identical to SEQ ID NO: 35193

SEQ ID NO: 38189 - DNA, 726 bp, Agrobacterium tumefaciens
cgcaccgccatcatcaccggcagcggtcgcggcctcggtttcgaaatcgccaaaggcttcgccgaggcgggcgcccatgtctggctgaccggccgtaacgccgagacgttgcaacaggcggtcgacacgctgcgcaaggcgggcggaaaggccgattatgcagccttcgatattgccgacacggctgcaggaagcgcgcttgtccgccgcatcatggatgaggccggccatctcgatatcctcgtcaacaatgtcggcgcgcgcgaccgccgcccgcttgccgaatttaccgacgacgacgtgctggagctcatccgcaccgacctcacctcctccatctcgctgtcgcgtgatgcggctgaagccatgaatgccaacggttacggccgcatcatcaccatcacctccattctcggccatatcgtccggccgggtgatgcgatctatcccgtcgccaaacaggggctgaccgggctgatgcgggcgattgcagtggaatatggcgcgcgcggcatcaccagcaacgccattgcccccggcatgttcgccaccgaaaccaatgccgcccttgccgaaaaccctgacatggtggcctttgccaagctgcgcgtaccgctggagcgctggggcagacccgatgaaatcgccggggctgccctgtttctcgccagcgacgcggcctccttcgtcaacggccacatattgacggtggacggcggcatgtcg

SEQ ID NO: 38190 - DNA, 1470 bp, Agrobacterium tumefaciens
atgagcagtcagatcattcctgttgaaccttttgattgtgtcgttttcggcggcacgggcgatcttgccgagcgcaagcttctgccggccctttatcaccggcaggtcgaaggccagttcacggagccgacccgcatcatcggcgcgtcgcgttcggtcatgacccatgaggaatatcgcaaattcgcgcaggacgccctgaaggaacacctgaaggccggcgaatatgacgatgcgcaggtgaccctgttcctcaaccggcttttctacgtgcccgtcgatgccaagtccggcaatggctgggacgtgctgaagaaactgctcgatgagggcaaggaacgcatccgcgcgttttatctggccgtcgcacccggcattttcggcgacatcgccgacaagatccgtgagcacaagctgatcacccgctcgacccgcatcgtcgttgaaaagccgatcggccgggatctcgcatccgcgcaggaactgaacgacaccatcggtcacgtcttcaaggaagagcagatcttccgcatcgaccactatctcggcaaggagacggtgcagaacctgatggcgctgcgtttcgccaatgcgctttacgagccgctgtggaattccgcccatatcgaccacgttcagatcaccgttgccgaagcggtgggtcttgaaggtcgcgccggttattacgacaaggccggtgcgctgcgcgacatggtgcagaaccacattctccagctgctttgcctcgttgccatggagccgcccgcttccatgaaatcggaggcagtgcgcgacgaaaagctcaaggtactgcgctcgctgaagccaatcgataccagcaatgtcgaaaagctgacggtacgcggccagtaccgcgccggcgcttccgcaggcggccccgtcaagggttatctggaagagctggaaggcggcgtttccaacaccgaaaccttcgtcgccatcaaggctgaaatcgccaactggcgctgggccggcgttcccttctacatccgcaccggcaaacgcctcgcgacccgtgtttcggaaatcgtcgtcaccttcaagcagatcccgcactcgatcttcgacgatgcggctggcaagatcgaagccaacaagctggtcattcgcctgcagccggatgaaggcgtcaagcagtcgctcctcatcaaggatcccggtccaggcggcatgcgcctgcgtcaggtctcgctggacatgagctttgccgaagccttcaacgtgcgcagccccgatgcctatgagcggctgttgatggacaccattcgttccaaccagacattgttcatgcgccgcgacgaggtcgaggccgcgtgggactggatcgaccccatcttgaagagctgggaagagctgggacagagcgtacagggttacactgccggcacctggggcccgagcggttcgatcgcactgatcgagcgcgacggccgcacctggcacgatgcc

SEQ ID NO: 38191 - DNA, 2448 bp, Agrobacterium tumefaciens; identical to SEQ ID NO: 35157

SEQ ID NO: 38192 - DNA, 1515 bp, Agrobacterium tumefaciens
  unsure (1)..(1515): unsure at all n locations
ttctnngaattgcgcgagganctgagcgcngagggtgcaacctttaccacccagaccgataccgaagtggtggcgcagcttctggcgaaatacacccgcgaggggcttggccatcgcgaagcaatgttgaagatgctgaaccacgtaacgggcgcctatgcgctggtcgtgatgtttcaggacgatcccggtacgctgctttcggcgcgctccggcccgccgcttgcggttggttacggcaggggcgaaatgttcctggggtccgacgcgatcgcgctttcgcccttcaccaacgagatcacctatctggtcgatggcgactgcgccatcgtgacccgggacggcgcggaaatcatcgatttctccggcaagccggtgaaacgcgagcgccagatttcgcaggcgacggcttttgtggtcgacaagggcaatcaccgccatttcatggaaaaggaaatctatgagcagccggaagtcatttcccacgcgctcagccactatgtggatttcgccaccaggaccgtgaaggacgccgataaggcgattgattttgccagcctttccggccttgccatctccgcctgcggcacggcctatctgtcaggcctgatcggcaaatactggttcgagcgttatgcccgcctgccggtggaaatcgatgttgcctcggagttccgttaccgcgaaatcccgcttgttcccacgcaggcggcgctgttcatttcgcaatctggcgaaaccgccgatacgctggcggccctgcgttattgccagcaggagggtctgaagatcggcgcggtggtcaatacccgcgaatcgaccatggcgcgcgaatccgatgcgatctttccgatcctcgccgggccggaaatcggcgttgcctccaccaaggcctttacctgccagcttgcggtgcttgcttcgctggccgttgccgccggcaaggcgcgcggcacgctgaaaccgggtgaagaaaagcagctggtgcagcagctgatcgagatgccgcgcatcatgagcaaggtgttgaacgtcatccagccgcagatcgaggcgctgtcgcgtgacctgtcgcgcttcaaggatgtgctttatctcggccgtggcaccagcttcccgctggcgctggaaggcgcgctgaagctcaaggaaatctcctatatccacgctgaaggttacgccgctggcgagctgaagcatgggcctatcgcgctgatcgacgagaacatgccggttatcgtcattgctccgcacgaccgcttcttcgaaaagaccgtgtcgaacatgcaggaagtagccgcgcgcggcggccgcatcatcttcatcactgatgagaagggtgctgccgcttccaagctcgaaaccatggcgacgatcacgctgcccaatgtcgatgaactgatcgcgccgatggtcttctcgctgccgatccagctgctcgcctatcacaccgccgtcttcatgggcacggatgtggaccagccgcgcaatctggcgaaatcggtgaccgtggaa

SEQ ID NO: 38193 - DNA, 832 bp, Agrobacterium tumefaciens
tcattcgtaaagaacaaggacggcgtcgaaatctatttcaaggactggggcccgaaggatgcccagccgatcgtgttccatcacggctggccgctgtcctccgacgactgggatgcgcagatgctgtttttcgttcagaacggttaccgcgtcgtggcgcatgatcgccgcggccacggccgttcgcagcaggtgagcgacggccacgacatggatcattatgccgccgacgcgtccgccgttgccgaacatctcgatctcaggaatgcggttcatatcggccactcgaccggcggcggtgaagtggcacgttatgtcgcgaaattcggccagccgcagggccgtgttgccaaggccgtgcttgtctccgccgttccgccgctgatgctgaagacgccttccaatcccggcggcctgccgatcgaagtcttcgacagcttccgcaagggcgtggccgagaaccgcgcgcagttcttcctcgacgtgccggccggtcccttctacgggttcaaccggccggatgccaaaatctaccccggtgtcatccggaactggtggcgtcagggcatgatgggcagtgccaaggcccattatgatggggtcaaggccttctcggaaaccgaccagactgaagacctcaaggcgatcacggtgccgacgctcgttctccacggcgatgacgaccaggtcgtgccgatcgcagattcggccgaattgtcagtcaaacttctgaagaatggcacgctgaaggtttacaagggctatcccgcatggcatgctgacgacccatgcggacgtcatcaaccccgatctgctggccttcgtgaagggc

SEQ ID NO: 38194 - DNA, 1653 bp, Agrobacterium tumefaciens; identical to SEQ ID NO: 35377

SEQ ID NO: 38195 - DNA, 1415 bp, Agrobacterium tumefaciens; identical to SEQ ID NO: 35378

SEQ ID NO: 38196 - DNA, 735 bp, Agrobacterium tumefaciens
accatcctcatcaccggcgcgacgtccggtttcgggcaggccacggcgcggcgtttcgtcaaggaaggctggaaggtcatcggcaccggccggcgggcggaacggctggaggcgctggcggctgaactcggccaggcctttcatggtatcgccttcgacatcaccgacgaggatgcgaccgaaaaggcgctcgcggctttgcctgatggtttcagggatatcgacattctcgtcaacaatgccggtctggcgcttggcaccgcgcccgcgccgcaggtggcgctgaaggactggcagaccatggtggacaccaacatcaccggtctcctgaacattacccatcatcttctgccgacgctgatcaagcagaagggcattgtcgtcaacctctcgtcggtggccgcccattacccctatttgggtggcaatgtgtatggtggcaccaaagccttcctgcggcagttctcgctcggtcttcgctccgacctgcacggcaagggtgtcagggtgacctcgatcgaacccggcatgtgcgaaacggaattcacgctggtgcgcaccggcggcaatcaggaagcctcggataatctctacaagggcgtcaatccgattacggccgacgatatcgccaatacgatctattgggtcgcctcgcagccgaagcatatcaacatcaacagccttgaactgatgcccgtcaaccagtccttcgcgggtttccaggtctatcgggaa

SEQ ID NO: 38197 - DNA, 1662 bp, Agrobacterium tumefaciens; identical to SEQ ID NO: 35265

SEQ ID NO: 38198 - DNA, 1005 bp, Agrobacterium tumefaciens; identical to SEQ ID NO: 35214

SEQ ID NO: 38199 - DNA, 711 bp, Agrobacterium tumefaciens; identical to SEQ ID NO: 35428

SEQ ID NO: 38200 - DNA, 1149 bp, Agrobacterium tumefaciens
gcaacccagctcgttcacggcggtacgctacgctcaccctatggtgaaacgtcggaagcgatctatctgacccagggtttcgtttacgaaaactccgaagccgccgaagcccgcttcaagggcgaaacggatggcttcatctacgcccgctacgccagcccgaccaatgacatgttcgaaaagcgcatgtgcctgctggaaggcgcggaagacgcgcgcgcgcttgcctccggcatggccgccgtcaccgccgccatcatgtgccagctgcgcgccggcgatcacatcgttgccgcacgagcccttttcggctcctgccgctgggtggtggaaacgctcgcaccgaaatacggcatcgaatgcacgctgatcgacggacgtgatctcgacaattgggaaaaggcgatccagccgaacaccaagctgttcttccttgaaagcccgaccaacccgacgctcgaagtggttgatattgccggtgtggcgaagctcgccaaccagatcggcgcgaaagtggtggtcgataacgtctttgcgacgccgcttttccagaagccgctcgaactcggcgcccatatcgtggtttattcggccaccaaacatattgacggccagggccgctgcctgggtggcgtgatcctctccgacaagaagtggatcgaagaagagctgcaggactatttccgccatacgggcccggccatgtcgccgttcaacgcctggacgcttctgaagggcatcgagaccctgccgcttcgcgtcaagcagcagacggagaatgccgcgaagatcgccgatttcctcgccgatagcggcaaggtcgccaaggtcatctatcccggccgcgccgatcatccgcaggcggatatcatcgcacggcagatgtccggaggctccactttggtggccttcgaactgaagggcggcaaggacgcagccttcaagttgcagaacgcgcttgagatcgtgaagatttccaacaatctcggcgatgccaagagcctcatcacccatcccggtacgacgacacacaagaacctctccgacgaggcgcgtgccgaactcggcatttccggaggcaccctgcgcctttcctgcggcatcgaggataccgacgatctgctggaagatctcgcaaagggtcttgcg

SEQ ID NO: 38201 - DNA, 897 bp, Agrobacterium tumefaciens; identical to SEQ ID NO: 35463

SEQ ID NO: 38202 - DNA, 1152 bp, Agrobacterium tumefaciens; identical to SEQ ID NO: 35464

SEQ ID NO: 38203 - DNA, 804 bp, Agrobacterium tumefaciens
atgccgaagcgccaagatatcaagtccatcctcatcatcggcgcgggaccgatcgttatcggtcaggcatgtgaatttgactattccggcacgcaggcgtgcaaggcgctgaaggaagagggttaccgggtcattctggtcaactccaacccggccaccatcatgaccgatcccggtcttgccgatgccacttacgtcgagccgatcacaccggaagtcgtcgccaagatcatcgccaaggagcgcccggatgcgcttctgccgaccatgggcggccagaccgcgctgaacactgcgctttctctcaagcgcatgggcgttctcgatcgctacaatgtcgaaatgatcggcgccaagcccgaagccatcgacatggctgaagaccgcgctttgttccgcgaggcgatggcccgcatcggccttgaaacgccgaagtcgatgctcgccaacgccactgaaatcaaggacgccgaccgcaagacgcacgaagccgcccgcactgaactcaaggcaaaactgtcaggcgcagagctggacaaggctctcgacaacctcgaaaaccagtggaacctcggcgagacggaccgcaagcagcgctatatcagccacgccatggccattgccgcgcaggccatcgacgtcgtcggcctgcccgccattatccgcccttccttcaccatgggcggcacaggcggcggcatcgcctataaccgctcggaattcttcgaaatcatcggcggcggtctcgacgcatcgcccaccaccgaagtgctgatcgaagaatccgttctcggctggaaagat

SEQ ID NO: 38204 - DNA, 630 bp, Agrobacterium tumefaciens; identical to SEQ ID NO: 35152

SEQ ID NO: 38205 - DNA, 2631 bp, Agrobacterium tumefaciens
gaaaccaaaaccacctgcccctattgcggcgtcggctgcggcgtcatcgccaccgtcaatgattccggcgtcgtttccgtcaagggcgacccggaccaccccgccaatttcggtcggctatgctccaagggttcggctctcgccgaaaccatcgatctcgacggccgcctcctccacccggaaatcgccggcaggcgggcggcatgggacgaggcgctcgatctcgtcgcttcccgtttttccgacgccattgccgaacacggcccggattcggtcgccttttacgtttccggccagttactgacggaagattattacctggcgaacaagctgatgaaaggtttcatcggctcggccaatatcgacaccaattcaaggctctgcatgtcgtcctccgtcgccggccaccgccgcgccttcggcgcggatacggtgccgggaacctacgaggatatggagcttgccgatctggtgatcctcaccggttccaacctcgcctggtgccatcccgttctttatcaaaggctggcggcggcgaaggcggcgcggccggggatgaaggtcgtcgtcatcgatccgcgccggacgatgagcgctgatattgccgatatgcaccttgcaatccgcccggatggcgatgtggcgctgtttaccggcctgctggcgcatcttttcgccagcagcgcaatagaccgcggttacgttgaaaaccacacggccggtttcgaggccgccacgcaggccgcaagtgagcatagcctgccggaaattgccgaggccaccggcctgaccatcgccgaactgattcccttttatgaattgttcgagcgcacggaaaaaaccgtcacctgttacagccagggcgtcaaccagtcggagagcggcaccgacaaggtcaacgccatcatcaattgccacctcgccaccggccgcatcggcaggccgggcatggggccgttttcgctgactggtcagccgaacgccatgggcgggcgcgaggttggcgggctggcaaacatgctggctgcccatatgtccatcgaaaatgctgacgaccgcgaccgcgtgcagcgcttctgggcctcgcccgccatcgcgcagaaacccggtctcaaggcggtggatatgttccgggcggtggctgatggccgcatcaaggcgctgtggatcatggccacaaacccggtcgtctccatgccggatgccggtgccgtcgaggtgacgatcaaggcctgtcctttcgtcgtcgtctccgatgtcatggccaatacagacacggcccgccatgctcatgttcttctgccctcgctcggttggggcgaaaaggacggtacggttaccaattccgaacgacgcatttcccgtcagcgcagctttctcgatgcacccggcgaagcgaaagccgactggtggcagatggcggaagtggcccgacgcatgggcttcgacgctgcttttgcttaccagcagccctcggagatttttgcagaacatgcagccctttcgggtttcgagaatgcggggcgtcgggattttgatatcggcggaatcgaacgcgattcctacgagacgatggcacccgtccagtggccgaaagccggggccggcgaggccgaggtgacgcgcttttttgcaaatggccggttttatcatgccgatggcaaggcacgcttcatcgccaccgccctgccggagacggacagaacatcggcggactatccgctgacgctaaataccggccgcattcgcgatcaatggcacacgatgacgcgcaccggcaaaagcgcgcgtctcaccgcccatattgccgaaccttttgcagaaattcacccgcgcgatgcgcaggcgctcggcataaaaagcgccgatctggtggagctggaaagcccgcacggcaaggtcctgctgcgggcgctggtcagtgaaaggcaggcgcggggatcggtctttgcgccgatgcactggaacgaccagttcgcgtcgcgggcgcggatcgatgtcgttgtcgcgccggtcacggacccgcattccggccagcccgcttcgaaaaacgtgggcgtgagggtaacgcgcttcgaggcgagcgcctatggtttcgccatctgccgcagccggccggatgcgccggattgcgcttattgggccgtcgccaaggccgagggcggctatcggatggagcttgccttcgcggaagcgcctgaagactggacgctctgggcgcggcgggtcttcggcatcgatgtccggatcgagccgctgggctatagcgaccggcagacgggcgatctgcgccttgcctttttcgacggcgatacgctgcttgcagcgctgttcatcgcgcgggagccggtggcggtcgctcgcaactgggcgatatcgcagctttccgagcgccatgaggatttgcgcatgcggtttgcgctggtcgccggtcgtccgggggccgggcgggccgatccgggcgcaacggtctgctcctgctttaatgtcggggtgaaccagatcaccgccgccattcgtgagggctgccacagtgtcgaagccatcggcaatgcgttgaacgccggaaccaattgcggctcctgccgcgccgaaatcagggggatcatcgatggatgccttaaaaccgca

SEQ ID NO: 38206 - DNA, 1347 bp, Agrobacterium tumefaciens; identical to SEQ ID NO: 37870

SEQ ID NO: 38207 - DNA, 843 bp, Agrobacterium tumefaciens
atgtctgacgaggcaattcacgatattttcgtgatcggcggcggtatcaatggctgcggcattgcgcgcgacgccgtcggcagaggctattccgtcgcacttgcggaaatgaacgatttcgcctccggcacgtcatcggctgccacgaagctcatccacggcggtttgcggtatctcgaacattatgaattccgcctcgtgcgagaggccttgatggaacgcgaggtgctgtgggccatggcgccgcatatcatctggcccatgcgtttcgtgctgccgttccagaagggcggggtgcgcccggcctggctcgtgcgtctcgggcttttcctttacgatcatctcggcggccgcaagcttttgccggccacccgttcgctcgacctgcgccgcgatcccgccggaaaaccgctaaagccgatttttgcccgcgccttcgaatattccgatggctgggtggatgatgcccgtctggtggtgttgaacgcccgcgatgcggccgatcgtggcgccgtgatccttaaccgcacgcaggtggtttccgcgcggcgcgagggtgccttctggcgggttgaaacgaaaaatgccgccggcgaaagcaagacctaccgggcgcgcatgctggtaaatgccgcaggcccctgggtagacaaggttctggctgcgacatttggcaagaacaatgttcacaatgtccgcctcgtgcagggcagccacatcatcgtgcgcaagaagtttgccgatccgcgcgcctattttttccagaatccggacggccgcatcatcttcgctatcccctatgagcaggattttaccctgatcggcacgacggatcgcgactat

SEQ ID NO: 38208 - DNA, 1890 bp, Agrobacterium tumefaciens
atggcaaaagtaatcggtatcgaccttggcacgaccaactcctgcgtcgcagtgatggatggcaaggacacgaaagtaattgaaaacgcagaaggcgcgcggaccacgccgtcgatggtggcattttccgacgatggcgaacgccttgtcggccagccggccaagcgccaggcagtcaccaacccgaccaacaccctgtttgcggtcaagcgccttatcggccgccgttatgaagacccgaccgtcgagaaggacaaggcactcgtccccttcgaaatcgtcaagggcgacaatggcgacgcctgggtgaaggctcaggacaagaattattccccttcgcagatttccgcgatgatccttcaaaagatgaaggaaacggctgaatcctatctcggcgaaaaggtcgagaaggccgtcatcaccgttccggcctactttaacgacgcccagcgtcaggccaccaaggatgccggccgcatcgccggtctcgatgttctgcgtatcatcaacgagccgacggcagcagccctcgcttacggcctcgacaagaaggaaggcaagaccattggcgtttacgaccttggcggcggcacgttcgatatttccgttctggaaatcggcgacggcgtctttgaagtgaagtcgaccaacggtgataccttcctcggtggtgaagacttcgacatgcgtctggtcgaatatctggccggcgagttcaagaaggatcagggcatcgacctgaagaacgacaagctcgctctgcagcgcctcaaggaagctgccgaaaaggcgaagatcgaactttcgtcctcgcagcagaccgaaatcaacctgccgttcatcacggctgatgcttccggtccgaagcacctgacgctgaagctgacccgcgccaagttcgaaagcctggttgacgatctggtgcaacgcactgtcgccccttgcaaggcagcactgaaggatgccggcgttaccgcggccgagatcgacgaagtcgttctcgtcggcggcatgagccgcatgcctaaggttcaggaagtcgtcaagcagctgttcggcaaggagccgcacaagggcgtgaacccggatgaagtggttgccatgggcgccgctattcaggccggcgttctgcagggcgacgtcaaggacgttctgctgctcgacgtgaccccgctgtcgctcggcatcgaaacgctgggtggcgtcttcacgcgtctgatcgatcgcaacaccacgatcccgacgaagaagagccagaccttctcgactgccgaagacaaccagtcggccgtgaccatccgcgtttcgcagggtgagcgcgaaatggcacaggacaacaagctgctcggccagttcgacctcgtcggtctgccgccgtcgccacgcggcgttccgcagatcgaagtgaccttcgatatcgacgccaacggcatcgtgcaggtatccgccaaggacaagggcaccggcaaggagcagcagatccgcatccaggcctccggtggtctctccgacgccgacatcgaaaagatggtgaaggacgccgaagccaatgccgaggccgacaagaagcgtcgcgccggtgtcgaagccaagaaccaggccgaaagcctcattcactccaccgaaaagtcggtgaaggaatatggcgacaaggtttccgagaccgaccgcaaggcgatcgaagacgccattgccagcctgaagaccgctgtcgaagccgccgagcctgacgcagacgacattcaggccaagacccagaccctcatggaagtctccatgaagcttggtcaggccatctacgaagcacagcaggccgaggccggtgatgcttccgcagaaggcaaggatgacgtcgtcgatgccgactatgaagaaatcaaggacgacaag

SEQ ID NO: 38209 - DNA, 618 bp, Agrobacterium tumefaciens; identical to SEQ ID NO: 35483

SEQ ID NO: 38210 - DNA, 1014 bp, Agrobacterium tumefaciens; identical to SEQ ID NO: 35150

SEQ ID NO: 38211 - DNA, 810 bp, Agrobacterium tumefaciens
gttgtcggttacccgatcaaacattcccggtcgccgatcatccattcctattggctgaaaaaattcggtatcgccggttcctatacggcagttgaggtctccccagacgatttcccgaagttcattgcaacgctgaaggaaggcaagccgggtgcagcggtgggcggtaacgccaccattccgcacaaggaagcggcttaccggttggccgatcatcccgatgccttggcggaagaactcggcgccgccaacaccatctggatggaggagggtaaactccacgcgaccaacacggatggttacggtttcgtctcgaacctggacgagcggcatccgggctgggataagacccagcgcgcggtggtgttcggcgccggcggtgcaagccgggccgtcattcagtcgctgcgtgatcgggatgttgcggaaattcacgtcgtgaaccgtacggtcgagcgcgctcgcgaactggccgaccgctttggcccacgggtcttttcccatccccaggcagcgcttcaggaggtcatgcacggcgcggggttgttcgtgaatacgacatcgctcggaatgaatggaaccgaagcgccgcatcttgatttttcgcatctcgcggccaatgcggtggtgaccgatatcgtctacgtgccgttgaaaacgccgatcctcaacatggcgcaagagcagggcatcgcaaccgtcgatgggctcggcatgttgcttcatcaggcaaaacctggtttcaggcgatggttcggcaggattccggaggtggatgaaacccttcgttccctgatcatcgcggatatg

SEQ ID NO: 38212 - DNA, 798 bp, Agrobacterium tumefaciens; identical to SEQ ID NO: 38001

SEQ ID NO: 38213 - DNA, 1668 bp, Agrobacterium tumefaciens
tccatgaccgcttcggtgacttccgctttgacgcctaacaaggactggtggcgtggtgcggtgatctatcagatctacccgcgctcctatcaggactccaatggcgacggcatcggcgatctcaagggcattaccgaccgtctgcatcacatcgccggtctcggtgccgatgcgatctggatttcgccctttttcacctcgccgatgaaggatttcggctacgacgtctcgaactatgtcgatgtcgatccgatgttcggcacgcttgccgatttcgacgggctgattgccgaagcccaccggcttggcatccgcgtgatgatcgacctcgttctgtcgcacacgtctgaccagcatccgtggttcgtggaaagccgcgccagccgcaacaatccgaaatcggactggtatgtctggtcggaagcgaagcccgatggcacaccgcctaacaactggctgtcgatcttcggcggttccggctggcagtgggatcccacccgcatgcaatattacatgcacaacttcctgacctcgcaaccggacctcaacctgcataaccctgaagtgcaggaggaactgcttaatatcacccgcttctggctgaagcgcggcgtcgatggtttccgcctcgacactatcaacttctatttccatgatctggaattacgagacaacccggcgctggcaccggagcgccgcaatgcctcgaccgcgcctgcagtcaatccctacaatttccaggaacatctctacgataagaaccgcccggaaaacatcgccttcctgaagcgcttccgcgcggtgctggacgaattccccgatatcgccgccgttggcgaagtgggcgacagccagcgcggtctcgaaatcgtcggtgaatacacctccggcgatgacaagatgcagatgtgctatgccttcgaattcctcgcacccgatgcgctcaccccccagcgcgttgccgatgtgcaggcggattttgcgcgcgcagcaccagagggctgggcctgctgggccttctccaaccatgatgtcgtgcgccatgtcagccgctggggcgagcatgtcgaggacaaggatgccttcgcgaagctgctgtcggcactgctgatgacgcagcgaggctccgtctgcatctatgagggcgaggaactgggcctcactgaagccgatattgctttcgaggacttacaggacccctatggcatccagttctggccggaattcaagggtcgcgatggttgccgcacgccgatggtgtgggatgcgggccatgcgcaggccggcttttcgacttcggacaagatctggctgcccattccggccgagcacaagcagcgcgccgtcagcgcccagcagggcaacgaggcgtcggtgctggagcattaccgccgcttcctcgccttccgcaaacagcacccggctttcgccaagggcggcatcgaattccagccgcttgagggagacgtgctgagctacacccgcaagctgggcaacgaaaccattctgtgccttttcaatctgtccgcaacgccggcaaatgccacgctgccgaaagggaactgggaggttctcgaaggccatggctttgcaagcggccttgaaggcacaagcgtagaacttccggcatggggcgctttcttcgcccgttacgcctgatagagcagg

SEQ ID NO: 38214 - DNA, 1329 bp, Agrobacterium tumefaciens; identical to SEQ ID NO: 35300

SEQ ID NO: 38215 - DNA, 1140 bp, Agrobacterium tumefaciens; identical to SEQ ID NO: 35301

SEQ ID NO: 38216 - DNA, 1719 bp, Agrobacterium tumefaciens; identical to SEQ ID NO: 35482

SEQ ID NO: 38217 - DNA, 771 bp, Agrobacterium tumefaciens; identical to SEQ ID NO: 35481

SEQ ID NO: 38218 - DNA, 1473 bp, Agrobacterium tumefaciens
attgccgatggcgagccgatgatggcgatcgtgccggccgccgttgcggtccttatcctcgggcttctcaaggcgtggctggaaaaagtcgcggcgcggctgtccttccgggccgcgcgcgcagcactttcgcagcggcggttcgaggcgttgcaggccgtggcgaaggtttccccgctcgatctgtcgcgcacggcctcgggtgaggcggcaggtatcgtggcggaggctgcggaagcgctggtgccctatctttcccggttccagccggcgcgcatgaaagccaccatcgttcccctggttttcgtgctcgccatcctgccctttagctggattgcggcgcttgtgcttctgctcgccatgcccaccatcccgcttttcatggccctgatcggctggcaggcaaaggccgccagtgaaaagcagctggccgagacgggcaacatcaacgccttcctgctcgatcggctgcgcgggctggaaacgatccgcacgctcaaggccgttgacctgacggcggcgcgcctcgatgccgatgcgcagaacctcaagaagcggacgatggccgttctgaggatcgccttcctctcctccgccgtgctggagctttttgcggcgatcggcgttgccatgaccgccgtttatatcggtttccacctgctcggttttctcgatttcggcgcgtggggcgaaaagcttacgctggccgaaggcctcttcatcctgctgcttgcacccgcttttttcgagccattgcgcgaactctccgccgtctggcacgaccgcgcggccggcgaggcgtcacttaatgcgctcgccacattaacggccggcggtgctgccatcgtgggtgagggcgcggatgtggtgcgcgcgccatcttcgacacccggcctgctggagatggaaaacctttccttcgcttacccgaatgctccgcctgtcatccggaatttcaacctgacggttcagcagggcgagagagttgcgattcttggggcttccggttgtggcaaatccactatactctccttgattgccgggctggccgaggcgggtgagggcgtaatcaggatcggcggcgtcacgcttgatgacgcaacggctgatgggctgcgcggaacgatcggctgggtcagtcagaagccattcttttttgccgcgtccatgaaggcgaatattggttttggccgcttggcggtcagcgaggccatggtggaagaggtcctgcaccgcaccggactggatggattgacgcaggcgcgccggcatttgcagatcggagacggcggaaatggcatttcgggcggggaggcggtgcggctcgccatagcgcgcgctttcgccgatccggcaacgcagcttgttctggccgatgagccgaccgcgcatctcgaccgggaaacggctgctctcgtcacggataacctgctgcaactggcaaagggcaggacattgatcgtcgcgacccat

SEQ ID NO: 38219 - DNA, 975 bp, Agrobacterium tumefaciens; identical to SEQ ID NO: 35066

SEQ ID NO: 38220 - DNA, 723 bp, Agrobacterium tumefaciens; identical to SEQ ID NO: 35065

SEQ ID NO: 38221 - DNA, 1617 bp, Agrobacterium tumefaciens; identical to SEQ ID NO: 35284

SEQ ID NO: 38222 - DNA, 1473 bp, Agrobacterium tumefaciens; identical to SEQ ID NO: 35285

SEQ ID NO: 38223 - DNA, 1104 bp, Agrobacterium tumefaciens; identical to SEQ ID NO: 35351

SEQ ID NO: 38224 - DNA, 405 bp, Agrobacterium tumefaciens
atcatcgtcatcaacggccccaatctcaatatgctgggaaaacgggaaccgggtatctacggtggcaaaacgctgaaagacatagaaaacgattgtgtgaacgccggagccgatctcggcttttcggtggaatttcgccaatccaaccacgagggcgtgctcgtggactggctgcatgaggcgggcgagcgggcggcgggtgtcgtcatcaatcccggcgcttacagccacacctccatcgccctgcacgacgccattcgcgcaatttcgactccggtcgtggaagtgcacatctccaatatccatgcacgggaagaattccgccacaaatcaatggtctcgcccgcagccaagggcatgatctgcggtttcggaccatatggatacgtcatggcgcttcacgcg

SEQ ID NO: 38225 - DNA, 678 bp, Agrobacterium tumefaciens; identical to SEQ ID NO: 35392

SEQ ID NO: 38226 - DNA, 528 bp, Agrobacterium tumefaciens; identical to SEQ ID NO: 38060

SEQ ID NO: 38227 - DNA, 1254 bp, Agrobacterium tumefaciens; identical to SEQ ID NO: 37980

SEQ ID NO: 38228 - DNA, 1344 bp, Agrobacterium tumefaciens
cagatgtggggcggacgttttgcttccgggccatcagccatcatggaagagataaatgcctccatcggcttcgacaagaagctttatgcccaggacatccgcggctctatagcgcacgccaccatgctggcggaaaaaggcattatttcgcaggaagataaagagaagatcgttcacggcctgaacacgatcctgtcagagatcgaagccggcaccttcgaattctcgcgcaagctcgaagatattcacatgaacatcgaggcgcgccttgcaaccctcatcggcacggcggccggccgcctgcacaccgcgcgctcgcgcaacgaccaggtggcgctcgatttccgcctgtgggttaaggaagaattgcagaagaccgagggcatgttgacagccctcatcgccgccttcctcgaccgcgccgaggaaaatgccgataccgtgatgcccggcttcacccatctgcagacggcgcagcccgtcaccttcggccaccattgcatggcctatgtggaaatgttcggccgtgaccgtgcccgtgtgcggcacgccatcgagcatctggacgaaagcccgatcggcgcagccgcgctggccggcaccggctaccccatcgaccgccatatgacagccaaggcgctcggtttccgcgagccgacccgcaactctatcgacaccgtctccgaccgcgatttcgcgctggaattcctgtcgatcgcttcgatctgcgccacgcatctgtcgcgtctcgccgaagaaatcgtcatctggtcgacgccgcaattcggtttcatccgcctctcggatgccttttccaccggctcttcgattatgccgcagaaaaagaaccctgacgccgccgaactggtgcgcgccaagactggtcgcatcaacggctcgctggtggcgctgctgactgtcatgaagggcctgccgcttgcctattccaaggacatgcaggaagacaaggaacaggttttcgactccgccgaaagcctggaattggcgattgccgccatgaccggcatgatacgcgacctcgaggtgcgcaaggaccgtatgcgtgcggccgccggttcgggttattccacagccaccgatctcgccgactggctggtgcgcgaggcgggcctgccgttccgcgatgcccaccatgtgaccggcaatgccgtggcgctggcggagaaaaagggctgcgatctggccgatctttcgctggaggaattgcaggccatccaccccgacatcaccaacggtattttcgacgttctctcggtcgaggcatcggtcgccagccgcacaagctttggcggcaccgctccttcggaagtcaggaagcagatc

SEQ ID NO: 38229 - DNA, 831 bp, Agrobacterium tumefaciens
atcggtgtcatcggagccggtcagatgggatgtggcattgcgcatgtttccgccattgccggctaccgggtccatatctacgatctttcgaaagaaggcatcgaggccggccttgccacgatcaacggcaatctcgcccgccaggtgaccaacaacaagctttccgatgatgcccgcaagcaggcgctggcgctcatcagtggatcgaccgacgtcaatgatctggcgccgatggatatcgtcatcgaggcagccacggaaaacgaagagatcaagcgcaagatttatgcgcaggtctgcccggtcctgaaacccgaggcgctgctcgccaccaatacgtcttcactttccatcacccgacttgcttccgccactgaccgccccgaacagttcatgggcatccatttcatgaacccggtgcccgtcatgaaactggtcgagctggtgcgcggcatcgccaccaacgaaaaaaccttcgacgcggcgaaagcctatgtgcggacgcttgaaaaggcgatcaccgtcgccgaggatttcccggccttcatcgtcaaccgcatcctgctgccgatgatcaacgaggcgatctacacgctgtatgagggcgtcggttcggtggaagccatcgataccgccatgcggctcggcgcgaaccacccgatgggtccgctgcaacttgccgatttcatcggtctcgatacctgtttgtcgatcatgcaggtgctgcatgacggtctctccgacagcaaatatcgcccctgcccactactggtcaaatatgtcgaggccggctggctcggccgtaaatccggccgtggcttctacgattac

SEQ ID NO: 38230 - DNA, 1776 bp, Agrobacterium tumefaciens
atttcgcccgacagcaccagcacccgctgcagtgcgtcatggaaaagaaatgaggatcgcaacgtgccaactttttccccaagtctcgagaaggcgctgcaccaggcactgacctttgcgaatgagcgtcaccacgaatatgcgacgctcgaacacctgcttctggcgctgatcgacgacgcggatgccgccgccgttatggctgcctgcaatgtcgatctcgacgcgctgcgcaagaccgtcagcgattacgtcgacaatgaactgactaacctcgtcaccggttatgacgaggattccaaacccacatccggcttccagcgcgtcatccagcgcgccgtcatccatgttcagtcgtccggccgcgaggaagtgactggcgccaatgtgcttgtggccatttttgccgagcgcgaaagccatgccgcctatttcctgcaggaacaggaaatgacccgttacgatgcggtcaattacatctctcacggcatcggcaagcgtccgggcacgtcgcagacgcgcgcgccgcgcggtgccgatgagcccgaaagcgaaagcaagcccagccgcggtaatcccgaggaagacggatcgtccgccaagaagcagcaggatgcgctgaaggcctattgcgtcaacctcaacgacaaggcgaggaacggcaagatcgacccgctgatcggccgtcacgacgaggtcaatcgcaccatccagattctctgccgccgctccaagaacaacccgctttatgtgggtgatccgggcgtgggcaagacggcgatcgccgagggcctggccaagcgtatcgtcgaaggtaaggtgccggaggcgctcgccaatgacaccatcttctcgctcgacatgggcacgctgcttgccggcacccgttatcgcggtgatttcgaggagcgtctgaagcaggtcgtcaaggaactggaagagtttccgggcgcggttctgttcatcgatgaaatccataccgtcatcggtgccggcgccacatccggcggcgcgatggatgcatcgaacctgttgaagcctgcgctgtcatcgggtgctatccgttgcatcggttcgaccacctacaaggaatatcgccagttcttcgaaaaggaccgcgcgctggtgcgtcgtttccagaagatcgacgtcaacgagccgtcgatcgatgatgccattgcgatcatgaagggtctgaagccctatttcgaggattatcatcacctcagatattccaacgaggcgatcaaggccgccgttgaattgtcggctcgctatatctccgaccgcaagctgccggacaaggcgatcgacgtgatcgacgagacaggtgccgcacagatgctgctgccagcctccaagcgccgcaagctgatcaccgaacgggaaatcgaggccaccatcgcgacgatggcccgcattccgccgaagacggtttccaaggatgacgagatggttctcgccaatcttgaaaaggaactgcgctcggtcgtttatggtcaggacatcgccatcgaggcgctggcgaccgccatcaagctggcgcgtgccggcttgcgcgagccgaacaagccgatcggctcctatgtcttctccggcccgacgggcgtgggcaagacggaagtggccaagcagcttgccgcctcgctcggtgtcgagatgctgcgcttcgacatgtcggaatatatggagcgccataccgtctcacgtctgctcggcgcacctcccggttatgtcggcttcgatcagggcggtcttttgaccgacggcgtcgat

SEQ ID NO: 38231 - DNA, 819 bp, Agrobacterium tumefaciens; identical to SEQ ID NO: 38094

SEQ ID NO: 38232 - DNA, 804 bp, Agrobacterium tumefaciens; identical to SEQ ID NO: 38095

SEQ ID NO: 38233 - DNA, 2505 bp, Agrobacterium tumefaciens; identical to SEQ ID NO: 35267

SEQ ID NO: 38234 - DNA, 1487 bp, Agrobacterium tumefaciens
gtggccgcaggccacgccaagcagccattctacaagcacctggtattttcaggttctggtggccatcatcgccggtatcgcactcggccatttttacccgaccttcggcgaacagctgaagccgctcggcggacgagcttcatgcgtctcgtcaagattgatcatcggtcccgtcatcttcctcaccgtcgcaaccggcattgccggcatgaacgacatgaagaaggttggccgcgtggccggagcggctcatgatctacttcctgggcttctccacggctcgcgctcatcgtcggcctgatcgttgccaacaccggtgcagccgggcgccgggatgaacatcgatccggcgaccctggatgccaaggctgtcgcgacctatgccgacaaggcccatgagcagaccatcaccggcttcctgatgaacatcattccgaccaccatcgtcggtgcgtttgccagcggtgatatcctgcaggtgctgttcttctccgtgctgttcggcatcgcactcggcatcgtcggcgaaaagggcaagcccgtcaccgatttcatgcatgccatgatgtacccgatcttcaagctggtcgcgatcctgatgaaggccgcccccatcggcgctttcggtgccatggcatttaccatcggcaaatacggcatttcctccgtcaccaatctcgccatgctgatcggcaccttctacatcacgtccgcgctcttcgtgttcgtggttctcggcgcggtctgccgttataacggcttctccatcgtcgcgctgatccgctacatcaaagaagagctgctgctggttctcggcacctcttcatcggaagcagccctgccgggcctgatgagcaagatggaaaaggctggctgcaagcgctccgtcgtcggcctcgtcatccccaccggttactccttcaaccttgatggcaccaacatctacatgacgctggccgccctcttcatcgcgcaggcaaccggtatccacctgtcctttggcgaacagatcctgctgctgcttgtggccatgctctcctccaagggcgctgccggcatcactggcgctggcttcatcacgctggccgcaaccctctcggtcgtgccttcggttccggtcgccggcatggcgctgatcctcggcatcgaccgcttcatgtcggaatgccgcgcgctcaccaacttcgtcggcaatgctgtcgccaccatcgtcgtcgcccgctgggaaggcgaactcgaccaggagcagctcgcgcgcgtcctcagcggcaaggaagaattcaccagcattgccgatgtggacgccctgccggcatcggtgcagcccgccgaataatacgacctcccaaggtcctgcctgttccggttcgtccggacaggcccgcatgaaggccggcgtatcctgtggatgcgtcggcctttcatcgttccggccctgaacgaaaacggtttttatcggcccggcgatgctgtagagccagacaggg

SEQ ID NO: 38235 - DNA, 1209 bp, Agrobacterium tumefaciens; identical to SEQ ID NO: 35345

SEQ ID NO: 38236 - DNA, 1198 bp, Agrobacterium tumefaciens; identical to SEQ ID NO: 35344

SEQ ID NO: 38237 - DNA, 1397 bp, Agrobacterium tumefaciens
acaaaattcaagacattcgcattgaccagccaggcactcggctgaatcgggagagacccatgttaagcaattcactgatcgaactggaccgcgcccatctggtgcaccctgtctcctccttccgcggccatgaaaagctcggcgtgcgggtgctgaaatctgcaagcggcgccaccgtcaccgatatgaccggccatcagctgatcgatggttttgccggcctctggtgcgtcaatgccggttacgggcacgacagcatcgttgaagcggcggcaaagcagatgcgtgaattgccctatgccaccgcttatttcgacattggcagcgaaccggcgatccggctggcctcggaacttgccgaccgcgcgccgggtgatctcaaccacgtctatttcacgcttggcggttccgatgccgtggacagcaccatccggttcatccggtattactggcatgcgaaaggccagccgcagcgcgaccagttcatttccatcgaacaggggtatcacggctccaccaccgccggctccggcctcactgcgctacccgctttccacgcgggtttcggcgtgccctatgactggcagcacaaaattccgtcgcattatgcctatcgcaatcccgccggcagcgatccggccgccatcatcgcatcctccctgcaaattctgaaggacaagatcgaggccatcggcccggaccgcgtggccgccttttatgccgaacccatccagggatcgggcggcgttctggtgccaccgccgggctggatcaaggccatgcgcgagctctgcagttcctatggcattctcttcgtcgccgatgaagtcatcaccggcttcggccgcacgggaccgctctttgcctgcgccgacgaggacatcgtgcctgatttcatcacggccgcaaaaggcctcacgtcaggttatgtgccgatgggcgccgtcttcatggccgaccatgtttatgatacaatagccgacttcgcgggcgaggccgccatcgggcacggatatacctattccgcccaccccgtcagcgccgctgtcggtctggaagtgctgaaactttatgaaggcggactgctggagaacggccgtcgcgccggtcaacggctgatggccggccttgaaggattgagaaaccacccgctggtgggtgatgtgcgcggccggggcatgctcgccgccattgaactcgtgaccgacaaggacaagaaaacgcccttgccggccgcagccgcccccgcgcgaaaagttttcgaccgcgcctgggaaaacggcctcatcgtacgcgccttcgcgaacggcatcctcggttatgcgccgccgctctgctgcaccgatggcgaaatcgacgccatcgtcgagcggacgctgaagacgctcgatcagacg

SEQ ID NO: 38238 - DNA, 645 bp, Agrobacterium tumefaciens; identical to SEQ ID NO: 35348

SEQ ID NO: 38239 - DNA, 1005 bp, Agrobacterium tumefaciens; identical to SEQ ID NO: 35347

SEQ ID NO: 38240 - DNA, 991 bp, Agrobacterium tumefaciens
atgaaattctcaatcgcagaggcggaggatctcgtatcctctatctttgagcgcaatggcgttctgccgcaaaatgcccgttctgtggcaaaggcgctggtcgcctccgaggcggctggccagggcggccatggttttcgccgtattcccgtttatgtccgtcaggcgcgggttggaaaggtggacggtcaggcgcgtcccgtggtgaggcgcgtgaagccgggcgtgctctcgatcgacgccaatcatggttatgcctatccggcgatcgactgcgctcttgaagaattgcctgaaatggcccgacagcagggcattgcgctggcagcgatccatcgctcccaccatgcaggcgtcatggctctgacggtcgagcgttttgcggaaatgggccttgtcgcgctcatgttcgccaatgcaccagcctccatggctccctggggcggccacacgccgctttatggcaccaaccccatcgcctttgcggcccccattggcggcgccgatccgctcgtcatcgatctggccctgtcaaaggtcgcgcgcggcaagatcatggcggcacgacagaaggggtgaaaccattcccggcgactgggcgctcgatagaaacggccggccgacgaccgatccagaggaggccattgccggaaccatggtccccgcgggtgaagccaagggcgctgctctggcgctgatggtggagatcatggcagctgcggtgactggtggaaatttcgcattccaggcatcgtcccttctggatgataagggtgcgccgccctccctcggccatacgatcatcgccatcgacccggtatcctctggcggcgcagcctttaccgagcggctggccctcatcgcgggtgagatcgaaaagcaggaaaatgtgcggttgcccggtcgccgcagccagggcatccgcaagcaggcgctcgaaagcggcattgcgatcgaaagcgacattctggccgaaatccaatcgctttga

SEQ ID NO: 38241 - DNA, 921 bp, Agrobacterium tumefaciens; identical to SEQ ID NO: 35349

SEQ ID NO: 38242 - DNA, 996 bp, Agrobacterium tumefaciens
aaccttttgaaaaaacttgatcttatcacgatcgggcgctcgtctgtcgacctatacggttcgcaggtcggcggccgtctggaggacatggcctcctttgccaaatatattggcggctctcccaccaatatcgcagcgggtgctgcgcgccttggattgaacagcgccgtcattacccgcgtgggtgatgagcatatgggccgcttcatccgcgagcagctggtgcgcgaaggcgtcgatgtgcgtggcgtgaagacagacccggagcgactgaccgcgctggttctgctcggcattcgtgaccagaaccagttcccgctgatcttctatcgcgagaactgtgccgacatggcgctcagcgaagacgatatcgacccggccttcattgccgacgccggctgcatctgcgccactggaacgcatctgtcgcatccgaacacggaagctgccgtactgaaggcgctgaagctcgcccgtgaaaacggtgcaaagaccgcactcgatattgattaccgtcccaatctctggggtgttgccggccatggcgatggcgaaagccgtttcgtcgaatcgcagaaggtcactgccaagctgcaatccaccctgcatctctttgacctgatcgtcggcacggaagaggaattccacatcgccggcggctccaccgatacgctgaccgcgctcaacgccgtccgcaaggtctcgaatgcgacgctggtgtgcaagcgcggcccgatgggcgcttcggtcttcaccggcgatattcctgatagcctcgacgatggagaaacgggcgaaggtttcccgatcgaggtcttcaatgttctcggtgcgggcgatggtttcatggccgggctgttccgcggctggctgcgcggcgaggactggccgacgacactgaaatatgccaatgcctgcggcgctttcgcggtctcccgccatggctgcacgcctgcctatccgagctgggaagagctgcaatatttcttcaaggcc

SEQ ID NO: 38243 - DNA, 1329 bp, Agrobacterium tumefaciens; identical to SEQ ID NO: 35421

SEQ ID NO: 38244 - DNA, 1032 bp, Agrobacterium tumefaciens; identical to SEQ ID NO: 35420

SEQ ID NO: 38245 - DNA, 1962 bp, Agrobacterium tumefaciens; identical to SEQ ID NO: 35110

SEQ ID NO: 38246 - DNA, 866 bp, Agrobacterium tumefaciens
aagaaaattcggaaggccgtatttccggtcgcaggtctcggtacacgtttcctgcccgccaccaaggcagttccgaaagaaatgctcaccgtcgtcgacaagccggtcattcagtacgttgtcgatgaggcggcggaagcgggtatcgagcattttgtatttgtcaccggccgcggcaaggcagtgatcgaagattattttgatattcaatttgaacttgaacagatgctgcgcgagcgcaacaagaatgccgagctgacattgctggccggccttctgcccaaggcgggcacggcaagcttcacgcgccagcaggtgccgctcggtctcggccatgcggtttggtgtgcgcgtgatatcgtcggcgatgagccttttgccgtgcttttgcccgacatgatcatgcattcgcaaaaaagctgcctgaagggcatggtcgaactttacgaccagacccagggcaacgtcatcgcggtgcaggaatgcgctcccgaccagacgcataaatatggcattgttggcgtgggaaatgccgtcggcgaaggcttcaagattaccgaaatggtcgaaaagccagccaagggtacggcgccgtcgaatttctacatcaacggtcgttatatcctgcagccggaaattttcgatattctcgaaaatcaggaacgcggcgccggtaacgaaatccagttgacggatggcatgctgacgctcgccaagtcgcaagaattctccggctatacatcttccgtgggcagaccttcgattgcggcgccaaggatggtttcatcctggcaaacgtcgctttcgcactggagcgcggcgatatccgtccggcgatcgaggagccgatcaaggctttgatcgag

SEQ ID NO: 38247 - DNA, 1425 bp, Agrobacterium tumefaciens; identical to SEQ ID NO: 35320

SEQ ID NO: 38248 - DNA, 831 bp, Agrobacterium tumefaciens; identical to SEQ ID NO: 35321

SEQ ID NO: 38249 - DNA, 726 bp, Agrobacterium tumefaciens; identical to SEQ ID NO: 35044

SEQ ID NO: 38250 - DNA, 1203 bp, Agrobacterium tumefaciens; identical to SEQ ID NO: 35158

SEQ ID NO: 38251 - DNA, 1425 bp, Agrobacterium tumefaciens
ctgttcattgatggccgtttcgtcgagccccgaagcggcaaattcgtcgatagctacgatccaaccacgggcgaagcctggtaccaatttgcagaaggcggtgccgacgacgtcgatctggcgatatcctctgcacagcgtgccttccgtgatccgtcctggcggcgcatgacgcagaccgcccgcggtaagctagttcgccggctggccgatctcgtgctggaacatgctgaagatctcgctttgctcgagacgcgcgacaatggcaagctgatcaaggaaatgcgcgcgcaaatgcgggcaattccagactcctacctctattttgccggcatggccgataagctgcagggcgacacgatccccgtcaacaagctcgaccagctgaacttcaacatgcgcgagccgctcggtgtcatcggcatggtgaccccgtggaactcacctttgatgctgcttaccggaacgctcgccccgtgccttgcaatcggcaacacggtggtaatcaagccttccgaacacgcgactgcctccacactcgcgcttgcggaactgatcgtagaggcggggttcccggccggtgtggtcaatgttgtcactggcggtggcgcggtaaccggtgaggctttgacccgccacaacggtattgccaaattcgtcttcacaggtagcaccgcgactggtcggcgcatcgccgcgaacgcggcggccaacctggtgccatgccagatggaactgggcggcaaatctccgcatgtcgtgttctcggacgtcgacattgaaaagacggttaacggggtcgtctcgggtgtcttcgctgcagctggacagacctgcgttgcgggatcacgctgcttcgttgaagccaatatctatgatcggttcatcgaagcgctggtggagcgcacccgcaacatcaagctcggcgacccgatggatgacgcgaccgacatcggcccgctcgcactcgaaagccagctatcaaagctcgaggggtacgttgcctccggcgtccgcgaaggttcgcgcatcgcaatcggtggcaaacgtccgcaatcggaggaactgtcgaggggctggtacttcgagccgacggtgatggcggatgcaaccaacgacatgagcttcatgcgccatgagttgtttggcccgatggtcggggtcatgcccttttcctccgaagaggaaatgatctcgcttgccaacgatacgaattacggcctggcatcgggcatctggacgcagaacatcgatcgcgccatgcggttcgccaaccagatcgacgccggcaccgtgtggatcaacacctatcggtcggccgcttacatgtccgccaatggcggcttcaaggaaagcggttacggccgccgcggcggcttcgacgtgatgcgcgaattctctcgcgccaagaatgtcgtcatcgac

SEQ ID NO: 38252 - DNA, 1431 bp, Agrobacterium tumefaciens
tatattctggcgatcgatcaggggacgacatcgacgaggtcgatggtctttgatcgcgacatgcgggtgatcggtgtcggccagcgagaatttccgcagcatttcccggcctccggctgggtcgagcacgatgccgaagatatctggaaaagcgtgctcgaaaccatccggctggcgcttgccgatgccggcatcgccgcatccgatattgcagcaatcggcatcacaaaccagcgtgaaacaaccgtgctgtgggaccgcaacaccggcgaggccgtgcatcgcgccgtggtctggcaggatcgtcgcgccgcgccggtctgcgaggacctgaagcgccgagggctggagccgctgttttcgaaaaagaccggactgctgctcgatccctatttttccggcaccaagctgaaatggcttctcgatagcgtcagcggccttcgcgaaaaagccgtgaagggagaaatctgcttcggcaccgtcgacagtttcctgatctatcgcctgactggcggccggcgtcatgtgactgacgccactaatgcctcccgtaccttgatctacaacatcgaagacaacgcctgggatgacgaattgctgtctatccttaacattccccgcgccatgctgccggaggtgctggactgcgctgccgatttcggcgtgacggataaggcgcttctcggtgcggaaattccaatcctcggtgtggccggcgatcagcaggccgccgttatcggcaatgcctgcttcgagccgggcatgatgaaatctacctatggcacgggctgctttgcccttctcaataccggcacagaccgggtggcatccaccaaccggttgctaacgacgattgcttaccgcctcgatggcgtgacgacctatgcgcttgaaggttcgatcttcattgccggcgccgccgtgcaatggctgcgtgacgaacttggtttcatctcggttgcgtctgaagtcagcgcgctcgccgaaaaggccgatcccaagcagcgggtttatctcgtgccggcctttaccggccttggcgcgccttattgggatgccgaggcccgcggagcgattttcggcctgacgcgcggtacgggacctgcggaatttgcccgcgcggcgctcgaaagcgttgcctaccagacgttcgatctcctggacgccatgcgcaaggactgggcgggtgacaatggcaagacggtgctgagggtggatggcggcatggtcgcttccgattggaccatgcagcggctggcggatattcttgccgccccggtcgatcgtccggtctttctggaaacgaccattctgggcgcagcctggcttgcggcctcccgcgccggcatctggccggaccgcaaggcctttgccgaccattggcgccgtgaccgccgcttcagccccgacatggaagaaagcgagcggaag

SEQ ID NO: 38253 - DNA, 882 bp, Agrobacterium tumefaciens; identical to SEQ ID NO: 37975

SEQ ID NO: 38254 - DNA, 763 bp, Agrobacterium tumefaciens; identical to SEQ ID NO: 35488

SEQ ID NO: 38255 - DNA, 2103 bp, Agrobacterium tumefaciens
ctggattatcacgcgctgaacgcgatgctgaacctttatgacgagaacggaaagatccagctcgacaaggaccgtctggctgcccggcaatatttcctccagcacgtcaaccagaacaccgtcttcttccataatctgcgggagaagctcgattatctggtaacggagggatattacgagcaggaagtgctggaccagtactccttcaatttcgtccgtgacctctatgacgaggcctattcccggaagtttcgttttccgaccttcctcggcgcgttcaaatattacacgtcttatacgctgaagaccttcgacggaaaacgttatctcgagcgttacgaggaccgggtctgcatggtggcgctggctcttgcgcgcggcgacgagcagctggcccgtgatctcatggacgagatcatttccggccgttttcagccggcaaccccgacattcctcaacgccggcaagaaaagccgcggcgagctggtctcgtgttttctgctgcgcgtggaagacaatatggaaagcattggccgctcgatcaattcggctctccagctttccaagcgtggcggcggtgtggcgctgtccctgaccaatattcgcgaattcggggcaccgatcaagcagatcgaaaaccagtcttccggcgtcattcctgtcatgaagcttctggaagacagcttttcctacgccaaccagttgggtgcacgccagggcgcgggcgcggtctatctgcatgcccaccaccctgatatcatgcgtttcctcgataccaaacgcgaaaatgctgacgaaaaaatccgtatcaagaccctgtcgctcggcgtcgtcatccccgacattaccttcgagctcgcccgcaacaatgaggatatgtacctgttctcgccctatgatgtggagcgggtctatggcgtgccgttgacggagatctcggtcaccgaaaaatatcacgagatggttgccgacagccgcatccgcaagaagaagatcaaggcacgtgaattcttccaggtgatcgccgaaatccagttcgaaagcggttacccctacatcatgttcgaggatacggtgaaccgcgccaatccggtcgccggccgcatcagcatgagcaatctctgctcggaaattttgcaggtcagcgaagcgagcgagttcaacgccgatctctcctatagccatatgggcaaggatatctcgtgcaatctcggctcgctcaacattgcctctgccatggactccgctgatttcggcaagacgatcgagacctccatccgggcactgaccgccgtatcggacatgagtcatatttcctccgttccttcggtggaaaagggcaatgatgccagccacgccatcggccttggccagatgaacctgcacggttatctggcgcgtgagcgcatcttctacggttcggaggaaggtatcgacttcaccaatatctatttctacaccgtgacctatcacgccatccgtgccagcaaccggctcgccgtggaacggggccagagtttcaagggctttgagaactccaaatatgcctcgggcgactatttcgacaaatataccgaccgggaatggttgcccgcgacggaaaaggtccgcgacctgttcgaaaaggccggtattgccattccgacgcaggaagactggacggcgttgaaacaggacgtcatggcatcaggcctctataaccagaaccttcaggccgtgccgccgacgggctcgatctcctatatcaaccactccacttcttccattcatccgatcgtttcgaaaatcgaaattcgtaaagagggtaagatcggtcgcgtttattacccggcttcctatctctcgaacgataatctcgaatattatcaggatgcctatgagatcgggccggaaaagatcatcgacacctatgcggcggccacccagcatgtcgatcagggcctgtcgctgacgttattcttccgcgataccgccacgacgcgcgatatcaaccgggcgcagatttacgcctggagacgaggcatcaagaccatctattacattcggttgcgccagatggcgctggaaggcacgcaggttcagggctgcgtttcctgcacgctc

SEQ ID NO: 38256 - DNA, 939 bp, Agrobacterium tumefaciens; identical to SEQ ID NO: 35486

SEQ ID NO: 38257 - DNA, 1974 bp, Agrobacterium tumefaciens; identical to SEQ ID NO: 35248

SEQ ID NO: 38258 - DNA, 774 bp, Agrobacterium tumefaciens
atggatttcggcatttccggcaaacgcgccctcgttctcgcctcctctcgcggccttgggctgggcattgccaccgcgctggcgaaagagggcgcaaacgtccttctggttggccgaagcggtgaaaagctggcggaaaattgcaaggcgatcaatgcgctcggcaagggcaaggccgactgggtgtggggtgatcttgccgatgacaatttcgtcgaatccatggttcaggccgtcgaggacaagctcggcggcatcgatattctcgtcaacaataccggtggtccgacgcccggccttgcgcaggaaatgacggtcgacaagctcgacaccttcttccagtccatggtgctgcgggtcatcacgctgaccaacgcgctgctgccgcagatgaaggaacagggtttcggccgcatcctcaccgtcgcctcgtcaggcgtgttcgaaccgatccccaatctcgccctttccaacaccctgcgcggcgcgcttgtcggctggagcaagacgctgtcgtcagaagtggcctccttcggcatcacctccaacctgctgctgcccggccgcatccataccgaccgcatcgacgagctggatggcgccaatgccaagcgtctcggcaagagcattgaggaagtgcgtgaggcctccgtcaagggcattccggccggccgtctcggcacggtggaagaattcgccgccgccggcgctttcctctgctcggtgccggcgagctatattaccggcacgatgctgcgggtagacggcggcgcc

SEQ ID NO: 38259 - DNA, 1500 bp, Agrobacterium tumefaciens; identical to SEQ ID NO: 35445

SEQ ID NO: 38260 - DNA, 720 bp, Agrobacterium tumefaciens; identical to SEQ ID NO: 35444

SEQ ID NO: 38261 - DNA, 912 bp, Agrobacterium tumefaciens; identical to SEQ ID NO: 38098

SEQ ID NO: 38262 - DNA, 926 bp, Agrobacterium tumefaciens
gcctacacctatgtcgatcactcctatgacgtgatcgtggtgggcgccggtggcgccggtctacgcgcaacgctcggcatggcggaacagggtttccgcacggcctgcatcaccaaggttttcccgacccgctcccacacggtcgcggcgcagggcggcattgccgcatcgcttaccaacatgacgcccgactgttggcagtggcacctttacgacaccgtaaagggctccgactggctgggcgacgtcgatgcgatgcaatatctcgccatggaagcgccgaaggcggtctatgagctggaacattacggcgtgcccttctcgcgcaatgccgagggcaagatttaccagcgcccgttcggcggtcacatgcagaattacggcgaaggcccaccggtacagcgcacctgtgctgccgccgaccgtaccggccacgccattctgcacacgctctatggccagtcgctgcgcaacaatgcggaattcttcatcgaatatttcgcgctcgacctcatcatggcgccagatggtcgttgcacgggcgtcgttgcctggaacctcgatgacggcacgatccatcgattctccgccaagatggtggtgctggcgaccggcggttacggccgcgcctatttctcggcgacctctgctcacacctgcaccggcgacggcggcggcatgattgcccgtgccggcctgccgcttcaggacatggaattcgtacagttctcatccaaccggcatcttatggtgcagcctgcttcatcatcgaaggcgcgcgtggcgaattcagttccttagtcaactcacaagtcgaacgcttcacacagcgttatgcaccatagttgaacatccttgcctcacgtgacggtgtctattcgtgcgtgagaatgataatccgtcaagctgtcggcgccggccagttc

SEQ ID NO: 38263 - DNA, 1068 bp, Agrobacterium tumefaciens
cgcacgctcatcgacaatgagcgttaccagaaatggtatcaggagagcgtcgaggatccggaaaaattctgggacaagcacggccggcggatcgactggttcaagccctataccaaggtcaagaacacctcattcaaggggcgtgtgccgatcaaatggttcgaagacggcctgaccaacgtctcctataactgtatcgaccggcatttgaagacgcatggcgagcgcacggcgatcatctgggaaggcgacaatccctatatcgacaagaagatcacctataaccagctctatgattatgtctgccgtctggccaatgtgctgaagaagcacggcgttaagaagggtgaccgcgtcaccatctacatgccgatgattcccgaggcggcctatgccatgcttgcctgcgcccgcatcggtgccgtgcattccgtcgtctttggcggcttctcgcccgaagcgctggccggtcgtatcgttgactgcgaatcgaccttcgtcatcacctgcgatgaaggcgttcgcggcggcaagccgatcccgctcaaggaaaataccgacaaggcgatcgatatcgccgccaagcaatatgtcatcgtcaacaaggttctggtcgtgcgccgcaccggcggcaagaccggctgggcgccgggccgcgacatctggtatcatcaggaaattgcgaccgtgaagccggattgcccgccggtgaagatgcgggcggaagatccgctgttcatcctctacacttcaggctccaccggcaagcccaagggtgtgttgcacaccacgggcggctatctcgtctatacgtcgatgacgcatgaatatgtgttcgattacaaggatggtgaagtcttctggtgtacggccgatgttggctgggttaccggccattcctacatcgtctacgggccactcgccaattgtgcgacaacgctgatgttcgagggtgttcccaacttcccggatcaggggcgtttctgggaggtcatcgacaagcacaaggtcaatatcttctataccgcgccgacggcgctccgatcgctgatgggggcgggcgaccag

SEQ ID NO: 38264 - DNA, 768 bp, Agrobacterium tumefaciens; identical to SEQ ID NO: 38097

SEQ ID NO: 38265 - DNA, 1083 bp, Agrobacterium tumefaciens
gagcagcaatccagccccgttgccatcgcagccgcgctggccgaagatttcagccagacggcggctgaccacgacaaaagcggggaattcgccgccggcaatttcgaagcgcttttcaagtcgggtctgctcggcctggtgacggctgtgaaggatggaggctggggcgagggcatggaaacggcgcatgccgtcattacggccattgccaagggcgatccgtccaccgcgctcattctggccatgcactacagcgttcacgccgcgatccggcgcggcaaatggccggctgctctctcggcaaaggtattggtcgccaataatagggagccggcgcttctgaacaatgcgcaggcggagccgggtgtcggttcacccgcccatggcggcctgccggaaacgacggcgcggatcgaaggcgatgtctgggtggtcaatggccgcaagagcttcgtcaccggcctgccggggctgaaatgggcgatcgtgcttgcggtgacgacggaagagacgccgcgtctcattcagcttctggttccactcgatgctgctggcatcgcccaggaaaaggcatgggaggcgaccggcatgtatgccaccgccagccatgatcttgtgctggaggatgtaagagtgccgcttgcagacatcgttgccgaacagccagcggatgagccgctgcggcgcgatgaggccgatggctataattttttcgcgcttctggcgtccgtttatcatggtgtagcactttcggcgcgggatgatctgctgcgccatctgacgggccatgcaccagtaagcctcggtgcgccgctctcctccattccgcgtattcaggaaggtcttggccagatcgaggtgcttctcgcagcaaaccggcgcctgcttctttccgttgcccgtgatatcgatgcgggagagcgggtgggaacggatgcgctggccgttcgccatgtggtgatcgacaatgcggtgacggtgaccgatctggcgctggagcttggtggcaatcgcggcctgcggcgggactacaatctcgaacgccatcaccgcgatgccatcacggcaagggcgcatgcgccg

SEQ ID NO: 38266 - DNA, 795 bp, Agrobacterium tumefaciens; identical to SEQ ID NO: 35477

SEQ ID NO: 38267 - DNA, 2205 bp, Agrobacterium tumefaciens
ctcaagcggctgcgcgaaatgatggcggagcaccttgagccgcaggagcgtctggaccagatcgtccgtcagatagccagcaacatggttgcggaggtttgctcggtctatgtgctgcgctccgacagcgtgctggagctttatgccacggaaggtctcaacaaggatgccgtgcatcttgcccagctgaaaatggggcagggtcttgtcggcaccattgccgcttccgcccagccgctcaatctttccgatgcgcaggcgcatcccgctttccgctatcttcctgaaaccggtgaggaaatttatcattccttcctcggcgtgccgattttgcgctccggtcgcactcttggcgttcttgtggtccagaacaaggccagccgaacgtaccgggaggatgaggttgaagcgctcgagacaactgcgatgctcatcgctgaaatagtggcgagcggtgaattgaagaagatcacccgccccggcgtggaactcgacctgacgcgcgccgtgtccatcgatggcgatgcctacggcgaaggcatcggccttggtcatgtcgtgctgcatgacccccgaatcgtcgtcaccaatcttctgaacgaggatgcggatacggaaatccggcgtcttgccgatgccatcggttcgctgcggctctccatcgacgacatgttgcagcgccgcgacgtgcctacggaaggcgaacatcgcgaagttctggaaacctaccgcatgttcgcccacgatcagggttgggtgcggcgcatggaagaggcgatccgcaacggcctgacggcggaagccgcggtcgagaaggtgcagagcgacaccaaggcgcgcatgatgcgcctgaccgatccctatctgcgcgagcgcatgcatgatttcgacgatctcgccaaccggctgctgcgccagttgatcggtttcggcggtcataatcccgcgcaggattttccgctcgatgccatcgtgcttgcccgcgccatgggggctgccgaactgctggattatccgcgtgagaagttgcgcggactggtgctcgaagacggcgcggtgacgagccacgtcgtcattgtcgcgcgcgccatgggtatcccgatcatcgggcaggcgaccggcatcgtcgcacttgccgaaaataacgatccgatcatcatcgatggcgatgacggccaggtgcatttgcgcccgatgtcggatttgcagcgcgcctatgaggaaaaagttcgcctgcgcgccaagcgccaggagcagttccgcgcgctgcgcaatgtcgagccgatcaccaaggatggccagaaggtcaatctaaagatgaatgcgggcctgctggttgacctgccgcagctggaggaatccggcgccgatggcattggcctgttccgcaccgagctgcaattcatgatcgcctccaatatgccgaagggcgaggagcaggaagctttctaccgctccgttctgcggcaggcaaagggcaagagcgttaccttccgcacgctggatatcggcggcgacaaggtcgtctcctatatgcgcggccaggaagaggaaaacccggcactcggctggcgggcgatccgcctgtcacttgatcgtccgggcctgatgcgcacgcagatgcgcgcgctgttgcgtgccgcttcaggtgctgaactgcgcatgatgttgccgatggtgacggaagtgtccgaaatccgcgccgcgcgcgacctgttgcagaaagaagagcagcatctgtcgaaggtcagacacgcgctgccgaaaaagctgaaattcggcgcgatgctggaagtgccgagcctgatgaggcagctcgatgagctgatgcaggaggtggatgtcgattccgtcagatcgaacgacctattccagttctagatggccggcgatcgcggcgatgcacgggtgtcggatcgttttgacaatctcggcaagccgttcctgcgcattctgcgcgatatcgtgcgcgccggtgagaaacaccacaccgccgtcacgctttgcggcgaaatggcaagcaagccactttcggccatggcgttgatcggccttggtttccgctcggtttctatgtctccgacggcgatcggtccggtcaaggcgatgctgctcgggctcgatgccgccaaccttgccgaagagctgaacgcggcgctggacgatcacaattcgctggaaagtgcgcgcgaggtgttgttacgc

SEQ ID NO: 38268 - DNA, 1266 bp, Agrobacterium tumefaciens; identical to SEQ ID NO: 35078

SEQ ID NO: 38269 - DNA, 1349 bp, Agrobacterium tumefaciens
ggtatcgccccggcgatcgcgcaggcgttggaaaaacgcggctacaaagacttgacccccgtacagcaagccatgcttgcgcccgaacttgccaacaaggacgcgctggtttccgcgcagaccggctccggcaagacggttgccttcggcatagcgcttgcgaccacgctgctgtcggaaaatacacgcttcggtcaggcttccgcaccgctggcgctggcaatcgcacccacccgcgaactggccatgcaggtcaagcgcgagctggaatggctttatgaattcgccggtgtctccatcgcatcctgcgtcggcggcatggatatccgcaacgagcgccgggcgctggagcgcggcgcccatatcgtcgtcggcacgcctggtcgcctgtgcgaccatatcaagcgcaatgcactcgatctgtcgtcgatccgcgccgtggtgcttgacgaggccgacgagatgctcgatctcggcttccgcgaagatctggaattcattctggaagaatcgcccgacgatcgccgcacgctgatgttctcggccaccgtgccgcgcagcatcgccaagctggccgaaagctaccagaagaacgccgtgcgcattgccaccgcttccgaacagaagcagcatgtcgatatcgaatatcgcgcgcttctggtgtcgccttccgatcgcgagaacgccatcatcaacgcgctgcgcttttacgaagcccgcaacgccattgtgttctgctccacccgcgccgcggtgaaccacctgacggcccgcctgaacaatcgaggcttctccgtcgtggctctctccggcgaactgacccagaacgagcgcacacatgccctgcaggccatgcgtgacggccgcgcccgcgtttgcgtggccaccgacgtagccgcccgcggtatcgacctgcccggcctggaactcgttatccatgccgacctgccgaccaattccgaaacgcttctgcaccgttcaggccgtaccggtcgtgccggccaaaagggcgtcagcgccatcgtggtaccggtcagtcagcgccgcaaggccgagcgcctgcttgagggcgccaaggtcagcgccgcatgggtgcgcccgccttcggttgaagagatcgtggagcgcgatggcgcacgccttctggccgacccgacgctcagcgaagcggtaacagatgacgaacgcgatttcgtcaacaagctgcttgaacagcacggcgcggaaaaagtcgccgccgcctttgtgcgcctttatcattcgggacgttcggcaccggaagacattttcgaagtcgcgctcgacaacactcgcaagccccgccgcgacagcttcgaaacaaccgaaaa

SEQ ID NO: 38270 - DNA, 729 bp, Agrobacterium tumefaciens; identical to SEQ ID NO: 35046

SEQ ID NO: 38271 - DNA, 855 bp, Agrobacterium tumefaciens
cgcgaccgcatcatcgccgaccttaaggatatcctgccggaggactgtcttgtgcacgagccgcgcgagctcgtgcctttcgaaaccgatgccttcgtctcctatcgccgcctgccgctggccgtagcactgccgaaaacgacggaagaagtggcggcagtgatgagatattgccaccgttacggcattcccgtcgtgccgcgcggcgccggcacctcgctgtccggtggcgctattccgcaagaggatgctgtcgtgatcggcctctcgaagatgagcgcgatcctcgatcttgatttttacaatcgcacggcgcgggtgcaggcgggtgtcaccaatctttccatttccgatgcggccggggctgagggttttttttatgcgcccgatcccagctcgcagctcgcctgcaccattggcggcaatatcggcatgaattccggtggtgcgcattgtctgaaatatggtgtcaccaccaataatctgcttggcgtgaaaatggtgctggtggatggcacggtgctggaactgggcggcaatcacctcgatgccgcaggctacgatcttctcgctctcgtctgcggttcggaaggccagctcggcatcgtcacggaagcgacggtgcggctgatcgccaggccggaaggggcgcggcccgtgctgttcggtttcgagacctctgaagaagcgggctcctgcgtagccgatatcatcggcgccggcatcatccctgttgcaatcgaattcatggacaaaccggccatcgagatttgcgaggccttcgccaaggcgggctatccacttgacgtcggtgcgcttctgatcatcgaggtcgaaggctccgaggcggaaatg

SEQ ID NO: 38272 - DNA, 723 bp, Agrobacterium tumefaciens
ctcgaaaacaaggttgctatcatcaccggcgcgtcatccggcatcggccgggcgacggcgatgctgtttgtcacgcaaggcgcggcagtcgtcatcaatgcgcgcggtgaaaaggcgctgcaggaggttgcagccgacattcgtgatgccggcggccgtgtccatgcggttgcgggcgacgccggtgttgcggaaacccattcccggttggcggatgcggccgtgggcgttttcggtggcctcgatatcgccatcaataatgccggggcggtgggggctatgaagccgctggcggagatttcgcccgaggagtgggatcatgtcctcaacgtcaatctcacctccgcctttctgggggcgcgttaccagattccgccgatgctgaagcggggcggcggttccatcgtctttacgtcgagcttcgtcggcaccagcgccggcattcctggcatgtcggcttatggaactgcgaaggcagcgttaatggggctggtgaagggcattaccgccgattatgcgatcaatggcattcgcgccaatgccctgctccccggcggggtcgatacaccggccgcaggagacccggcgcagaaggaatgggccgccggcctgcatgcgatgaagcgcattgcccagcccgaggaaattgcgcaggccgctcttttcctcgcaagcccaatggcaagcttcgtcgccggggccgcattgtttgccgatggcggc

SEQ ID NO: 38273 - DNA, 498 bp, Agrobacterium tumefaciens; identical to SEQ ID NO: 37995

SEQ ID NO: 38274 - DNA, 1350 bp, Agrobacterium tumefaciens
tctgcgctcgcggtgctgaagcagcagctgggcgataagctccagacgggccaggcgtttcgcgagcagcatggccataccaccacctacctgaccctgcaggcgcccgacggtgtcgtttttgccgaaagcgccgatgatgtgaaggccgtggtaaaggcctgcgcgcaatacaaggtgccggtcattcccttcggaacgggatcttcgctcgaagggcaggtcaacgcgcccaatggcggaatatgcatcgatttcagccggatgaatcgcatcattgaggtgaatgccgaagatcttgacgtgacggtggagcccggcgtgacgcgcgaggatctgaatgtctatctgcgcgataccggcctgttctttccgatcgatcccggcgccaatgcttcgattggcggcatggcctcgacgcgcgcttccggcaccaatgccgtgcgttacggcacgatgaaggacaatgttctggccgtcaccgccgttgtcgccaatggtgaggaaatccgcactgcgcggcgcgcccgcaagtcgtccgccggttacgacctgacgcggcttttcgtgggggccgaaggcacgctcggtgtcatcacctcggtgacgctgcggctgcagggcattccggaaaagattaccggcggtgtctgcaccttcgacagtatcaaggcggcctgcgatgccgtcatcatgacgatccagatgggcgttccggtcgcccgcatcgaattgcttgacgaggtgcaggtgcgcgcctgcaatgcctattccggtctgaactatgcggaaaagccgacactcttcgtggagttccatggcaccgaggagacggcggcgctgcaatcgcagcagttcgccgagattgcagccgaatgcggcagcgtcgatttccgctggacgggcgatgcggcggagcgcaacaagctgtggaaggcgcgccacgacgcctattgggcgtcgcgggcgctggcaccacatctcgacgggctttccaccgatgtctgcgtgccgatttcacggctggccgattgcgtcgtggaaacgcagcgggatattgccgagaacggctttctggcgccgatcgtcggccatgcgggtgatgggaacttccatgtgcttattctgtttgatggcaaggacgccgaaagcgttgcgaaaacagaggcctttgttgcccgtctcaaccgccgcgccattgccatggacggcacatgcaccggcgaacatggcattggccagggcaagatgagttttcttgccgaagaggcaggaaatgcactggatctcatgcgcgccatcaaaacgtcgctcgaccccgataacatcttcaatccgggcaaattgttt

SEQ ID NO: 38275 - DNA, 1407 bp, Agrobacterium tumefaciens; identical to SEQ ID NO: 35237

SEQ ID NO: 38276 - DNA, 756 bp, Agrobacterium tumefaciens
caatccgtattcgtgaccgggggcaacaagggcatcggttacggcatcgcccgccgttttgccgaagaaggcgcgaaagtcgccatcgcctctgtcgacaaagacacacatgacgccgctaaaaaactggcggacgaaaccggcaccgtcacccatggcgtcatcctcgacgttagggatgcggcggcggtgcgtgacgcctatggcgctgcggaagacgcgatcggcgcgctttccatctccgtccagaacgccggcgtcatcactatctcaaagatcgaggatctgacgcaagaacagtgggatttgaacctcgacgtcaacaccaagggcgcgttcctctgctgccaggaggcaatccgtcgcttccgcgcaagcggcaccaagggccgcctcgtcaacaccgcctccggccaagcgcgtcagggcttcatctacacgccgcattatgctgcgtccaaattcggcgttatcggcctgacgcaaagcctcgccaaggaacttgcacctgagggcatcaccgtcaacgccatctgccccggcatcatccacaccgaaatgtgggattacaacgaccgcgtctggggccagatgctgggcgaatacaagcccggcgagttgatggccgaatgggtgcgcaacatccccatgcgtcgcgccggaacgcccgccgaagtggcggcgctggtggcatttctggcatcagaggatgcggcctatatcacggcccagacgatcaacgtcgatggcgggttg

SEQ ID NO: 38277 - DNA, 936 bp, Agrobacterium tumefaciens
gtttccatacggaatctgacaaaatcctacgcaaatggctttcaggcgctcaaaggcgtcagcctcgatattaaagagggggaaatccttgcccttctcggcccgaacggtgccggcaagacgacgctgatttccatcgtctgcggcctcgtcaatccgggggaaggttcggtgcttgtcggcggccacaatgtggtgaaggattttcggcagacccgcgcgcttatcggcctcgtgccccaggaactgacgacggacatgttcgagactgtgtggaacacggtcagcttctcgcgcggcctgcacgggcagaagaagaacccggcgctgatcgaaagcattctgaagtccctgtcgttgtgggacaagaaagacaacatgctgcgggaactttccggcggcatgaagcgtcgtgtgttgatcgccaaggcgcttgcgcacgagcctaaggtgcttttcctggatgagccgaccgccggcgtggatgtgaccttgcgccgcgacatgtggaatgtcgtttccgagctgcgcgccaagggcgtcaccatcattctgacgacgcattacattgaggaggcggaagaaatcgccgaccgggtgggtgtcatcaacggcggcgaattgctcctcgtggaagaaaagaccgcgctgatgaagaagctcggccgcaaacagctctttcttgaactgacgcaaccggtggaacggttgcctgacagtctcgccccctttgccctgacgctttcggacgaccgcagcacgatcacctacgaaatcgagggaaatggcgagcagggacgcatcgccgatctcctgggcgctctttctgccgccaacatccatttcaaggatatttcgacgcggcaaagctcgctcgaggatatcttcgtttcgctggtcggaggccagaaatgaatttcgaagccatcaagtcca

SEQ ID NO: 38278 - DNA, 906 bp, Agrobacterium tumefaciens; identical to SEQ ID NO: 35234

SEQ ID NO: 38279 - DNA, 735 bp, Agrobacterium tumefaciens
ctttccggtcaggtggcgctcgtcaccggtgctggatccggcatcggccagcggatcgccatggggcttgcccagtccggcgccaatgtcgcgctgctcgaccgccgcaccgatgacggtctggcgcagacggccgatttcatcgccagggccggccgcaagtcgatccagatcgccgccgacgttaccagcaagcaggcgctgacggatgcggttgcccgcacgcaagccgaactcggcgcactttcgctcgccgtcaatgcggccggcatcgccaatgccaatccggccgaggagatggaagaaagccagttccagacgatgatggacatcaacctgaagggcgtgttcctgtcctgccaggccgaagccaacgccatgctgaaaaatggccgaggtgccatcgtcaacatcgcgtcgatgtccggcgtcatcgtcaatcgaggcctgatgcagtgccattacaacgcctcgaaggcgggtgtcatccacatgtcgaaatccatggcgatggaatgggtgggtcgcggcatccgcgtcaacaccatctcgccgggctacacggcgacaccgatgaacacgcggcctgaaatggtgcaccagaccaagctgttcgaagagcagacgccgatgcagcgcatggcaggcgtcgatgaaatggtgggaccggcgatcttcctgctgtccgacgccgcgagttttgtgacgggtgtggatctcttggtggatggcggg

SEQ ID NO: 38280 - DNA, 1038 bp, Agrobacterium tumefaciens; identical to SEQ ID NO: 35243

SEQ ID NO: 38281 - DNA, 558 bp, Agrobacterium tumefaciens
agccaggccgaagcggaagaagccgtgcgcgttctcctgcgctgggcaggagaaaatcccgcccgcgaaggacttctggatacgccgaagcgcgtcgccaaggcctatcgcgagctttttgccggttatgagctgaatgttcaggacgtgcttggcacgaccttcgaggaagtcggcggttatgacgatgtggtgctggtgcgcgacatccccttcttctcccattgcgagcaccatatggtgccgatcgtcggcaaggcgcatgtcgcctatcttccggccggccgtgtgcttggcctgtcgaagatcgcccgcgtcgtcgaaatcttcggccgccgcctgcagacgcaggaaaacatgacggcgcagatcgcaagatcgatcgaagaaacgctgaaaccgcgtggcgtagccgtcatgatcgacgcggaacatatgtgcatgtccatgcgcggcgtaaacaagcaagggtccacgacgctgaccaccagcttcaccggcacgttcaagaacgatccggccgagcaggtgcgcttcatgaccatggtgcggaaccgc

SEQ ID NO: 38282 - DNA, 1200 bp, Agrobacterium tumefaciens; identical to SEQ ID NO: 35256

SEQ ID NO: 38283 - DNA, 816 bp, Agrobacterium tumefaciens; identical to SEQ ID NO: 35175

SEQ ID NO: 38284 - DNA, 792 bp, Agrobacterium tumefaciens; identical to SEQ ID NO: 35176

SEQ ID NO: 38285 - DNA, 1128 bp, Agrobacterium tumefaciens; identical to SEQ ID NO: 38068

SEQ ID NO: 38286 - DNA, 1044 bp, Agrobacterium tumefaciens
atcaaggaagcaaagatcggtacgctgcgcgttcccgaagccaagggcggaccgggcggctcgattgcggactatattgaggttctgatgatcctcggcgaagccgacagcaatattccgcacgcgctgcgcagccattttaatttcaccgaaaacctcgccctcgcccccatcgagctggaagaccggcggcatctcgaacaggtgcttgccggcaaactctttgcgggcgccagcaccgaacagggcaccaagcgcccgggcgaaatcaccacacggctgagcgccgatggcgaccgctaccggctgaacggccgaaaatggtatgcgaccggcaccgcctttgccgatttcggcactttcagcgcgatcggtgacgacgagcagccaatcggcgtgctcattccgctcgatcgcaccggcatcaccatcctcgacgactgggacagcatgggccagcgcatgacggcaagcggcggcgtgttactcgaaaatgtcgaggtgctgccgcatgaattgacaacccgcaagctcggcagccagatcggccgccacagctccgccatgcggcagttgcatctcgccgcctctgccgccggtgccgttcaaggcgcgctgaatgacggcgtggagtatgttctgcgccaggcgcgcaccacccttcacagcagcgcggaaaccgccaatcaggaccccttcgtgcagaagatgctcggcgaaatcagcgccggcgctttcgccgtcaaaaccctgatccgcgaggccgcccggacgcttgaccgcactgcggctaccttcgccaccggcgatgaagaggtgatcgaggcagccctgctggaaggctcgctcgccaccgcgcgaacccagatcatcgcctcgcagctttcgctgacggtcgccaccaacctttacgaactgggcggcggctcggcgacgtcaagcgagcggaatttcgaccgccactggcgcaacatccgcacggtctacaaccataatccactggcccacaaggcgcgggtgatcggcgattattatctcaacggc

SEQ ID NO: 38287 - DNA, 1209 bp, Agrobacterium tumefaciens; identical to SEQ ID NO: 35118

SEQ ID NO: 38288 - DNA, 1011 bp, Agrobacterium tumefaciens; identical to SEQ ID NO: 35117

SEQ ID NO: 38289 - DNA, 585 bp, Agrobacterium tumefaciens
atccatgccaaacgggctttcaaatctatgaatgaaacgaatttatccgtcccggccacactcggggagcaagcacgggcaaagctcggacggcgcaacatcgtcttcgtggggctgatgggggctggaaagtcggcggtgggccgcatggtcgcccagcagctcaaggtgcctttcattgatacggatgtcgaaatcgagcgcgtatcgcgcatgacgatatcggagcttttcgccacctatggcgaggaggaattccgggcgctggaaacgcgggtcatcaagcggttgatgcgcggcggtcccaaggtcgtctccacgggcggcggcgcatttatcaacgacactacccgaggccatatcaggcgcggcggcatttcgctgtggctgaaggccgatctcgaggttctgtgggagagggtcaacaagcgcgaccaccgcccgcttctcaagactgaaaaccccaaggcaacgctcgctgccctgatggagaaacgttatccgatctatgcggaggcggacgtcaccatcgaatcccgtgatgtccgcaaggagatcatcgcgaccgaagtgctgacggcttta

SEQ ID NO: 38290 - DNA, 1065 bp, Agrobacterium tumefaciens; identical to SEQ ID NO: 38023

SEQ ID NO: 38291 - DNA, 759 bp, Agrobacterium tumefaciens
ttggaaatagacgtctttctttgccgcagcgacaatttcggggttttgttgcacgatcccgaaagcggggcgacggccgccatagacgcgccggaagaaggccctatcctgcgcgcccttgatggccatggctggaagctcacacatatcttcaccacccaccaccatcaggaccatgtggaagccaatctggtgctgaaggacaagttccgttgcgaggtgcacggcccctacgacgaggcgattgcgataccgggcctcgaccgttcgcaggccgatggcgacgaattcgaatttgccggccgccgcgtgcaggtgattgccacacccggccatacggcagggcatatctgttattacctgccggatgacgggctgctgtttgccgccgatacgctgtttgccatgggctgcggtcggctgttcgaacggccggcggcggatatgtggcactccttccagaagctgatggccctgccggatgacacgcgggtctatttcggccacgaatacacgctttcgaatgcccgttttgcgctgaccgtcgatccagacaatgctgtgctgcgcgagcgcgcggcacgtgtcgagaccgcgcggcaggccaatgaattcaccattcccaccaccatcgggctcgaaaaacagaccaatccctatatgcgggtggcggatgccggtatccgcagacatctcggccttgaaggcgctgccgatgccgatgtcttcgcggaaatccgcacgcgcaaggataatttc

SEQ ID NO: 38292 - DNA, 1053 bp, Agrobacterium tumefaciens; identical to SEQ ID NO: 35308

SEQ ID NO: 38293 - DNA, 1059 bp, Agrobacterium tumefaciens
atgcgcgcgctcagatttcatgcagccaaggatttgcggatcgaagacattgccgagccgaaacggcctggcccgggacaggtcctcgtccgcaaccgtttcgtcggcatctgcggcaccgatctgcatgaatatagctacggcccgatcttcattcccaccgaaccgcatccttttaccggcgcccatggcccacagattctgggccacgaattcggcggcgtggttgaggcgatcggcgacggtgtgacctccgtcaacgtcggcgaccgcgtctccatccagccgctcatcatgccgcgatccggcgattatttcgctgatcgtggccttttccatctcagcacgcaactggcactggtcggcctcagctgggacggcggcggcatggcggaagccgcacttgtcaacgaatacaacgtccagaaaattccggacgagatgaccgacgaagaggccgcactggtggaaccctcggccgttgccgtttatgcctgtgatcgcggtggcgttaccgccggtaatagcgttctggtcacgggtgccggcccgatcggcatgttgacgcttctggcggcccgcgccgccggcgctacccagctttttgtctccgatctgaatgacgcccgcctcgagcttgcccgcaatgtcatccgtgatgtcatcaccatcaaccccaagcgcgataatgtcggtgatgtcgtccgctcggcaaccgaaggcaaggtcggctgcgacgtggcgatcgaatgcgtgggtaatgaacatgcgctcaaggcctgcgttgacgccgtgcgcaagcagggcgtcgtcgtgcaaaccgggctgcacccgcatgaaaacccgatcgactggttccaggtgacgttccgtgatctggagatcaagggctcctgggcctatccgacccattactggccgcgcgtcatccggctcattgcctccggcctgctgccggcgacgaagatcgtcaccaagcgcatcacgctggatacggccgtgaccgagggcttcgatgccctgctcgaccccgccggcacgcatctgaaaatcctgatc

SEQ ID NO: 38294 - DNA, 1726 bp, Agrobacterium tumefaciens
cggctttgttttcaaccattggagccaccgaaaggcgctcgtgggtttcatcatcgtgctggtggttgccagcacgctcgccgaagtgatggtgccggtcttttccggccggatcgttgatgccatcgctggtgacaatgggggtgccaatgcgggtgatggcgctctgcgcgctttcgtcatcgtggttgcgcttggctttaccagtgttgtgctgcgctggttcatcttcaacggcatcatccggctgacgctgaagaccatggctgacgtcaccaataacggcttccacaaggtgcagcgtttctccaccgactggcacgccaacagcttcgccggctcgacggtgcgcaagatcacgcgcggcatgtgggcgctggattcgctcaacgacctgctgctcgttgcgctcctgccctccatcgtcatgctggtgggcgccaccgtagtgcttggcagttactggccggtcatgggcctgatcgtcggcctcggctcgctgatctatatcggtgtcacggtcgggctttcgatgggttatgtgtcgccggcggcgcggcttgccaatgcctgggacacccggcttggcggcgcgctggcggatgcgatcagctgcaacgcggtggtcaaagccttcggtgccgaaacccgtgaagaaacgcggcttggtcatgtgctggtgaaatgggacaatcggacgcgcagaacctggaaacgtggaacgctgaacggcactatccagagcttcatgatggtatcgatgcaggcgggcatcctcggcaccggcctcatcatgtggcagaagggtctggcgacagcgggcgacatcaccttcgtgctggcgatgtttttcgtgttgcagggctatctgcgcgatgtgggccaggatatccgcaacctgcagcgcgccgtcaatgacatggaagagctggtgctgctcgacaagatgccgctgggtgtcgaagacaggccggacgccaagcggatcaatatcggcaagggcgagatcgtcttcgatcatgtcaccttccagtatggcgcgcatgcaaccccgctttatgaggacttctcggtcaccatcaagccgggcgagcgtgtgggtctggtcggtcactccggttcgggcaagacaaccttcgtcaagctcatccagcgcctttacgacataaaggcgggggctatccgcatcgacgggcagaacatcgccgatgtcacgcaggcgagcctgcgcggccagatcgccatcgtgcagcaggaacccatcctgttccaccgcacgctggcggaaaacatcgcctatggccggccggatgcctcgcgtcgtgagatcgagcaggcggcgaaacaggcgagcgcccatgatttcatcatgtccctgccgaagggttatgagaccatggtgggcgaacgcggtgtcaagctgtcgggcggcgagcgccagcgcgtcgccattgccagggcgttcctggcggatgcgccggtgctgatcctagacgaagcgacgtcaagcctcgacagcgaaagcgaagtgcagatccagcaggcgatggaacggctgatggatggccgcaccacgctcgtcattgcccaccgtctttccacggtccgggcgctcgaccggctgctggtgttcgacaagggcaggattgtcgaggagggcgaccatcaggcgctgatccgcctccatgacggcatctaccgccggctgttcgagcggcaggcgctg

SEQ ID NO: 38295 - DNA, 1725 bp, Agrobacterium tumefaciens; identical to SEQ ID NO: 35278

SEQ ID NO: 38296 - DNA, 930 bp, Agrobacterium tumefaciens
atgaaggttttcgcaggcaattcgaaccggcacctcgccgaagcgatctgcaagtatctgaacgttcctctcggaaatgccactgtaaagcggtttgctgaccaggaaatattcgtagaaatcagcgagaacgtgcgcggcgaggacgtttttatcgtccagtccacctccttcccggcaaatgatcatctgatggaactgctcatcatgatcgatgccatgcgccgctcttcggcaaaacgtatcaccgcggtgcttccctatttcggttacgcccgccaggaccgcaaagccggtccccgcaccccgatttccgccaagctcgttgccaacctgattaccgaagccggcgccgaccgcgttctaacgctcgatcttcatgccggccagatccagggttttttcgacatccccaccgacaacctcttcgcagcgcccattctcgcccgcgacgtgaaggaccattacgacaccaacaatgtcatggtcgtttcgcctgatgtcggcggcgtggttcgcgcccgcgccctgtcgaagcgcctcgactgtctgctggcaatcgtcgacaaacgccgtgaccgtcccggtgaatccgaggtcatgaacgtcatcggcgatgtctccggcaaggattgcatcctgatcgacgatatcatcgattccggcggcacgctctgcaacgccgccgaagcgctgctgaaaaaaggcgcgaccagcgttaccgcctatatcacccacggtgtgctttccggcggcgcggttgcccgcgtggcctcctcgaagctgcgcgaactcgtcatcaccgacagcatccagccgaccaccggtgtgcaatccgcgcacaatatccgcgtggtcagcaccgcaggcctgcttggcgaggcgatcaaccgcaccgcgcaggaacagtcggtctccggcctgttcgac

SEQ ID NO: 38297 - DNA, 789 bp, Agrobacterium tumefaciens
ctcgtcctcgtgggggccggcaatatgggcggcgccatgctttcgggctggctgaaaaagggtgtgccgggatcgaaggtcatcgtcatcgaccctcgcccctccgacgccatgcgcacgacgatagcggaagccggcgcgacccacagcgaaagcgtgcctgagggcgtcaaggccggcattcttttcgtggcggtgaagccgcagatgatggatgccatattgccgtcgctgaagcccctgctgggtccggaaacggtcgttgtctccatcgcggccggtaccaccatcgccactttcgtttcgcatttcggtgcggtcgctgccgtgcgcgccatgcccaatacgcctgccatggtcggccgtggcgtcaccggcgcttatgccaacgatcttgtcacagccgagctgaaaaccgttgtggacgggttgctgaaggtcagcggtccggtcgaatgggttgaggccgaaagcgacatcgacgcggtgaccgcggtttcgggaagcggcccggcctatgtcttctatctggtggaatgcatggcggaagctggccgcaaggccggtctgccggccgacgtggccatgcgtctggcgcgcgaaaccgtggccggtgccggtgaactcctgcatcagtcccccgaggaggccgcgcggctgcgccagaacgtgacctcgccgggtggcaccacggccgcggcgctgtccgtgctgatggccgaagacggcatgcagcccctgttcgacagggccgtcgccgccgcgaaaacgcgcgccgaagaactggcg

SEQ ID NO: 38298 - DNA, 717 bp, Agrobacterium tumefaciens
gattttaacggccggacagtggtgatcaccgccgccggtcagggtatcggccgggcgacggcggagcgtttcatatcgctcggcgcgcgcgtcatcgccaccgatatcaacgagcaggcgctttccaccctgaagggtgcggaaacgcgggttctaaacgtgcttgacggtgatggcgtcgaggatttcgcagccgatatcggccatgccgacgtgctgttcaactgcgccggcttcgtccattccggcaccattctcgattgtgaagagaaggactgggatttctccttcgacctcaacgccaaggcgatgtatcgcacctgccgcgccttcctgcccggcatgctggaaaagggcaagggcgcgatcgtcaacatgtcatcggttgcgtcaagcgtgaagggcgtgccgaaccgtttcgcctatacggcttccaaggcggccgtggtgggtctcaccaaggccatcgccgccgatttcgtcaccaagggcattcgctgcaacgccatttgccccggcacggtcgatagcccgtccttgcatgaccgcctgcgcgccaccggcaattacgaacaggcgttggcggatttcatcgcccgccagccgatgggccgcatcgccacaccggaagaaatcgcagcgctcgtcacctatctcgcttccgacgaggcaggtttcaccaccggccagattcatgtgatcgatggcggctggacg

SEQ ID NO: 38299 - DNA, 948 bp, Agrobacterium tumefaciens; identical to SEQ ID NO: 35164

SEQ ID NO: 38300 - DNA, 1536 bp, Agrobacterium tumefaciens; identical to SEQ ID NO: 38043

SEQ ID NO: 38301 - DNA, 950 bp, Agrobacterium tumefaciens; identical to SEQ ID NO: 35357

SEQ ID NO: 38302 - DNA, 1167 bp, Agrobacterium tumefaciens
ccgacataaagattataggcatcaagcgatccgccatttacaacgctcaagcttccggagccctgaaagccgacatcgacagagccggaatttacggtgccgttgtcgacgtaagcggtgaccttggaaccggctccggtgatcgtcatcgtgccggaagcgccggcaagatccccgagagtgaccccagttgccctgatggcgccgccgttgcttaccgtcacatttcccgtggccccgcttgcgtatccgacaaaaaaagtgccggtcatcgcccagctcgatccgtcgcccgttaccgtcacggcggaagtggacccgccataggtggcaacataaccgtcacggcttttaacggcgccaccggcctcgacggtcatggaaccgttgccgtaaaggccgacattgagatcggagcggcttttcacggtgctgtctgcccccgatacccggaccgagccattgccgcctgtatttgttccgatgatgatattcgctgcgtcgacaaggccgccgcctgtcaccgccagcgaacctgcgccactcacccccacctcgagactgttgcggtccacggtccagaccgacccctttccatccacgatggcagagccggttgcgcctgcgacgacgccaaggtgcgcgacagtgctatccacggaaccgcctgccgtgacgttgagcgtgccgttgccggccaagccgcccggatcggaggtgtcgcctccgacctgcaaatcgccggtcgtccatttcgagccgtcgcccgtcaccgtggcctcacttgccgaatggcggccgataatggcctcgccactggtgaccgttgccgcggcttcgaccacaagctttgcagctccaccattgccgacgacgagcgaatcgctttgcagcgaggaacccaaacggctgactgtcacgctactgccgtctgcggaattcagatccgcgattacagttgttgtctggctgataaccataccgccaccggtgatggtgagcgtgccaacgcccgcctcaccaacaaccaggtccgatgacatgttccagctgctgcctccaccggaaaccaacgctgttcccacggtatcggggtcgtttgccagcacgccattggcactgtacagcgagctggcgccaaggacctccacattgccgctaccaccc

SEQ ID NO: 38303 - DNA, 933 bp, Agrobacterium tumefaciens; identical to SEQ ID NO: 35354

SEQ ID NO: 38304 - DNA, 768 bp, Agrobacterium tumefaciens; identical to SEQ ID NO: 35353

SEQ ID NO: 38305 - DNA, 903 bp, Agrobacterium tumefaciens
gtcacggctggcgaaatcctcgtggagatcatggcgacgacggtgggcgacggttttctggagccgcagacgctgatcggcccctttccgagcggcgcgcccgccatcttcatcgatcaggtggcgcgttgcggcggaaccgccggcatcatcgcggctgtcggcgacgatgatttcggccgcctcaacatcgagcggctgcgccgcgacggcgtcgatgtctcggccatcaccaccatagcggaccgcccgaccggcagcgccttcgtgcgttaccgggaaaacggcgcgcgggatttcgttttcaacatcgcccattcggcggccagcgaaacacggatgacggatgaggcgcaggcgctcatcgaaaaggcgggccatgtgcacatcatgggatcggccttcgcgattgccggcattggcgcgatcattctcgaggccgttaaaagcgtcaaagcgcgcggcggttcggtatcattcgatccgaatatccgcaaggaactggcgcagggcgatgaaggccgcagactgatagacgatctgcttgccgtcaccgatctcctgctgccgtcaggcgaggaacttcaggccgcctccggtctggacgatgaggaagcagcgatagaaaagctgctcgccgccggtatcggcgagatcgtgctgaaacgcggtgcaaacggcgcaagccatttcagccgcgcccatgggcgcatcgacgcccccggccttgaagtggaggaaatcgacccgaccggtgccggcgactgtttcggcgcaacctacctcacctgccgccgcctcggcatgcgtccaggaaaagcgcttgtctatgccaacgcctccggcgcgcacaacgtcacaaagcgcggcccgatggagggcgctgccagccttgccgaactc

SEQ ID NO: 38306 - DNA, 920 bp, Agrobacterium tumefaciens; identical to SEQ ID NO: 35467

SEQ ID NO: 38307 - DNA, 1545 bp, Agrobacterium tumefaciens
gatctgcgcgccgcttttgcggccgacgaccagagattcagccgtttcagcgtcaaattcgatgacctgctgatggattactccaaatgtgccgtcaacgaagagatcgtcacgcttctcgaacagctcgcgcgcgaaggcggtgtcgaggccaagcgcgaggagatgttctccggcaaggccatcaacttcaccgaagaccgcgccgtgctgcataccgccctgcgcaatcgttccaacacgcccgttctcgttgatgacaaggacgtgatgcctgatgtgaacggcgttctggcagccatgggcaagtttgccgatgcgatccgttccggctccctgaaaggtgcgaccgggaaaaagattaccgacgtcgtcaatattggtattggcggttccgatctcggccctgttatggcgacgctggcgcttgcgcccttccatgacggcccgcgtgcgcatttcgtttccaatatcgacggcgcgcatattgccgatacgctgaagcttctcgatccggaaacctctctcttcatcatcgcatcgaagaccttcaccaccatcgagacgatgacgaatgccgccaccgcgcgccgtttcatcgccgaaaagctgggcgaaggcgccgtcaagcatcacttcgccgccgtctccaccgcgctggacaaggtcgccgccttcggtatcgaaagcgaccgcatcttcggtttctgggactgggtgggcggacgttattcgatctggtcggccatcggcctgccgctgatgatcgccatcgggcctgacaatttcggcaagttcctggatggcgcgcatgccatggatcgccacttccgcgaggcgccgatccgcgaaaacctgccgatgctactcggcctcatcggcttctataaccgtaacgtgctggactatccgacacgcgcgatcctgccctatgaccagcgcctgtcgcgtttaccggcctatcttcagcagctcgacatggaatcgaacggtaagggtgcgaccatcgacggcacgccggacgaatgccagtccggtccggtcgattagtgcgagcccggcaccaatggccagcacgccttctaccagctgatccatcagggcacgagcgtcattccggccgaattcatgatcgccgccaatggctttgagcccgaactgcgccatcagcaccagcttcttatcgctaattgcctggcgcagtcggaagcgctgatgaagggacgtacgcttgccgaagcgaaggcccagctcacctccaagggcatggaagacagccaagccgatttcatcgcgccgcaccgtgtcttcaccggcaatcgcccctccatcaccttcgtttacgacaagctgacgccctttgcgctcggccggctcatcgcgctctatgaacatcgcgttttcgtggaaggtgtgctgttccgcatcaactcctttgatcagtggggcgtggagcttggcaaggaactggccaccggcctgcttcccgtcgtggaaggcaaggagagcgccgccggccatgacagctcgacacaagggctggtg

SEQ ID NO: 38308 - DNA, 1680 bp, Agrobacterium tumefaciens
gttgccaagcgctggctggcatcctatccgccgggcgtgccttcagagattcccgcctcggcaaatgcctccctcattgaccttctcgaaaagagctgcaagcaatttgccgaccgcaaggccttttccagcatgggaaaatccctgacctaccgggaactcgacgctgacacccgtgcggtcgccgcatggctgcaatccagaggactggaaaaaggcgaccgggttgcggtgatgatgccgaacatcctgcaaaatcccgtcgcggtttatgggattctgcgggcgggcatggtcgtggtcaatgtcaacccgctctataccccgcgcgaactggagcaccagctcaaggactccggcgcgaaagccctgttcgtgctggagaacttcgcccatgtggcgcagcaggctgtaccgaaaaccgccgtccggcatgtggtcgtcgcagcaatgggcgatcttctcggcctcaagggacatatcgtcaatctggtggtgcgcaaggtcaagaagctggtgcccgcccatgccattcccggctcgatcagcttcaaggccatgctgaaggaaggccagggggtttccctgaaaccggtcggccttacggcgcaggacatcgccttcctgcaatataccggtgggacgacgggcgtatccaagggcgccgtcctcacccatgccaatctccttgccaacaaggcgcagatcagcctgtggctcgacgctgccttcaacggccgcaaggaccgccccgaggttctcaacttcatctgcgcgctgccgctctaccatatcttcgcactgacggtgaattcactgatgggcattgcgctgggcggccataatctgctgatcgccaatccgcgcgacattcccggcttcgtaaaagagctttcgcattaccagccgcatatcttccctggcctcaccacgcttttcaacgcgttgatgaacaatgaagagttccgcaaacttgacctgtcgtcgctcatcttcgtactcggcggtggcatggcagtgcagaggccggtggccgaacgctgggtttccgtggtcggctgccctatcaccgaaggttacgggctgtcggaaacctcgcccgtcgccaccgtcaatcggctcgatgctgcggaattcagcggcaccatcggcctgcccatctcctccaccgaaatcgatattcgcgatgaggacggcaacagtctgccaacaggcgaagtcggcgagatttgcattcgcgggccgcaggtcatggccggttactggcagaggccggatgaaaccgcgaaggcgataacggcagacggcttcttccgttccggcgatatgggcttcatggacgaacgcggttacaccaagatcgttgaccgcaagaaggacatgatccttgtttccggattcaacgtctatccgaacgaggtggaagaagtggccgccagccatcctggtgtcctcgaatgcgccgcgatcggcgttccggacgaacattccggcgaaaccgtcaagcttttcgtggtcaagaaggaccagtccctgacggaagcggagctcaaggccttctgtgccaagaacctgacgaattacaaacggccgaaaatcatcgagttccgcaccgacctgccgaaatcgaatgtcggcaagattttgcggcgcgaattgcgcaatctgaactgaacgaag

SEQ ID NO: 38309 - DNA, 780 bp, Agrobacterium tumefaciens; identical to SEQ ID NO: 37966

SEQ ID NO: 38310 - DNA, 1107 bp, Agrobacterium tumefaciens
gtcgccaactggagttatcccaccgccgtcaagcttggccgtggccggatcaaggaactggcggaagcctgcaaaacgctcggcatcaggaagccgctgctcgtcacggatcgtggccttgccaatatggcgatcaccgcgcatgcgctggatgtgctggaagaggcgggtcttggccgggcgatctttgccgatgtcgatccgaaccccaacgaaatcaacatggaagccggcgtcaaggcttaccgcgatggcggtcatgacggcgtcgtcgcctttggcggcggctcgggcctcgatctcggcaagatgatcgccttcatggccgggcagacacgtccggtctgggatttcgaggatatcggtgattggtggacacgcgctgatgcgtcgaagatcgcgcccatcgtcgcagtcccgacgacggctggcaccggttcggaagtcggccgcgccagcgtcatcaccaattcgcagacgcatgtgaagaagatcatcttccatcccaagctgcttcccggtgtcgtcatctgcgatccggaactgacggtcggcatgccgaaggtcatcacggccggcaccggcatggatgccttcgcccattgcctcgaagcgtattcgtcaccgttcttccacccgatgagtgctggtgtcgcgcttgagggcctgcgtctcgtcaaggaattcctgccgcgcgcctataaggatggcacggatatcgaagcccgcaccaatatgatggcggcggcggcgatgggggcggttgccttccagaagggtctcggggccattcattcgctctcgcatccgatcggggcggtctacaacacccatcacggcatgaccaatgccgtcgtcatgccggcggtgctgcgtttcaaccgtcctgccatcgaagacaagatcgcgcgtgctgccgcctatctcggcatttccggcggttttgacggtttttatgactacgtgctggatcttcgcagggaactcggcgtgccggaaaacctgaccgccatgggcatcaagcctgatcgtatcgacgagctggcggcagaagcgatcaaggatccgagctgcggtggtaatccggtgccgatgacgcttgagaat

SEQ ID NO: 38311 - DNA, 1293 bp, Agrobacterium tumefaciens
tcgcccattgacggctcggtttatgccgagcgggaggcgatgtcgctggaagcggcgcgcgccgccgtttcgaccgcgcgcagggcgcagaaagactgggcgcgacggccgcttgaggaccgcgttcagctggttctcaaaggtgtggcgcgccttaacgaaatggtggccgaggtggtgccggaactcgcgcatatgatgggccgtccggttcgttatggcggtgagtttaggggattcaacgagcgttccaactatgtcgcctccattgcggcggacgcgctggcgccgctcgttatcgaagaaagcggcaatttcgaacgccgcatcgagcgcgaggcgcatggcgtggtcttcgtcatcgccccctggaattatccttacatgaccgcgatcaacacggttgctccggcgctgatggctggcaatacggttgtcatcaaacatgcggcgcagacgcttctcgtcggcgagcgcatggtgcgggcctttgtcgaggctggcgtgcctgaggatgtgttcatcaatgtcttccttgatcacggcacgacctcgacgctcatctccgaaggcctgttcaatttcgtcaatttcaccggttcggtggaaggtggccgggccatcgagcgcgccgctgccggcaccttcaccggtctcgggctcgagctcggcggcaaagaccccggttatgtgatggaggatgccgatctcgacgccgccgtcgatacgctgatggacggcggcacttataattccgggcaatgctgctgcggtatcgagcgcatctacgtcaatgaaaacctctatgacgaattcgtcgagaagtcggtggcgtgggtttcgaactacaagctcggcaatccgctcgagcaggaaacgacgcttgggccgatggccaacaagcgtttcgccaaggtggtgcgggcgcagattgcggacgcggtttcgaagggtgccaaagcgctggtcgatccgaagcttttccccgctgacgatggcgagagtgcctatgtcgcgccgcagatcctcgtcaatgtcgatcattccatggaattcatgaccgaagagactttcggtcctgccatcggcatcatgaaggtcaagaacgacgacgaagccattgcgctgatgaatgacagcaaatacggcctcaccgcttcgctgtggacgcaggatgcggcgcgggctgcccggatcggccgggaaatcgagaccggaacggtgttcatgaaccgcgccgattatctcgacccggcgctttgctggaccggcgtcaaggaaaccggccgtggc

SEQ ID NO: 38312 - DNA, 975 bp, Agrobacterium tumefaciens
atgactaagttcaaactcgagtacatctggctggacggatacaagccggtcgcaaacctgcgcggcaagacacagatcaaggaattcgatgaattccccacactcgagcagttgccgctttggggttttgacggctcctccacccagcaggccgaaggccactcatcggattgcgtgctgaagcccgttgcgatctacccggatccggcccgcaccaacggcgcgctcgtcatgtgcgaagtcatgatgcccgatggcgtcaccccgcacgcttccaacagccgcgccacgatcctcgaagacgaagacgcatggttcggtttcgaacaggaatatttcttctaccaggacggccgcccgctcggtttcccggaacagggttaccccgctccgcagggtccgtattacaccggcgtcggcttcaagaacgtcggctcggttgcccgcgaaatcgttgaagagcacctcgatctctgcctcgaagccggcatcaaccatgaaggcatcaacgccgaagtggccaagggccagtgggaattccaggtattcggcaagggctccaagcgcgccgccgaccagatctggatcgcccgttacctgctgctgcgtctttgcgaacagtacggcatcgacgtcgagttccattgcaagccgctcggcgataccgactggaacggctccggcatgcattgcaacttctcgaccaagttcatgcgcgaagttggcggcaaggactatttcgaagccctcatggccgctttcgccaagaattggcaggagcacatcgacgtttacggtccggacaaccatctgcgcctgaccggcaagcacgaaaccgctccgtggaacaagttctcctatggcgtggcagaccgtggcgcctcgatccgcgttccgcactccttcgtcaacaacggttaccgtggttacctcgaagaccgtcgtccgaattcgcagggctgcccctaccagatc

SEQ ID NO: 38313 - DNA, 792 bp, Agrobacterium tumefaciens; identical to SEQ ID NO: 35427

SEQ ID NO: 38314 - DNA, 768 bp, Agrobacterium tumefaciens; identical to SEQ ID NO: 37969

SEQ ID NO: 38315 - DNA, 813 bp, Agrobacterium tumefaciens; identical to SEQ ID NO: 35198

SEQ ID NO: 38316 - DNA, 888 bp, Agrobacterium tumefaciens
aaagccttcgtcgcgatcgtgacctgctttaacgatgacgagaccatcaactacgaagccacccgcgcgcaggttcgccgtcaggtgacggctggcaacaacatcatgtgcgcaggcaccaacggtgattttaccgctctcacccattccgaaaaaatcaggattctggaagaggttgtcgatgaagtcggcggaaaggtcgatgtcatcgtcaatgcgggcatgccggcaacattcgagacgctgcaacttgccaaggaattcgaccgcatcggcgtcaagggcattgccgtcatcacaccattcttcatcgcctgcacgcaagatggtctgattcgccacttttctacggtggcagatgaggtgaacacgccggtctatctttatgacattccagcgcgcacccagaaccacatcgaacccgaaacggcacgaaagctggcgacccatggcaatattgccgggatcaaggattccggcggcgcgcaggagacattggaagcttacttgcaggtctcaaaggaggtcgatggcttcgaggtctattccgggcccgatcatctcgtcctctgggcactgcaaaatggagccgcgggctgcatctccggtctcggcaacgcgatgcccgacgttctcgcaggcatcgtcaatggcttcaactctggagatatcacgtacgccgaacgccaacagtccgtctacacagctttccgcaccgatctctacgcccacggctttcctccagccatggtcaaacgcgcgctttatttacaggacccctctgtcggagccagtcggcagccagcattacttcccgatgcagaacaggatcaaaagattgaggaaatcctcagaaaatatggccttctagtaacaaaggcgtgacaa

SEQ ID NO: 38317 - DNA, 729 bp, Agrobacterium tumefaciens; identical to SEQ ID NO: 35178

SEQ ID NO: 38318 - DNA, 1329 bp, Agrobacterium tumefaciens
ttcgatacggttctcattgccaacaggggtgaaatagcagcgagaatccagcgggcctgccatgaactcgggctaaaaaccgttgcaatatgctccgaggcggacaggggcgcatcctatgtccagactgccgatagttttctttgtatcggcccttccgctgcgggcaaaagttatctcaacaaggatgccatcctgctcgcggcgcggttgacatcttcaggagcgatccatcccggttacgggtttctatcagaaaataccgccttttcggacgccgtcgaaaaagccggccttgttttcatcggaccgggcgcatcgtcgattgcgacgatgggcgacaagatcgctgctaaacgggcgatgattgctgctgctgtgccgtgtgttcccggccctgatacggcattgccggatgatccggctgccgtcgaaagcattgcgcaggaaatcggttatcctgtcatcgtcaaggctgccggtggcggcggcgggcggggtatgcgggttgtgccggatgccggatctctgcatgaggcgattcccacgacacgcgaggaagcccgtcaggctttcggctcgccggcgctctacatggagaaattccttcagcatccccggcacattgaaatacaggtgctgtgcgacacccacggacatgccgtttggctgggacatcgcgactgctccatgcagcgtcgccaccagaaggtggtggaagaagcgcccgcgcccggcatttcgcctgacgtgatccggtccgtcggacaagcctgcgtcgaggcctgccagcagatcggttatcgtggagtcggaacgtttgaattcctctacgagaacggggccttctatttcatcgagatgaacacgcgtctgcaggtcgagcatcccgtcaccgaaatgaccagcgggatcgatatcgtccaggcgcagatcagggcggcacagggggaggaactggttctacgccagcaggatgtaaaatgcgaaggccacgccttcgagtgccgcatcaacgcggaagatccgcagacgtttctgccttccgccggggtcgtgacgggtcttgcctggccgcaggggcaaggtattcgtgtcgatacccatattcatgggggttacagggtttctccctattacgattcccttgtcgccaagctcatcgtccatgcgccaacccgcagcgaggcgatggcgaagatgcgcgaggcacttgccgggacatcgattgaaggcatttcgaccaatctgccgttcctgcgcgcgctgtttgaggacgacgctttcgtgtgtggtgaaacggacattcattatctggagaaatggctc

SEQ ID NO: 38319 - DNA, 2440 bp, Agrobacterium tumefaciens
atgagcctgacgcgcaagccgctggcgagccaccaccggatcgtcatcaagatcggttcggcgcttctggtggaccggaaaagcggcctgaagaaagactggctggatgccatctgcgaggatatcgcggcgctgaaaaaaaacggcgcggatgtccaggtcgtgtcttctggcgccattgcgcttggccgcaccgtgctcggcctgccttccggtgcactgaagctggaagaaagccaggcggcggcggcagtcggccagattgcgctggcgcgggcatggtcggaaagcctgtcgcggcatgagatcgtcgccggtcaaattctattgacgctatccgataccgaggagcgtcggcgttatctcaacgcgcgtgccaccatcaatcagcttttgaagatcggcgccattccgatcatcaatgaaaacgacacggtggcgaccactgaaatccgttatggggacaatgaccgtctggccgcgcgcgtggccacgatgacgggtgccgatctcctggtgctgttgtcggatattgacgggctctacaccgccccaccgcatctcgatcccgatgcgaaatttcttgagacgattgccgatatcacgcccgaaatcgaagccatggcgggtggggcggcctccgagctttcgcgcggcggtatgcgcaccaagatcgatgcgggcaagatcgcgaccgctgccggttgtggtatgatcatcgcttccggcaagacgctcaatccgctgaaggcaatcgaaaacggcgcacggtcttcatggtttgcaccctccggcacgccggtgacggcccgcaagacctggattgccgggcaattgcagccggccggcgaaatccatgtggatgccggggccgaaaaggcgctttatgctgggaaaagcctgcttcccgccggtgtgcggcaggtgaagggcaatttcggacgcggcgatgccattgccatcatcggcgtcgaaggccgtgaagtggcgcgcggtcttgcgggttacgatgcagaggaagcgcgcctgatcatcggccacaagtccaacgagatcgagacgatcctcggttatgtcggacgggcggcgatgatccatcgcgacgaccttgtgatgactggcgctgccgtcaaagtgaaacatgcaaagaaggatgaggtccatgcctgaacaggccgtgaagcagagccatgatatcgatgcgctgatgatgaccatcggcgctcaggcgaaagctgcttcgcgaccgttgtccatcgccggcacggaccagaagaaccgtgcgctgcttgccatggcatctgccattgaggcttcgaaggaggcgatccttgccgccaaccgcaaagatctggcggctgcggaaagcgccggccttgccgcttcgttcgtcgacaggctgacactcaacgatgcgcgcatcgccggcattgccgaaggcatccgctcggttgccgcgctggccgatccggtgggtgaagtcatcgccgcctgggatcgccccaacgggctgaaaatcgagcgcgtgcgcacgccgctcggcgttatcggcgtgatctacgaaagccgcccgaatgtgacggcggatgcgggcgcgctgtgcctcaaggccggcaacgccgtgatcctgcgcggcggctcggattcgcaacattcatcgcgtgctatccatgcctgtctcgtgcagggcctgaggatcgccggtcttccggagaatgccattcaactcgtgccggtaaccgaccgcgcggctgtcggcgctcttctcagcgggcttaaaggtacggtcgatgtcatcgtgccgcgcggcggcaaaagcctggtggcgcgggtgcagtctgaagcccgtgtgccggtcttcgcgcatctggaaggcatctgccatatctatgtcgacaaatccgctgatctcgacatggcaaaagccatcgtcgtgaatgcgaagatgcgccgcaccggcatttgcggggcggccgaaaccctgctggtggatgcgtctgccgtctccagtcatctcgagccagtcgtcaaagccctgcttgacgcgggttgcgaagtacgtggttcgcagccggttcgtaatgtggttgaggggctggaggccgctacggaagaggactggcgcaccgaatatctcgatgcgatcatttcggtcgccgtggtggatggcatttccggcgcgatcgagcatatcggcacctattcgtccaatcataccgaggcggtgatcgccgaggacccggatgtggtcgcgcggtttttcaacgaactcgattcggccattctgctgcacaatgcctcgacgcaatttgccgatggcggcgaattcggcatgggcgcggaaattggcatcgccaccggcaagatgcatgcgcggggccctgtcggcgtcgagcagctcacctcgtttaaataccgtgtgcatggcaccggccagaca

SEQ ID NO: 38320 - DNA, 723 bp, Agrobacterium tumefaciens; identical to SEQ ID NO: 35143

SEQ ID NO: 38321 - DNA, 1179 bp, Agrobacterium tumefaciens; identical to SEQ ID NO: 35142

SEQ ID NO: 38322 - DNA, 789 bp, Agrobacterium tumefaciens; identical to SEQ ID NO: 35141

SEQ ID NO: 38323 - DNA, 1248 bp, Agrobacterium tumefaciens
aggcgtgtcgttatcaccggtaccggcatggtatctcctcttggatgcggaacggaagtgacctgggagcggctgttggccggccagaatggtgcccgtctcgtgactgaattcgaggtcgaagacctgcccgcaaagatcgcctgccgcattcccgtcggcgacggctccaacggcaccttcaatgccgatgactggatggagcccaaggaacaacgcaaggtcgatcctttcattctctacggcatggctgccgccgacatggcgcttgccgacgcaaactggcatccggaaacggacgacgaccagatcgctaccggcgttctgatcggctccggcattggcggtctggaaggcattgtcgaggcgggttacacgctgcgcgacaagggcccacgccgcatttctccattcttcattcccggccgtctgatcaacctcgtatccggtcaggtttccattcgccacaagctgcgtggaccgaatcattccgtggtaacggcctgctcgaccggcgcacacgctatcggcgacgccgcccgactgatcgcgcttggcgatgccgaggtcatggtcgccggtggtgccgaatcgccggtctgccgcatttcgctcgccggatttgccgcctgcaaggcgctctccacccagcacaatgacgatccgcaaaaggcctcgcgcccctatgatcgcgaccgcgacggtttcgtcatgggcgagggtgccggcatcgttgttctcgaagaactcgaacacgccaaggcgcgcggcgcgaagatttacgccgaagtcgtcggttatggcctgtccggcgatgccttccacatcacggcgccgtccgaggatggcgacggtgcgtatcgctgcatgtccatggcgctgaagcgcgctggcctcacgcctgacgatatcgactatatcaacgcccacggcacctccaccatggccgacacgatcgagcttggcgcggtcgaacgtctggtcggcgaatctgctccgaagatttccatgtcttccaccaagtcggccaccggccatcttctcggcgctgccggcgcaatcgaggcgattttcgcgacgcttgcgatccgcgacaatatcgttccgccgacgctcaacctcgacaatcccgatgtcgagacgaagatagacctcgtgccgcacaaggcccgcaagcggcaggtcaatgtggcgctttcgaattccttcggtttcggcggcaccaacgcatcgctcgtgctgcgtcgt

SEQ ID NO: 38324 - DNA, 234 bp, Agrobacterium tumefaciens; identical to SEQ ID NO: 35411

SEQ ID NO: 38325 - DNA, 735 bp, Agrobacterium tumefaciens; identical to SEQ ID NO: 35412

SEQ ID NO: 38326 - DNA, 927 bp, Agrobacterium tumefaciens; identical to SEQ ID NO: 35413

SEQ ID NO: 38327 - DNA, 1041 bp, Agrobacterium tumefaciens
tccatgaaacagaaactattgggtcgcacgggcatctccgtgtctgaaatctgcctcggcaccatgacgtggggcacgcagaacactgaagccgaagcgcatgcgcagatggattacgccatcgaaaacggcgtcaatttcttcgatacggccgagctttatcccaccacccccgtttccgccgaaacgcagggacgaacggaagactatatcggtgcgtggttcgaaaagaccggcaagcgtgaccaggtcgtgctcgccaccaaggtcgccggctcgggccgtgactatattcgcggcggtcgcgacatcgatgccgcctcgatccgcgaggcggtggataccagcctcacgaggctgaagaccgattacatcgacctctaccagattcactggcctaaccgcggcacctaccatttccgcggcgcctggggtttcgatgcttccgggcaggacaccaagcgcacgcttgccgaaatcaccgaaaagctcgagacgctcggcgaactggtgaaggcgggcaagattcgcgccatcggcctttccaacgaaagcgcctggggcacacagaaatatatcgatatcgccgaggccaacggcctgccgcgcgtcgccaccatccagaacgaatataacctgctctatcgcagcttcgacctcgacatggcggaagtcgcccatcacgaggatgtcggcctgctcgcctattcgccgctcgcggcggggctgctgacaggcaaataccagaacggcgcccgcccggcgggctcgcgcggcaccatcaacaaggatctcggcggccgcctgcagccgcatcaggaagcgccggtcaaggcgtatctggaccttgccgccgcacacggggtagacccggcccagctcgccatcgccttctgcctcacccgcccgttcatggcctctgccatcatcggcgcgaccaccatggaacagttgaaggtggatattgcggcggtggatgtggccctgtcggaagacctgctgaagggtattgcggcgatccaccggcaatatccgatgccg

SEQ ID NO: 38328 - DNA, 660 bp, Agrobacterium tumefaciens; identical to SEQ ID NO: 35415

SEQ ID NO: 38329 - DNA, 1287 bp, Agrobacterium tumefaciens
atgacggaaaaaagcgctacagtgacacttggcgaaaagcaggtggaactcccggtcagggaaggcacgattggaccaagcgtcgtcgatatcgccacgctctacaagcacacgggctccttcacctacgacccgggtttcacgtcgacggcctcctgcgaatccaagatcacctatatcgacggtgacgagggcgttctcctgcatcgtggtttccccatcgagcaactggctgaacagggcgacttcctcgaaacctgctatctgctgctctacggcgaactgccgacggctgcgcagaagaaggatttcgacacccgcgtcacgcgccacaccatggtgcatgagcagatgagccgcttcttcaccggctatcgtcgcgacgcacacccgatggccgtcatgtgcggcacggtcggcgctctctcggccttctatcacgactcgacggacatcaccgatccgcaccagcgcatggtcgcttcgctgcgcatgatcgcgaagatgccgacgatcgccgccatggcctacaagtaccatatcggccagcccttcgtttacccgaagaacgatctggattacgcctccaacttcctgcacatgtgctttgccgtgccgtgcgaggactacaaggtggacccggttctggcccgcgccatggatcgcatcttcatcctgcatgccgatcacgagcagaacgcctccacctccacggtgcgtcttgccggttcgtcgggtgcaaatccgttcgcatgtatcgcggctggcatcgcctgcctctggggtccggctcacggcggcgccaacgaagcggcgctcaacatgctgaacgagatcggctctgtcgaccgcatcccggaatatatcgcccgcgccaaggacaagaacgatccgttccgcctgatgggctttggccaccgcgtctacaaaaactacgacccgcgcgccaagatcatgcagaagacgatgtacgaagtgctggaagccaccggcaattccgacgatccgatcatgcaggtcgcgctcgaactggaaaagatcgccctttccgacccatacttcgtcgaaaagaagctctacccgaatgtcgacttctattcgggcatcacgctgaaggcgctcggcttccccaccaccatgttcaccgttctcttcgctctcgcccgcaccgtcggctggatcgcacagtggaacgaaatgatcgaagatccgcagcagcgcatcggccgtccgcgccagctctatacgggcgccggcaagcgcgattacgttccggtttccaagcgt

SEQ ID NO: 38330 - DNA, 414 bp, Agrobacterium tumefaciens; identical to SEQ ID NO: 35390

SEQ ID NO: 38331 - DNA, 1017 bp, Agrobacterium tumefaciens; identical to SEQ ID NO: 35277

SEQ ID NO: 38332 - DNA, 1401 bp, Agrobacterium tumefaciens; identical to SEQ ID NO: 35097

SEQ ID NO: 38333 - DNA, 1425 bp, Agrobacterium tumefaciens
gatttgatcgaagaccgtgcgtttgtgaatggggcatgggtggagcgcgatcagatgttcgccatcgttgatcccgcgggaggcgatcacctcgccgacgtggcgtcctgcacgctcaatgatgtcgattttgcgatagacgcagccagcaaggctttcgccggctggcgcgatatgctgcctgttgatcgcggcgacattttgcgcaactggagtgcgcgcatgcgggagaatgcgcatgacctcgccacgatcatcagcgccgaacagggcaaaccgctggcggaatcacgcggcgaaatcgcctacgccgccaatttcctcgactggttcgcgagtgagggggagcgatcttacggcgaaacaattccaacccatctgaagggcagcaatctttccgtgcggatgcagccgatcggcgttaccgtcgccatcacgccatggaactttccctcagcgatgatagcgcgcaaggccggtgctgcacttgctgccggctgtacgatgatcgtcaaacctgctcccgaaacacctctgtcagcgctggcgctggcaagacttgccgaagagtccggcgtaccacctggcgtattgcaagttctgccgggagaagccgcaccccttgcgcgccgccttctggaaaataccgaggtgcgggcattttcctttacgggttcgaccgaggtgggacgaattcttctgacgcaatctgcggcgacggtgaaaaaagcatccttggagcttggagggcacgcacccttcatcgtcttcgcagatgcagatctcacagaggccgtcaaaggctgtctgggcgcaaaattcgccacttccgggcaggactgtcttgcggcaaaccgcatctatgtgcagcgcagcctttatccgcgatttgttgagcggtttgccgaggcgacgtccaggctgactgttggtcatggcctcgaaaccggtgtcgatatcggccccatgacgcggccgtccgtcgccgaaaagtgccgccagcaggttgcccaggcgctgtcggcgggtgcacggctcgtctgcggcggacaggacagtccgctcggcggcaacttcgtcacccccaccgtgcttgccgatgttaccgacgacatgctgatcgcccgcgaagaaaccttcggcccggtggccgccatcttgccgttcgatgacgaggcggaggtgatccgccgcgccaatgcaacagagatgggactggcggcctatctctacaccaacgatctcggccgggcgatgcgcctgaccgaccagctcgaatacggcatggttgccgtcaacacgccgaaattcaccggagcgcccattccattcggcggctggaaacaatcaggccttggccgcgagggctcgcgtcatggcctcatggaatatctcgaacccaaatatgtctgcttcggcaatctg

SEQ ID NO: 38334 - DNA, 1647 bp, Agrobacterium tumefaciens
gtggcaatgttgctggttgcgggcacaacctcgctcagcgcgtggatcatgcgtgacattgtcaacagcgtctatttgaaacaaggtttcgatgtcgttcttgagattgcctttgccgttgcagccatcttcatcgtcaaggggctcgctaccttcgtgcaaagctactatcttagcaaagcggggaacagcatcgttgccgaacaacaacgcaagatctacgatcggcttctgaagcagggcgtgtccttcttccagaacctgccatcttcagaactccttgtccgcgttacttacaacgctcaggctgcgcgcagcgtgatcgacacgatcgtgacatctttcgtccgcgacctattttcccttcttggcctgatcatcgtgatgtttgcccagaatttccttctgagcgcgatttccatgattatcggccctgtggcgatatttagcgttcgtctcgtgctgcggcgcgttcgaaagatcatggaggcggaacttgcttcactgggcgaaatcgtcaacgtcgtgcaggaaacgagtattggcgttcgcgttattaaggcattttcgcttgagaaactaatgcgccagcgcatgaacaaggccgtgtccgacgtcgagcatcgtgcaaacggcattgcgaagcttgaagcagcaaccagcccgatcatggagaccctgtctggcctcgccattgcagtcgtcatcgccgtttccggttataccgtgcttgaaaaaggcggatcaccgggtgacctgatggcctttatcaccgctttgcttcttgcttacgaaccagcaaagcgtctggcccgcatgcgagtccaaattgaaggcggcatgatcggcgtgcgcatgatgttcgaggttttggacgctccattgacacttgccgagaaaaaggatgcccagccgctccccaaggcaagcggcaatgtggaactcaagaacgtcagcttcgaatatgttgctaaccagcctgttctgaaggacgtcagcgtcctcttcgaaggtggtaagatgactgcgctggtcggaccttccggcagcggcaagtcgacgatcatcaacctcatgatgcgtctttatgatccgcagagcggttccgtcgagatcaacgggatggatttgcgcgacgtgtccttcgccagcctgcgcgagcatgtttcttacgtcggccaggaaaccttccttttctctggaacggtgaagcacaatatttccgtcggtcgcgacaacgctaccgatgaggaaatcatcgccgcggccaaggcggcaaacgcacatgatttcatcatgaacatgcctgatggttacgacagcaagcttggcgaaaacggctccggtctgtctggtggccaaaggcagcgcgttgcaatcgcccgcgcgatgctaagagacgcagacatattgatcctcgacgaagcaacaagcgcgctcgattcggaatccgaagcgcttgtccgggacgcgcttgagcgtttgacgcttaacaagacatccattgtcattgcccaccggctctctacaataaaccgggccgacaagattgtcgttatggataatggtcaggttgtggagcaaggaagccgtcgcgagttgctcgccacggatggtctctacaagcgcctgcacagcatccagttc

SEQ ID NO: 38335 - DNA, 1173 bp, Agrobacterium tumefaciens; identical to SEQ ID NO: 35132

SEQ ID NO: 38336 - DNA, 588 bp, Agrobacterium tumefaciens; identical to SEQ ID NO: 35156

SEQ ID NO: 38337 - DNA, 780 bp, Agrobacterium tumefaciens; identical to SEQ ID NO: 35155

SEQ ID NO: 38338 - DNA, 1612 bp, Agrobacterium tumefaciens
atgaacgagcttggggttcataatcctgccaatggagttgcggaactcggactgggcgaggcctcccgcgtcttttataacctcaatgagagcgaattatacgaacacgcgatccgtaacggcgaagccgaactgaccatcgacggcgcgctgcgcgccgtcaccggccagcatacgggccgctcgccgaaggataaattcgtcgttcgtgatgcttccaccgaaaacaccatctggtgggacaacaacaagccgctgtcgccggaaaatttcgagctgctgcgtcaggacatgctggcccatgccgccggcaagacgctttacgtgcaggatctgatcggcggtgccgatgaggaaaatgcgctgccgacccgcgtcgtcaccgagcttgcctggcattcgctgttcatccgcaatctactgatccggccgaagcgggagacgctttcgggcttcagccagaagctcaccatcatcaacctgccaagcttcaaggctgatccggcccgtcatggcgttcgctcggaaacggtcattgcctgcgatctgacgaatggcctcgtgctcatcggcggcacgtcctatgccggtgaaaacaagaagtcggtcttcacggtgctgaactacctgctgccggccaagggcgtgatgccgatgcattgctcggccaatgtcggtccctgagggtgattccgccgtgttcttcggcctctccggcaccggcaagaccacgctctccgccgacccggcacgcacgctgatcggcgatgacgaacatggctggggcgaacacggcatcttcaacttcgagggcggctgttatgccaaggcgatcaagctttcgtccgaggccgagccggaaatctacgccgcgaccaatcgtttcggcacggttctcgaaaacgtcgtgctggatgaaagccgggttcctgatttcaacgacaactcgctgacggaaaacacccgcagcgcctatccgctgcacttcattccgaatgcatcggaaacgggcattgccggccatccgaagacgatcatcatgctgacggcggatgccttcggcgtgctgccgccgatcgcgcgtctgacgccggaacaggccatgtaccacttcctctccggttacaccgccaaggttgccggcacggaaaagggcgtgaccgagccggaagccacattctccacctgcttcggcgcacccttcatgccgcgtcatccggcggaatacggcaacctgctgcgtgagctgatcggcaagcacggcgtcgattgctggctggtcaataccggctggaccggcggcgcctatggcatcggcaagcgtatgcccatcaaggcgacgcgcgcgcttctgaccgccgcacttaccggcgacctgaagaatgcgcaattccgcaccgatgcgaatttcggtttcgccgtaccgctgtcgctcgacggcgtcgatggtgcgatccttgatccacgttccacctgggccgatggcgcagcttacgacgcgcaggcgaagaagctggtatcgatgttcgtttcgaacttcaccaagttcgaagatcacgtcgacagcaaggttcgcgacgcagccccgggccttctgctcgcggctgaatga

SEQ ID NO: 38339 - DNA, 1383 bp, Agrobacterium tumefaciens; identical to SEQ ID NO: 35153

SEQ ID NO: 38340 - DNA, 2667 bp, Agrobacterium tumefaciens; identical to SEQ ID NO: 37992

SEQ ID NO: 38341 - DNA, 768 bp, Agrobacterium tumefaciens; identical to SEQ ID NO: 35342

SEQ ID NO: 38342 - DNA, 507 bp, Agrobacterium tumefaciens; identical to SEQ ID NO: 37998

SEQ ID NO: 38343 - DNA, 1110 bp, Agrobacterium tumefaciens
atcaccgttgaagaagccaagactgctgaaaccgaactcgaagtcgtcgaaggcatgcagttcgaccgcggctacctgtcgccttacttcgtaaccaacccggaaaagatggttgcggacctcgaagacgcttacatccttctgcacgaaaagaagctctcgaaccttcaggccatgctgcctgttctcgaagccgtcgttcagaccggcaagccgctcgtcatcatcgctgaagacgtcgaaggcgaagctcttgcaacgctcgtcgtcaacaagctgcgtggcggcctcaagatcgctgccgtcaaggctcctggcttcggcgatcgccgcaaggccatgctggaagacatcgccatcctgaccggtggtaccgtcatttccgaagacctcggcatcaagctcgaaagcgttaccctcgacatgctcggcaagtcgaagaaggtttcgatctccaaggaaaacaccacgatcgttgacggtgccggccagaagtccgacatcgaaggccgcgttgcccagatcaaggcacagatcgaggaaaccacttccgactacgaccgcgaaaagctgcaggaacgtcttgccaagctcgctggcggcgttgccgtgatccgcgttggcggttcgacggaagttgaagtgaaggaaaagaaggaccgcatcgacgacgctctcaacgcgacgcgcgctgctgttcaggaaggcatcgtaccgggcggcggcgttgccctgctgcgttcttccacgaagatcaccgtcaagggtgtgaacgacgatcaggaagccggcatcaacatcgtgcgcaaggctctgcagtctctggttcgccagatcgcagaaaacgctggtgatgaagcttccatcgttgttggcaagatcctcgacaagaacgaagacaactacggctacaacgcccagaccggcgaatatggcgatctgatcgctctcggcatcgtcgacccggtcaaggttgtacgtaccgctctgcagaacgcagcttcggttgcttcgctgctgatcaccaccgaagcgatgatcgccgagcttcctaagaaggaatcggcaatgccgcagatgcccggcggcggcatgggcggcatggacttc

SEQ ID NO: 38344 - DNA, 2907 bp, Agrobacterium tumefaciens; identical to SEQ ID NO: 35100

SEQ ID NO: 38345 - DNA, 714 bp, Agrobacterium tumefaciens; identical to SEQ ID NO: 35171

SEQ ID NO: 38346 - DNA, 1581 bp, Agrobacterium tumefaciens
tatcttgttggcgtcgatgtcgggaccggctcggcgcgggccggtgtctttgatgtcgcgggcaagcttctcgccaccgccaagcgcccgatcagcatgcaccgggaggatggcggcattgccgagcaatcgagcgcagaggtgtggcaggcggtttgtgatagcgttcgcgacagcgtttcacgcgccggtatcgatccggcggaggttaccggcattggcttcgacgcgacctgttctcttgtggttcgcggacccggtgacgtgaccctgccggtaggtgctgccgatcatcccgaacgtgatatcatcgtctggatggaccaccgtgctgtcgagcaggctgaacgcatcaacgccggcaagcatgccgtcctgaaatatgttggcggccgcatttcaccggaaatgcagacgcccaagctgttgtggctcagcgaaaacaggccggatatctatgcccgtgccgaacacttcttcgacctgacggattttctgacctggaaggcctccggggcgcttgatcgctccgcctgcacggtcacctgcaaatggacctatctcgcccacgaaaaccgctgggatgcggaatatttcaccaagatcggccttggcgatctggcggagcagggctttcgccgcatcggtgaaagcgtggtccatcccggcacggcactgggtaatggcctgaccgaagaggccgccaaggccatgggtctggtcgcaggaaccgccgtcgccgctggcctgatcgacgcccatgccggcggtgtcggtacggtggctgcgggtggtgatgcatcacgatgcctcggttatgttttcggcacctcgtcctgcaccatgacgaccaccactgagcccgcctttgtgccgggtgtctggggtccctattattccgcaatggttcctggcgcatggctcaatgaaggcggccagtccgccgccggtgcggccatcgattaccttgtgcagttgcacccggcctttgccgaggcaaaagcgcttgccgacaaggacggcaaagcattgccagtctggcttgccgaccgcgcgctcagcctcgccgcatccgcttccgccgcagtgaagcttgccgaagattttcatatggtgccggaattccttggcaatcgcgcgcccttcgccgatccccatgctcgcgccatcattgccggttatggcatggagacgggcgtggattccctcgtcgcgctctatgtggcggggcttctcggcctcggttacgggcttcgccagatcatcgaaacacaggcccgcaacggcgcgccggtggaaaccatcagcgtcagtggcggagcaggcgctcatccgcttgccaggcagttgctggcagatgcgaccggcctcccggttgaactgaccgaatgcgaggagccggtgctgcttggatctgccatgctcggcgccgttgccgctggaacctatccggacctgatggctgccatgccggcgatgtcgcgtatcgacagcagtgcaatgcccgatcccgattttcagaagattcaccaggcgcgttacgacgcgtttctggcgctgcagaatgcggcgcgtgccatt

SEQ ID NO: 38347 - DNA, 654 bp, Agrobacterium tumefaciens
tcgctgcaaggcaagatcgcggtcatcaccggcgccgcatccggcatcgggcttgcaaccacagaagcgctcttggaacagggcgcaaccgtggtcatggtcgactggaacgagaaagccttgaatgatctggccgccaagctcggcgagcgcgccattccgcaggtgaccaacctgctcgatgccgacagctgcaacgcgatgatcccggaaatcctggggaaggtcgatcatatcgacattctctattgtaatgccggcacctatatcggtggtgatctcaccgaaacgacgcctgaagccatcgacaagatgctgaacctcaacgtcaacgccgtgatgaagaacgtgcaggccgtcgtgccgcacatgtcggagcgcaagaccggtgacatcatcgtcacctgctcgatcgccggccactttccgacctattgggagccggtctattcgggctcgaaatgggcgatcaccagcttcgtgcagggcatgcgccgccagatgatcccgcacggcgtgcgcgtcgcgcaggtctctcccggcccggtcgtctcggcacttctggccgactggccggaggaaaatctccgcaaggccaaggaatcgggcagcctcatcgatgcgagcgaagtggctgatgccgtcgtttatatg

SEQ ID NO: 38348 - DNA, 1008 bp, Agrobacterium tumefaciens; identical to SEQ ID NO: 35174

SEQ ID NO: 38349 - DNA, 1398 bp, Agrobacterium tumefaciens
atgtaccagttcgatctgattgttgtcggcagcggtccggcgggaagacgggccgccatccaggccgccaagctcgaaaagaaggttctggtcatcgagaaaggcagccgtgtcggcggtgtttccgtgcataccggcaccatcccgtccaagaccctgcgcgaaaccgcgctcaatctcaccggctggcgcgagcgcggtttttacggccgtgcctatcgcgtcaagcaggagatcgacgccgacgatctgcgccgccgtctgctcatcacgctcgatcatgaagtcgaggtgctggagcatcagttcgcccgcaaccgcgtgcagcacattcgcggcacggcaagcttcatcgacgccaacacgatgaaagtcgtgaagagcgacggtgaagtcatgaccgtcactgccacctccattctgctcaccatcggcacccggccctaccggccgccgcatattcccttcgatggccaggcggtgctcgattcggatgagattctcgagatcaaggaattgccgcgctccatggtcgtcgtcggtgccggcgtcatcggcatcgaatatgcgacgatcttcagcgcactcgacacacaggtaacggtggtggaaccacgcgagaccatgctggaattcatcgataaggaaatcgtcgaggatttcacctatcagctgcgcgaccgcaacatgaagctgatcttcggccagaaggcggaaaaggtggagcgcgacgaaagcggcaaatgcctcgtttcgctcagcaacggccgcgtcctgaaagccgagaccgtactcttcgccgccggccgcgtcggcgccaccgatacgctcaatctttccgcctgcgggctggaggccgacagccgtggccgcctgaaggtcgatcccgagaccttccagacctcggtgccgaacatctatgccgccggcgacatcatcggtttcccgagccttgcctccacgtcaatggaacagggccgcatcgccgcccgccatgccgtcggcgcaccggccggcgagccgccgcaattcttcccctacggcatctatgccgtgcctgagatctccacctgcggcctgacggaagaggaagttgttgaacgcggcattccctatgaatgcggcatcgcccatttccgcgaaacctcgcgcggccacatcatgggcctcgacagcggtctgttgaagatgatcttctcgctgaaaacccgccgcctgctcggcgtccacatcgtcggcgaaggcgcgacagaactggtgcatatcggccaggcggtgctaaacctcaaaggcacggtggaatatttcgtggagaatacgttcaactatccgacgctggcagaagcctacaagatcgccgggctggatgcgtggaaccgcatgggtgagttgaagaag

SEQ ID NO: 38350 - DNA, 888 bp, Agrobacterium tumefaciens
atggacgttcgcgccgccgttgccattcaggcaggaaaaccgctcgaggtcatgaccgttcagcttgaaggtccccgcgccggtgaagtgctgatcgaagtcaaggcgaccggcatctgccacaccgacgatttcaccctctctggcgctgacccggaaggcctgttcccggcaatcctcggccatgaaggtgcgggcatcgtcgtggatgtcggccccggcgtcacctcggtcaagaagggcgaccacgtcattccgctctacacgccggaatgccgcgaatgctactcctgcacctcgcgcaagaccaatctctgcacctccatccgcgccacccagggccagggcgtgatgcctgacggcacctcgcgcttctcgatcggcaaggacaagattcaccactatatgggttgctcgaccttctcgaatttcaccgtcctgccggaaatcgcgctggccaagatcaacccggacgcgcccttcgacaaggtctgctacatcggctgcggcgtcacgaccggtatcggcgccgtcatcaacaccgccaaggtcgagattggctccacggcgatcgtcttcggtctcggcggcatcggtctcaacgtgctgcagggcctgcgtcttgccggtgcggacatgatcatcggcgtcgatatcaacaacgaccgcaaggcctggggcgaaaaattcggcatgacccacttcgtcaatccgaaggaagtcggcgacgacatcgtgccctatctcgtcaacatgacgaagcgtaatggcgacctcatcggcggcgcagactatacgttcgactgcaccggcaataccaaggtcatgcgccaggcgctggaagcctcgcatcgcggttggggcaagtcggtcatcatcggcgtcgcc

SEQ ID NO: 38351 - DNA, 837 bp, Agrobacterium tumefaciens; identical to SEQ ID NO: 35470

SEQ ID NO: 38352 - DNA, 885 bp, Agrobacterium tumefaciens; identical to SEQ ID NO: 35469

SEQ ID NO: 38353 - DNA, 852 bp, Agrobacterium tumefaciens; identical to SEQ ID NO: 35468

SEQ ID NO: 38354 - DNA, 966 bp, Agrobacterium tumefaciens; identical to SEQ ID NO: 35404

SEQ ID NO: 38355 - DNA, 1230 bp, Agrobacterium tumefaciens; identical to SEQ ID NO: 35449

SEQ ID NO: 38356 - DNA, 927 bp, Agrobacterium tumefaciens; identical to SEQ ID NO: 35450

SEQ ID NO: 38357 - DNA, 783 bp, Agrobacterium tumefaciens; identical to SEQ ID NO: 35451

SEQ ID NO: 38358 - DNA, 1008 bp, Agrobacterium tumefaciens; identical to SEQ ID NO: 35452

SEQ ID NO: 38359 - DNA, 558 bp, Agrobacterium tumefaciens; identical to SEQ ID NO: 35260

SEQ ID NO: 38360 - DNA, 1848 bp, Agrobacterium tumefaciens; identical to SEQ ID NO: 35261

SEQ ID NO: 38361 - DNA, 1818 bp, Agrobacterium tumefaciens; identical to SEQ ID NO: 35262

SEQ ID NO: 38362 - DNA, 861 bp, Agrobacterium tumefaciens; identical to SEQ ID NO: 35263

SEQ ID NO: 38363 - DNA, 1314 bp, Agrobacterium tumefaciens; identical to SEQ ID NO: 35264

SEQ ID NO: 38364 - DNA, 957 bp, Agrobacterium tumefaciens; identical to SEQ ID NO: 38038

SEQ ID NO: 38365 - DNA, 1071 bp, Agrobacterium tumefaciens; identical to SEQ ID NO: 35406

SEQ ID NO: 38366 - DNA, 825 bp, Agrobacterium tumefaciens
atgacaacgatcaccaccagagacggaacgcacatcttctacaaggactggggtccgaaagacggccagcccatcatcttctcccatggctggccgctcagcgccgacacctgggatgcgcagatggtgttcttcgccaataacggtttccgcaccatcgcccatgaccgccgcagccacggccgctcggatcaggtctggcacaacaataccatggatcaatatgccgacgatctcgccgagttgatcgaacagctcgatctccacgacatcattctagtcggtcattccaccggcggcggcgaggtgacccgttatatcggccgccacggcacggcccgcgtcgcgaagatcgccctcatcggcgcggtgccgccgctgatgctgaagacggaaagcaataccatcggcatgccgatcgatgtcttcgatggcatccgcaagagcacctatgataatcgcagccagttcttcaaggacctgaccattcccttctacggctacaaccgcgaaggcgccgtgatttcggaaggcattcgcgaggaattctggcggcagggcatgatgggcggcctcaagggccagctcgacagtatccgcgccttctcggaaagcgatttccaccaggacctgaaggccttcgacaaaccaacgctggtgctgcatggcgatgacgaccagatcgtgccggtcggcgcttcagcactttccacggtcaagatcgtcaaacatgcgaccctcaaaatctacgagggcgccgaccatggcctgacgcagacccatcaggaccggttcaacgccgacctcctcaccttcatcaacgcc

SEQ ID NO: 38367 - DNA, 774 bp, Agrobacterium tumefaciens
cagaatacctttctcatcaccggcgcatccgatggtatcggcgccgtatatgccgaacgcctcgcaggacgcggccacgatcttatcctcgtggcgcggcgtgccgagaagctgaaggcactggcagcgcagctggaaaaggaccacggcattgccgtcgaggttctcagcgccgatctttccagcgcggaagacctcgaaaaggtcgaggtccggctgcgcgaagaccagcgtatcaccggcctcgtcaacaatgccggcatagccggggaaggcgcgatcacggcactggacccggcctatgtgacgacgatgatcaatctcaacattcttgccgtcacccggctggcggcagccatcgcgccccgccttgccgccgcaggcaaaggcacgatcatcaacatgacttcggtcacggcgctgatgccggcggcattcaccgccgtctatccggccacaaaggccttcgtgctcgccttcaccgaagcactgcaggcgcagctttcgccgtccggcgtgcgggttcaagccgtgctgcccggcatcacccgcaccgcgatatgggaagaggaacggctcgatgccatcccggccgccatggtcatggacgtgcacgacatggtggacgcggcccttgccggtctcgatctcggtgaggcgctgaccattccttccctgccggatacggtcgaccttgaaaatttccttgcagcacgcgcagcgttgaggcccaatctgtcgcatgcacttgccgccagccggtatcgtgcaggc

SEQ ID NO: 38368 - DNA, 1500 bp, Agrobacterium tumefaciens; identical to SEQ ID NO: 35329

SEQ ID NO: 38369 - DNA, 1275 bp, Agrobacterium tumefaciens; identical to SEQ ID NO: 35328

SEQ ID NO: 38370 - DNA, 1003 bp, Agrobacterium tumefaciens
atgacgatgatcgaagccgtccgcagcgccatggatgtatccatggagcgaagcgacgatgtcgtggtgtttggcgaagacgtaggttacttcggcggcgttttccgcgccacgcaggggctgcagggaaaatacggcaagacccgctgtttcgatgcgccgatcagcgaatccggcattgtcggcacggcgatcggcatggccgcttatggcttgcggccctgcgtcgaaatccagttcgccgattacatgtaccccgcctatgaccagatcactcaggaggcggcgcgtatccgttatcgctccaatggcgatttcacctgcccgatcgttcttcgcatgccgaccggcggcggcatttttggcgggcagacgcatagccagagcccggaggcgcttttcacccatgtctgcggactgaaagtggtcgttccctccaatccctatgatgccaagggcctgctgatcgcctccatcgaagaccctgaccccgttatgtttctggagcctaagcggctttataacgggcctttcgacggtcatcacgaccggccggtgacgccgtggtcgaaacacgaaatgggtgaggtgccggaaggtcattacaccatccccatcggcaaggccgaaatccgtcgccccggaaacgatgtcaccgtcatcgcatacggcaccatggtgcatgtggcattggcgcgcggcggaggagacgggcgtggatgccgaaatcatcgatctgcgcagcctgctgccgcttgatctcgacaccatcgtgaagtctgtctccaagaccggccgctgtgtgatggtgcatgaggcgacgctgacttcaggcttcggcgccgaagtcgtgtcgctggtgcaggaacattgcttttaccatctcgaggctcccgtcgtccgggtcgccggctgggatacgccttatccccatgcgcaggaatgggactattttccgggacccgcccgcgtcgggcgtgccctcgtagacgtcatggaggcc

SEQ ID NO: 38371 - DNA, 1227 bp, Agrobacterium tumefaciens; identical to SEQ ID NO: 35326

SEQ ID NO: 38372 - DNA, 1135 bp, Agrobacterium tumefaciens
atgatcctgaacgaagcccagcagcagatcagggacatggcccgcgatttcgcccgcgagcggctttcccccggcgctgccgcgcgtgaccgggaaagccggttcccaaaggacgaattgaaggaaatgggcgagctcggtttcctcggcatgctcgtctccgaggattatggcggatcggaaaccggtgccgtggcctatgctttagcgctggaggagatcgccgccggtgatggcgcctgttccactatcatgagcgtgcataattcggtcggctgcgtgccgatcctcaaattcgggaccgaggagcaaaagcagcgattcctgccgaagctggctgccggcgaatgggatcggcggttttgcgctgaccgaaccgcaggccggttccgatgcctccaacctcaagacccgggcgcggcgcgacggcgatcgctatgttctcgacggcgcgaagcagttcatcacatcgggcaagaacggcgatgtcatcatcgtttttgccgtcacagatgcggcggcgggcaaaaagggtatcaccgccttcatcgtgccgacggatacgccgggttacgaggtcatcagggtcgaagaaaaactcggcctgcattcctccgatacctgccagatcgccttcaccgagatggcggttccagtcgacttgcggctgggcgaagaggggcagggttaccgtatcgcgcttgccaatctggaaggcggccgcatcggcatcgccgcacaggccgtcggcatggcacaggcggccttcgaggcggctcgggactacgcccgcgaacgcaaggctttcgggcaggcgatcatcgagcatcaggctgtggcgtttcgtctggcggatatggcgacgcggattacggcggcgcggcagctggtgctgcatgcggcggcgctgaaggaagcgggtgagccctgtctttcggaggcgtcgatggccaaactctttgcgtcggaaatggccgaacgcgtctgctcggacgccatccagattcacggcggttatggctacatggcggattatccggtggagcggatctatcgcgatgtgcgcatctgccagatttacgaggggacaagcgatgtccagcgcatggtgatcgctcggaacctgtgaggattg

SEQ ID NO: 38373 - DNA, 1137 bp, Agrobacterium tumefaciens
gtcgtgatcgtcggggccgcccgtactgctatgggtgggttccagggcgaattcaaatcggtggccgcgcccgatctcggggccgcggcgatccgtgcggccgtcgaacgggcggctattccggtttctgacattgatgatgtgctgatgggctgtgtgctcacggccgggcaggggcaggctccggccagacaggcggccattgccgccggtgtcccgaattccgtgggcgcaacgaccatcaacaagatgtgtggctcgggcatgaaggcgatcatgctggggcatgaccagatcgcggcgggaagctcttccatcgtgcttgcgggcggcatggaaagcatgagcaatgcgccttatctgctggatcgcgcccggaacggctatcgtctcggccatggcaaggtcatcgaccatatgtttctcgatggtctcgaagatgcctatgacaagggccggttgatgggcactttcgcggaagattgcgctgaagcctaccagttcacccgcgcaatgcaggatgactatgcgctgacctcgcttgaacgggcgcgacgcgccatagcggaaggcgcattccaagcggaaatcgcgcctgttggtgatgttgccgtggacgagcagccgggcaaggcaaagccggaaaaaattccgcagctgaagcccgcctttcgcgatggcggaacggtgacggcggcgaattccagttccatttctgatggtgcggccgctcttgttctcatgcgcagatcggaagcagaacgacggggccgttcaccgctggcaaccattatcggtcaggcctcgcatgccgatgcacctgccggatatccgaccgcgcccatcggcgcgattaaaaagctgttcgaaaaaaacggctgggccgcgaaggacgtcgatctgttcgaaatcaacgaggcctttgcggtcgtggccatggcagcgatgcgcgatctcgatctgccgcatgagaaggtgaatgtgcatggcggcgcctgcgcgcttggccacccgatcggcgcttccggcgcgaggatcgtcgtcaccttgctggcggcccttcaacgccacgggctgaaacggggcgtggccgccgtctgtatcggcggcggtgaagcaaccgcgctcggtatcgag

SEQ ID NO: 38374 - DNA, 1005 bp, Agrobacterium tumefaciens
ttgcgcgacagcgccagtgcattcgcagatgataaaattgcgccgctcgccaccgagattgatcgcaacgaccgcttcccgcgtcagctctggccgcaaatgggtgagcttggcctgcacggcatcaccgtttcggaagagtttggcggtgccgatatgggttatctcgcccattgcgtggcgatggaggaaataagccgggcttccgcttccatcggcctttcctatggcgctcattccaacctctgcatcaaccagattcaccgctggggaaccgatgagcagaagcacagatatctgccgaaactcgtctccggtgaccatgtcggttcactcgccatgagcgagacggaagccggttccgacgtcgtatcgatgcggctgaaggcggaacgcaagggtgaccgttacgtactgaacggcgcgaagatgtggatcaccaatggccatgaagccgatacgctggtggtttatgccaagacggacatgtccgccggtgcgcgcggcatcaccgccttcctgatcgaaaagggcttcaagggtttccgcccggcccagaaactcgacaagctcggcatgcgcggctcgcccacatcggaactggtgttcgaggattgcgaggtgccggaggaaaacatcctcgggcgtttgaatgacggcgtgacggtgctgatgagcgggctggattacgaacgcgccgtgctggccgccggccctgttggcatcatgcaggcggccatcgatctggtgctgccctatgtccgcgagcgcaagcaattcggcaaggctatcggcgagttccagctggtgcagggaaagcttgccgatatctattcggccatgaatgcatcccgcgcctatgtctatgccgtggcccgcgcctgcgacaatggccgtatcacaagacaggatgcggcgggcgcgattttgtttgccgccgagcgggcgacacaggtggcgctggatgcgatccagcttctcggcggctccggttatgtcaatgaa

SEQ ID NO: 38375 - DNA, 1956 bp, Agrobacterium tumefaciens
aaaatactgatcgccaaccgtggcgaaatcgcctgccgcatcatccgcaccgcagccagtatgggcatccgcaccgtcgcggtctattcggatgccgaccgcgacgccatgcatgtggcgctggccgatgaggccatcgccatcggccccgcacctgcgcgcgcctcctatctcgacggcgaaaagatcattgccgccgcaaaggcaagcggcgcagaggccatccatccgggctatggttttctttcagaaaatgccggtttcgccgaagcctgcgcttctgcgggcctcgttttcatcggccctccaccagaagcaatccgcgccatgggcggaaaaagcgaagctaaggcgctgatggcaacggcaggcgttcccatcgttcccggttatcacggcgatgaacaggccgagaaacgactggcaagcgaggcggacaagatcggttacccggtgctgctgaaagcctcggcaggcggcggcggcaagggcatgcgcgtcgtccggcagaagcacgactttgctgcggagcttgccggcgccaaacgcgaagcactggccgccttcggcaatgaccgcatgctgatcgaaaaatacctggagcggccgcgccatgtggaagtgcaggttttcgccgatggccacggcaattgtgtttcgctttttgaacgcgactgctcgatccagcgccggcaccagaaggtgatagaggaagcccccgcccccggcctgcccgatgacttgcggcaacgcatgtatgacgcggcaaccgccgccgcccgtgccatcgattatcgcggcgcgggaacgatagaattcctccttgatccatccggcttctatttcatggaaatgaacacgcgccttcaggtcgagcatccggtgacggaatatattaccggtctcgatctggtcgaatggcagctgcgcgttgcgaatggagaagccctgcctaaagactgggccgatctccgcatcaacggccatgccatcgaggcacgcatttatgccgaagacccggcgcatgatttcctcccgtcgattggcacgatcagccacctcgtctttcccgatgaaggtcctcacctccggatcgacagcggcatccgcgccggcgacgccatcaccgtgcattacgatccgatgatcgccaagctgatcgtctgggatcatgaccgacccgccgccgtgcggcgtctaaaggtggcgcttgaaaagctggcaatttgcggcgtcaccagcaatgccacctttctggcgcggcttgcggggctcgaaactttcgcagcggccgatctggataccggcttcatcgcccgcaacgaggcagacctttttgctccgcaggccgtgggcgacaatgagatcgcactggcggcactcggcttccttctcagccgtaaaaacgcgagcaccaacccgcaagcgcaggccgaccctcatagtccctggaataccgccaacgccttccgactgaatgcgccggcgcgtgagacgctgcatttcaccatgcagaaccggccgatcgaccttggcgtagcccatgaggcagacagcttttcgctggagatgggcggacacacgatccgcgcttatggcgacctctctgacaacggccgctttcgcgcgaccatcaacgaccggacatggaaaggctatttctttgcagagagtgatagctacgcactttttctgcacggcgaacactatcgcatcagccagccagacccggtcgatatcgcagattcttctggccatacgggcggtctggaggcgcccatgccgggcgttatccgcgccgtgctcagccagagtggcgcggcggtcgagaccggtgatgcacttgtcgtgatggaagcgatgaagatggagcataccatccgcgcacccgcgaaaggcatcgtcaccgccgtcaactgcgccgaaggcgacatggtcgtcgccggtgcggtgctg

SEQ ID NO: 38376 - DNA, 651 bp, Agrobacterium tumefaciens; identical to SEQ ID NO: 35375

SEQ ID NO: 38377 - DNA, 2019 bp, Agrobacterium tumefaciens
attgccaccggcgacgaacccgttttgacgaccgctcaaggggctccagttgcagacgaccagaattcgcttcggatcggtcctcgcgggccgctcgtggtggatgacttccattttcgcgagaagatcttccatttcgatcacgagagaattcccgagcgcgtcgtccacgcccgcggatatggcgcgcacggctatttcgagacttatgattcccttgccacccataccaaggcggatttgtttcaacgggcaggggaaagaaccccggcctttgtgcggttctcgactgttgccggcaacaagggctcggccgatctcgcacgggatgtccgcggttttgccgtgaagctctataccaaggagggcaactgggatctcgtcggaaacaacatcccggtatttttcattcaggatgcgatcaagtttccggatctcgtccatgcggccaagcaggagcccgatcgcgcctttccacaagctcaaacggcacatgacaccttctgggatttcatcagtctcacgcccgaaagcatgaacatggtgatgtggatcatgtccgaccgcaccattccgcgttccttccgcttcatggaaggcttcggtgtgcacaccttccgcttcatcaatgcgaaggagcaatcaacctttgtgaagtttcactggaagccaaaacttgggttgcagtcggtggcgtggaacgaggcggtcaagatcaatggtgccgatcccgattttcaccggcgtgatctctggaccgcaatccagtcgggaaatttcccggaatgggagttgcaggtccagctcttcgatcaggatttcgccgacagcttcgatttcgacgttcttgatcctaccaagatcattcctgaagagatattggctccgaagcctgtcggccggctcgtgctcgaccgtatgccggacaatttcttcgccgagacggaacaggtggcgttcatgacacaaaacgtcccgccaggcatcgatttcagcaatgacccactgctgcagggtagaaatttttcctatctcgatacgcagttgaagcgtcttggcggtcccaacttcacgcatttgccgatcaatgcgccaaagtgtcctttcgcgcatttccagcaggacggtcacatggcgatgcgaaatccgacaggacgggccaattatcagccgaattcattcggggaaggccagcgggaatcgccgacgcgtggtttccagcatttcgcggctgaggagcagggggtcaaggcaaggttgcggccggaaagttttgccgatcactatagtcaagcacggcagttctacatcagccagacgccacccgaacaacgtcatatcgcatcggccctgactttcgaactcagcaaggtcgaaacggtggagattcgagagaggatggtttcacatcttcttaatatcgacgaaaccctcgctacgacggtggcgcagaagctcggccttcagacaatgccggagccggcgaatacggccattcctacccgtcaggatctggagccgtcgcccgcgctcagcatcgttgaacggggtcccaaacgcttcgaaggccgaaagcttggcattctcatcacggatggcgtggacgcaaaactgctgaaggggctgacccaggcagtaacagccgaaaaagccgtcttcgagttcatcgcgcccaaggtcgggggcgtaacggcgtcgaacggcacccttatcgaggcacatcacatgattgatggaggcccttcggtgcttttcgatgcggttgctctgctgacatcggaggcggccatcgctgagctgaccgaggaggcaactgcccgggatttcgttgcagacgcgttccagcactgcaaattcatcggatacgaccggtcagcgttgccgttgctggaaattgccggaattgccgacgccatggatgaaggcgtgctgcccttgcccggcgaggaagggcttgcggccttcgtggcagaacttgggaaattgcgtgtctgggctcgggaaccctcgctgaaactc

SEQ ID NO: 38378 - DNA, 750 bp, Agrobacterium tumefaciens; identical to SEQ ID NO: 35363

SEQ ID NO: 38379 - DNA, 1418 bp, Agrobacterium tumefaciens
aggaaaacgagtaaaaaggcaagattgatgacagccacacggacagaaaccgatacatttggccctattgaagttcaggccgatcgctactggggcgcgcaggcgcagcgctcgctcggcaacttcaagatcggctgggaaaagcagcccgcctctgtcgttcgtgcgctcggcatcgtcaagcaggccgctgcccgcgccaacatggcgcttgcaggtctcgaccccaaggtgggagatgccatcatcgccgccgcgcaggaagtcatcgacggcaagctgaccgagcatttcccgctcgtcgtctggcagaccggctgcggcacccagtccaacatgaatgccaacgaggtgatttccaaccgcgcgatcgaaatgctcggcggcgaatgggcaccaagaagcctgttcacccgaatgaccacgtcaatatgagccagtcctcgaacgacacctacccgacggcgatgcacatcgcctgcgtggaagagatcgttcaccacctgttgccggccctcaagcacctgcacacggcgctggaagccaaggtcaagcagttcgaaaagatcatcaagatcggccgtacccacacgcaggacgcgaccccgctgacgctcggccaggaattctccggttacgccgctcaggtcgcctcggcgatcgccaatatcgaactcacactgcccgcactgtcgaagctcgcccagggcggtacggcggttggcacgggcctcaatgcccctgttggttttgccgaaaaggtcgccgaggaaatctctgagattaccggcctttccttcgtcaccgcgccgaacaagttcgaagcgcttgcctcgcatgattccatggtcttctcgcacggcgcgatcaacgccgctgccgctgcactcttcaagatcgccaacgacatccgcttcctcggttccggcccgcgcgccggtctcggcgaattgtcgctgccggaaaacgagcccggctcgtcgatcatgccgggcaaggtcaacccgacgcagtcggaggcactgacgcaggtttgcgcccatatcttcggcaacaatgcagcgctttccttcgcaggctcgcagggccacttcgaactcaacgtctataatccgatgatggcctacaactttctgcagtcggtccagcttctgggcgatgcggccgtgtccttcaccgacaactgcgtcgtcggcatcgaggcgcgcgaagacaatatccggaagggcgtcgagaactcgctgatgctcgtcacggcgctcaacggcaagctcggctacgacatctgcgccaagatcgccaagaccgcccacaagaacggcacgacgctgcgcgaagaagccgttggtggtggatacctcaccaacgaggaattcgaccagtatgtgcgccccgaaaacatgatcggcccgaagtaa

SEQ ID NO: 38380 - DNA, 1344 bp, Agrobacterium tumefaciens; identical to SEQ ID NO: 35365

SEQ ID NO: 38381 - DNA, 385 bp, Agrobacterium tumefaciens; identical to SEQ ID NO: 35366

SEQ ID NO: 38382 - DNA, 1233 bp, Agrobacterium tumefaciens; identical to SEQ ID NO: 35367

SEQ ID NO: 38383 - DNA, 981 bp, Agrobacterium tumefaciens; identical to SEQ ID NO: 35368

SEQ ID NO: 38384 - DNA, 1437 bp, Agrobacterium tumefaciens
agcctgaccttgccgatcggccatttcatcggcggccggttgatcccggctcaaaacggcatcgacatgcatcgcccctcggacggcgtcgaatatgccggctgccccagggcgaatgccgcgctggtcgatgaagcggtgcagaccgccaaggccgccctgaaaagcagcaactggggtggcgtgcgcccgcgcgaacgcacgaaaatcctgcagcgctgggcagacctgatcgagcaggaagccgagacgctggcgaaaatcgaggccctgtcctctacgcggcccgtcggccagctgatcgccggcgacatcgccgtgaccgccgaacagatccgtttcttcgccgaattcgccgacaaggaaggcggcgatctcgtgccaaccgacgatgccagcctcggcatgatcatgaccgaaccctatggcgtagtcggcgcgattacaccgtggaatttccccgtctcgatggccggctggaaactcggcccggcgctcgcggccggtaatgccgtggtgctgaaaccatcggaaatgacgcctttttccagcattttcatggctgaactggccatcaaggccggcctgcccgccggcctcatcaacgtcgtgctcggcgacggtcccgtgacgggcaacgccatcaccggccatcccgagatttccaaggtcagttttaccggctctaccgcggcgggcgccgccatcatggccaatgtcgcccgcaccggcatcaagcccatgacgctggaattgggtggcaaaagcccgcaactggtctttgccgatgccgatatcgaaaaggcggcagcggcgatcgccggcaatattctctcaaatgcgggacaggcctgtgtcgccggctcgcgcatcatcgttgaggaaagtgcggccgacgccctttccgccgcgatcatcgcccgcatgaagacggtaaagcccggccctacttgggacgaggccacccaatattcgccgatcatctccgaagtgcagcgccagcgtatagacggtatcgtgcaggcagccgtcgcccatggcggcgaatgcctgacgggtggcgcaatcatggatggtcccggttatttctaccagccgacgctgatcgccaatgtcgaccagacctcgcccgccgtcaccgaggaaatcttcgggccggtgctgacactacagaccttccgcacggaagaagaggctctggcgcttgccgatcatccgacatacggtctggcggcgggtcttttcagccgggacgtctcgcgtgtcctgcgcctgtcgcgcgctatccaggcgggaacgatctgggtcaatcgctatggacgttcgcgcgaccacatcctgccgaccggcggttacaagcgttccggcatcggcaaggatcttggacgggacgcctatctcgccaaccgcaagagcaaaagcgtcctcatcggactg

SEQ ID NO: 38385 - DNA, 963 bp, Agrobacterium tumefaciens
ttgaaaacgcatcgcatcgcactcatccccggggacggcatcggccaaagcgtgacggacgcggcgtggcaggtcctcaatgccgtcgccaaaacctccggttttgtgctcgaaggaaccgaattcccctggtcctgcgccttctacaaggaaaccggggcgatgatgccgaaggacggcatcgaaacgctgcgcggattcgacgccatcatgctcggcgcggtcgggtggccggcggaggtgcctgactcggtgtcgctgcacggtctgctgctgccgatccgcaaggctttcgtgcaatatgccaatatccgcccgcaccggctactatcaggcgtacaagggcccttgaaggccgacggcttcgatattctctgcatccgcgaaaacacggaaggcgaatattccggcgccggcggccgcgtgcatcaaggcacggaggacgaggtggccgtcgaaacctcgatcttcacccgcaagggcgtggagcgaatcttgcgcttcggtttcgaacaggcgcaaaaacgtcgcggcaagctcgcctccatcaccaaatccaatgcccagaaatattcgatggtgttctgggacgaagtgacccacaagctcgcggcggaatatcctgacgtggaggtctcaagctatcacatcgacgccatggcggcacgtatggtgatggcgccggaaagcctcgatgtcgtcgtcgcttccaacctcttcggcgatattctgaccgatctcggcgccgccattcagggcggcctcggttttgccgcttccgccaatatcaatcccgaccgcagcgccccctcgatgttcgagccggtgcacggctcggcacctgacatcgcccatctcggcatcgccaacccgatcgccgccatctggtccggcgcgatgatgttcgagcatctcggcgaaaaggatgcagccgcgaaaatcatggcggccctggaaacggcg

SEQ ID NO: 38386 - DNA, 2376 bp, Agrobacterium tumefaciens; identical to SEQ ID NO: 35339

SEQ ID NO: 38387 - DNA, 357 bp, Agrobacterium tumefaciens; identical to SEQ ID NO: 35340

SEQ ID NO: 38388 - DNA, 1629 bp, Agrobacterium tumefaciens
tatgactatattgtcatcggggcggggagtgccggatgtgtccttgccaaccgcctttcaaaggatccgaacaaccgtgtcctgctcttggaggcgggtggcaatgacaattaccactggatccatattcccgtcggttatctctattgtatcaacaatccgcgcaccgactggtgtttcaagacggccgaagagccggggctcaatggccgcgcgctgatctatccgcgcggcaaggttctgggcggctgctcctccatcaacggcatgatctacatgcgcggccaggcgcgggactacgatgtctggcgccagcttggctgcgagggctggggctggagcgacatcctgccctatttcatgaagtcggaagatttttaccgcggcaagagcgacctgcattccgccggcggtgagtggcgggtggaaaaagcccgcgtgcgctgggatgtgctggacgccttccagaaggcggcaggcgaagccggcattcccgcgaccgatgacttcaatcggggcgacaatgaaggtgccgggtatttcgatgtgaaccagcgctctggctggcgctggaacaccgccaaggcatttctcaagcccgcacttggccgcaagaacctcacggttctgaccaaggcgcatgtcaagcggttgatcatcgaggagtgccgggttacagccgtcgagttccaccatgacggcgtcctgaaaaagatgcgcgcacggcgcgagacggtgctatcagccggcgcgatcggttcgccgcatattctggagctttccggtgtcggccgtggcgatgtgttgcaggccgccggtatcgacacggtggcggaggttcatggggtgggcgaaaacctgcaggaccatctgcaattgcgcatggtctataaggtttccggcgttctgacgctgaatgaacgggcctccaccctgttcggcaaggcgaggatcgggttggaatatgcgctgacgcgctccgggccgatgtcgatggcgccgagccagcttggcgtcttcacccgttcctcgccggagaaggaaaccgccgatctggaatatcatgtccagccggtttcgctcgacaagttcggggatccggttcacacttttccggccattaccgcaagtgtctgtaatctgcggccggaaagtcgcggctcagtgcatgttaaaggaccggatttcgccatgcagccggaaatccgcccgaactatctttccaccgaaggcgaccgtcaggtggccatcgacgccatgcggctgacgcgccgcatcgtcgcccagccggcgttttcccgcttcaacccgcaggaataccggcccggcccgtcgttcgaaaacgacaatgatctggccaaggcggcgggcgatatcggcaccaccatcttccaccccgtcggcacgttgcgcatgggctcggatgtggagagcgttgtcgataacaggctgaaattccgaaggctcgccgggctgcgcgttgccgacgcctcggtgatgccgcgcatcacctccggaaacaccaattccccgacgatcatgattgccgaaaaggccgccgacatgatccttgcggataatcgctgaaaggaacgcaccgatgaagaccgtcgcttttctcgggctggg

SEQ ID NO: 38389 - DNA, 1911 bp, Agrobacterium tumefaciens; identical to SEQ ID NO: 35071

SEQ ID NO: 38390 - DNA, 768 bp, Agrobacterium tumefaciens; identical to SEQ ID NO: 35072

SEQ ID NO: 38391 - DNA, 2349 bp, Agrobacterium tumefaciens; identical to SEQ ID NO: 35073

SEQ ID NO: 38392 - DNA, 1302 bp, Agrobacterium tumefaciens
atgcggattgtgatgatcggttcgggttatgtcggcctcgtgtccggcgcgtgttttgcagattttggccatgatgtggtctgcgtcgacaagatgccggagaaaatcgaggctttgaaaagcggccatattccgatcttcgagccgggtctggaaaccatcgtcgccaacaacgccaaggctggccggttgagcttcacgacagatctttccgccgctgtcgccaatgccgatgtcgtcttcatcgcggtcggtacgccttcgcggcgcggggatggacatgccgatctcggttatgtctacgcggcagcgaaagagatcgcccatgctcttgatggtttcaccgtcatcgtcaccaaatccactgttcccgttggcaccggcgacgaggtggagcgcatcattcgcgaggaaaacccctcggccgattttgccgtggtttccaacccggaattcctgcgcgaaggggctgccatcgaggatttcaagcggccggaccgcattgtcgtcggcctctcggatgagcgcgcacgccctgtgatgaccgaagtttaccgcccgctttacctcaaccagtcgccgctgctcttcaccacaaggcgcgcttccgaactcatcaaatatgccgccaacgcctttctggcgatgaagatcaccttcatcaacgaaatggctgacctctgcgaaaaggtcggcgccaatgtgcaggatgtttcccgcgggattggtctcgatggccgtatcggctcgaaattcctgcatgccggccccggttatggtggctcctgtttcccgaaggatacgctggcgctcgccaagaccgcgcaggattatgatgcgccggtacggctgatcgaaaccaccatcgccgtcaacgacacgcgcaagcgcgccatgggccgcaaggtcatcaatgcggtgggcggtgacgtgcgcggcaagaaaatcgccgtgctgggcctgaccttcaagccgaacactgacgacatgcgcgacagcccggccatcgccatcatccagaccctgcaggatggcggcgcaaaggtggtcggctacgatccggaaggcatggcgaatgcccggcacctgatggaagatatcgactatgcggcaggcccttacgaggcagcggaaggcgccgacgccgtcgtgatcgtgacggaatggaaccagttccgcgcgctagacctgccgcgcctcaaagccatcatgaaaagtcctgtgctcgtggatttgcgcaatatctaccgcacggacgaggtcgccggccatggcttcatctatgccgcggtgggtcgcccg

SEQ ID NO: 38393 - DNA, 1497 bp, Agrobacterium tumefaciens; identical to SEQ ID NO: 35075

SEQ ID NO: 38394 - DNA, 690 bp, Agrobacterium tumefaciens; identical to SEQ ID NO: 35473

SEQ ID NO: 38395 - DNA, 983 bp, Agrobacterium tumefaciens; identical to SEQ ID NO: 35461

SEQ ID NO: 38396 - DNA, 1203 bp, Agrobacterium tumefaciens; identical to SEQ ID NO: 35460

SEQ ID NO: 38397 - DNA, 2145 bp, Agrobacterium tumefaciens; identical to SEQ ID NO: 35459

SEQ ID NO: 38398 - DNA, 420 bp, Agrobacterium tumefaciens; identical to SEQ ID NO: 35409

SEQ ID NO: 38399 - DNA, 711 bp, Agrobacterium tumefaciens; identical to SEQ ID NO: 35408

SEQ ID NO: 38400 - DNA, 2117 bp, Agrobacterium tumefaciens; identical to SEQ ID NO: 35407

SEQ ID NO: 38401 - DNA, 1293 bp, Agrobacterium tumefaciens; identical to SEQ ID NO: 35232

SEQ ID NO: 38402 - DNA, 1209 bp, Agrobacterium tumefaciens; identical to SEQ ID NO: 35233

SEQ ID NO: 38403 - DNA, 1799 bp, Agrobacterium tumefaciens
ttcaccttcacgctggtcaatctatcccacgaaccactgaaggattttcgcatcgtttatacgtcgctcacgcgcacagtggacaagccggtgtgcggcaacgccatctatctgcgtcgcaacgccaatttccatgaatttgcacccccatccggtttcgtgctggagccgggcaaatcctggcgcttcaccgtcgatggcctgttgagacctgcccggcatcgcacggatggtgcaaaatccgcctatgtcagccttgccgatggcacacatcgcgccgtggatgtgggtgacctgatgctggatgggcgccacagcgagccggcgccggtgctgcttcccgaaggcaagctcgatctgcccttcgccatccagccctggccagctgaaatcgatgccgaaccgggtgaaggctttcccgtagcacttttcccgatggaggacgccagggcggaggaagcgcttgcggtggaaaccgtgctgtcgctgttccgcaggctctttgccgtcgggcatgtgcctttcagccttgcgccggtgcatgagggaaaaccgctgcgtttcaagcagcatagcgggctcgaagcggaaggttaccgcatcgctttttccaacgaagccgtcaccgtggaatattccgccgctgccggcctgcaatatggcctgacggttctggcgcagctgctgcatggcgcgcgcattgatccgaagttccgtttcccggcctccggcaccatcagcgatgcgccgcgttacagctggcgcggctgccatctggatgtctcgcggcaattttatccgaccgatgatgtgctgcggctgatcgatattctcgcatggctgcgcatgaaccgcttccattggcacctgacggatgacgaggcgtggcgtctcgaaatcaaggcttatcccttgttgaccaccgtcggcgcgacgcgcggtccggatgggccgcttctgccgcagctcggcaatggcgcggaaccggtttccggctattacacgcaggataatgtgcgcctggttgtggcgcatgcggcggcactgaatgtcgaaatcgtgccggaggtggatattcccggtcacagcaccgcggctcttgttgcctatccggagctgacggacgggcaggaagcgccggacagctatcgctcggtgcagggatatcccaataacgcgctcaacccggccatcgagccgacctatgagttcctcggcaagattttcgacgagatggtggagctgttcccatcgcggctcatccatatcggcggcgacgaggttgcggatggctcgtggctcgcttcgccactggccaaggcgctgatggacaaggaggggctggacggcaccttcggcatccagtcttatttcatgaaacgcattcaggggatgctgcatgagcgcggtcgccagcttgccggctgggacgaggtttcccatggcggcggcgtcgatcccgctggaacattgctgatggcatggcagaagccagaagtcgggcttgagcttgcaaggcagggttatgacgtggtgatgacgccgggtcaggcctattatctcgacatggtgcaggacgaagcctggcaggagcccggcgcaagctgggccggcacggttccgccgtcgcatacctatgcttatgaggcggtcggcgatttccctgacgaattgaaggagcggatgaagggtgttcaggcctgcatctggtccgaacattttctcaaccgtgcctatttcaaccatctggttttcccaaggctgccggccattgccgaggcggcatggacgccaaaggc

SEQ ID NO: 38404 - DNA, 1314 bp, Agrobacterium tumefaciens; identical to SEQ ID NO: 35114

SEQ ID NO: 38405 - DNA, 1050 bp, Agrobacterium tumefaciens; identical to SEQ ID NO: 35113

SEQ ID NO: 38406 - DNA, 756 bp, Agrobacterium tumefaciens
caacgagaaggaattcggatcatggataggctcaaaagcaagcgggcgctcatcaccggtggcaccagcggcatcggacttgagacagcacgtcaatttatcagtgagggtgcacgggtagcagtcacgggaaccaaccccgagacgctggatgctgcacggcgggagcttggcccgagtgcattggtcatcaaggcagacgctgccgacgtggatggccagaaggtcgtcgctgaaacgatcagggaggcgttcgggggcctggacgtcgtcttcatcaacgcaggcgtcgcccttctcaagcctttggaagcatgggacgaaaaaggctttgatagggtcttcaacatcaacgtgaaaggtccgtattttttgctgcaggcactgctgccgatactggccaatccggcttctatcgtgctgaacacctcggtaaatgcccacatcggcatgcctaactcgagtgtctacgccgcctcgaaagcggcactgcagtcattcatccgcaccttgtccggcgaactgatcgcgcgcggcatccggctgaatgcggtgagcccaggtcccatctctacaccgctctatggtaagcttggtttcactgagactgacctgaaaaatgtcgctgaaagcattcaaaatctggtcccggccggccgctttggcgaaccgtccgaaattgcaaaggcagtagtgttcctggcatcggacgaagccgcctacacggtcggtagcgagatcatgatcgacggtggc

SEQ ID NO: 38407 - DNA, 1263 bp, Agrobacterium tumefaciens; identical to SEQ ID NO: 35189

SEQ ID NO: 38408 - DNA, 951 bp, Agrobacterium tumefaciens; identical to SEQ ID NO: 35223

SEQ ID NO: 38409 - DNA, 1419 bp, Agrobacterium tumefaciens
atgacaatgccggaatccatgctctcggaatccaagctctcgggctgggccatttcgccgaagctcgcccagctcgccagccttgccgggcactatgccgatccggagttctcggtggcgcatggcggccatgtccgcaccatcgccgccgggcactatacggtgtccggcctgtcgcggcatgtgcggctcggcgaattcgttgcccatcgcagcgcaaccggcattcatctcggcgaagtcgtgcgcgtggaaccggatatctgctatgtctgccctatcgagcccggcgagccgatcggcatccacgacaccgtcatccgcaagggtgccttccgcgtctcgcccgacgagagctggtgcgggcgcaccatcaatgcgcttggcgagccgatcgacggccaggggccgcttgcttccggcatcgtgcgccgttcgatttccaacaatgcgccgccctcgatgacccgtaaaagggtggagacaccgttcaagacgggcgtgcgggctatcgatattttctcaccgctctgccttgggcagcgtctcggtattttcgccggttcgggcgtgggcaaatccacgctgctgtcgatgctcgccaaagccgatgccttcgacaaggtggtgattgcgcttgtcggcgaacgtggccgcgaagtgcgcgaattcatcgaagacacgatgggcgataatatgagcaagtccgtcgccgtcgtcgcgacgagcgacgagagcccgatgctgcgcaagatggccccgctttccgccgtcaccattgccgagcatttccgcgatcagggcgacaatgtccttctcatcatcgacagcgtgacgcgatttgcccatgcgatccgcgaagtggcggtcgcttcgggcgaaccgcccgtcgcacgcggttatcccgcctcggtcttcaccgaactgccgcggctgctggaacgggcaggaccgggcgcggaaggcaccggcaccatcaccgccatcgtctccatcctcgtggatggtgacaatcacaacgatccgattgccgattcgacccgtggtattctcgacggccatatcgtgctggatcgcagccttgccgaagagggccgctatccgccgatcaatccgctcgcctcgatctcgcgtcttgccaagaaggcgtggacgccggatcaggaaaagctggtctcgcgcctgaaggcgctggtgcatcgtttcgaggaaacgcgggatcttcgcctcatcggcggttaccggcccggaaccgaccccgatctcgacatggcggtgaagcaggttccgatcatctatgaaacgctgaaacagctaccggacgaaccggcggcacaggatgcctatgccgatctggcgaccgcactacgcggtggagcacagaatggccagccccaggtcaatccgagaatgagaggc

SEQ ID NO: 38410 - DNA, 711 bp, Agrobacterium tumefaciens
atggcagttgtgattgacgggaaggcgaaggcggcttcggtaacggaggcggtccgcaaatcggcagaagcgctcgaggcggagaagggcgtgaagcccggcctcgcggttgtcatcgtcggaaatgatccggccagccacgcttacgtgaactccaagagcaagatggcgaagcaatgcggtttcaactccatccagcacacgctgccggaagaaacgacgcaggcggcactcttgaagctggtcggcgaactgaacaccgatgcgtccatccacggcattctggtacaactgcccctgccgaaacatttcaattcggatgagatcatccagtcgatcctgcccgagaaggatgtcgatggcctcagcgtcctgaatgccggcaagctcgctaccggcgatctcgccaccggtctcatttcctgcacgccagctggcgccatgctgcttgtgcgtggcattcacggtgatgacctttccggcctcaacgccgttgtcatcggccgctcgaacctgttcggcaagcccatgggccagctcctgctgaacgccaacgccacggtgaccatggcgcattcgcgcaccaaagatcttgtctccgtttgcaatacgcccgatattctagtgtctgcggtcgggcgcgcggcgatggtgaatggtgactgggtaaagcctggagcaacggtcatcgatgtcggcatcagccgcatt

SEQ ID NO: 38411 - DNA, 1110 bp, Agrobacterium tumefaciens
atgacagtccgttcgcttttcctgctgcccggtgatggtatcggccctgaagccatgactgaggtccgcaagctgatcgaatatatgaacagcgcgcacaatgccggctttaccgtttctgagggcctcgtcggcggttccgcttacgacgcgcatggcgtcgcgatttccgatgcggacatggaaaaggcgcttgccgccgatgcaatcctgttcggtgccgttggcggcccgaaatgggatggcgtgccgtatgagcatcgcccggaagccggactcctgcgcctgcgcaaggatctcgaacttttcgccaatctgcgcccggccatctgctatccggcgctcgctgccgcctcatcgctaaagccggaactggtcgagggtctcgatatcctcatcgttcgcgaactgaccgccggcgtttatttcggtgaaccgaagcagatcatcgatctgggcaacggccagaagcgcggtatcgacacgcagatctacgacaccttcgagatcgagcgcatcgccagcgtcgctttcgaactggcccgcagccgcgacaaccgcgtttgctcgatggaaaagcgcaacgtgatgaaatcgggcgttttgtggaaccaggtcgtcaccgaaacccacgcggccaaatacaaggacgtgcagctagaacatatgctagccgatgccggcggcatgcagctggtgcgcaagcccaagcagttcgacgtgatcgtcaccgacaacctcttcggcgacatgctgtccgacgtggccgccatgctgactggctcgctcggcatgctgccatcggcctcgctcggcgcacctgatgccaagaccggcaagcgcaaggccatgtatgagccggtgcacggttctgcccctgacatcgctggcaagagcattgccaacccgatcgccatgatcgcgtccttcgccatgtgcctgcgctactcgttcaacatggtggacgaagccaccaagctcgaggcggcgatcgccaatgtattggacaagggcatccgcaccgccgacatcatggccgacggttgccgtcaggtcggcacgtctgacatgggtgacgcggttctcgccgaattcaaggcgctttcggcg

SEQ ID NO: 38412 - DNA, 1308 bp, Agrobacterium tumefaciens; identical to SEQ ID NO: 35146

SEQ ID NO: 38413 - DNA, 3312 bp, Agrobacterium tumefaciens; identical to SEQ ID NO: 35147

SEQ ID NO: 38414 - DNA, 975 bp, Agrobacterium tumefaciens; identical to SEQ ID NO: 38129

SEQ ID NO: 38415 - DNA, 999 bp, Agrobacterium tumefaciens; identical to SEQ ID NO: 35149

SEQ ID NO: 38416 - DNA, 999 bp, Agrobacterium tumefaciens
catccccgcgtaacttttggcaaggtcggcgtcctgctcgtcaatctcggcacgcctgacggcacggattattggccgatgcgccgttatctggcggagtttctaagcgacaagcgcgtgatcgaatggtctcgtctctactggtatccgatcctctacggcatcgtcctcaacaagcgtccgcagaaggtcggcaaggcctatgaggaaatctggaaccacgagcgcaacgaaagctatctgcgcacctatacccgcagccagggcgagctgatggctgcggcgctgaaggactttccgaatgtcgtggtcgactgggcgatgcgttacgggcagccttccatcgcatccaggatcgatgccctgaaggaacagggttgcgaaaaaatcttgctcttcccgctttatccgcaatatgccgcctcgaccacggcaaccgtgaacgacaaggctttcgagcatctgatgaagctgcgctggcaaccggccatccgcaccgtgccgccctatcatgacgatccggcctatatcgaggggctcgccgcctccgtgaaaaaccatctggcgacgctggactgggagccggaaatgctgatcacctccttccacggcattccgcaatcctatttcaaaaagggtgatccctattattgccattgccagaaaaccgcccgcctgctgcgggaggctctggggcggaccgagaagaatttcatgatcaccttccagtcccgcttcgggccggaagaatggctgcagccctataccgacaagaccgtggagaagctggcctcggagggcatcaagcgcattgccgtcatgaatcccggcttcgtatcggattgtcttgagacgctggaagaaatcgccggtgaagccggggagattttcctgcataatggcggagagaaatttacccatatcccctgtctgaatgacagcaccgaaggcatgaacgttctcgaaaaggttgtaagacgggagttgcaaggctgggtg

SEQ ID NO: 38417 - DNA, 1575 bp, Agrobacterium tumefaciens; identical to SEQ ID NO: 35292

SEQ ID NO: 38418 - DNA, 1407 bp, Agrobacterium tumefaciens
ctgatgaagcgtaaccgcaaagtcaaaattcttgcaactctcggcccggcctcttccgaagaggccatgatcgaaaagctgcatcttgctggcgctgatcttttccggatcaacatgagccatgcgagccacgacgtgatgcggacgctcattcagcgtatccgctctgtcgaaagccgcaacggccgtcccatcggcattctggccgacctgcagggtcccaagctgcgcgtcggaaaattcgccgagacgaaggtcgatctggttccgggccagaccttcacgcttgataacaacgacacccccggcgacaacacccgcgttttcctgccgcatcctgaaattctcgaggcggtcaagcccggccaccgtctgctgatcgatgacggcaagctgcatctgcgcgctgaaaagagcgacggcaagagcatcgtcaccacggtcgtttccggcacccggatttccgaccgcaagggcatcagcctgcccgacaccctgctcggcgtcggcgttctgaccgacaaggaccgcgtcgacctcgatgccgttctcgagaccaacgaagtggactgggttgctctttccttcgttcagcgccctgaagacctggcagaagtgcgcaagatttcccgcggccgcgttggcctgatgtccaagatcgaaaagccgcaggctgttgaacgcatcgaggaaatcatcgagctttccgatgcattgatggttgcgcgcggcgatcttggcgtggaaatgccgttggaagccgttccgggcatccagaagcagctgacccgtgcctgccggcgcgccggcaaacccgtcgtcgttgccacccagatgctggaatcgatgataacggcaccggttccgacccgcgcggaagtatcggacgttgcaacggccgtattcgaaggcgccgacgccatcatgctctcggctgagtccgcttccggcgattatccgatcgaagccgtatcgaccatggcgtctatcgccagcacggtggaacaggacccctattattccaacatcatctacgcgcagcgtccgcagccggaagcaaccggtgccgacgccatttcgcttgccgcccgccagatcgctgaaacgctgaagcttgcggcgatcgtcacctatacgtcctcgggcacgaccggcctgcgcgccgcgcgcgagcggccgcaggtgccgatcattgcactgtcaccgatcatccagaccgcacgccgcctgtcggtcgtctggggcctgcactgcgtcgtcaccggcgatgccagcgatctggacgacatggtgaaccgcgcttgtcgcatcgttgtttccgaaggtttcggcaagcccggtgatcgcatcatcatttccgccggcgtgccgctcggcacccccggcgcaaccaacatggtgcgcatc

SEQ ID NO: 38419 - DNA, 1770 bp, Agrobacterium tumefaciens
cagaaagcggcgaaacagagaagcctgaagccgcttcttggcctgtttccctatctcaggcggtatcgtggcctgatggcggcggccctttttgcgcttgtactttcctccgccacaacactggctctgccgcttgccgttcgccgtatcatcgatcacggtttccagacgccggatggtggcatgatcaacagctatttcgccatgcttctggcgattgccgttgtcctcgcgctcgccagcgccatgcgctattattacgtgatgaccataggcgaaagggtcgtcgccgatctgcgccgcgatgtatttgcccacctcaccacgctgtcacagcaatttttcgatagcaatcgatcgggcgagctcacttcgcggctgaccgccgatacggtgcagattcgttccgccttcggctcctccgcctcggtcgcgctgcgcaacatcatcatgtgctgcggtgctgtggcgatgatgatctataccagccccggcctttccggccttgcgctgcttgccattcccttcatcgtttttccgctgatcgccttcgggcggtccgttcgcgcccgctcccgcaccacgcaggatacattggccaattccgccgcctatgcttcggaaacgatcgcggcgagccgcaccgtgcagtccttcaatgccgaggtgctggcgaatgcccgttacggcgcctccgtggaagccgcctatcagggcgcacgcgcggcgatcggcgcgcgctccgtcctgactgccgtcgcaatcgctctcgttttcggcagcgttgtcggcattctctggtatggcgcgcagaacgttctggcgggcagcatgaccgcgggtacgcttggccagttcgtgctttattccgtcatcgcagccagtggcctcggccagctttcggaagtctggggtgaactcgcccaggcgggcggcgcggctgaaaggctttccgagcttctgaatgaacgctcacccgttgcagagcccgcagcccccgtcgccatgccgcaaccaccgcggggcgaggcggagttcgacaatgtcgacttcgtctatccactcgcaacagggcggccgattgtctccggcctctccttgaaggtcgccgccggcgaaaccgtcgccatcgttggaccttccggcgccggcaaaagcacggtcttttcgctgctgatgcggttttacgatccgcagcagggccgcatcaccatcgatggcgtggatatccgcaacgtcagccttgccgatcttcgcgcacggctctccatcgtgccgcaggatgtcgcgatcttcgcctcctccatccacgataatatcgcatttggccggcccgaagcgacacgcgaggacgtgcgcgccgccgccatcgccgcgcaggccgacggcttcatcgagcgtctcggcgatggttacgatacgcaggtgggcgagcggggtgtgacgctgtcgggtggccagcggcagcgcatcgccatcgcccgcgctattctgcgcgatgcaccaatcctgctgcttgatgaagcgacctcggcgctcgatgcggaaagcgaaacgctggtgcagaaggcgcttgatgagctgatgaaaacccgcaccaccatcgttattgcccatcgcctcgccaccgtgctgaaggccgatcgcattctggtgatggatgaaggccgtatcatcgaggaaggcacgcatcagagcctcattcgccagaatggcctttatgcccgcctcgcccggctgcaattccagaccggaccggatgaattgcgc

SEQ ID NO: 38420 - DNA, 957 bp, Agrobacterium tumefaciens; identical to SEQ ID NO: 38085

SEQ ID NO: 38421 - DNA, 1182 bp, Agrobacterium tumefaciens; identical to SEQ ID NO: 35296

SEQ ID NO: 38422 - DNA, 1422 bp, Agrobacterium tumefaciens; identical to SEQ ID NO: 35379

SEQ ID NO: 38423 - DNA, 1356 bp, Agrobacterium tumefaciens; identical to SEQ ID NO: 35380

SEQ ID NO: 38424 - DNA, 1419 bp, Agrobacterium tumefaciens; identical to SEQ ID NO: 35381

SEQ ID NO: 38425 - DNA, 1041 bp, Agrobacterium tumefaciens; identical to SEQ ID NO: 35382

SEQ ID NO: 38426 - DNA, 1260 bp, Agrobacterium tumefaciens
atgactgccattaccgatatcatcgcgcgcgaaattctcgacagccgcggcaatccgaccgttgaagtcgatgtttacctcgaagacggctccatgggccgtgcggccgttccgtccggcgcctccactggcgcgcatgaggcggttgagctgcgcgatggcggcaagcgttatctcggcaagggcgtggaaaaggcggtcgaagccgtcaataccgaaatcttcgacgccatcggcggtttcgacgctgaaaaccagatccagatcgatcagatgatgatcgcgcttgacggcacgccgaacaagtcgcgcctcggcgccaacgccatcctcggcgtctcgcttgccatcgccaaggctgcggctgaagcctccggcctgccgctttaccgttatgttggcggtccgaacgcccatctgcttccggttccgatgatgaacatcatcaacggcggcgtgcatgaccataaccccatcgacttccagcaattcatgatcctatcggttggcgcggaaaacatccgcgaagccgtgcgtatgggttcggaagtgttccacacgctgaaaaaagaactgtccgcacagggccacaacaccaatgtcggtgatgagggcggttttgcaccgggcctcgagagcgcgccggcagccctcgatttcatcatgaagtcgatcgaaaaggctggctaccgtccgggcgaagacatgtatgtcggcctcgactgcgcatcgaccgagttctttaaggacggtaagtacgttctggaaggtgaaggccgcacgctggagcccggcgccatggccgaatatctggccgagcttgtcaataaatacccgatcatctcggttgaagacggcatggccgaagatgactgggaaggctggaagacgctgactgatctcgtcggcaacaaatgccagctcgtcggcgacgatctcttcgtcaccaactccgcgcgtcttcgcgacggcatcaagatgggcgtcgccaactccattctcgtcaaggttaaccagatcggttcgctttccgagacgctggatgcagtcgaaacggcacacaaggccggttacaccgccgtcatgtcgcaccgctctggcgagacggaagattctaccatcgccgatctcgctgtcgccaccaactgcggtcagatcaagaccggttcgcttgcccgttctgaccggctcgcaaagtacaaccagctgatccgcattgaggaaatgctgggtccgcaggctgcctacgccggccgttcg

SEQ ID NO: 38427 - DNA, 1728 bp, Agrobacterium tumefaciens; identical to SEQ ID NO: 35384

SEQ ID NO: 38428 - DNA, 765 bp, Agrobacterium tumefaciens
aatatcgaaggcgcaggcgcactcgtcacgggtgcggcatccggcctcggggcggccgtggcgcgaatgctcgcggctcgcggcgcggcggtcaccatttttgaccgtaacggcgaagccggcaaaaagctggcggcggagatcggcggtaaggccgttcaaggcgatgtgacaagcgacgccgatgcgcaggcggcaataaaggtagccgcttccgccaaaggcggccttcgtattctcgtcaattgcgcgggcatcggcaccgcgggtcgaattctcggtcgcgaagggccgcaaccgcttggcgatttcgaacaggtcatccgcgtcaacctgatcggcaccttcaacatgatgcggcttgcggccgctcacatggctgagagggaacaggatgaaggccaagacagtcgccaagacaatggtgtgatcgtcaacacggcgtcggttgccgctttcgagggccagatcgggcaagcggcctatgccgcgtcgaaaggcggcatcgtttcactcgccctgcccgcagcacgcgaacttgcccgcttccgcattcgggtgaacaccgtggcgcccggcattttcctgacccccctgcttcagggattgccgcaggaggttcaggagagccttgcgggccagataccccacccttcccggctcggcgatccagccgaattcgccgatacggtgcgctttctcatcgagaacgattacatgaacggtgaagtcatccggctggatggcgcgatccgcatgcagccg

SEQ ID NO: 38429 - DNA, 975 bp, Agrobacterium tumefaciens
gtcgtcattcatgcagcaaaagacctgcgggtagaggacgttgctggccagccacttgccgcggacgaggtgcgggtggccgttgccgtcggcggaatttgcggctcggatctgcattattataaccatggcggcttcggcacggtgcgcgtgcgcgagccgatggcgctcggtcatgagtttgccggtacggtggttgaggtgggcagttcggtctcgcatctcgtgcccggcatgcgcgtggccgtcaatccgagcctgccttgcggcacctgccgctattgcgctcagggcaggcagaatcagtgcctggacatgcgcttcatgggcagcgccatgcgctccccccatgttcagggcggtttccgtgaagtcgtgaccgtccattcaacgcaaccggtacagatcgccgacggactttccatgggtgaggcagccatggccgagcctttggccgtgtgcctccatgccgcgcgtcaggcgggatcgcttctgggcaagacggtgctgataaccggtgccgggccgatcggcatgcttagcctgctggttgcccgtcttgccggcgcggcgcatatcgtcgttaccgatgtcgccgatgcaccgctcgatctggcgcgacgtatcggcgcggatgaagccgtcaacatcctgcgcgatgccgacatgcttgaaaaataccgatttgaaaaaggcgtcttcgacgtcctgttcgaagcctccggcaatcaggcggcacttctcccggcgctggatctgctccggccgggcggtattatcgtccagctcggtcttggcggagacttcaccattccgatgaacctcatcgttgccaaagagctgcagctgcgcggaacgttccgcttccacgaggaatttgcccaggcggtgaatatgatgggacgtggcctgatcgacgttaagcctttgatcagcgccacattgccgttcgatcaggcccgcgaggctttcgat

SEQ ID NO: 38430 - DNA, 795 bp, Agrobacterium tumefaciens; identical to SEQ ID NO: 35388

SEQ ID NO: 38431 - DNA, 2643 bp, Agrobacterium tumefaciens; identical to SEQ ID NO: 35432

SEQ ID NO: 38432 - DNA, 3466 bp, Agrobacterium tumefaciens
atgaagttcaacaagctccgcgtcgtcggtttcaagtccttcgttgaaccctccgaattcatcatcgagcccggtctgaccggcgttgtcggcccgaatggctgcggcaagtccaatctggtcgaagcgctgcgctgggtgatgggcgagaattcctacaagaacatgcgcgcatccggcatggatgacgtcatcttttccggctccggcaaccgcccggccagaaacaccgccgaagtcggcctttatctcgacaattccgaccgcaccgcgcccgccgctttcaacgatgccgatgaaattcaggtgacgcgccgcatcgagcgcgaaaacggctccgtttaccgcatcaatggcaaggaagcccgcgccaaggatgtgcaactgctgtttgccgatgcctccaccggcgcccgctcgccctccatggtggggcaagggcgtatcggcgagctcatcaatgccaagccacaagcccgtcgccagctgctggaagaggcggccggcatttccggcctgcattcgcgccgccacgaggccgagcttcgcctgcgcgccgccgagaccaatctggagcgtctggaagacgtgactgcccagctggaaagccagatcgaaagcctgaaacgtcaggcgcgccaggccaaccgcttcaagatgctgtccgccgatatccgcgctcgcgaggcgacccttctgcacatccgctgggtggaggcgaaggaagcggaaggcgaggcggaaagcgcgctcaatcaggcgaccaacatcgtcgccgaaaaggctcaaggccagatggaagcggccaagcagcagggcatcgccagcctgaaattgccggaactgcgcgaggacgaggcccgcgtggccgccgccctgcaacgcctgcagatcgcccgcacccagctggatgacgaggcaaaccgcctgctgcgccgtcgtgacgaactggcccgccgtctctcgcagcttggcgaggatatcgtccgcgaggaacggctggtcgccgataatgcccagatactcgcacggctggacgaagaagaggccgaacttctcgacatcctctccgattccggtcgtcatgcggatgagatgcgcgaagccttcgaggctgcggccgtcaagctggcggaaagcgaagccgttttcacatcaatcaccgccgaacgcgccgaggcggcggccggccgtcagcagttggagcgggcgatccgcgatctttctgaccgcaagctgcggctggagcggcaatcgcaggaagcctctgccgagattgacaccatcgacgaaaaactctccggtcttcccgaccccgcggagcggcgcgaagcggtggaagcggctgagattgccgtcgaggacgcgttgatcgtggcggaggaggccgaggccgccggttgccgaggcgcgttccgccgaagcgctggcgcgcgggccgctggaaacggcgaagaaccggctgaatgcgctggataccgaagcacgcaccatcaccaaaatgctcgccaccagcgctgccgccaatggtagtttcacgccggtggcggaagaaatgacggtggagcgcggttatgaggccgcacttggcgcggcgcttggcgacgatctcgaaagcccgctcgatgcgagcgcccccgcctattggggcggcaatggaaacggtgcggatgatcccggcctgccgcagggcgctaaaccgcttctggactatgcgcaggcgccggatgccctccggcgcgcccttgcacagattggtgtcgttgcagacgtatcggaggcccgacgccttctgccgtcgctgaaagccggccagcggctggtaacgcgcgaaggcgcgctgttccgctgggacggccatatcgccagcgccgatgcgccgggtgctgcggcccttcgcctgtcgcagaagaaccgcctcgccgaaatcgaagccgaactggacgaggcccgctccattctggaagaggccgaagaccagcttgccgcgaaaaccgaggacatcagaagcagtgaattgcggctctcggaggtgcgtgaccggagccggctcgcgacccgtcagcttgccgaggcacgcgaggcgctgacatccgccgaacgggcctcgggcgatctgctgcgccgccgggatgtcgtttccgaagcgcagaaccagatcggcgcgcagatcgacgagatcgccgttcaggaagaaaatgcccgcatcgaaatggaagatgcgccggatctttccgtgcttgatctccggctgcgtgaaagccagctggaagtcgcgaccgaccgcggcctgctggcggaggcccgcgctcgccatgaaggcgtgagtcgcgaggcggaaagccgccagcgcagaattcaggccatagggcaggagcgttccacctgggcatcgcgcgctgcaagtgcggccgatcatatcgccacattgcgcgaacgcgaggaagaggcgcgcgaggaaatcgccgagcttgatatagcgccggaggaattcgacgagaaacgccgcaacctcctcaacgaattgcaaaagaccgaagacgcccgccgcgccgccgccgaccggctggccgaggcggaaaacctgcagcgtgccgccgatcgggtggcggcaacggcgctttccgaactggccgaagcccgcgaaaagcgcggccgtgccgaagaacgtctggtttccgcccgcgagaaacggctggaaaccgaacaccgcatccgcgaaacactgaataccgagcctcatatggcatttcgcctgaccggccttggcccggatcagccgaagcccgatatccgcgatgtcgagcgcgatctcgaccggctgaagatcgagcgcgaaaggcttggtgccgtcaatctgcgcgccgaggaggaacaggcggagctttccggcaagctcgaggcgctgatcaaggagcgggatgatatcatcgatgccgtgcgcaagctgcgcgccggcatccagagcctcaaccgcgagggtcgtgagaggctgattgccgccttcgacgtggtcaattcacagttccagcggctgttcacccatcttttcggtggcggcacggcagaattgcagctgatcgaatccgacgacccgctggaagccggcctcgaaatcctcgcccgcccgcccggcaagaagccgcagaccatgacgctgctttccggcggcgagcaggcgctgacggcgatggcgctgatctttgcggtcttcctcaccaatcccgcgcccatctgcgtgctggacgaggtggatgcgccgctcgacgaccacaatgtcgagcgctactgcaacctgatggatgagatggtggcctccaccgagacgcgattcgttatcatcacccataatcccatcaccatggcgcgcatgaaccgcctgttcggtgtcaccatggccgaacagggcgtctcgcaactcgtctccgtggatttgcagactgccgaacagctgcgcgaagccgtc

SEQ ID NO: 38433 - DNA, 564 bp, Agrobacterium tumefaciens; identical to SEQ ID NO: 35434

SEQ ID NO: 38434 - DNA, 1209 bp, Agrobacterium tumefaciens; identical to SEQ ID NO: 35435

SEQ ID NO: 38435 - DNA, 1179 bp, Agrobacterium tumefaciens; identical to SEQ ID NO: 35418

SEQ ID NO: 38436 - DNA, 648 bp, Agrobacterium tumefaciens; identical to SEQ ID NO: 35417

SEQ ID NO: 38437 - DNA, 1806 bp, Agrobacterium tumefaciens
atgatggccacgaagaaaaaaaccatttcggcggattccagcaatccgacccagaccctgatcaatctctggccctatatgtggccagagggtcggtgggacctgaagatgcgggtgatctgggcaaccgtgttcctcatcgtcgccaagctggtgctgatcgcggttccctatttcttcaaatgggcgacggatgcgctgaacggcaagctcgacatggcagggctggttccggccttcctgctcggcgcggtggcgctggtcatcgcctataatctgacgcggctgatccaggtcgggctcaaccagctgcgcgattcgctgtttgccagcgtcggccaacatgcggtgcgccagctcgcctatcgtaccttcgtgcacatgcaccggctttcgctgcgtttccatctggagcgcaagaccggcgggctgtcgcgggtcatcgagcgcggcacgaagggcatcgaaaccattgtccgcttcaccattctcaataccgcaccgaccttcatcgaattcctgctgacggccatcatcttctgggcgtcctatggtttttcctatgtgctggtcaccgtcgtcaccgtctgggcctatatctggttcacggtcagggccagcaactggcgtatcggcatccgccgcgccatgaatgacagcgataccgacgccaataccaaggcgatcgattcgctactcaacttcgagaccgtcaaatatttcggcaatgaggaaatggaggcacggcgtttcgacgtcgccatggagcgttacgaaaaatcggcgatctcgatctggacctcgctcggctggctgaactttggccagggcgtgattttcggcatcggctccacgatcatgatggtgatgtcggcactggccgtgcagcgcggcgagcagaccatcggcgatttcgtgttcgtcaatgcgctgctgctgcagctttccgtgccgctcaatttcatcggcttcgtttatcgcgaaatccgccagggcctgaccgacatcgaacagatgttcgatcttctcgaggtggaggccgaagtcaccgacaggccggatgcgaagccgcttgcggccggtcccggcgcgatctccttccgcgacgtgcattttgcctacgaccctgaaagaccgatcctcaagggcgtttccttcgatgtgccggcgggcaagacggtggcgatcgtcggcccttccggtgcgggaaaatcgacgatctcgcggctgctttatcgtttctacgatattcaggagggcgccgttaccatcgacgggcaggatattcgcgacgtgacgcaaaagagcctgcgctcgatgatcggcatggtgccgcaggataccgtgctgttcaacgacaccctcgcctacaatatccgctacggtcgcccctccgccaccgacgaggagctgaaggcagcggcggatgcagcgcagatcagcgccttcatcggcaaactgccggacggttacgccaccatggtcggcgaacggggactgaagctttcgggtggcgaaaagcagcgcgtggcgattgcccggaccattctcaaggcaccgccgatcctgatcctcgacgaggcgacctcggcgctcgatacgcataccgagcaggaaatccagagcgccctcgacatcgtctcgaaaaaccgcaccacgctggtcatcgcccaccgcctctccacggtcatccacgcggacgaaatcatcgtgctgaaggaaggactgatcgccgagcggggaacgcatgcctcgctgatggcgcatgatggcctctacgcctcgatgtggagccgccagcgcgag

SEQ ID NO: 38438 - DNA, 768 bp, Agrobacterium tumefaciens
ccgatgaagattgccacctggaacatcaatggcgtcaaggcgcgtatcgaaaacctctgccagtggctgaaggattcctcgcctgacatcgtctgccttcaggaaatcaagtcggtcgacgagggtttcccccgccttgagatcgaggcgctcggttatcacatcgaaacccacggccagaagggttttaacggcgtcgccctgctctcgaaggtgaagccggacgaggtcaatcgtggcctgccgggcgatgatgccgatgaacaggcccgtttcatcgaaggcgtgttttccgtggaaggcggcgcgatccgcgtctgctcgctttacctgccgaacggcaatccgcctgacgatccggtcaaatatccctacaagcttgcctggatggagcgcctgcggcgctttgcggaagatcgccttgcaatggaagagccgctgatcctcgccggcgattacaacgtcatccccgaacccttcgattgccacgacccacgcgtgtgggaaggcgacgcattgttcctgccgaagacccgggcggccttccgcaaactggaaaatctgggcttcactgacgccgcgcgtgcgacgaccgacgcggcaggactttattccttctgggattatcaggccggcgcctggccgaaaaacaacggcatccgcatcgatcatctgatgctgtcagcggaagcagccgacaggctgcaatcggtcgagatcgaaaaacatgtgcgggcctgggaaaaaccgtccgaccatgtgccggtc

SEQ ID NO: 38439 - DNA, 612 bp, Agrobacterium tumefaciens; identical to SEQ ID NO: 35227

SEQ ID NO: 38440 - DNA, 1215 bp, Agrobacterium tumefaciens
gaataatccggccagcaaatccggaggcatacagtgagcgaacgcgcagcatttcattggcaggacccttttctgctcgaagaccaactgaccgacgacgagcgaatgatccgcgacagcgccgaggccttcggcaaatccgaactgctgccgcgcatctcggaagcctatctttccgaaaccaccgaaccggaactcttccgtctgatgggacgcaccggcctgctcggcgtcaccctgccggaagaatacggcgcagccaatgccagctatgtggcttacggcctcgtcgcccgcgaggtggagcggatcgacagtggttaccgctcgatgatgagcgtgcagtcctcgctcgtcattcacccgatcttcgcttacggctcggacgaacagaagaagaaatacctgccgggcctcgtttccggtgaactgatcggctgtttcggcctcaccgagccggatgccggctccgatcccggcggcatgaagacccgcgccgaaaagatcgagggcggttatcgcctgcgcggttcgaaaatgtggatttccaacgcgccgatcgccgatgttttcgtcgtctgggcgaaatcggaagcgcatgacaatgagatccgtggtttcgtgctggaaaagggcatgaaaggtctttccgcccccaagatcggcggcaagctttcgctgcgcgcctccattacaggcgaaatcgtcatggatggcgtggaagtgggcgaagatgcattgcttccgaatgtttccggactgaaaggcccgttcggctgccttaaccgcgcccgttacggcatttcctggggcgtgatgggggctgcggaagattgctggttccgttcccgccaatatggcctcgatcgcaaacagttcggcaagccgctcgccggcacgcagctttaccagaagaagctcgccgacatgcagaccgaaatcgcgctcggccttcaggcatcgctgcgcgtcggccggctgatggacgaacataagatggcgccggaaatgatctccatcgtcaaacgcaacaattgcggcaaggcgctggatatcgcccgccaggcccgcgacatgcatggcggcaatggcattcagatcgaatatcacgtcatgcgccatgcccagaatcttgaaacggtgaatacctatgagggcacgcatgacgtgcacgcgctgatcctcggccgggcgcagacgggcattcaggcgttt

SEQ ID NO: 38441 - DNA, 2487 bp, Agrobacterium tumefaciens
ctgacgcggcgtaatctattgaaggcgcatgctgccggcattgcggcggcaacggcgggcattgcgctgccggccgccgcccagccggtgccgggcggtgtttccgcattgcagatcaaatggtccaaggcgccctgtcgtttctgcggcacgggttgcggcgtcatggtcggcgtcaaggaaggcaaggtcgttgccacccatggcgacatgcaggcggaggtcaatcgtggcctcaactgcatcaagggctatttcctctccaagatcatgtatggcaaggaccgcctcgagaccccgcttctgcgcaagaaaaacggcgtctacgccaaggatggcgagttcgagcctgtcagctgggacgaggccttcgacgtgatggcgcagcaatgcaagcgcgtgctgaaggaaaagggaccgacggccgtcggcatgttcggttccggccaatggacgatcttcgaaggttatgccgcgaccaagctgatgcgcgccggcttccgctccaacaatctcgaccccaatgcccgccactgcatggcgtcggccgcttatgccttcatgcgcaccttcggcatggatgagccaatgggctgctacgacgatttcgaacatgccgatgccttcgtgctctggggctcgaacatggcggagatgcaccccattttgtggacccgcatcgccgaccggcgtctgggtttcgaccatgtgagggtggcggtgctttcgaccttcacccatcgcagcatggatcttgccgatatccccatggtcttcaagccgggcacggatctcgtcatcctcaattacatcgccaaccacatcatcaagaccggccgcgtcaacgaagacttcgtgaggaaccacacgaaattcgtgcgcggcgtcaccgatatcggttatggcctgcggccagacgatccggttgaggtgaatgccgccaattctgccgatccgaccaagacggaagcgatcgatttcgagaccttcaaggaatttgtctccgaatacacgctggaaaaaaccgccgccatgaccggggtggaagccggcttcctggaggaactggccgagctttatgccgacccgaaacgcaaggtcatgtcgctctggaccatgggtttcaaccagcatgtccgcggcgtctgggccaaccagatggtctacaacatccatcttttgaccggaaagatttccgagcccggcaacagtccgttctcgctcaccggccagccctcagcctgcggcacggcgcgtgaagtgggaaccttcgcccaccgcctgccggccgacatgacggtgaccaacccggaacaccgcaaacatgccgaggaaatctggcgcattccgcatggcatcatcccggaaaagccgggttaccacgccgtgcagcaggaccgcatgctgcatgacggcaagctgaatttctactgggtgcaggtcaacaacaacgtccaggccggccccaacaccaagaacgagacctatctgggttatcgcaacccggaaaacttcatcgtggtttcggatgcctatccgaccatcaccgccatgagcgccgatctcatcctgcccgccgccatgtgggtggagaaggagggggcctatggcaatgccgagcggcgcacccatgtctggcaccagctggtggaggcctcgggcgaggcgcgttccgacctctggcagctggtggagttttccaagcgtttcaccaccgacgaggtatggccggccgaaatactcgacgccaatcccgcctatcgcggcaagacgctttacgaggtgctctacaaggacagcgatgtcggcaagttcccgctgagcgaaatcaacgccgactacaagaaccaggaatccagtgatttcggcttctatctgcagaagggcctgtttgaggaatatgctgctttcgggcgcggccacggccacgatctggcgccttacgatgcctatcacgaggtgcgcggcatgcgctggcctgtcgtcgatggcaaggaaacgctgtggcgttaccgcgagggttacgacccctatgtcaaacccggcgagggtgtgaagttctacggcaacaaggacggcagggcggtcatcatcgccgtgccttacgagccgccggcggaatctcccgaccaggaattcgatacgtggctggtgacgggccgggtgctggagcactggcattccggttccatgaccatgcgcgtaccggaactctacaaggcgtttcccggcgcccgctgtttcatgaatgccgatgatgcgcgcaagcgcgggctcaatcagggcgcggaaatccgcatcgtctcgcggcgcggggaaatccgctcgcgggtggaaacgcgtggccgcaaccgcatgccgcccggcgtcatcttcgttccctggttcgatgccagccagctgatcaacaaggtgacgcttgacgcaaccgatcccatctccaagcagacggatttcaagaaatgcgcagtcaagatagagccagtc

SEQ ID NO: 38442 - DNA, 855 bp, Agrobacterium tumefaciens
gacccgcgcagccagtatccccgcccgccgttttcaaccccgacccaggaaatgccgggtctggtgacgaatatgacgcctttccctgatcatggtgaaaagagctacaagggcaccggcaagcttgcggggcgcaaggcactgattaccggcggcgattccggcatcgggcgcgcagtcgcaatcgcttttgcgcgggaaggtgccgatgtcgcgatatcctatctgccggaggaagaatcggatgccgaggaagttgttgcactgatcgaggcggaaggccgcgtggcggtagcgctcccgggcgatattaccgacgaggcatggtgccgtgaactggtcgagaaagccgtcagcgatctcaatgggcttgatattcttgtcattaacgccgcaaggcagcaatatcgcgaagacatcgaagagctctcgaccgatgatttcgaccgcaccatgaagaccaatctttatgcgttgcactggattgcgcaggcggctgttccatatctgaagccgggtgcgtctgttatcaccaccgcgtccatccaggcctatgaaccatcggccatccttctcgattacgccacgaccaaggccggtatcgtcgcttataccaaggcgctcgcaaagcagctgatcgaaaagggcgtgcgcgccaatgcggtagcgcccggtccgttctggacggttcttcagccgagtggcggccagccggatgagaaggtgaagaacttcggcaaggacagcgatttcggccgtccgggacagcctgtggaactggcacctgtttatgtgctgctcgcctcgcaggatgcgagtttcatcaatggtgaagtatatggcgtgaccggtggg

SEQ ID NO: 38443 - DNA, 2148 bp, Agrobacterium tumefaciens
gctggcaagtgtcccgtcatgcatggaggcaatacggcctccggcaaatcggtgaccgaatggtggccgaacgcgctaaacctcgacatcctgcatcagcacgacaccaagaccaatccgctcggcacctccttcaactaccgcgaagcgctgaagacgcttgatgtcgaagccctcaaggccgatctgcgcgcgcttatgaccgacagccaggaatggtggccggcccactggggcagttatgtcggcatgatggcccgtgttacctggcatgccgccggttcctatcgtgtcacagacggtcgcggcggcgccaataccggcaaccagcgttttgcaccgctcaattcctggccggacaacgtcaacaccgacaagggccgccgcctgctgtggccgatcaagaagaaatacggcaacaagatttcctgggccgaccttatcgcgctcgccggcacgatcgcctatgacgtcgcgggtctgaagaccttcggcttcgccttcggccgcgaagacatctgggcgccggaaaaggacacctattggggtgacgaaaaggaatggctggcgccgagcgacggccgttatggcgacgtgagcaagcccgagacgctggaaaacccgcttgccgccgtgcagatgggcctgatctacgtcaacccggaaggtgtcaacggcaagtccgatccgctggcgacggcggcgcagatgcgcgaaacctttgcccgcatggggatggatgacgaggaaaccgttgccctgacggccggcggccacaccatcggcaagtcccatggcaatggcagtgctgccaatctcagccccgatccggaagctgctggcccggaatatcagggtctcggctggatcaataccaagggccgcggcattggccgtgacaccgtggtgtcgggtatcgaaggcgcatggacaagcgaaccaaccaagtgggacaacggcttcttcgacatgctgttcaagcacgagtggaccctgacgcacagccccgcgggtgcatcgcaatgggcgccgattaccatcgccgaagaagacaagcctgttgatgtcgaggatgcgtcgatccgcaccatcccgatgatgaccgacgccgacatggccctgaaggtcgatccgatctaccgcgagatttcgctgaagttcaaggacgatcaggaccatttctctgatgtcttcgcccgcgcctggttcaagctgacgcatcgcgacatggggccgaagtcccgttacgtcggcccggatgttccggctgaagacctgatctggcaggatccgatcccggcaggctccacgagctacgatgtcgctgccgtcaaggctaagatcgctgcctccggcctttctgtcgccgatctggtttcaaccgcatgggacagtgcccgcaccttccgtggttcggacaagcgcggcggcgccaatggcgcgcgtattcgtctcgcaccgcagaaggattgggaaggcaatgagcccgcccgtctttcccgcgtgctttcggttctggagccgattgcccgcgaaaccggtgcaagcatcgccgatgtgatcgttctggctggcaattacggcgtggagcaggcggcgaaagcggctggtttcgatatcgccgtgcccttcgcggccggtcgtggtgacgcttccgccgagcagacggatgccgacagctttgcgccgcttgagccgctggcggatggtttccgcaactgggtgaagaaggactatgtcgtcagccccgaagagctgctgctcgatcgggcacagcttcttggcctcaccgcgccggaactcaccgtcctcatcggcggcctgcgcgtcatcggcgccaattacggcggtgcggcgcatggcgtcttcaccgataagccgggggcgcttacaacggacttcttcacgacgttgacggacatggcctattcctgggtcccgaccggcaacaatctctatgagatccgtgatcgcaagaccggcgcagccagatattcggcaacccgcgtcgatctcgtgatcggctccaactccatcctgcgcgcttatgcggaagtttatgcgcaggacgacaacagggaaaaattcgcccgcgacttcattgccgcctggacgaaggtgatgaacgccgaccgtttcgatctgatc

SEQ ID NO: 38444 - DNA, 1452 bp, Agrobacterium tumefaciens
gtaaatcttttcatcggcggcgatcattgcgcggccgcgaacggcaagcgcttcgaacggaacaacccgatcaccggcgatgccgtaacgagtgccgccgccgcttcggttgaagatgcgacgaacgcggccgatgctgccgctgccgctttcccgaaatggtccgccaccacgcccggtgaacgccgccgccacctgcttgcggctgccgaggcgctgcgcgcggcgggcccgcaaatcattcaggcgatgatggaggagatcggcgcgacggaggcctgggccggttttaacgtcatgctcgccagcgatatgctggtggaggcggccagtctaaccacgcacatcacgggcgaagtcatcccatcgaaccgcccgggaaccatggccatggcgctccgtcagccggcaggggtcgtgctgtcgatggcgccgtggaacgcgccggtcattctcggcgtgcgctccatcgccaccccgcttgcctgcggcaatacggttgtcatgaagacctcggaactttgcccgcggacccacgccctgatcatcgaagcggttgcctccgcaggactgccgaaaggcgtgctgaacgccatttccaacgcgccggacgatgcggcgaagatcgttgaaacgctgattgcccatccggcggtcagaagggtgaacttcactggctccacccgtgtcggccgcgtcattgcggaaacggcgggccgctacctcaaacccgccctgctggagcttggcggtaaggcgcccttcatcgtgcttgacgatgccgatatcgacgcggcggtcgctgccgctgcattcggcgcctacatgaaccaagggcagatctgcatgtcaaccgagcgtatcatcgtgcttgacagcattgccgatacattcgtcgaagctttcgcgaaaaaggccgccagcctgacggcgggcgatccgcgcgagggcaagacaccgctcggctcactggtcagtgccgaagcagcctcgcgtatccgggtgctggtcgatgacgccgtctccaagggtgcaaggcgggttgccggtggcggtggcgatggcacgatgcttgacgcgatcgccgtcgatggcgtcaccccggccatgcggctttattcggaggagagcttcggcccggtcgtatccatcatccgggccggcagcatcgatgaggccgtgagcatcgccaatgaaagcgaattcggtctttccgccgccgttttcggcagggaccaggcgcgggcgctttccgttgccgcgcggattgaaagcggcatttgccatgtcaacggcccgaccgttcatgatgaggcccagttgcccttcggcggggtcaaggcttccggttatggccgtttcggcggcacagcgggtatcgccgaattcaccgaattgcgctgggtcacgctgcaggacgggccgcttcactacccgatctgaacgtcctga

SEQ ID NO: 38445 - DNA, 1503 bp, Agrobacterium tumefaciens; identical to SEQ ID NO: 35106

SEQ ID NO: 38446 - DNA, 717 bp, Agrobacterium tumefaciens
ttcgcccatatcggccgccccgttgcgctgctggcaaggctcggcaccgacacgttttcgcgcgatatcggtgagaaaatggcacaaagtggtgtggacctgcagtttctggaacatgcaacagatgccggacctcaagtcacggtagcaaccgtggtcggtcaggaccgggcgtttttgacacgccgcgccggtgccgcccggccttcgacgctggatgccgcctttgcttgggacaaggcacggcatctgcacatcgccgaattcgctactctgcaagagattcccgatctggtctcacgcgccaaggcaagcggattgtccgtttcgctcgatccgagctgggatgcagcgctgatctacgacaaaggcctgctcaaggcctgtgccggtgtcgacgtgtttttgcccaatctcgaggaggcggaagcgatcacgggacgttcagaaccggaagcggccatcaggacactggcggaggcttttcccatcgtcgcgctcaaaggtggtgcggaaggtgcatgggtatcttctgcggccgggcttcaccatagagcggcccaaaaagtcccggtcatcgacacaactggcgcaggcgatgcctttaatgccggttttctggatgcctggcttcagcggcaggacgaacagcagtgtctcaaagcagggatcgctgcgggcagtcttgccgtacaggcggcaggcggtgcaccgagg

SEQ ID NO: 38447 - DNA, 1308 bp, Agrobacterium tumefaciens; identical to SEQ ID NO: 35104

SEQ ID NO: 38448 - DNA, 1467 bp, Agrobacterium tumefaciens; identical to SEQ ID NO: 35103

SEQ ID NO: 38449 - DNA, 1284 bp, Agrobacterium tumefaciens
ggcgacgtgctgcagcgtccggccctttcgggcgccaccattgcgctgatggacatcaatcgcgagaggctggaagaaagcgccatcgtcgtcaacaagctgatttcgacattgggggcaaaggcgaaagccgagacctataccgaccagaaaaaggcgcttgccggtgccgattttgtcgaggtcgccttccagatcggcggatatgaaccctgtacggttaccgatttcgaggtgccgcgcaaatatggcctgcgccagaccattgccgatacgctcggcgtctgcggcatcatgcgtggtcttcgcaccgtgccgcatctgtggaaaatctgcgaggatatcctcgccgtctgccccaacgccgtcatgctgcaatatgtgaacccgatggcgatcaacacctgggcgattgccgagaaatacccgacgatccggcaggttggcctttgccattccgtgcagggcacggccatggaactcgcccatgatctcgatatcccttatgaggagatccgctatcgttcggccggcatcaaccacatggcgtttttcctcgaattcgagcatcgccagcccgacggcagctataggaacctctatcccgatctcgtgcgcggctaccgcgaaggccgtgcgccaaaacccggctggaacccgcgttgccccaacaaggtgcgttacgagatgctgacgcgactcggttatttcgtcaccgaaagctcggaacatttcgccgaatatacgccctatttcatcaaggaggggcgcgacgacctgatcgagaaattcggcatcccgctcgatgaatatccgaagcgctgcatcgaacagatcgagcgctggaaggggcaggcggcggcctatcgttcggccgagaagatcgaggttaagcaatcgaaggaatatgcctcctccatcatcaactccgtctggactggcgaaccctccgtcatctatggcaaccagcgcaacaacggctgcatcacctcgctcccatcggattgcgcggcagaagtgccctgccttgtcgaccataacggcgtgcagcccacctttatcggcgaattgccgccgcaactccgcgcccttgatgcgcaccatcatcaacgtgcaggaactgcaggtgcgggcgcctgatgagcgaaaaccgtgcccatatcttccacgcggcgatgatggacccggacaccggcggcggaactggatctcgaccagatatggtcgctggtagacgacctactgctcgcacaccgcgactggttgccggaatggacgcaggcg

SEQ ID NO: 38450 - DNA, 1296 bp, Agrobacterium tumefaciens; identical to SEQ ID NO: 35221

SEQ ID NO: 38451 - DNA, 915 bp, Agrobacterium tumefaciens; identical to SEQ ID NO: 35220

SEQ ID NO: 38452 - DNA, 1419 bp, Agrobacterium tumefaciens
atgcggattcttgccgttacggccgaaatgtttcccttcgtcaaaaccggcggattggccgatgccacgagcgctttgccgcaggcgctggaacgaaaaggggctgacgttcggacattgctacccctctaccgcgggctcacgccgcttgtccgcggccggaagccggtcctggttgccaatattctggagcagccggtatcagtttattacgttgtttccgatggtcacaagcttctgcttcttgaagcggcaagcctgttcgacagagacggacatccctatggcgtaaaaggcgagccttttgctgacaacgatcttcgctttgcggttctgtccaaagtagcggcggaaatagccctcggcgcgattgacggctggcagccggatgttgtccatgtccatgattggcacgcggctctgacctgcgtctatctcgcggattcgacgccctcggtagcctccgttctaacccttcacaatctcgcatttcagggtcagtatccgctggagagggcgggtatgcttggactaccctcgcacctctgcactgtcgattgccttgaatattacgatgacatgtcatttttgaagggcggtctgacgaccgcgtcggcggtaacgacggttagtccaacttatgcaagagaaatccttacgccggaaatggggatgggaatgcatggcgtgctcgccaggcggcgaggggacctgcgcggcatcgtcaacggtgtcgatcacgacgtctggaatccggcaacagatccgtacattctcgcaaatttcacggctgccacggcgacaagacggagcctcaacaaatatgccttgcttcaggcccttggcctagcccctacccagggccctgtcttcggcgtggtcagtcgcctgacctggcaaaagggaatcgatctcctccctcacgtcgtaccccttataatagaaaggaaaggcaggctgatcgttcacggagagggagatacggcactggaagacagcttgcaggcgctggcaaagcgctatccggaactagtctgcgcccatatcggctatgacgaacggctggcgcacatgatccaggccggctcggatttcatcatccagccgtcacagcgccaaccctgcgggctgacgcagctttacgcgctgcgatacggcgcgctgcccatcgtcagccgcacgggcgggctggcggaaaccattatcgacgcgaatgacgcggccattgaagcgggcgtagcaacaggctttcaattcgagccggcgaatgaagacgatctgcgcgccgcgctggagcgtgccattagcgcctataacgaccgggaacttttccgacggcttcagacgcaggccatgcaggccaatttttcctgggacaagagtgccgcacaatatatggcgcttttcgagagccttgtc

SEQ ID NO: 38453 - DNA, 843 bp, Agrobacterium tumefaciens
acccgacaccctaccccgccctatccggaacaacagcaggagccaccgggcaagacagccgagatgaaacccatcccggatcatggtgaacagtcctacgtgggtgacggtaagctgaaaggcagggttgccctcatcaccggagccgattcaggaattggcaaggctgtcgccattgcttttgcgcgagaaggcgccgacatcgtcatttcctacctcaacgaggacgatgacgcccgcgacactgcaaagtgggtaaaggaagccggccaaggagctttgttggtacccggcgacatcaagtctgaggaacattgcaagaatctcgtacatcgcgccgtcaatgagctcggtgctgtcgacattctcgtgaacaacgcagcgttccagcgaacctatgacgatatagccgacatcaccgccgaggagtgggacgaaacttttcgcaccaacatctatgcacctttcttcctgtcgaaagcggccgctccccacatgaaaccgggtagctcgatcatcaacacgacctcaattcagtcgcggcagccctcgcctcaacttctcgcctacgcttccacaaagggcgcgatatccaacttcactgcgggtctggcggaaatgctggcggaaaaaggtattcgcgtgaatgcggtcgcaccggggccgatctggacccctctcattccctcgaccatgcccgctgaaaaggctgccaagtttggagagaataccctcattggccgtgccgggcagccggcagagctcgcaggagcctacgtcctgcttgcttcggatctgggaagctacatgacgggagccgtcattcccgtgaccggcggcgag

SEQ ID NO: 38454 - DNA, 2685 bp, Agrobacterium tumefaciens
ctgatctcggaagagagccgcgcgacggccactccgatgatggagcaatatatcgagatcaaggcgaacaatcccggttcgctgctgttttaccgcatgggcgatttttacgaattgttctttgacgatgcggtcgaagcctcccgcgcgctcggtatcacgctgacgaaacgcggccagcatatggggcacgatattcccatgtgcggcgttcccgttcacgctgccgatgactatctccagaagctcatcctgcgcggctaccgtgtcgccgtctgcgaacagattgaagacccggctgaagcgaagaagcgcggatcgaaatccgtggtcaagcgtgatgtggtgcggctcgtcacgcccggaacgctcactgaagaaaagctgctgtcgccgacggaatccaactatctgatggcgcttgcccgtattcgcggcagtgcggaggcgcagttcgcgctggcctggatcgatatttccaccggcgtcttccgtctggcggaaaccacgctgacgcggcttctcgccgatatctggcgtatcgatccgcgtgagctgatcgttgccgacagcctgttccacgacgaggaactacggccggttttcgatgtgctgggccgtgtcgcggtgccgcagccggccatcctcttcgacagtgcggtggcagaaggccgtattgcgcgttatttcaacgtctcgacgctggatggtttcggaacgttttcacgggtggaaatggcagccgcagcagcagccgtggcctatgtcgaaaagacccagattgccgagcgtccgccgctcggcgcgccggaacgcgaaagtgcggcatcgacgctcttcattgatcccgccacccgcgccaatctggaactggtgaaaacactatccggcgaccgggatggatcgctcctgcacgcgcttaaccgcactgtcactggcggcggtgcgcgacttctggccgaacgactgatgtcgccattgaccgatccggaaaggatcaatgcccgtcttgatgccgtggcctatctcatcgatgacgtctccctgtgcgatggtctgcgtgacgcgctgaaacatgtcgcggatatgcctcgtgcgctttcccgccttgcgctggaacgtggcggcccgcgcgatcttggcgccatccggcagggtctggtttcggccgaaaaaattgcggtcattctcgacggtgggctgctgccggatgagctggcgaaagctctcagggatttgaaagccctgcccggcgctcttgaagccatgctcggctcgatgctggccgacgatctgccgcttctgaaacgcgatggtggtttcctgcgtgagggcgccaatcccgaactcgacgaagttcgcgcactgcgcgaccagtcacgccgggtgatcgccgggttgcagctgcaatatgccgatgagaccggcatcaagtcgctcaagatcaagcataacaacgtgctgggttattttatcgaggtgacggcgggcaatgccgatgtgatgatggcaacggatgaggccaaagcgcgctttatccatcggcagaccatggcgggcgccatgcgcttcacaaccacggagcttgccgatctcgaaagccgcatcgccaatgccgcggccgaggctctgaccatggagctggaagccttcgagcgcatggtcgaggccgtggtgcagcaggcggaggcgatcaaggccggggctctggcgcttgcggtgatcgatgtcgcctcaagcctcgcctatcttgcgaccgaacaggcctattgccgtccgatcgtcgatgccttcatgaccttttcaatcaagggcgggcggcaccccggttgttgagcaagcgctgcggcggcagtctgccgggccgttcattgcgaataattgcgatctctccgccgtcaatggtggcaagaacggtgcaatctggctgctcaccggcccgacatgggcggtaaatcgaccttcctgcgccagaatgcgctgatcgccatcctcgcgcagatcggttccttcgttccggcggaggctgcccatatcggcgtcgtagaccggctgttttcgcgcgtcggcgcctccgacgatctggcccgtggacgctcgaccttcatggtggagatggtcgaaaccgccgccattctcaatcaggcgacggatcgctcgctggtgatcctcgacgagatcggccgtggcaccgcaacttttgacgggctttcgatcgcctgggcggccgtcgagcatctgcatgaggtcaatcgttgtcgcggcctcttcgccacgcacttccacgaactgacggtactgtcggaaaaactcggccgcctttccaatgccacgatgcgggtgaaggagtgggaaggtgatgtcatcttcctgcatgaggtcgggccgggcgctgcggatcgttcctatggtattcaggtcgcgcgacttgcgggcctgcctgcctcagtggtggagcgtgcccgtgaggtgctgacgaagctcgaggatgccgaccgcaagaacccggccagccagctgatcgacgatctgccgctgttccagattgccgtccgccgcgaggaaacccgcaaggcggggccatcgaaagtggaggaggccctgaagagcttcaacccggacgaaatgacgccgcgtgaggcattgtacgcgctctatgcgttgaagaaagaacttggcaaggct

SEQ ID NO: 38455 - DNA, 1296 bp, Agrobacterium tumefaciens; identical to SEQ ID NO: 35472

SEQ ID NO: 38456 - DNA, 2040 bp, Agrobacterium tumefaciens
cagaatgatttcttgcgcctttacacccacgacatgaccaccgatgcccgcaacggcaaggtcgatcctgttatcggccgcgatgatgagttgcgccagctcgttgatattctgacccgccgccgacagaacaatcctattctggtgggcgaggccggcgtgggcaagaccgcggtcgccgaagcgctggcgttggaaatcgcctccggcaacgttccggagaaactgcgcaatgtctgcctgctgaacctcgatatttcgctgctgcaggccggtgccggcgtgaaaggtgagttcgagcggcgcctgcacggcgtgatcgatgcggtcaagcgttcggccgaaccggtcatcctgttcatcgatgaggcccatggccttgttggcgcgggtggtgcggcgggccagggtgatgcggcgaatattcttaagcccgcactcgcacgaggcgaggtgcggaccgtcgcggcaacgacgtggagtgaatacaagaaatatttcgagaaggatgcggcgctgacgcgtcgtttccagccagtgcatgtgcgcgagccggacgaggcgactgcgatacggatgttgcgcggtgtggcggatactttcgtcagccatcacaacgttaccgttcgtgatgaggcgatcgtggctgccgtgcaattatccgcgcgctacatgcccgctcggcaattgccggacaaggcggtcagcctgctcgataccgccgccgcggccgtttcgctggcgcggcagacgttgccagagcggttacgtgccatggaaagcgagcgacaccttctgtctgacgaactgaactggcttctgcgtgaaccgcaggatgaggacatgcaaaaccgcatccagtcgatacgcgacgagcttgaacggcttgaggccgggatcgatgatctgcgcggccgttatgacgcggaaatggctgaactggcggcgctcagtgaagagcagccggccgaaaccggcgcgtcgaatgtttcgcacctgcggcctgccacggagatgcggcccgcaaatgccgaaagacttgttccgacagtggttgatcgtgaagcgatcgccgccgtcgtctcgcgatggaccgggattccgctcggcaaacttctggcggaccagatcgaaagcgcccgcactctggatgtgcgcatgcggcagcgcgtggttgggcaggatgccgcaattacccggattgccgatgccatgcgcaccgcccgtgccggattgtccgatccgcgccgtccgccggcggtgtttttccttgtcggcatgtccggaacgggcaagaccgaaacggcgctgtcgctggccgatcttctctatggcggcaacagccatctgacgacgatcaacatgtcggagttcaaggaggagcacaaggtttccctgcttctcggctcaccgcctggctatgtcggtttcggcgaaggtggggtgctgacggaagcggtgcgccgccggccgttcggcgttctgcttctcgatgaaatcgacaaggctcaccccggcgtccaggatattttttatcaggtgttcgacaagggcgtgcttcgcgatggcgaaggccgcgacgtcgatttcaagaacaccacgatcttcatgacggccaataccggttcggaattgctgtcggcgctttccgccgatcccgacactatgccggaaggtgaggcgctggaagcgcttctgatgccggagcttaccaaacagttcaagcccgcattcctcgggcgcacgatcatcctgcccttcatgccgcttggcgcggaggagcttgcaagtgtcgtggacatgcagattggcaagatcagggaccgtgtgctcgcaacatatggcaccgacctgagattgtccgatgcggcgcgcgatgccttggtggcgcgcgccggtgcaagtgaaatcggcgcacgcgccatcgaaatcatgatcggcaaggatctcctgccgcctctttccagctttttcctcgagaaggtcatcgcgggagaacgcgtcgggaagatcgttgtcgattttggtgaaaacgggttc

SEQ ID NO: 38457 - DNA, 744 bp, Agrobacterium tumefaciens; identical to SEQ ID NO: 37951

SEQ ID NO: 38458 - DNA, 1704 bp, Agrobacterium tumefaciens; identical to SEQ ID NO: 38089

SEQ ID NO: 38459 - DNA, 732 bp, Agrobacterium tumefaciens; identical to SEQ ID NO: 37965

SEQ ID NO: 38460 - DNA, 1404 bp, Agrobacterium tumefaciens; identical to SEQ ID NO: 38132

SEQ ID NO: 38461 - DNA, 1758 bp, Agrobacterium tumefaciens; identical to SEQ ID NO: 35441

SEQ ID NO: 38462 - DNA, 1892 bp, Agrobacterium tumefaciens
cagacaccattgctcgaccgggtgaattttccctccgatctcaaggagatcgatgatcgcgacctgccggaactggcacgggaactgcgcgacgagatgattgacgcggtgtcgaagaccggtggccatctgggtgccggcctcggtgtggtggaactgacgattgccattcacaaggtgttcaacacgccggaagaccggctgatcttcgatgtcggccaccaatgttatccgcacaaaatcctgaccggccggcgtgaccgcatccgcacgcttcgacaggaagacgggctttccggtttcacgcggcgggccgaaagcgaatatgacgattttggcgccggccattcctccacctccatttccgccggtctcggcatggcggtggcggcggggctcgatggcagcgaccgcaaggtcatcgccgtgatcggcgacggttcaatgtcggccggcatggcgttcgaagcgctcaacaatgccggtgcactcgatgcgcggctgatcgtcatcctcaacgataacgacatgtcgattgcgccgccgacgggtgcgatgagcgcctatctggcgcggctggcctccggccgcacctatatgggctttcgcgatttcggcaagaaactgaccgcctatctcggcaagaccatcgatcgcgccattacccgcgccgtgacccatgcccgcggttatgtgaccggcggcacgctgttcgaggagcttggtttctatcacatcggcccgatcgacggtcattccttcgatcaccttttgccggtgcttcgcaatgtgcgcgacaaccagaaaggccctgtcctgatccatgtggtgacgcagaagggcaagggttacgccccggcggaagcggcagcggacaaatatcacggcgtcaacaagttcgacgtcatcaccggcgcgcaggcgaaagccaagccaaatgcgccgagctataccagcgtgtttgccgaagcgctgatccaggaagcgaccctcgacgagaagatcatcggtgtcaccgctgccatgccgaatggtaccgggctggacaagatggccgagcttttcccgtcccgcaccttcgatgtcggcattgccgagcaacacgcagtcaccttcgcggcgggacttgcggccgatggttacaagccgttctgcgcgctttattccaccttcctgcaacgcggttacgaccagctggtgcatgatgtggcgatccagagcttgcccgtgcgtttccccatcgatcgcgccggcttcgtcggcgccgacggaccgacccatgccggctccttcgacacgacgttcctcgccaccctgcccggcatggtggtgatggcggcggccgacgaggcggagctaaaacatatggtccgcacggcggcggcttacgatgaaggcccgatttcattccgttatccgcgcggcgaaggtgtcggcgtcgaaatgccggcacgcggtgagattctccagatcggcaaaggccgcatcatcaaggaaggcaccaaggttgccctcctctccttcggaacgcggcttgcggaatgccttgcggccgccgaagatctcgatgccgcgggcctttcgactacggttgccgatgcgcgcttcgccaagccgctcgatctcgatctcatccgccagcttgccgcccatcacgaggttctggtaacgatcgaggaaggttctgtcggcggttttggtgcgcatgtgctgcatttcatggccagcgccggcctactcgaccatggcccgaaggttcggaccctgaccctgcccgaccagtgggtggagcaggccaagcctgagaccatgtatgccaatgccggcctcgaccgcgccggcatcgtttccaccgtgtttaatgcgctcggccagcgtcaggccggcgtcgg

SEQ ID NO: 38463 - DNA, 598 bp, Agrobacterium tumefaciens
gattgggatcaggtcgaccagaacccgttcttctgccctgatcccgagatggtgcccgtctgggaagagtatctcgatggtatccgcaagtccggctcctccatcggcgcggtggtcgaagtggtggcggaaggggttccggccggcatcggcgcgccgatctatgccaagctcgatcaggatatcgcctccagcctgatgtcgatcaacgccgtcaagggcgtggagatcggcgaaggttttgcctcggccgagctttccggcgaggaaaatgccgaccagatgcgcatgggcaatgacggcaagccgattttcctctccaaccatgccggcggcattctgggcggcatcgcgaccggtgagcctgttatcgcccgcttcgccatcaagcccacctcctccatcctgacggagcgcctgtccatcgataccgatggcaacaatgtcgatgtgcgcaccaagggccgccacgacccctgcgtcggcatccgcgccgttccgatcggtgaagcgatgatcgcctgcaccgttgccgaccattacctgagagaccgcggccagaccggccgactgaaataaggggatatcgccatggcct

SEQ ID NO: 38464 - DNA, 2460 bp, Agrobacterium tumefaciens
atgatcaataatcttaccgccgccgatcttccccgccccgccccgcgcagttccaacccggaaatcatggccgcggaaatcatcgagcgactgacctaccgcatcggcaaggacgtcaaggttgcgaaaccgcacgactggctgaccgcaaccatcctcgtcgtgcgcgaccgcatcatcgacaaatggatggcatccacccgcaaggcctatgccgacaattccaagcgcgtttattatctgtcgctggaattcctgatcggccgcctgatgcgcgacgccatctccaatatcgggctgatgcatgaaatccgcgatgcgctgtcctcgctcggcgtcgatctcgacgtgattgccggtcttgagccggatgccgcacttggcaatggcggcctcggccgcctcgccgcctgtttcatggaatccatggcgaccgtcgacattcccgcctatggttatggcatccgttacgtgcacggcctcttccgccagcagatggcggatggatggcaggtggaactgccggaaacctggctggcgcatggcaatccctgggagttcgaacgccgcgaaagctcctatgaaatcggcttcggcggatcggtggagacgatcggcggatatgaagacccgcagcgtttcgtctggaaaccggccgaacgtgtgatcgccatggcctatgacaccccggtcgtcggctggcgcggcacccgcgtcaacacgttgcggttatggtctgcgcagcctatcgaccccattctcttggccgcctttaatgccggcgaccatatcggcgcattgcgcgagagcaacaaggcggaaagcctgacgcgggttctctaccctgcggacgcgaccccggccgggcaggaactgcgcctgcggcaagagttcttcttctcctccgcctcgctgcaggacattctgcgccgccatctccagcaatatcctgacttcacctcgttgccggacaaggtctcgattcagctcaacgatacccatccggccatttccatctgtgaaatgatacggctgctctgcgatgtgcacggtcttgaattcgacgaggcctggaggatcacccagggcaccttctcctacaccaaccacacgcttctgcccgaagcgctggaaagctggccggtgccgctgctcgagcgtcttcttccaagacatatgcagatcgtctacgcgatcaacgccaatacgctgctctttgcccgcaaggaaaagaagatggcggatcagcagatccgctcgatctcgctgatcgatgaaggcggcgagcgccgtgtgcgcatgggcaatctcgctttcatcggctcgcattccatcaatggcgtttcggcgcttcatactgagttgatgaaggaaacggtttttgccgacctgcacagcctctatcctgaacggatcaacaacaagaccaacggcatcaccccgcgccgctggctgatgcagtgcaaccccggcctcaccgggttgatccgggaagcgatcggcgacgatttcctcgacgatgcggaaaagctcatcgcgctcgaccgtttcgccgacgatgccggtttccgtgagaaattcgctgaagtgaagcgcctgaacaaggtgcgcctcgccaacaccgtggcacagcgcatgggcatccgcgtcgatccttcggccatgttcgacatccagatcaagcgcatccacgaatataagcgccagcttctgaaccttatcgaaacggtggcgctttacgaccagatccgttcccacccggaactggattgggtgccgcgcgttaagttcttcgcaggcaaggcggcgccgagttatcacaacgcgaagctgatcatcaagcttgccaacgatattgcccgggtcatcaacaacgacccggccgtgcgcgggcttctgaaggtggtgtttattccgaactacaacgtctcgcttgcggaaatcatggttcccgccgccgatctttccgaacagatttcgaccgccggcatggaagcgtccggcaccggcaacatgaaatttgccctgaacggcgcgctcaccatcggcacgctcgatggcgcgaatgtggaaatgctcgaacatgtcggcgctgacaacatcgtcatcttcggcatgacggcggaagaagtctccagggctcgcgccgaaggccataatccccgcgccatcatcgaagggtctgcggaattgtcgcaggcgctgtcatcaatcgcgtcgggtgtgttttcaccggatgaccgttcgcggttttccgccctgatggatggcatctacaacagcgactggttcatggtggctgccgatttcgacgcctatgccgatgcacagcgcaaggtggacgcgatctggagcgatcaggatagctggaacacgaaagcagtgcgcaacacggcgcgtatgggctggttctcgtccgacaggacgatccgccaatatgccaccgagatctggagagcc

SEQ ID NO: 38465 - DNA, 1260 bp, Agrobacterium tumefaciens; identical to SEQ ID NO: 35063

SEQ ID NO: 38466 - DNA, 1440 bp, Agrobacterium tumefaciens; identical to SEQ ID NO: 35062

SEQ ID NO: 38467 - DNA, 1626 bp, Agrobacterium tumefaciens
atgatcaagactatcaagacgacgccttatcaggaccagaagccgggcacatccggcctgcgcaagaaggtgccagtcttcgcccaggaaaattatgccgagaacttcatccagtcgatcttcgacgcgcttgaaggttttgagggccagacgctggtgatcggcggcgacggccgttattacaaccgcgaagtcatccagaaggcgatcaaaatggccgccgccgccggtttcggcaaggtgctggtcggtcagggcggcattctctcgacgcccgccgcctccaacgttatccgcaaatacaaggccttcggcggcatcgtgctttccgccagccataatcccggcggcccgaccgaagatttcggcatcaaatacaatatcggcaatggcggcccagcaccggaaaagatcaccgacgcgatctatgctcgctctaaggtcatcgacagctacaaaatctctgatgcagccgatatcgatctcgacaagatcggcagcttcaaggtggatgaactaacggtcgacgttatcgatccggttgccgattatgctgcgctgatggaagagctgttcgattttggcgccatccgttctctcatcgccggcggcttcaaggtcgtcgtcgattccatgagcgccgtcaccggcccctatgccgttgagatcctcgaaaagcgtctcggcgctcccaagggctccgtccgcaacgcaacaccgctgcccgatttcggcggccaccatcccgatccgaaccttgtccatgccaaggagctttatgacgacgtcatgagcccggaaggcccggatttcggcgcggcttccgatggtgatggcgaccgcaatatggttgtcggcaagggcatgttcgtcactccctccgatagtctcgcgatcatcgccgccaatgccaagctggcgcccggttatgccgccggcatttccggcatcgcccgctcgatgccgaccagtgcggcagccgaccgcgtcgctgaaaagctcgggcttggaatgtacgaaaccccgaccggctggaaattcttcggcaatctcatggatgccggcaaggtgacgatctgcggcgaggaaagctttggcaccggttcgaaccatgtgcgtgaaaaggatggcctgtgggccgtgctttactggctgaacattgtcgcggcgcgcaaggaaagcgtgaaggacatcgtcaccaagcactgggcggaatatggccgcaactattattcgcgccacgactatgaggaagtggattcggatgccgccaatacgctggtggccatcctgcgcgaaaaactcgcgacactgcccggcaccagctacggcaatctgaaggtcgcggcggcggatgattttgcctatcacgatccggtcgaccagtctgtcagcaagaaccagggcatccgcatcctgttcgaaggcggctcgcgcatcgtgctgcgcctttccggcaccggtactgcgggcgcgacgcttcgactctacgtcgagcgttacgagccggatgcggcccgccacggcatcgaaacgcagtcggcgctcgccgatctgatttccgttgccgataccatcgccggcatcaaggcccataccggccgcagcgaaccgactgtcattacc

SEQ ID NO: 38468 - DNA, 1860 bp, Agrobacterium tumefaciens
  unsure (1)..(1860): unsure at all n locations
ttccccaaaggcgcaacccgaacggaaaacggagtggagttcactgtctattcccgccacgcctcgcaaatcgatctctgcctgttcgatgacgctggcgagaaagagacggcgcgcctgccgatgatgcgcggcgaagacgacgttcatcggctcacacatgagaatgccgggcccggcacgcgatacggcttccgtgcccacggcatttacgcccccgaacatggcctgtggtttgatcctgcaaagctgctgctcgacccctatgccaccgagatcgaccgccccttccggcacgatccctcgctttatgcctttggcgctgaaaccggcgcgatcatgccgaaggcgatcctttccgcgcatgacccggtcaagcgccagccgcctcgttttgccgaaggcgggttgatttacgaacttgccgtcaaatccttcacccagctgcatccttatgtgcctgaagatatcaggggcaccgtcgcggcactggcgcatcccgccattctcgcgcatttgaaaaaaatcggcgtcgatgctgtggaattgatgccgattaccgcctggatcgacgaacgccacctgccgccgctcgggctttccaatgcctggggttataatccggtcggcttcatcgcgctcgatccgcgcctctgccccggcggtgtgcgggaacttcgcgacaccgttgcagctttgcatgcggaaggtattggcgtcattctcgatctggtcttcaaccatacgggtgaaagcgatatcgaaggctcgattctatcactgcgcggcctcgataatctcaccgctttccgtcacccgcagggaaagccgggcgtgctggtcaacgataccggcaccggcaatacggttgcctgcgaccacccctatatccgccagctcatcgtcgattcgctgcggcatttcgttctcaacgccggcgtggatggcttccgtttcgatctcgcgcccgtgctcggcagaacagccgcgggtttcgacatggcgagcgagacgctggccgccatgcattcggacccggtgctttacgaccgcctgctgatcgccgaaccctgggatatcggccccggcggttatcaactcggcaatttccctgagagtttcctggagtggaacgaccgcgcccgcgatgacatgcgccggttctggcgtggcgatgccggcacgaccggggcgcttgccaatgcgctgtccggctcctcgccgatcttttcccgccatggccgcttaaaaagtcgcagcgtcaatttccttgccgcccatgacggtttcaccctgttcgatctcgtcagccatgagcgcaagcacaatgaaaagaacggcgagaacaatcgcgacggccacaatgacaaccattcctggaacaatggttttgaaggcctgaccgatgatcccgccattgtcgccgcccgccttgcggatgtgaaagcgctgctttccacgcttttcgtcagccgcggcaccctgatgttgacggcgggcgacgagggtggccgcagccagcagggcaatancaatgcctattgccagnacaatgagatcagctgggtcgactggtcatcgcttgtccctgagttgatcgaccacacggcgtttctcgccgcactgcgcaagcgcttcggtgtgttttctgagagtggcttcttctccggcaggggcgacgtgacatggcttgccccgggcggcgaaccgatgacggttgctgactgggagaggccggatgggcaggccttcgccatggtgctttccaccccggaccgggaaaccggcaaagctaccgagcttgccgtgctcatcaatcgcggccgtgacatcgttcccttcaccttgccgggcgatggt

SEQ ID NO: 38469 - DNA, 903 bp, Agrobacterium tumefaciens; identical to SEQ ID NO: 35059

SEQ ID NO: 38470 - DNA, 729 bp, Agrobacterium tumefaciens
atggctcaaatgagtagcaaggttgccctggtcgtcgggggtgccaagggtatcggcttggcaattgcagagcggctttcagaggaaggggcgaaggtcttcatcaccagtcgtcgaagcgaagatgccgaaaaggcagcaacggctattggtcatggcgcgatcggtatcgccgccgatgccgcgatccccgaagatatggtggcgactgtcgaaaaagtgcgaaaggcacacggccgtatcgacgcgctcgtcttgaatgcgggtctttctgagcctgcgcagatcgccgagataactcctgaacatttcgaccgccacttcgacgtcaacgtccgcgggatggtcttcggcttccaggcggctctgcctgcaatgacggaaggcgggtcagtcgtccttgtcggatccattgctgatagtggcggctacgcttcctacggaacctacgctgctaccaaggcagccgtgcgttcctatgcccgaacctggacggcagagctcgcatccgtcggcatccgcgtcaacgtcgttgcacccggccctacagatacagaaatgatggctgcggttcagccagacatgcgcgcggccattgtcgctcctatcccgatggggcggatggcgcggccttccgaagtggctgcagccgccttgttcttattgagcgatgacgcgagttacatcgctggtgctgaattgtgcgtcgacggcggcttgcggcaggtc

SEQ ID NO: 38471 - DNA, 672 bp, Agrobacterium tumefaciens
atttccgcagtcctgattaccggcgcctccacgggcattggcgccacctatgccgagcggttcgcccgacgcggacatgatctcgtgttggtcgcccgagacatggcgcgcatggaggcgctcgcgagtcgtctgagccaggaaaccggtgtaaggatcgatattctaccggccgatctcacccaggcgacggatcttgtaaaggtcgaaaccaggctgcgtgacgatgagcgcattggcattctcgtcaacaatgcaggaacggccatcggcggaacctttgtcgaccagagcgtcgatgacatgaccaggctcgttgcgctcaacgcgaccgcgctcgtccggcttgccggtgccattgctccgcgtcttgccaaggccggcgagggagcaatcgtcaatatcggttcggtcgttggcctcgcgcccgagttcggcatgacggtttacggcgcgaccaaggcttttgttctgttcctgtcgcaggggcttgcgcacgaactcggaccgaagggcgtctacgtccaggctgtgcttcccgcgacgacccggaccgagatatgggatcacgtcggtgccgacgtcaacaccctgaacaacgtcatggaagtaggcgatctcgtggatgcggccctggtcgggttcgaccgccgcgagccggtcaccatcccg

SEQ ID NO: 38472 - DNA, 1005 bp, Agrobacterium tumefaciens
gtgaaagccttcgtcgtcgacaagtacaagaagaagggcccgctgcgtctggccgacatgcccaatccggtcatcggcgccaatgatgtgctggttcgcatccatgccactgccatcaatcttctcgactccaaggtgcgcgacggggaattcaagctgttcctgccctatcgtcctcccttcattctcggtcatgatctggccggaacggtcatccgcgtcggcgcgaatgtacggcagttcaagacaggcgacgaggttttcgctcgcccgcgtgatcaccgggtcggaaccttcgcagaaatgattgcggtcgatgccgcagaccttgcgctgaagccaacgagcctgtccatggagcaggcagcgtcgatcccgctcgtcggactgactgcctggcaggcgcttatcgaggttggcaaggtcaagtccggccagaaggttttcatccaggccggttccggcggtgtcggcaccttcgccatccagcttgccaagcatctcggcgctaccgtggccacgaccaccagcgccgcgaatgccgaactggtcaaaagcctcggcgcagatgtggtgatcgactacaagacgcaggacttcgaacaggtgctgtccggctacgatctcgtcctgaacagccaggatgccaagacgctggaaaagtcgttgaacgtgctgagaccgggcggaaagctcatttcgatctccggtccgccggatgttgcctttgccagatcgttgaaactgaatccgctcctgcgttttgtcgtcagaatgctgagccgtggtgtcctgaaaaaggcaagcagacgcggtgtcgattactctttcctgttcatgcgcgccgaaggtcagcaattgcatgagatcgccgaactgatcgatgccggcaccatccgtccggtcgtcgacaaggtgtttcaatttgcgcagacgcccgacgccctggcctatgtcgagaccggacgggcaaggggcaaggttgtggttacatacgcatcctag

SEQ ID NO: 38473 - DNA, 1134 bp, Agrobacterium tumefaciens
gtgaatacgcgcctgacccatggcggcaacgatcccgcggactgtttcggtttcgtcaatcctcccatcgtgcgtggctcgaccgtgctttttcccgatgcggagacgctttcgaccgaagaccagaaatacacctatggcacccatggtacgccgacgacggacgcgctctgcaatctggtcaacgagctggaaggttctttcggaaccattctcgtcccgtcgggccttgcggcgattaccgtgccgttccttgcctatctcggtgctggcgatcatgcgctgatcgttgattccgtctatttccccacccgccgtttctgcaacaccatgctgaagaagctgggcgtggaggtggagtattacgatcccgcgatcggggctggcatcgaggcgcttatccgaccaaatacgaagctcgtgcatctggaagcgccgggttccaacaccttcgagattcaggatgtccggctgatcactgacatcgctcaccggcatgattgcgtggtgaccatggacaatacctgggcgacgccgctttatttcaagccgctcgatttcggcgtcgatgtctccattcacgccgccaccaaatatccctcgggccattccgacgtgctgatgggcttcgtttcggccaatgaaaagtactggaaagcgctttatcaggccaacaccaatctcggcatctgcgtcacccccgacgatgcctatcagatcctgcgcggcatgcgcaccatggggatcaggctggaacaccatcagaagagcgcgctggatatcgcgcaatggctcgagggtcgcgacgacgttgtgcgcgtgctgcatccggccttgccgagctttgccgggcatgaactctggaagcgtgatttcaagggcgcgagcggtgtcttctccttcgtattgaaggcggaagagggcaaatacaaacagacggcatctgccttccttgatgcgctgacgttcttcgggctcggctattcctggggcggctacgaatcgcttgccgtatcggtatcgctcgtcgacagaacgattgcgaagggcccgtcggaaggaccggtcatccgtctgcagatcgggctcgaggatgtcgccgatctcaagaaagacctcgaggccggtttttca

SEQ ID NO: 38474 - DNA, 1005 bp, Agrobacterium tumefaciens; identical to SEQ ID NO: 35371

SEQ ID NO: 38475 - DNA, 2121 bp, Agrobacterium tumefaciens
cgcgatctggggcaggggttgcgccagaccgatcttagcgtgcccggtgtttattgcggcgcctgcatcaccaccatcgagaccgcgctcggccgtctcggccaagtggagcgggcgcgggtgaacctgtcttcgaaacgtgtggcggttgtctggaaagaagaggtcaatggcgtcaggaccgatcccgccgacattgcccgcgccatccttgcgacgggatatcgcatacatcttttcgccagcgggcaggatgcttcatacgccttgcgctcgcagctgatcagggcggtggcgctgtgcggctttgcttccgccaatatcatgcttctgtcggtctccgtctggtcgggggcggatgccgcgacgcgtgacatgttccactggatatcggcgatgatcgccgcgccggcgctgatctatggcgggcgtttcttttaccagtcggcctggaacgcgctgaaacacggccgcaccaacatggatgtgccgattgcgctcgccatcacgctctcctatgccgtttcgctgtgggagaccattcatcacggcgaacatgcgtggttcgatgcgaccgtgtcgctgctgttcttcctgctgatcggccgcacgctggaccatatcatgcgcgacaaggcgcgctccgccattgccggattggcccggctttcgccgcgaggggcaacggtgatcgatgcagacggggtccgggactaccggccgcttgcggatatcgaacctggaatgtcgattgcgattgcggcgggtgaccgggtggcggtggatgccgtggtggtctgcggcagcagcgatctcgacatgtccatcgtcaatggtgaaagcgcgccgcgccgcgtcgtggccggcgacagcctgcaggccggcacgctcaatctcaccgggtcgcttgtcgcccgggtaaccgcgtccgcaaaggattctttcctgtcggaagtgatcgggttgatggaggcggccgaaggcgggcgcgcgcgttaccggcgtatcgccgaccgtgccgcgagctattattcgcccgtggtgcatcttctggcgctggtgacgtttctcggctggggcattttcggcggtgactggaaacaggcgatgctgatcgccattgctgttctcatcataacctgcccctgcgcgctcggccttgctgttccagtcgtgcaggtggtggccgcaggaaggctttttcggcgtggcatcatggtcaaggaaggctcggccatggagcgtctttcggagatcgataccgtgctgttcgacaagaccgggaccttgaccgtcggcaagcctaggctggtcgagaccgcagatgtgaagccggccatcatggcgattgcggcggggctcgctgcccattcgcgccatcctctctcgaaagccctgcatgccgcctataatggtgccttgccagcctatgaggcggtgcgggaaattccggggtcgggtgtcgaggccgagacggaagccggcacttaccggctcggcaatcgccgtttcgcctgcccggatgagacacggatcaacaatggcgatgcgcggtcggaagtggtgctgtctctcgacggccggcatctggcgagcttcggcttcgaggacaatccgcgcgcgggtgctattgcggcattgcgcagcctgtctgtgcggggccttgcgcaggaaatcgtctcgggtgaccgggccgccgccgtcagtgcgatggcgcagcggctggggatcggcaactggcgcgcggacctgtcgccgaaggacaaggcggcgcgctgtgccgcgcttgccggcgaggggcacagggtgctgatggtcggggatggtatcaacgacgcgccagcgcttgccgccgcccacgtatctatggcgcccgccaccgccgccgatattggccggcaggccgccgatttcgtgtttatgcaggaagatctcgatgccgtacctttcgcgatcgagacgtcgcagcgagccggcaacctcatccggcagaactttgcgcttgccatcggctacaatatcatcgccgtaccgattgcgattgccggttatgcgacgccgatgattgcggccattgccatgtcgacatcttcgctgatcgtcgttgccaatgcgctgcgc

SEQ ID NO: 38476 - DNA, 963 bp, Agrobacterium tumefaciens; identical to SEQ ID NO: 35082

SEQ ID NO: 38477 - DNA, 750 bp, Agrobacterium tumefaciens
gaaagaaacatgagcaatcgattgcaaggtaaaatcgctgtcatcaccggcgcttccaaaggacttggcgcggcaattgcgcgaagtttcgccgcagagggtgcatcagtcgtagtaaactactcgtcaagcaaatctgcggccgaagcagttgttgaggagatcatcgacgctggtggcacagccatcgccgtgaaggccgacatgagtgagcccgcggaagttgaagagctgtttgcggcaacaaacgcagctttcggccgcgttgacatcctggtcaacaacgccggtgtctatgacttccagccgctggaaaacctgtctatcgatctgttccgcaagcatatggagcttaatgtctttggctacctgctcgcgatcaaagaagctgtgaaatacatggcggagggcggcagcattgtgaacatgtcctcgacggtaacgattttcggcccagaaaacgcatcggtctatacggcaagcaaaggtgcaatcgacggtttgacgcgcgcgttgtcaaacgagctcgccccccgcaagattcgtgtcaacgcaatcaagcccggcgtggtcgacactgacggcgtgcaggccggaggctttctccactttgacttcggccccatgatcatggcgcagacgccgctcaagcgtctcggcgttcctgaggacattatacctgcagcgattttcctcgcatcggacgaatcgagctggacgactggcgaatttttcatcctcgccggtggc

SEQ ID NO: 38478 - DNA, 1485 bp, Agrobacterium tumefaciens
gaaatcggtcatttcattaatggcaagcatgtgccgggcgccagcggccgcacatcgaatgtctataacccggcaaccggcgaagtgcaggcaactgtcgcgcttgcaagcgacgccgagctgcgcgccgccgtggaaagcgccaaggcggcacagccgaagtgggccgccaccaacccgcagcgccgcgcccgcgttttcttcaagttcgtcgaacttctgaaccgcgacctcaacgagcttgcggttcttctctccagcgagcacggcaagaccgtcgaggattccaagggtgatatcatccgcggcctcgaagtctgcgaattcgtctgcggcattccgcatctgcagaagggtgagttcaccgaaggcgccggccctgccatcgacatgtattcgatccgccagccggtcggcatcggcgcgggtatcaccccgttcaacttccccggcatgatcccgatgtggatgttcgcgccggcgatcgcctgtggcaatgccttcatcctcaagccttccgagcgcgatccgtcgctgccaatccggcttgccgaactgatgatcgaagccggccttccggctggcatgctcaacgtcgtcaacggcgacaagggtgctgtcgacgctatccttaccgacccggatatcggcgcggtctccttcgtcggctcgacgccgatcgcccgctatgtttacggcaccgccgccatgaacggcaagcgcgcgcaatgcttcggcggcgcgaagaaccacatgatcatcatgccggatgccgatctcgatcaggccgtgaacgcattgatgggcgctggttacggttcggccggcgagcgctgcatggccgtttccgttgcggttccggtcggtgaagatacggccaatcgtcttgtcgaaaagctcattccgcagatcgaaagcctcagaatcggcccctacacagacgacaaggccgatatgggcccgctcgtcaccaaggaagcccagacgcgcgtcaggggcctgatcgacagcggtgtcgagcagggtgcgaagctgctggtcgacggccgtgatttcaaacttcagggttatgaggatggctatttcgtcggcggctgcctgtttgaccacgtcacccccgacatggacatctacaagacggaaattttcggaccggttctgtccgtcgttcgtgccaagaactacgaagatgcgctggaactgccgatgaagcacgaatatggcaatggcgtcgcgatctacacccgtgacggcgacgctgcccgtgacttcgcaagccgtatcaatatcggcatgatcggcatcaacgttccgatcccggttccgctcgcctatcactccttcggcggctggaaggcttcaagcttcggcgatctcaaccagcacggcacggattccatcaagttctggacgaaaaccaaaacgatcacctcgcgctggccgtccggcatcaagtccggtgccgaattcgtcatgccgacgatg

SEQ ID NO: 38479 - DNA, 801 bp, Agrobacterium tumefaciens; identical to SEQ ID NO: 35423

SEQ ID NO: 38480 - DNA, 1350 bp, Agrobacterium tumefaciens; identical to SEQ ID NO: 35424

SEQ ID NO: 38481 - DNA, 2514 bp, Agrobacterium tumefaciens; identical to SEQ ID NO: 35425

SEQ ID NO: 38482 - DNA, 909 bp, Agrobacterium tumefaciens; identical to SEQ ID NO: 35058

SEQ ID NO: 38483 - DNA, 1647 bp, Agrobacterium tumefaciens; identical to SEQ ID NO: 35430

SEQ ID NO: 38484 - DNA, 864 bp, Agrobacterium tumefaciens; identical to SEQ ID NO: 35426

SEQ ID NO: 38485 - DNA, 819 bp, Agrobacterium tumefaciens; identical to SEQ ID NO: 35402

SEQ ID NO: 38486 - DNA, 915 bp, Agrobacterium tumefaciens; identical to SEQ ID NO: 35401

SEQ ID NO: 38487 - DNA, 801 bp, Agrobacterium tumefaciens; identical to SEQ ID NO: 35400

SEQ ID NO: 38488 - DNA, 1254 bp, Agrobacterium tumefaciens
ttttcgacgttggccgttcacgccggtgcgcagcctgatccgaccaccggcgcgcgcgcgacgccgatttatcagacgacggcctatgctttccgcgatgccgatcacgccgccgctttgttcggattgaaagagttcggcaatatctacacccgcatcatgaaccccacccaggcagttctggaggagcgcgtggcggcgctcgaaggcggcacggcggcgctcgctgtcgcttccggtcacgcagcacaattgctggttttccatacgctcatgcaatccggtgataatttcgtcgcggcccgccagctttatggcggctcgatcaaccagttcggccacgccttcaagggtttcgactggcaggtgcgctgggcggacgcggcagacccggcgagcttcgaggcgcagatcaatgagcgcacgcgcgccatcttcatcgaaagcctcgccaatcccggcggcaccttcgtcgatattgccgcgattgccgatgtcgcccatcgtcacggcctgccgcttatcgtcgacaataccatggcgagcccctatctgctgcggccgctggaacacggcgctgacatcgtgctgcattcgctgacgaaattccttggcggacacggcaattccatgggtggcatcattgtcgatggcggcaccttcgactggtcggcgacagacagatttccggcgctgtcgcagccgcggccggaatattccggcgtcctgttgcaccagaccttcggcaatttcgcctttgccatcgcctgccgcgttctgggattgcgtgatctcggcccggcaatctcgcccttcaacgccttccttatcctgaccggcatcgagacgctgccgctgcgcgttcagcgccattccgacaatgcactcgccgtcgcgaaatggctgaaggcacatccaaaggtcggctgggtgcattatgcgggcctggaggacagcgacaaccacgccatccagcagcattattcgccgaagggggcgggctccgtctttaccttcggcgtcaagggcggttatgccgccggcaaggcgctggtggaggggctgcagcttttctcccatctggccaatatcggcgatacgcgctcgctcgtcatccatccggcctccaccacccacgcccagctgacaccggaacagcagacggcagccggcgccgggccagacgtggtgcgcctgtcgatcggcatcgaagacgtcaaggacatcatcgccgatctcgaacagtcatttgcc

SEQ ID NO: 38489 - DNA, 750 bp, Agrobacterium tumefaciens; identical to SEQ ID NO: 37846

SEQ ID NO: 38490 - DNA, 738 bp, Agrobacterium tumefaciens; identical to SEQ ID NO: 35304

SEQ ID NO: 38491 - DNA, 1519 bp, Agrobacterium tumefaciens; identical to SEQ ID NO: 35303

SEQ ID NO: 38492 - DNA, 9683 bp, Agrobacterium tumefaciens
cctgacgacacgcggctcctgcatgaagcgtttttcgagagagctgcggaaagccctgagaagatcgccgtctgcgcagggggtatcgaattgacctacggacaggtggccgaacgcgcgctggcgctggcggcaagcctgcagaaggccggtgccggcccgaacgaccgggttgccgtttctctgccgaagggcgcagaccaggtgatcgcctgcctcggcattctggcaagcggtgcagcctatgtgcctgttgaccccgaactgcctgcggaacggcgtttcgagcttgtggaagacacggcggccgatctcgtcatcgccgaaggcggcgactggccgcagcgggtaagggtgattgcggttcccgaagaaggcggagcaagaccttcgccctcgtcgaccacaccatcggacctcgcctacatcatcttcacctcgggctcgaccggcaaaccgaaaggcgtgatgatcgaccatcgcggtgcgctgaatacgatcctcgacatcaatcgccgctttgccgtctccgccgaggaccgggttttcgcgctctcgtctctgagtttcgatctttcggtctacgatatattcggtccgcttgcggttggcggcgccatcgtcattcccgtgcgcgaggaagtgtcggacaatgcccgctggatgaagcttttgctgcaacatcgggtgacggtctggaactcggtgccggcccttgcgcaattgctgctggccgaactgccggcgctccgggaaaagccacccctgcgcatgatcatgatgagcggagactggattcccgtcagcctgcctcccgccttgaaagcacaattgccagatgctgacctgatcagccttggcggagccaccgaagcctccatctggtcgattttccacccgatcggagaagcgctgcgggactggacgagcatcccctatggccaacctctagcgaaccagcgttggtatgtcctcgacgatcaggggcgtccctgcccgccatgggtcacgggccggctgtttatcggcggcatcggtgttgcgcgcggttactggggacggccgcaactgaccgccgaacgcttcatccccgacagtttcgcggacgaagaagaagctggaaacggcgcgcttctgctttacgaaaccggcgatctcggacgactgcggccggagggattgctggagtttctggggcgcgaagatttccaggtgaaggtcaacggcttcaggatcgagctcggagaaatcgagaccgcgctgctgcaaaatgaaaatgtcgccgaagcggtggtgacgacaatgggtcagccacctgccctcatcgcctatatcgttccggataccaaaggcagcctcatcggcaaactggaagcgaaggccggccggtcaggcaatggcgggttgggcgatgccggaaggaccgtggatttacccacgccggacggcctgttccacgaagcgatcacccggcaaagtcatcgccggtttttgaacgctccgacggagcttcagaaaatcggccatctcctggccagcgtgcgggccttcgacatatcaggaacgccgctgaaaaagaccctctatccgtctgcggggggactttacccggttcagacttatattctggtccaagacggccgggtcgaaggattgtctggcggctggtatcgtcatcatcccgccgaacatcggctggagtttctggcggccacttcgcaggaacagatcgcggcaatcgccggcaagagcgacgatattatcgggcaatgcgctttccttgtgcttttcaccgggcacgcggcagccatggcgcgcagctacgggcaaaagtccagagacttctgcctgctggaagccggtcatatggcgcagaccatgatgctgcatgcgccgcgtctcgatatcggcctctgcgcagcgggcggcgtcgatctgaccgccatcgcatcggcactggcaaccgaagaagacgaggagccgctttatgtgctggctggcgggtccatcgatcccgcctggagcacacagtggcaggcatccgcgcaaatgcggggtgaaaccctctcggagcggctgcgcgcctttcttgccggaaaactccccgcttatatggttccgggcgaggtgcggagcatggagcgactgcctctcagcgccaatggcaaggttgaccgccaggccctgcccgcgccgggcggaagggcacgccaaaccgttgccccggcaaccgaaaacgagagcgcacttctggcgatctggcacgaactcctgtccagcgacagcgctggcgtggaggacaatttcttcgaagccggcggcgattcactgacgatcatgcagctgctgtcgcgcatcaggcaggaattttcggttcacctgacgcttgcccagctctttggcgccaccaccgtcaaagcccagtcggaattgctcggctcactttcaccgtccctgccggacgaagcggaaaccggtatctccccgatcgttgcgccgacatccgtgaatgacctttccgatgatgacgtggataagatgctggagcagctgctctccggccaaaaggaccagtagacgtgaacacaatggatatttcccgactgaccccggaggaaaagcggcagcttctgcagcgcctgatggctggacagcaggcatccgaaaagaagaacttccgcctgagccatgcccaggaacgtatctggttcgtcgagcagatgcagcccggcacaggcgcatattcgatacccgtggccatcaggctggaaggcccgctcgaccgcgacaggcttaggatctgcttcgatatcgtggtgcagcgccatgaaagcctgcggacagttttcgaggttcaggacggcgagccgtttcaggtcatcgtttcgcaaacaacggcagacttcagttttcatgaaccgggcgatgacgaagccgcacgcgatgtcgccatcggccgcttcgcgcaggaaccgttcaatctctcgcagggtccgctgtttcgcgtcggcctgttctccgtcgcacctgacgagcatactctcgtcatggtgatccatcatatcatttccgactacgcctcgttgcagatcctgatcgatgaggtctacaggctttatagcgcagcagaagctccagccatcggccagctgccggcactcgatatccagtatcgcgattatgccgaatggcaacgcaacggcaccgcggcgctttcaggccagatcgactactggcgcgaacagcttcgtgacgcaccgctgctgcttcaactcccgttcgatttcgcccggccggtgacgcagtcgttccaaggcgcccggcacaaattccgccttgggccggccctctccagcgccgtcaaggatctggcgaaaagccggaaactgacgacattcatggtgctgctggcggcctatcaaattctgctcgcccgcctttcgagatcggacgatatctgcatcggcacgacggcatcgaaccggaaccgggcgcagacccgcaatctcatcgggttgttcgtcaacaatctcgtcttgcggacgcgtctacagccaaatgacaccttcgatacgctcctcgacagggttcgggatacgacccttgaggcgctgtccaaccaggatgttccctttgagcaggtggtggatgcactgaatgtcgagcgtgacatcggccataacgccctgttccaatcgactttcgtgcttcacaatgcgtccggtgcagctttcgatctcggcgacatcaaggtcacgccgatcgcgctcgattccggcgcctcgcgtttcgatctcagcctcgacatgcacgagggacggggaaacgaaggtttcagtggggttttcgagttcaacacggaactcttcctgcctgaaacggtgtcgcgcttctctgcctatttcctgagactgctcggcgggctcgtatcgaaccccggcggccgcatcgccgaaatcgacctgctggacaagacggagcatgcggctatagcgactgcgaaccggacaaccattgcctttccattgagagatttcgcatcgctgctggaagagacggcacaggtgcgcggctcgtccgtggccgtgcgctgcggcgaccggcaatattcccacggcgatctcaacgaagccgccaaccgggtggcatccggtttgcgtgatcgcatcggcaacagcaaacctcatccccgcatcgccatctgcctgccgcgttccgaaaacctcgtcatcgccatcctcgcggtgctcaaactgggcggccattacgtgcctctcgaccccggacacccggcggagcggcgcgcactcattctcgaggactgcaagccagacatcattctcatcagcgagggtgaggatacggcatatccatgcggctgcatggcgattgaacccctgctgcgtgcaaccggctccttcggtaacccgcatcgcgagacgctacccgacgacctggcctatatcatctatacctcaggctcgacgggcaggccgaaaggcgtcccgatcagacagaaaagcctggtcaaccttctcaccagcatggcgcggcggccgggcatgtcggctgaagatcgtttccttgccgtcaccacaccggcttttgatatcgccacgctggagctgctgatgccgcttatggtcggcggcctgctgattattgccgaagccgatgacatctatgacgatatggcgctttcagagcttatccggaaccacagcgcgacgatgatgcaggcgacacctgcgacatggcggctgatggccgatgcggactggaaggctccggcgggtttcaggatgctttgcggcggcgaagcgctcgagcccggccttgcccgccgcctgctggcagccggaggcgaattgtggaacctctacggcccgaccgaaacaaccatctggtccacatgcacccgcatatgcgcggaacatctggagcttcccgccctgccggtcggcgagccgatcgccaatacgcagcttcatctgctcgacgacgcgctgatgccggtgccggcaggcgttgtcggagagctgtatatcggcggcgaaggtctgagccccggctatttcaaccgggacgacctgacgtcgcgtgcattcgtcgaagggccggccgcgggctcgaacggcggaggcgagagatcgagactctaccgaaccggtgacctgatgcggcgttccgccgccgggcaccttctttatgttggtcgcgccgattttcaggtcaagcttcgaggattccgcatcgaacttagcgagatcgaggcgatccttgccgcacagccatccatcgagcaggccgtggttgcgctttttcaggacgaggaagggtctggcaccctcgtcgcctattgccgccgcggaacaagcccagtggacgaggacgcactccgcgcagcgctcgcctcacagcttccctcctacatgcttcccgccgcctatgtctggatggaccgctttccgttaaacgccaatggcaagatcgatcgcaagcggcttgagcgaccaaaacagatcgtatcgtcaaccgcctacaccgctccgctcgaagggaccgaacaaattgtcgccgccatatggcgtgagttgctcggcgcggaaaagatcggccgtgacgacaatttcttcacggtgggcggccattcgctgctggcgacgcggatgcttgcgcgtttgcgggcgtcattcgccatcgacctgccgctgcgcaccttttttgagagaccccggcttgcggattttgccggtgctgtcgatgctctggtggccatgaccgaacgcaggccggaagcggtttcgtccgcgctgtccaagcgcgagcatactggcccaacaccgctgtcccatgcacaaaacagacaatgggcgcttgcgcagctggaaccggacagcccgctctacaacatcccgtttgccctgaagatcaggggagcgctcgatttcgaaatcctctcgcatgcgctggaactgacggcacaaagacaggatacgctgcgcagccgcttcgtctccgtcgatggcaagcccttcgtcgagaccgacccggagatgatattcaagatcgtgccggaagagatcggcgaccgggaactcgaggctgccctgctcgattgcgcgcgccggccattcgatcttgccgttgcacccctcctgcgcattcacgccttccgcaccggtccgcaggatcatgtcctgcttttcctattgcaccacattatcggtgacgccctttcagccgaaattctgctgaacgacgttgcgacgttttacgcgtccctctcgaagaaagaagcaccgccaaacggggcgctaccgctgcaatattcggattttgcaatctggcaacgggaacaggacacgacgaatgaggttgattactggcgcaggacgcttgccggcgctccgccactgctggaattgcctaccgattttgtgcggcccgccatacagggcttctccggcgagagcatccgcttctcgctcaatgcggatttgctcgcaagattgcgccaactctgcgaccagcaaggcgctaccctttttatgggaatgctgacagcgttctcgacgctgctccagcgcgtgagcggcatgcgcgatatcgtcatcggcacaccggtctccgagcggttccatcccgatctggaaaacgttatcggcatgttcgccaatacgctggcgatccggttgcagacgcagggcggcgaaaacttcaacgaagcactgaaggcagcccgcgacacggcattaagcgctttcgccaaccagaccgcaccgtttgagaaagtggtggatgcgctgtcgcttccgcggacatggagccacaacccgctgttccaagccatgctcgtctcgaccgtcgaaacccggcgcggcgccatctcgctcgccggcatggagtgggaccgactggcgcttcccgacacgtcgtcgcgcgtggacctgacattgttcatccatgaaacggcagaggaactgtcgtgccgcctcgaatatcgcagcgatcttttccgccgggcaactatggaatcgcttggcgaagccctcgtcgccctgctcgaaaaaatcgttgagcgacctgaactgccactcgacaggcagtcactggtatcgggcaaccatcagaaaaggctgcggcaatggaacgagacggatgcggaatttcagccgcagcggcgctgcctgcacgactttgtgacagcaagtgccgagaccagcccacaggcgatagccgttaccgatcaggaccggagcctgtcctatgccgaacttgactggagagccgaccggcttgcaagcgggctcgtcgcagccggcataggcaggggaaagcgagtcggcatccgcctcgaaaggagcgtggagctggtggttgccatattggcagtgcttcgcaccggcgcggcctatgtgccgctcgacccgcgttaccccgcagaccgcatagaattcatcgccgcggacgccgatctcgcgctcattctggtcacgaccgagaatgatatttcaacgatcggacagaatttccgctgcatgacgcccggtatggtggaaaatctggcaggtggagccgttcccacgccggtgacgtcaggagccgatcttgcctacctcatctacacatcaggttcgacgggcaggccgaagggcgtggccatcgaacatcgcaacgccgttgctttcatgcaatggtgcatgcacgcctttacgaaggatcagctgtccggcgtgctcgcttccacctcgatctgctttgatctttcgatcttcgaaatatttgcgacgcttgcagcgggcgggcgcatcttcatggtcgatgatctcttcgctttcccaagcgcgccatttgcaggtgaagtaacgctggtgaacaccgttccgacgccgatgtcggaactgctcaaactcggccctctgccgcagaacgtgaaaacagtgtgtctggcgggagagccgctgccgcgtgaacttgtcgcgcggatttacgccaacgaccaggtggaatgcctctataacctctacggtccctcggaggacaccacctattcgacggtggccccggtgcctccatcgggcgaatggttcggcatcggcgtgccgattgccaatacccgcgcctatgtgctcgacggcgagatgaacgaggtgccggttggggtgcccggcgaactgttcctgtccggcagcggattggcgcgcggctactggaaccggcccggccagaccgccgagcgttttctgcccaatccctttgccgactgcagccagcaccgcgtcatgtaccagaccggtgatatcgtgcgcaggcgcgatgatggcggtctcgattacatgggacgcgccgaccggcagctgaagctgaacggttttcgcatcgagccgggtgaaattgaggccgtattgctgcagcaggaaggggtacatgaggcggttgccgggctctggcgcgacgccgccaatcatccgcggctggcgatgtggattgccggcgatcccgcactggagatcaccaaacttgtcgcaaccctcaggcaacgcttgcccgagcacttcattcccgtccttgcaaccaggctcgatgcgcttccgcgcctgccgaacggcaagctggaccgatccgcattgccggatcccgcagcctatggcgaacgcgccacggaaaccgcaagtctgctcaatgaccaggaggacgtgctggcgcagatatggcaaggcttgctcggctgtggagacatccggcgaaacgacaatttcttctcgcttggcggcgattccatccttgccatccagctggtttcacaggcccgccagaaggggttgaagatgaccccgcgcgacgtcttcctgcatcccacgctcgcatcgctcgcggaagtgacacacgtggaaagcactgtgacagtcgggaccggtcatgccgatgatgaagctacgctcggggcgatacagcactggctgctggatcaggacctgcccgatcttgcccactggaaccagggattgatcctgaagcttacccgatctctcgatcccgaccggctcgaaaaggcgatttcaaggctactcgaggagcatcagtcgctgcgcgcccgattcttgcgcaaaaatgggcaatggcaacagaaattcgcccctctttcggcaatgccgccgatgcagcaactggccgccacagatgagaacgacgtcacagattttgccagaaagcttcatgccggtttcgatcttggtgccgggcctctcttcggcgcgatcctggcgacattgcctgatggctccggccgccttatcctcgcagcccatcacctcatcgtcgatggcgtgtcctggcgaatgatcgttgcggatatcgagcggcattatctggaggccagcaccattcggtccggcgcagtcgcggctggcagctggaacagccggctttcacggtcggcgctttttgacggcgaggaggaatattggcgcggcgtctgcgaggaagacgtccgggcgctgccgctcgacaacgagagtggaagcaatactcaatcggatgcggtgacgtaccgacagacgatcgatgccgagacgacgaggcaactgcttcgggatgtaccggaatgcttcagcatcgcctcgaacgaggttctggtcgcagccctttatctgacgctgcggcagtggagcggccagcca

SEQ ID NO: 38493 - DNA, 1413 bp, Agrobacterium tumefaciens; identical to SEQ ID NO: 35181

SEQ ID NO: 38494 - DNA, 1137 bp, Agrobacterium tumefaciens; identical to SEQ ID NO: 35182

SEQ ID NO: 38495 - DNA, 723 bp, Agrobacterium tumefaciens
gccctcatcacgggcgcatcgagtggccttgggatcgaatttgccgagctgctggcagcgcagaagatgaacctcgtgctcgcagcccgtcgaaaggagccgatggaaaaacttgccgaggaccttcgccgaagacatggcgtcgacattcttgtcgagcctatcgaccttgccgcacccggagccgccgctcgcctgaaagacagcctgaacgagagggcgatacagatcgacatactggtgaacaatgccggatacgggctacagggtgagtttctgaaaaccccgatcgagcgcaccaccgacatgattcagctcaacatcacggcgctgactgaactcagctatgttttcggccgggacatggccgccaggggatcgggagagattcttctgatagccagtctactggctttccagcctgtccctacctatgccgcatatgcggccacgaaatcttacgtgctgtcatttggtgaggctttgcacgacgaacttcgcacgcaaggcgtggtcgtcaccagcctttgcccggggcacactgaaacaggatttgatgccgctgccggcgctcaggtctcgccaatgttgcgcctgctcaccatgaaaccccgtcccgttgcagaagccggacttgaagctctcgccaaaggcaaggcgtccgttattgccggtttcatgaataaggtggttgcgttttcaactcgtctgaccccgcgttcc

SEQ ID NO: 38496 - DNA, 1257 bp, Agrobacterium tumefaciens
cgtcgtatcgttgtaacaggaatgggagccgtcagccctcttggcgcgaatgtggatatctcatggtcgcggctccttgctggccaaagcgggatccggcgactgaccgacgatgtcgtcggagatcttcctgcgaaagtgggaggcgttgtcccttctctcgccgaagacccagaaagaggattcgatccggacaggatcattgcacccaaggatcagcgcaaggtcgaccgcttcatcatcttcgcgctggcggcggcggaagaagcgctcgtgcaggcaaactggaagccggtctcgaatgaagacaggttgcgaaccgcgacaatcatcgcatccggcatcggcggtttccctgccatcacggaagccgtgcgaaccgttgatcaacgcggtgtacgccgcctctctcccttcacgataccgtcgttcctcgtcaatctcgcagccgggcaagtctcgatccgccacggtttcaaaggtccgctgggagcacccgtaacggcgtgtgctgccggcgttcaggcgatcggcgacgctgcacggcttatccggtccaatgaagccgacattgcggtttgcggtggaacggaagcttgcatgaacatcgtcagcctcggcggcttcgcggcggcaaggtcgctttccaccggtttcaacgagacgccgaccaaggcgtcgcgtcccttcgataccgcgcgtgacggcttcgtcatgggtgaaggcgcgggcgtactcgtcatcgaggcactcagccacgctctcgcccgcggagccaccccgattgccgaactcgttggatacggcacgacagccgacgcccaccacatcacgtcaggccccgaggatggaagtggggcacgcagggccatggagattgccatcgcgcaagcgggcatcgcccctcatgagattggtcatctgaacgcgcatgcgacatcgacgccggttggggacctcggagaaatcagggccatcaagagtgtgtttgggcaacgaaagtcggttgctgtcagtgggaccaagtcggcgacggggcacctgcttggcgcggccggcgggctggaagccatcttcacgattctagcgctcaaaaatcggatcgcccctccgacactgaacctgaacgcgccggatacggaatcggacgggatcgattttgttgcaaacctggcacgatccctggacgctgaatatgccatatccaacggcttcggttttggcggcgtcaatgccagcgttcttttccgacgttgg

SEQ ID NO: 38497 - DNA, 786 bp, Agrobacterium tumefaciens; identical to SEQ ID NO: 37929

SEQ ID NO: 38498 - DNA, 894 bp, Agrobacterium tumefaciens; identical to SEQ ID NO: 35186

SEQ ID NO: 38499 - DNA, 1140 bp, Agrobacterium tumefaciens
agtgatgccgaggcgatcgaagtcgcgaagattgtggccgccgaaatcgcgccgggcgctgcccttcgtgaccgcgaccgtatctggccggtgaaggaacttgatgcgttttcgcaaagcggcctctggtcgatcaacgtaccgaaaaaattcggcggtccggaggtctcctatgcaacactggccaaggtgatcgagattgtctctgcggccgattcctccattggccagattgcgcagaaccatctcggcgtcgttgcggcgatccgcacggtttccgacgaggcccagcaaaagttgctgttcgcagaggtgctgcgcggtacgcgcttcggtaatgccttttccgagttcggctccaagcgggccgcggatttcgagacgaagttcgtggatgccggcgaccatgtgatcgtcaacggacagaaattttattcctccggcgcacttctcgcccatctcgtgccgatcgtcgcgctcgatgatgaagggcgtgcatggtacgctatcgccgagcgggacgcacccggattgaccgtcatcgacgactggtcgtcctttggccagcgcacgacgctatccggcacggtgatcctcaacaacgtcaaagtgccgaagacctatctggttcccggctacaagggttatgccgagccgacggcggatggcgcgatcttccagatcatccaggtcgcggtcgatacggggattgcgcgggcggctattgatgaaaccgtctcttttgtccgcaccaagagccgtgcctgggtggatagcggtgtcgatcatgcctgggatgatccctacacgatccaggccgtcggcgatctgacgctacgcctgcatgcggctcaggcgttgcttgagaaagccggttatgccatcgaccgcgccatccagaacccgaatgctgaaacggtcgccgaggcgcaggtcgttacggcggaggcgaaaatcctcgcgaccgagatcgcgattgcggccaccaacaagctcttcgagctagctggcacccgctccacgcttgctgagcatcatcttgatcgccattggcgcaatgcccgtacccacaccctgcacgatccggtccggtggaaatattcgatcctcggcaagtatttcctcaatggcgagaagcca

SEQ ID NO: 38500 - DNA, 1158 bp, Agrobacterium tumefaciens
ttctttgaacgcgcctccaccgtttttccaggcggtgtcacacgcgcgacaattgagctggatccccacccgatctttgttgcctacggggaaggcgcgtttgtgaccgacgtcgacgggcaccgtatgctggatctaaacaataacttcacaaccctgatccacggacatgcctatcccccaataactgaagcgattgccggactactaagaacaggcagttgctttgctaatccgatgaaccatgaaatcgatctggccgaattgctagtaggcaggattccggctgttgagcaggtccgcttcgtcgcgagtggaacggaagccgttatgtttgccatcaaagccgctagagcaacgaccggccgggtcgcaatcgctcgggtggagggtgcgtaccacggcgcatatgactgggcggaggcgggccagcacgcatcgtcgaatacgccctgcgccgcctatccaggaatgccagcaagcgtcatagatgacgtcgtgctcctccaatttaactgccccgcagagttggagcaacagatcgcgatgaatgccgggcgccttgcggctattcttatcgatccgatgcccagccgggcaggcctcatagagccaacagaggagttcatcgcaactatcaacaaggtggcgaagcaacatgggatcgtcattatcgcggatgaagtcctgaacctccgccagggcttcgctggagcttcagcgcgctacggtctgaagccggatctcgtcacaatggggaagatcatcggcggtggctttccaataggggcagtcggtggacgtcgggagatcatgtcggcctttggcaagcaaggaagtaaggcgccattgacgcaaggcggaacctttgctgcaaatcccgtgtcgatggtcgctggccgtcttgcgatggaagccctgacgcaagatgctttccaacgtctcgaacatatgggcaacctggttcgcgaggggttgaggtcacgcatcgaacgtcacggcgcaaatctgagcgtgacgggagcggcttcgctttttcgaatacacgccaagaaagtggcgccggtttcttatcaggacagcattccgacagcttcggaagacgtcgttttgaaactgctgcgcaggcactttgcaaacaatgggatcttgatgccc

SEQ ID NO: 38501 - DNA, 744 bp, Agrobacterium tumefaciens; identical to SEQ ID NO: 35201

SEQ ID NO: 38502 - DNA, 954 bp, Agrobacterium tumefaciens
gtcgccttgttcgatgccattcctggcgagcctgagatatccacgctcgatgcagcgctggcagcggcacgcgtggccaaacctgatgtcgttatcggtctcggtggcggttcggtgatggatgtggccaagctggtcgccgccctctgggatggcgaacagacacttgccgatgtcgcaggccccaacaaagtggcaggccgccgaacccggctggcgcagattgcgacgacagccggcaccggctcggaagcgggcatccgctcgctgatcaccgatccaatcaagggcaacaagatcgcggtcgaaagcccgcatctgatcgccgatctcgcggtgcttgaccctgaattgacctattccgtgcctcctacggtaacggccgcaacgggcgtggatgccatggcgcattgcgtcgaagccttcaccagcaaacgctcgcatccgatgatcgacggttttgcccgcatggggtttcacctcgtcggtaaatttctgggtcgcgcggtacgtgacggatcggatcgtgaagcacgcgaaggcctgatgctggcttcctattacggcgggatctgccttggacccgtcaatacggcggcaggtcatgccatcgcctatccgcttggaacgctgctgcacctgccacatggattggccaatgcaatcgtgttcccgcatgtactggctttcaatcagcccgttgtttcggccaaaacggcggaagttgccgaagcgctcggtcttggggctggtctgtcgcagacacagttgcaagatagcgctcgtggcttctgttccgatcttgggatcgagatgtcacttgcgaaacatggtgcggccgaggctgatttgtcgcgctacgctgccgatgcgcatgccatccgtcgcttgatggacaataatccggcggatatgagcgttgatgacgtcctcgacgtctacaaggccagcttc

SEQ ID NO: 38503 - DNA, 783 bp, Agrobacterium tumefaciens; identical to SEQ ID NO: 35136

SEQ ID NO: 38504 - DNA, 3453 bp, Agrobacterium tumefaciens
ttgaagatatcgaaaatacttgttgccaaccgatccgaaattgcgatccgcgttttccgggcagcgaacgagcttgggatcaaaaccgttgcgatttgggcggaagaggacaagctgtctttgcaccgcttcaaggcggatgaatcctatcaggtcggcaggggtccgcatctcgccaaggatatgggaccgatcgagagttatctttcgatcgaggaggttatccgcgtggccaagctctccggagcggatgcgatccatcccggttatggtcttctgtccgaaagccctgagttcgtggaggcctgcaacaaggccggcatcaccttcatcgggccgacaccggacacgatgcgccagctcggcaacaaggtcgccgcccgcaatctggcgatttcggttgatgtccccgttgttcccgccaccaatcctctgcctgacgatatcgcggaagtggagcgtatggccgaggaaatcggttatcccgtcatgctcaaggcctcctggggcggcggtggccgcggcatgcgcgccattcgcaaaaaggaagatctcgcccgtgaggtgacggaagccaagcgcgaggcgaaggccgccttcggcaaggacgaggtttatctggaaaagctcgtcgagcgcgcccgccatgtcgagagccagattctcggcgatacgcatggcaatgtcgtgcatctgttcgagcgggattgttcgatccagagacgcaatcaaaaggtcgtcgagcgcgcgccagcaccgtatctgtccgaagcgcagcgccaggaactggccgcctattccctgaagatcgcagccgcgaccaactacatcggcgccggcactgtcgaatatctgatggatgccgataccggcaaattctacttcatcgaggtcaatccgcgtatccaggtggagcataccgttaccgaagtcgtgaccggcatcgatatcgtcaaggcgcagatccatattctcgaaggagcggccatcggcacggcggaatccggcgtgcccaagcaggaagatatccgcctcaacggccatgcgctgcagtgccgcatcacgacggaagacccggaacacaatttcattccggactatggccgtattaccgcctatcgctcggcttccggtttcggcatccgtctggatgggggcacgtcctataccggcgccgtcatcacccgttattacgatccgctgctcgtcaaggtcacggcctgggcgccggagccggatgaagcgatcagccgcatggatcgcgcgttgcgcgaatttcgtatccgcggcgttgcgaccaacctgaccttcctcgaagccatcatcggtcacgacagtttccgcaacaacacctatacgacgcgcttcatcgattcgacgccggagttgttcgcgcaggtcaagcgtcaggaccgcgccaccaagcttctgacctatctggccgatgtgaccgtcaatggtcacccagaaaccaagggtcgtgcgaagcctgcggacaaggcggcaaagcccatcgtgccctatatcgatgcgccgacgcctgacggcaccaagcaattgctggacaagcttggccctaagggctttgcggactggatgcgcaacgaaaagcgcgtgctggtcacggatacgaccatgcgcgacggacaccagtcgctgctggccacccgcgtccgtacccatgatatcgcccgcgttgccagcgtttattccaaggcgcttccgcagcttctgtcgctggaatgctggggcggtgcgaccttcgacgtctcaatgcgcttcctgaccgaagacccgtgggagcgcctgtcactcattcgcgaaggtgcgccgaacctgctgttgcagatgcttctgcgtggtgccaacggcgtcggttacaagaactatcccgataatgtcgtgaagtatttcgtccgtcaggcggcaaggggcggcgtcgatctttttcgcgtcttcgactgcctgaactgggtggagaatatgcgggtgtcgatggatgcgattgccgaggagaacaagctctgcgaggcaaccatctgctacaccggcgatctcttgaattcggcacgtccgaaatatgatctcaaatattataccaacctcgcggtcgagctggaaaaggccggcgcccatatcatcgccgtcaaggatatggcgggcctgctgaaaccggccgccgccaaggttctgttcaaggcgttgcgcgaggcgaccggtctgccgatccacttccacacccatgatacgtcgggcatttccgccgcgaccgttcttgcggccgtggatgccggcgtcgacgccgtcgatgccgcgatggatgccttctccggcaatacgtcgcagccctgcctcggctcgatcgtggaggcgctctccggatcggaacgcgatacgggtctcgataccgaatggattcgccgcatttccttctattgggaagccgtgcgcaatcaatatgcggcgttcgagagtgacctcaaagggcctgcctcggaagtctatctgcatgaaatgccgggtggccagttcaccaacctcaaggaacaggcacgttcgctgggtctcgaaagccgctggcacgaggtggcgcaggcctatgccgatgccaacaggatgttcggcgatatcgtcaaggtgacgccgtcctccaaggtagtcggcgacatggcgctgatgatggtgagccaggacctgacggtggccgatgtcgaaaaccctgaccgtgaagtgtccttcccggactcggtggtatcgatgctgaagggcgatctcggtcaatcgccgggcggctggccggaagcgctgcagaagaaggcgctgaagggtgaaaagccttacacggttcgtccgggttcgcttctggaagatgccgatctcgatgccgaacggaaggtgatcgagaccaagctggagcgcaaggtcgatgacttcgagtttgcctcctatctgatgtatccgaaggtgttcaccgatttcgcgctgaccgccgagacatacggcccggtctccgtgctgcccacccatgcctatttctatggcatggaggatggcgaagagctgtttgcggatatcgagcgcggcaagacgcttgtcatcgtcaatcaggcttcgtccggcattgacgataagggcatggtgacggtgttcttcgagatcaacggccagccgcgccgcatcaaggtgccggatcgcgcccatggcgcttccggctctgcggtgcgccgcaaggcagaacccggcaatgcgtcccatatcggcgcgccgatgcctggtgtcatcagccgcgtcttcatcaaccagggtcaggaggtcaaggccggcgacgtgctgctctcgatcgaggccatgaagatggaaacggcgctgcatgccgaacgcgacggcaagatcgctgaagttctggtgaagcccggtgaccagatcgacgccaaggatttgttgatctcttac

SEQ ID NO: 38505 - DNA, 1758 bp, Agrobacterium tumefaciens; identical to SEQ ID NO: 35138

SEQ ID NO: 38506 - DNA, 1407 bp, Agrobacterium tumefaciens; identical to SEQ ID NO: 35139

SEQ ID NO: 38507 - DNA, 1064 bp, Agrobacterium tumefaciens
atggtagacaagagagccttgattatcggcgtaaccgggcaggatggcgcttatctcagcgaattgctgcttgccaagggatatatggttcacggcctgaagaggcggtcttcctcctttaataccggtcggatcgatcatctttaccaagatcccttcgaggaagacctgcgctttcgcctgcacttcggtgacctcacggacgccacgaacctgtgccgggtcattcaggaggtccagcccgacgagatctacaatctaggcgcccagagccatgtccaggtcagcttcgagacgccggaatatacggcaaatgcggatgcgcttggcacgctgaggctgctggaagccatgcgtatcctgaaccttggcgatcgctgccggttttaccaggcatccacatcggagctgttcggggggatgggcacggtcgcccagcacgagggtacgccgttctatccgataagccactatgctgcggtcaaactctacgcatactggatgacgggccattaccgggaaagttacggatttcacgcatccaacggcattctctttaaccatgagagccccattcgcggggagacattcgtcacccggaagacacgcgtggcgttgcggccatcgagcgcggtctcatgagcaagctgcgtcttggcaatctcgacgcaaagagggactgggggcatgcgcgcgattatgtcgaaggcatgtggcgcatcgtgcagcaggaaatacccgaggactatgtgcttgcgaccggcgaagcacatacggtgcgggaatttgttgagcttgctttcggcgtggttggcaagaccatcgaatggcacggcgatggcagtgacgaagtgggatatgatgccaaaaccggcaattcgatcatcgaaatcgatcccagatattttcgtccggcggaagtggattttcttctcggcgatcccagcaaggcgcgcagaaaactcgactggagtcactcgacgtccttttgcgacctcgttcaggaaatggtcgaagcggatcttcgcctcgtaatgttggaagagggaagaaatgagttcgtc

SEQ ID NO: 38508 - DNA, 756 bp, Agrobacterium tumefaciens; identical to SEQ ID NO: 35093

SEQ ID NO: 38509 - DNA, 1290 bp, Agrobacterium tumefaciens; identical to SEQ ID NO: 35092

SEQ ID NO: 38510 - DNA, 576 bp, Agrobacterium tumefaciens; identical to SEQ ID NO: 35091

SEQ ID NO: 38511 - DNA, 1524 bp, Agrobacterium tumefaciens
atgaacctctcgcatttcctgacgcaggcggcacgccgcaacccggaccatatcggtttcgtctggggtgaaaagacttggagctgggctcaaatggaagcccgcgtcgacgccatggcccatgcgctggagactgaattcggcgtcagaaagggggatcgcattctggtgcagtcctccaacaacaaccagatgttcgaatccatgttcgcatgcttccgcgtgggtgcggtgtgggtgccgaccaattaccgtcaatcgcccgatgaagttgcctatctggcgaaggcaagcggcgcacgcggcatgatttgcgccagtgcttttcccgatcatgcaaaagccagccatgaggcaagcacgatcgatttcagcattgccatcggcacggctgagttcggtgaggattacgatgccatcgtggcccgtcatatggggcgcaaagtcaaaagccaggcagtggatcgggatgacccgtgttggttcttcttcacctcaggcaccaccggccggcccaaggctgcagtgcttacccatggccagatggcgttcgtcatcaccaaccatctctgcgatctgatgcccggcaccggaccggacgacgcctccatcgtcgttgccccgctttcacacggtgcgggcattcaccagctggtgcaggtggcgcatggcgcgaaaaccgtgctgccggcggcggaaaagctcgatgtgcccgccgtctgggcgctgatcgaaaaatggcgtatcaccaacgccttcactgtaccgaccatccttaaaatgctcgtcgaagacccctctgtggatcgtttcgatcactcctcactgcgctatgtcatctatgctggcgcgccgatgtatcgcgcggaccagaaacgggcgcttgcaaagctcggcccggtgctggtgcaatattttgggctgggtgaagtcaccgggaacatcaccgtgctgccgccttcttttcacaacgccgaggacggtccggaaacccgggtcggcacctgcggcttcgaccgtaccggcatggaagtgcagatccagaacgatgcggccgaggaggttggcgccggtgaaaccggtgaaatctgtgtaatcggtcccgctgtttttgcgggctattacgataatcccgaggccaatgccaaagccttccgcaatggctggttccgcaccggagatctcggccatcgcgatgagaacggcttcctctacatcaccgggcgcgcctccgacatgtatatttccggcggctcgaacatctatccgcgtgaaatcgaggaaaaaatcctcatgcatccggatatcagcgagactgcggttctgggtgtgccggacgcggtgtggggcgaggtcggtgtggccgtgtgcgtggcccgcgagggcgcggatatcgccgccatcgatctgaaggcctatctggaaggcaagatggcccgctacaagctgccgaaatcagtggtgttctgggatgccatgccgaaatccgcctatggcaagatcaccaagaaaatgatccgcgag

SEQ ID NO: 38512 - DNA, 1164 bp, Agrobacterium tumefaciens; identical to SEQ ID NO: 37944

SEQ ID NO: 38513 - DNA, 789 bp, Agrobacterium tumefaciens
ttgacaggtcgcctgacgggaaaacgcgcgcttgtgtttggcgcaggatcatcggggccgggatttggcaacggcaaggctgcggccgtgcaatttgcccgcgaaggcgcgcgcgtagcctgtgtcgatctctgcgctgacgcagccgaagagacggctgagatcattcgcggagaaggcttggaggcgattgcggctgccgccgatgtcactgaactacagtccgtatcggccaccgttgaccgcacctgcgaggcctttggtggcatcgatattctgcacaataatgtcggcgtgacccatatgggcgggccggttgagctggatgaggaaagctttcgcgcctcggtcgatctcaatatcggctccgtttatcgcacctccaaggctgtgttgccggtgatgttggcgcagggcggcggggccattgtcaatatctcgtcgctcgcctccattcgctggaccggctatccatattttgcctattacgccatgaaggcagctgtaaatcaggcgactgtggcgctggccatgcaatatgcccggcagggcattcgcgccaattgcattcttccgggaatgatcgacaccccactgatctacaagcagatcagcaatcaatatgcgtctgtcgaggaaatggtggcggcgcgcaatgcggctgtcccggtgggtcgcatgggcgatgcctttgatattgcccgcgccgccgtttttctcgcatctgatgaggctaagttcatcaccggcgtctgtttgccggtcgatggcgggcaaagctgtgcggtg

SEQ ID NO: 38514 - DNA, 2064 bp, Agrobacterium tumefaciens; identical to SEQ ID NO: 35087

SEQ ID NO: 38515 - DNA, 1350 bp, Agrobacterium tumefaciens; identical to SEQ ID NO: 35086

SEQ ID NO: 38516 - DNA, 894 bp, Agrobacterium tumefaciens; identical to SEQ ID NO: 35084

SEQ ID NO: 38517 - DNA, 1707 bp, Agrobacterium tumefaciens; identical to SEQ ID NO: 35317

SEQ ID NO: 38518 - DNA, 729 bp, Agrobacterium tumefaciens; identical to SEQ ID NO: 35318

SEQ ID NO: 38519 - DNA, 1218 bp, Agrobacterium tumefaciens
ctcgctcccaaatcctatcccgatatgcccgcgctgcgcggcgttcgcatggcgacggctgccgccggcatcaaatacaagaaccgcaccgacgttctcttgatggtgttcgacaagccggcaagtgtggctggcgtcttcaccaaatcgaaatgcccctcggccccggttgatttctgccgcgccaatctcggcagcggcgcggcgcgtgccgtggtggtcaattccggcaatgccaatgcgtttacgggcgtcaagggcaaggctgcgaccgaactgacggcgaagtccgccgccgctgccgtcggctgctccgaaggcgaaatattcctggcatcaacaggcgtgatcggcgagccgctggacgcttcgaaatttgcaggcgttctcggtgatatgaacgtcagggcggaagccgatttctggcaggaagccgccaaggcgatcatgacgaccgacacctatcccaaggtttcgacccgcaccgccgagatcggcggcgtgatcgtcacgatcaatggtatttccaaaggtgccggcatgatcgcgcctgatatggcgacgatgctctccttcgtcgtgacggatgccgacatcgaacccgccgcgctgcaatccctgttgtccgccggtgtcggcccgaccttcaattccgtgacggtcgatagcgacacgtccacgtcggacacgctgatgctgttcgccacgggtgcggcggctgaggacggtcaggtaaaggtgacgagcgccgatgacgagcgcctgtcctccttccgcgccgcgctcaacgatctcctgaaggatttggcgctgcaggtggttcgcgacggcgaaggcgcgcgcaagatggtggaagtcaccgtgacaggtgcggaaaacgatgccgctgccaagaaaattgccctttccatcgccaattcgccgctggtgaaaactgccgttgcaggtgaagacgccaattggggccgcgtcgtcatggctgtcggtaaatcaggcgaaatggctgaccgtgaccgcctcgccatctggtttggcggcgtgcgcgtggccgtgaacggtgaacgcgatccggattattcggaagcggagaccaccgccgtgatgcggctggaagatattacggtgaaggtggatatcggcctcggccaaggcacggccacggtctggacctgcgatctgaccaaagaatatgttgcgatcaacggcgactaccggagc

SEQ ID NO: 38520 - DNA, 744 bp, Agrobacterium tumefaciens
accaacagacttcaaaacaagatcgccgtcgtcaccggagcaaccagcggcatcggccttgcaacggccaaacttttcgctgtcgaaggtgcacgcgtctacatcaccggccggcgcaaggatgccctggacaaggcggtggccgagatcggccatggcgctgtcggcgtacaggccgactccgcaagtaacgaaaatctcgacaagctgttcgcccaggtgaaggcggagcaaggccgcctcgacgccctcgttgtgaacgccggtggcggcagcatgcttccgctcggccagatcaccgaggagcagatcgaccacaccttcggccgcaacgtgaaggctgtcatcttcacggtgcagaaggcgcttccgttgatgggcaagggcgcatccatcgtgctgaccggttcgaccgcaggcaccgaaggcacggccgccttctccgtttactccgcctccaaggccgccgtccgcaacctggcccgctcctgggcgcttgacctgaaaggcaccggcatccgcgtcaacgtcgtctcgcccggtgcgacacgtacgcctggcctcgtcgagcttgccggtgacgacaaggaacagcagcagggcctgctcgactatctcgcctcgcgcatcccactcggccgcgttggtgaatccgaggagatcgccaaggcaaccctgttcctcgcctctgacgacgcgagcttcgtcaacggcgccgaactcttcgccgacggcggccaggcc

SEQ ID NO: 38521 - DNA, 756 bp, Agrobacterium tumefaciens
ctgcagggccgtcgcgccctcatcactggcggcacttcgggggccggcgctgcaaccgtggcgctgttcaaggatctcggtgccagcgtattgaccaccgctcgtaagaagcctgccgacttcgcgggagcggcgttcgtcgaggccgacctgaccaccacggcgggggtaaagactgtcgtcgatgcggtgcagagagaactcggcggcctcgacattctcgtcaacgtgctgggcggctcttcggcgccttcaggtggttttgctgccctcacggacgaggaatgggagaaagagttcaaccttaactttttccccgcggtccggttggatcgggctctcgtccccggaatgatcgctcagggaagcggtgtcgtcatccacgtgacttcgatccagagaaaccttccgctaccggaggcgacgactggctatgcttcggccaagggagccctcaacacctacagcaaaagcgtctccaaagaggtttctccgaagggtgtgcgagtggtgcgcgtctctcccggctggatcgccgatccgggggcaaacggtctggcgctgcgcatcgccgaggaagcgggtatcgactacgccgccgcagtgcaggtgatcatgaactcgctcggcggcataccgctcggacgaccggcaaaaccggaagaggttgccgatctgattgcgtttcttgcatcggatcgagcagcgtctatcaccgggaccgagcatgtgattgatggcgggacggttccgacc

SEQ ID NO: 38522 - DNA, 1408 bp, Agrobacterium tumefaciens
tggatcgacggcacctttgtctcgtcttccaaacgcggccgctccatcgatccggcgacatatgagacgatcggagattatccggacgatggcggagcggccgcgcagtctgccatcgaagccgcaaaacgcgcattccgcggaaccgcttggcgcgacgatgctgagcttcgggcaagggtgctcgaccagatggcttcggcaatcgagcgaaatcgcgagcgcctgatcgacatcctctcgcttgagaacggcaaactgctcggcgaggcggcgctggagatcgacggtagtccgagcaagcttcgatactgggctgctatggcgcgtacggaggcagggcgagcgaaatcgcccaagcccggcagcctctccgtgattctgcgacagccgatgggagtggcggggatcatcgtcccttggaattctcccgtcatattgtcggttcgttcattcgctccagcgctcgccgccggctgcacggtcgtcgtcaagatgcccggtcagacggcgcaggtcggcagtgttataaccgaggtccttgcggaagcgacagacctgccggaaggcgtcgtgaacatgttcgtcgagagcggtgcggacggcgctgcgcttctggttgaaagtcccgatgtgccgacgatcagcttcactggaagcacacagaccgggcgaaccatcggggctatcggtgcaaagagaatgaaacggttcgggctcgaactcggcggcaagaccccaatgatcgtgtttgacgatgccgaccttgaagccatgctgcctgttctcgaaaaggctctcaccatctttgctggtcagttctgcatgaccggctcacggctactggtgcacagttcgatctacgaactggtgcgcgaccgcctcgccgaaaggctgcgtgccgtcaaagtcgggccggcatcggacccagcgagcgatatggggccactcattgacaaggagaacgtcgcccgtgtcgacagcgtagtgaaagatgcgctgtcgaagggtgcaactgtggtcgttccgaggcggtcccgtgccagaaggccctttggcaaaaggtgcttttttccgtccttcgatgctggaggtattcgacaacagccttccgatcgtgcagcaagaaacgttcggtcccgtcataacgatccagcggttctcagatgagcgggaagccgtcgtgctagcaaacgataacgactatggcctgtccgcctcggtctggacgcgggatctggatcgctcgttacgggtcgcacaggcgcttgaagcgggaagcgtattcgtcaacgactgggccaaggtgtacgacgggacagaggagggtggctttaagcaatccggtctcgggaggctgaacggcgttgccgccatcgaggactttatcgagtacaagcaagtcgct

SEQ ID NO: 38523 - DNA, 1047 bp, Agrobacterium tumefaciens
ttgcagatgtcggataagaaatttcgtgtgggtattattggagcagacactcacgcaagttgggcaggcgcatcgcatgtgccagctctggcgtcacaagctcacctgacgctggcggcagtcgcgacccggcgcgaggaaagcgccagggcggcggctgaagcattcggcgcagagctatggtttgccgatccctacgcgatgatcagtgataaaaccattgacgtcatcacggtcgccgtgaaggtgccggcgcacaagaatctcgtgatggccgccttgcacgcgggtaaagccgtctattgcgaagcgcctctaggcgcaacgctggcggaaacaaacgagatggccgcagcggtcgggtctttgcataccgcgatcggcttgcaaggtcggcataatcctgccgtccgacgagcggcggaactagtcgcgtcaggaaagctgggtcgcttgatgtccgcccgtgtcggcgcaaccacattcggctacggtccgcaatctccgagcatgtacgactatttcaacaaggccgcttctggcgccagtttcatgacgatcacggcaggccacgtgctggacgtcatcgaggctgtgctcggcaacattaccgaggtcgatgcgcgcacggagttgctctggccggagatcgagatcgtcgatacaggcgaaacttcacagcgagaaattccggatcatctcgatctgatcgccaagacggcaagcggtgcgcctgtatctgtgcaggttctggcgggcgtgcctgcagatgaggcgagtgttgtattcgagatccgtggttcccggggctggctgaagctaaccggcaatcatctggcaggcgtacaagtcggagacattttactttcatcgagcgtggaattcgctgcgcccgatagaccggtcgccaacggtgtcggtccgaccgcggccgaattctggtcaggcgccgctatcaatgtcggggaggtctatgcgtccctggggcgcgatttgaggaatggtacatataccactcccggtttcgaccatgcccgccataacagc

SEQ ID NO: 38524 - DNA, 1083 bp, Agrobacterium tumefaciens
atgcaaatgcgcaagctgggtgaaagcgggttgttcgtgtccgaattgtgtttcggcgccatgacattcggcggaactgacgggctatggggaaaggtggggagacttgaccaggaggatgccgatgcactggtcaaggccgctctcgaggccggcataaacctgttcgatacggcaaacgtctatgcgcacggacgcagcgaagaaatactgggacgttcactgaagaaccttggagtgtcgcgcagcgatgtcgtgatcgccaccaaagtcgcctccgccatgggtgacggaccaaaccatcgcggcgcgtcgcgggggcacataatttccgaatgccgggcaagcctcggccggctgggtctggaccacatcgatctataccagatccacgcattcgattccgcgacaccgatcgaggaaacgctggaggcgctcgacacactcgtgcgggccggcgacgttcgctacatcggcctttcgaactgggccgcgtggcagatcatgaaggcgatcgggataacacgcgccagagccctcgcaccaatcacgtcactgcaggcatactacacgcttgtcgggcgcgatctcgagcgcgagatcggcccgctgctctcatcggaacgtgttggcctcatggtctggagtccgcttgccggcggctatctcaccggaaagtattcagctgggggcaatgccgcaggcggtcgacagacggaattggattttccacccatcgatcgcatacggggagagcccctgatcgcggtcctgaaagctgtcgcggagaaacacggctccagcccggcgcaaatcgcgatcgcctggctgctgaagcaaaaggtcgtctcgaccgtcatcatcggtgcgaagcgcgtcgagcaattgcaggaaaacattcggtccgcatcgattgagctggacgataacgacatggcgaagctcgatgaggtcagtcgtctacccgtcgagtatccgggttggttgctgaatgacggaaacggacactcgcgctgacacggaaaagatgcttgagatcgatgaaggatgagtttaattatccatcccatgaatttacacggt

SEQ ID NO: 38525 - DNA, 720 bp, Agrobacterium tumefaciens; identical to SEQ ID NO: 35207

SEQ ID NO: 38526 - DNA, 729 bp, Agrobacterium tumefaciens; identical to SEQ ID NO: 38044

SEQ ID NO: 38527 - DNA, 633 bp, Agrobacterium tumefaciens; identical to SEQ ID NO: 38108

SEQ ID NO: 38528 - DNA, 1158 bp, Agrobacterium tumefaciens; identical to SEQ ID NO: 35204

SEQ ID NO: 38529 - DNA, 1374 bp, Agrobacterium tumefaciens
gccgcggatggcaagacgattgcggtggaaaatcccgccaactcgatgatcatcggtcacgttccttcattgtcggcagatgaggttaaagctgcagtcgagtcagcaggcaaggcattttccgagtggagccgccgttctgcgaaggaccgcgctgccatattgcgtcgatggtttgatctcatggtggcgaacgctgacgatcttggtgcgttgatgactgccgagcagggaaagccgtttgcggaagcaaagggcgaagccctttatgcggcatctttcgtggaatggttcgcggaggaagccaaacgtgtttatggcgataccattccttcgccgaccacggacaagcgcattaccatcctgaagcagccgatcggtgtctgcgccgcgatcacgccatggaacttcccggccgcgatgatcacccgcaaggcggccccggcacttgccgcaggctgcgcgatgatcgtcaaaccggctgagcagacccctctcaccgcacttgctctgggtgttctcgccgaagaagcgggcgttcccgccggtgtcttccaggtggtgacgggcgccgcacgcgatatcggcaaggtgtttaccgaaagcgacacggtgcgaaagatctcctttaccggatcgactgaagtcggtcgtctgctgatggcgcaatcggccccgacgatcaagaaactgtcgctggaacttggtggcaatgcgcctttcatcgtctttgatgatgccgatctggatgcggccgttgagggcgcgatcgtgtcgaaataccgcaatgccggacagacctgcgtgtgctccaaccggatctatgtccaggatggtgtttacgacgcattcgcggaaaagctggtcaaaagggtcgaaagcctgtccgtcggtgagggcacggaacctggtgttctgataggtccactgatcgaccaggaggccgtggcaaaggtcgaggatcacgttgctgatgcccttggcaagggagcaaagatcgtcatcggtggaaagcgtcatgctcttggaggcacattctacgaaccaacggttctgactggtgcaacccaggccatgaaggttgcccgtgaggagacctttggacccgtcgccccgctctttcggttcgggacggaagacgaagcggtcgccatggcgaacgataccgaatttggtctggcggcctatttctacaccgagaatgtccgccggacatggcgtgtcgcagaagcgctcgaatacggcatggtgggccacaatacaggcctcatctccaacgaagtcgcaccattcggtggcgtgaagcagtccggcttgggccgcgaaggctcgcactacggcatcgatgaatatcttgaaatcaaatacctgtgc

SEQ ID NO: 38530 - DNA, 1389 bp, Agrobacterium tumefaciens
tacatcgatggcaaatgggtccttcccagcggctcagacaaggtcgccgtcattaatcctgccaccgagctggaatttgcagaaatagcgctcggtaatgatgaagacgttgcgctcgctgttgcagctgcaagaggcgctttcgccggctgggctcgaaccggtccggcagaccggtcggaacttctcaatcgcgtccatcagctgatgcaacagagattggaacttctggcgcaagctttgacgatggaaatgggcgcggcgatcaattatgcccgaagcgttcaagttccccttgctgccgaacatatcaaggtggctcgcgacaatgcggccagctattcgtttctttcgcaacgggggcatacggcgatcctccgcgagccgatcggcgtatgcggcctgatcacaccgtggaactggccgttgtaccagataaccgcgaaggtcggcccggctttggcggcgggatgcacggtggttttgaagccgagcgagctttcgccccttagtgcgttgctgtttgccgaaatcatcgaagatgccggctttccgcctggcgttttcaacctcgtcaacggcgaaggcaccatcgtcggcgctggcttgtccgcacatcccgacgtggacatgatttccatcaccggctcgacccgggccggaattttggtcgcacaggcggcggctccgacagtaaaacgggtggcccaggaactcggcggaaaatcgccgaacatcatccttgcggatgccgatatgacgcgggccgtgcctttgggcgtcgctgcggcgtttcgaaatctggggcagtcctgcagcgcgccgacccgcatgatcgtgccgcgctcgcaccaaaaacacatcgaggaactggcagcggcagcggctctggaaatagttgtcggcgacccgttatcggagcataccacacacggcccggtcgcgaatcacgcgcagtttgaccgaattcagcggatgatatcgatcggcatggatgagggcgccaaacttgtcgtgggggggaccggcagacccgacggcctggataccggcttttacgtgcggcccacgatcttttcagacgtagatccgaaaatgcaaattgcccagcaggaaatcttcggacccgtcttgtccattatttcttacgatacgctcgaagaggcgatagagatcgcaaacgatacggtctacggtctgggagcccatgttcaggggacggaccttcaaactgtgcgaatagtggcggagcagattcgatccggacaggtgcatctcaattatccggcgtgggaccccaatgcgccctttggtgggtacaagcaatccggcaacggtcgggaatatggcaccgagggcatggaagaatatctggagatcaagtctatc

SEQ ID NO: 38531 - DNA, 834 bp, Agrobacterium tumefaciens
gtgttggtcgactgccagaacgtctggaagatttttggcgcgcgcgcttcgaccgccgtgaaggcggtggccagaggtggattgtcaaagaagcaggtgctggaggatttcgactgcgtcgtcggcgtatgcgacgccagccttcaggttcatcgtggcgaaatcttctgcatcatggggctttccggcagcggcaaatcgaccttgatccgtcttctcaatcgcctcatcgagccgagcctcggaaaaatcacggtgaagggcaaggatatcgccaggctgaatgctgccgaattgcgcgaattgcgcgcccgcaacatcgccatggtgtttcagagcgtagcgctgctgccttaccgcactgtgctcgaaaacgccggtttcagtctcgaggttcgaggcgtagcgaaagacgagcgcaaccgtatagcacgcgccgcgcttgaaaaggtgggccttgccgactggacgtcgcggtatccccacgaattgtcaggaggcatgcagcagcgcgtcggacttgcccgcgccctggctgccgacccggaaatcattctcatggacgagccgttcagcgcgctcgaccctcttatccgtcggcagctccaggacgaatttcggcaattgacgaagtcgctcggcaagtccgccgtcttcatcacccatgacctcgaggaagcaatccgcatcggcgaccgcatcgccatcatgaaggacggcgttatcgtgcaggtgggaaccgccgaggagatcgttacgaaacccgcagatgattacgtctccgatttcgtagcgggcatctccagaattcatctggtgaaggcgcatacggtc

SEQ ID NO: 38532 - DNA, 1464 bp, Agrobacterium tumefaciens
gccgaatacaaggcgattgcctcagaccttcagttcccggccaatgccttcattgacggggctttccggcccgccggttccggcaagaccttcaagacgatcaatcccgccaccggcgaaacgctcgccgatatttcggcctgcgacgtgagtgacgtggactatgcggtcggcaaagccagggcggcattcgacgacggccgctggcgcctgctgccacctggcgaacgcaaggccattttgctcacattcgcaaaactactggagcagcatcgccacgaactagccgtcatggaaagcctggacagcggcaagccggtttccgaatgccagaccgtcgacattcctgacacgatccacaccatccgctggcatgcggagctcatcgacaagctgtatgacaataccgcaccggtgggatcgaacgcccttgcactcgtggtgcgcgagccggttggcgtcctccgctgcgtgctgccgaggaactttcctttgctgatgctggcctggaagatcggcccggcgctcgcctccggatgttcggtgatcgtcaaaccggccgaggagacaacgctgacgaccctgcgcgtcgccgaactggcgcatgaagccgggattccggctggcgtcttcaacgtcgttccgggcggcggcaaggaggtcggcgagccgatcggcatgcatatggatgtcgatatggtagcgtttaccggatcgacgccaacgggacggcggttcctgcgatatgcggccgactccaacctcaagcgcatcgtccttgaatgcggcggcaaaaatccggcggtggtgctggatgatgcggaagacctcgacctcgtcgccgagcaggtggtcaacggcgcattctggaacatgggcgaaaactgctcggcctcgtccaggctcatcgtccatgcaaaaatcaaggacgagctgctgcagcggatcggcgcctatatgcgggaatggaggatgggcgatcctctcgatccgcaaaaccgcgtcggcgcgctcgtcagcaaagcccatttcgataaggtccactccttcctcgaggacgtgaaggcagaaaatcttaccatcgttcacggtggcaagaccgagaagggaatcttcatcgaacccacggtcgtcgatgccgtgccccctgcaagccgtcttttccgggaagagattttcggcccgatcctgtcggtgacgaccttcaacacgctggcagaggcggtagctcttgccaacgacacgaattacggccttgccgcatccgtctacaccggaagccttcgcaaggcgatcaagctctcgcgcgaaatccgggcgggtgtcgtcacggtcaattgcttcggcgaaggcgacgcaacgacgccgtttggcggctacaaggaatccggtttcggcggacgcgacaaatcgatcttcgcgcacgataattattgcgaactcaaaacgatctggatcgacgtc

SEQ ID NO: 38533 - DNA, 867 bp, Agrobacterium tumefaciens; identical to SEQ ID NO: 38045

SEQ ID NO: 38534 - DNA, 882 bp, Agrobacterium tumefaciens; identical to SEQ ID NO: 35051

SEQ ID NO: 38535 - DNA, 2781 bp, Agrobacterium tumefaciens; identical to SEQ ID NO: 35052

SEQ ID NO: 38536 - DNA, 2790 bp, Agrobacterium tumefaciens
atttccaagctttccacgtcgacgatcgccggcctgacgtcggaagacgtaaatgctcttgatagcaccaagatcaaggctctctcttcgtctcagatcgcctcgttgagcacggataaccttgctcttttcagctccgaagacctccgcgccatttcggtaacggcggtcaagggcctgacgctcacccagatggcgaaactgagctccgcccaggtcagcagcctgtcttcgtcccaggtcacggcactttatgccagccagatcgacgccatgtcgaccgaccagatcaaggcgctcaactcctctcaggtcgcagggctcagctccgcccaggtcgcaacgctgagcagcgacgaactcgctctcttcaccaccgacgagatcaagtcgatcagcgccaatgccatcgcaggtctttccgcggcggctatcgccggtctcagcaccgacaatgcagccgcactgacgaagtctcagatcgccgccatgtcttccacgcagttcaacgcgctcacgttgggcagccttgcaaccttctcggcggacgaagtcaaggcgatcagcaacaagatcctcgctggcctcgatgtcaccaaactcagcaccggcaacatcgcagccctcagcaaggcacaggtttcggcgctgtcgacgacacagttcgctgccatgtcgaccgaccagatcaaggccctcacctccgatcaggtcgccggtctcagctccgcgcaggttgcgacgctcagcagcgacgaactggctctcttctccaccgatgagatcaaggcgatcggcgccaacgccgttgccggcctgtctgccgcagccctggcggcgcttaccaccgacaacgctgcagcactgacgaagacccagatcgcgggtctgtcttcgacacagctgaatgcactgacctccgccaaccttgcaaccttctctgcagatgagatcaaggccatcagcaccaaggcgctggccggtctcgatgttaccaagctcagcaccggcaacatcgccgcgctgaccaaaacccaggccgcatcgctgtcctcaacacagttcgcagccatgtcgaccgaccagatcaaggccctcacatccgagcaggtcgccggtctcagctccgcgcaggttgcgacgctcagcagcgacgaactggctctcttctccaccgatgagatcagcgccttcagcgccaatgcggtcgctggcctttccacagcagccctggctgccctcaccaccggcaatgcaaccgcactgacgaagacacagatcgctggtctgtcttcgacacagctcaatgccctgacatcaggcagcatcgccactttctccgccgatgaagtcaaggccatcagcaccaaggcactggccggcctcgatgtgaccaagctcagcaccggcaacgtcgcagccctcagcaaggcacaggtttcggcgctgtcgacgacacagttcgctgccatgtcgaccgaccagatcaaggccctgacatccgagcaggtcgccggtctcagctccgcgcaagttgcgacgctcagcagcgacgaactggctctcttctccaccgatgagatcaaggcgatcggcgccaacgccgttgccggcctgtctgccgcagccctggcggcgcttaccaccgacaatgcatccgcactgacgaagacccagatcgcgggcatgtcgtccacgcagatcaatgccctgacctccgcaaaccttgccaccttctctgcagacgagatcaaggcaatcaccaccaaggctctcggcggtctcgatgtcaccaagctcagcaccggcaacatcgccgcgctgaccaaagcgcaggttacatcgctttcctcgacgcagtttgcagccctgtcgaccgaccagatcaaggctctcacctccgagcaggtttcgggcctcaactctgcccaggttgcgacactgagcagcgacgaactcgctctcttcaccaccgacgagatcaagtcgatcgccgccaacgccgttgcgggtctctctgctgcggcgctggcagcgcttaccaccgacaatgcatccgcactgacgaagacgcagattgctagcctctcatccacgcagctcaacgccctcacctctgcaaatctcgctaccttcacggcagacgagattaaggcggtcaccaccaaggcgctggccggtctggatgtcactaagctcagcaccggcaacgtcgccgcactcagcaaggcacaggtttcggcgctgtcgacgacacagttcgctgctatgtcgaccgaccagatcaaggctctcacctccgatcaggttgccggcctcacctccgcgcaggttgcaacactgagcagcgacgaactggctctcttctccaccgatgagatcaaggcgatcggcgctactgccgtctccggtctgtctgccgcagccctggcagcgcttaccaccgacaatgcatccgcactgacgaagacccagattgccggcctgtcttcgacgcagctcaacgccttcaactccgcgaacctcgccaccttcacggcggacgaagtcaaggcgatcaccgccaaggctctcggcggacttgatgccaccaagctcagcaccggcaacatcgccgcactcagcaaggcacaggcggcagcattgtccacgacgcagttcgcagcgctctcgacagaccagatcaaggccctcacatccgagcaggtcgcaggtctgaactctgctcaggtcgcgacgctcgacagcaccgagcttgccctgttctcgacagacgagatcaaggccatt

SEQ ID NO: 38537 - DNA, 1035 bp, Agrobacterium tumefaciens; identical to SEQ ID NO: 38121

SEQ ID NO: 38538 - DNA, 1194 bp, Agrobacterium tumefaciens
gtctggcatcccttcacccagcatgggctggaaccgccgatgaaacgtgtggtctcagcggacggggcgtttctggtggatgaggatggcaatcggctgttcgacgcgatttcatcctggtgggtcattacccatgggcaccggcatccggcgatcatggcggccatccgcgccgcgaccgagaccctggatcaggtcatctttgccgaattttcccatgaaccggctgagacgctcgcccgggggctgatcgagcttgctcctgctggactaagccatgtgttttattccgatagcggttcaacggcggtggaagtggcgctgaaaatggcgctcggttatttccacaattgcggtgaaaagcgcgatcgcatcgtggtgatggagcatggctatcacggcgataccatcggcaccatgtcgacaggcgagcgcggcgtgttcaacgccgcctatgaaccgctgcttttcggcgttgaccggttggcctttccggaagtgggcagcgagcagtgcacattggatatgtttgaggcttactgccgttcgggccgtgtcgccgcgctgctggtcgaaccattggtgctcggtgccggtggcatgaaggtctacgccgccaatgttctagccggactgaaacagattgcagaaagccatggctgtctcgtcattgccgatgaggtgatgacgggctggggcaggaccgggaccgtcttcgcctgcgagcaggcggcaatctcaccggatattctctgcacttccaaggggctgaccggtggttcgctgccgctggcggcgacgctgtgcagcgcgcagattttcgatgctcatttttcgaccgaccgccgcaagacctttttccattcgagttcctatacggccaatccgatcgcctgcgccgccgccgtcgccaatcttcaggtctggcgggatgaaccgattctccagcgcatcgggcaggtgcaacagacgctcggcgatcatatcaggcgctttgccgatgatggccgtttcgccaacatccggcaggcaggcaccattgccgcgcttgatctcgtggtgccggcgggtggctatctttccgaggccggtccacgcatgcgccagctgttccgcaggcgcggctttctcatccgcccgctcggcaacgtgctttacctgatgccgccctattgttcgacggctgacgatctg

SEQ ID NO: 38539 - DNA, 963 bp, Agrobacterium tumefaciens
acacgttcttcccgcatggccggttttggtcatgccgttccggcccgttgcgtcgacaatgccgaaatagaggccagtctggggctggaagccgggtggatcgagcgacggaccggcattcgctcccgttattgggcggaggcgggcgacacgctgagcggtcttgccgaaagggctggccggatggcgctggaggatgcgaagatcaatgccgatgacatcgcgctgacgctgcttgccacctccacgccggatcatcttctgccgccttccgcgccactgcttgcgcataggctgggtttgacgcgctcgggtgcgatcgatcttgccggggcctgttccgggtttctttatgcgcttaccctcgcggatggttttgtccgcacctacggccgcgccgtcctcgtcgtcgccgccaatattctcagccgccgcatcaatccggcggaaagggcgagcgccgtcctgtttgccgatgccgccggtgccgtggtgctgaccccgtgtccggaggtgaaacggggggtgttatcggccgatctcgttgccgatggcagcggttacgatctcatccagatcgcggcaggcggcagcagccagcccttttctgccggtatgattgcagaagatgccctgatgacgatgcgcgatggccgggaggttttctctcgcgccgtggcgctgatgacaaacacctctcagcgcgtgctgcatgaggcggaactgaccgcagccgatatcagccgtttcgtgccacatcaggccaatgcccgcatgtccgacgccgtttgcggtaatctcggaatcgagcgggaaaagacggtccgcaccataggaagcttcggcaattcttccgctgctaccatcccgctttcgttgtccatcaccaatgccgagcggccccttgcgggcggcgaaaccctgcttctgacggcggcgggtgcaggcatgacgggcggggcg

SEQ ID NO: 38540 - DNA, 918 bp, Agrobacterium tumefaciens; identical to SEQ ID NO: 35057

SEQ ID NO: 38541 - DNA, 1219 bp, Agrobacterium tumefaciens; identical to SEQ ID NO: 35271

SEQ ID NO: 38542 - DNA, 660 bp, Agrobacterium tumefaciens
gtcaaactcgaagacagctggaagcacgttctctcgggcgaattcgccagcccctacatgcagaagctgaaagagttcctgcttgccgaaaagaccgccggcaagcgcatctttccgaagggcgcggaatatttccgcgctctcgacctcacgcctctcgacgaggtcaaggtcgtcattcttggccaggatccctaccatgggctcggtcaggcacatgggctctgcttttcggtgcagcccggggtgcgcattccgccctcgctcgtcaatatctacaaggaattgcagagcgacctcggcattcgcccggtcaagcacggttttctggaaagctgggcaaaacagggcgtgttgctgctcaacagcgtgctgacggtggaagaggcgcgggccgcctcgcatcaggggcagggctgggaaaaattcaccgatgcggtcatccgcgccgtgaacgacgaatgtgaccatgtggtctttctgctctggggttcctatgcccagaagaaggcggccttcgtggaccagcgcaaacatctcgtgctgcgctcgccacacccgtcacccctttcagcccataacgggtttttcggcaacggccatttttctaaggccaacgctttcctcgtttcgcatggccgtgatccgatcgactggcaa

SEQ ID NO: 38543 - DNA, 1011 bp, Agrobacterium tumefaciens; identical to SEQ ID NO: 35273

SEQ ID NO: 38544 - DNA, 852 bp, Agrobacterium tumefaciens; identical to SEQ ID NO: 35274

SEQ ID NO: 38545 - DNA, 726 bp, Agrobacterium tumefaciens; identical to SEQ ID NO: 35362

SEQ ID NO: 38546 - DNA, 675 bp, Agrobacterium tumefaciens; identical to SEQ ID NO: 35361

SEQ ID NO: 38547 - DNA, 885 bp, Agrobacterium tumefaciens; identical to SEQ ID NO: 35360

SEQ ID NO: 38548 - DNA, 1356 bp, Agrobacterium tumefaciens; identical to SEQ ID NO: 38137

SEQ ID NO: 38549 - DNA, 720 bp, Agrobacterium tumefaciens; identical to SEQ ID NO: 35042

SEQ ID NO: 38550 - DNA, 876 bp, Agrobacterium tumefaciens; identical to SEQ ID NO: 35120

SEQ ID NO: 38551 - DNA, 924 bp, Agrobacterium tumefaciens
gcgggcaaggttacccaggttatcggcgctgttgtcgacgtggcgttcgaaggcgaactgcctccgatcctgaacgcgctcgaaacacagaacaatggcaaccgcctcgttctggaagtcgcgcagcatctcggcgaaaacgtcgtgcgcacgatcgccatggactcgaccgaaggtctggttcgcggtcagtccgttgctgacacgggcgcaccgatcgaggttcctgttggtctggaaacgctcggccgcatcatgaacgtcatcggcgagccggttgacgaagccggtccgatcgtaacggccaagaagcgcgccatccaccaggacgcaccgtcttacgtcgagcagtcgacggaaggccagatcctcgtcaccggcatcaaggtcgtcgaccttctcgctccttacgccaagggcggcaagatcggcctcttcggcggcgccggcgtgggcaagacggttctcatcatggaactgatcaacaacgtcgccaaggcgcatggtggttactcggtattcgccggcgtgggtgagcgtacccgcgaaggcaacgacctttatcacgaaatgatcgagtcgaacgtcaacaagctcggtggcggcgaaggctccaaggctgcgctcgtgtacggccagatgaacgaaccgccgggcgcccgcgctcgcgtcgctctgaccggtctgacgatcgctgaaaacttccgtgatgaaggccaggacgttctgttcttcgtggacaacatcttccgcttcacgcatgctggttctgaagtgtctgctctgctcggccgtattccttcggccgtgggttaccagccgacgctggcaaccgacatgggccagatgcaggaacgcatcaccaccacgaacaaggttccatcacctcggttcaggcaatttacgttcccgccgacgacttga

SEQ ID NO: 38552 - DNA, 735 bp, Agrobacterium tumefaciens; identical to SEQ ID NO: 38167

SEQ ID NO: 38553 - DNA, 888 bp, Agrobacterium tumefaciens; identical to SEQ ID NO: 35356

SEQ ID NO: 38554 - DNA, 1119 bp, Agrobacterium tumefaciens; identical to SEQ ID NO: 37970

SEQ ID NO: 38555 - DNA, 972 bp, Agrobacterium tumefaciens; identical to SEQ ID NO: 38170

SEQ ID NO: 38556 - DNA, 2052 bp, Agrobacterium tumefaciens
atggcaaagctcaaggttgacggtaaagagatcgaggttccggatcatttcacgctgttgcaggcgtgcgaggaggctggtgccgaagttccgcgcttttgttttcatgagcgcttgtcggtcgcgggtaactgccgcatgtgtctcatcgaggtgaagggcggaccaccgaagccggccgcctcctgcgccatgggcgtgcgcgatgttcgcggcggcccgaatggcgaattgcctgaggttttcaccaacacaccgatggtcaaaaaggcccgcgaaggtgtgatggagttcctgctcatcaaccacccgctcgattgcccgatctgcgaccagggcggcgaatgcgacctgcaggaccaggccatggccttcggtatcgccggttcgcgttacgcggaaaacaagcgcgcggttgaagacaaatatatcggcccgctcgtcaagacggtcatgaaccgctgcattcactgcacgcgctgcgtccgtttcaccacggaagtggccggcattgccgaactcggcctcatcggccgcggcgaagatgccgaaatcaccacctatctcgaacaggccatgacgtctgagcttcagggcaacgtcgtcgacctttgcccggttggtgcgctcacttccaagccattcgctttcaccgcccgtccgtgggaactgaacaagaccgaaaccatcgacgtgatggacgcgctcggttcggccatccgcgtcgatacccgtggccgcgaagtcatgcgcgtcatgccgcgtgtcaacgaggcgatcaacgaagagtggatttccgacaagagccgcttcatctgggacggcctgaagacgcagcgcctcgaccggccttacgtccgcaaggatggccggctgcagcccgccacttggggcgaagcctttggcgccatcaagcaggctgtagccgcaacgtcgggttcgaaaattggcgcaatcgccggcgatctgtcctccgtcgaagagatgttcgcgctgaagtcgctgctcgcttcgctcggctcggccaatgtcgattgccgtcaggatggcgcagcgcttgatccgtctttgggtcgtgccagctatatcttcaattccactattgaaggcatcgaacacgccgacgctctgctgatcgttggttccaacccgcgcttcgaagcggccgtgctcaacgcccgcatccgcaagcgctggcgtcgcggcggtttcccgatcggtgtgatcggtgaggccggtgagctgcgctacaattacgaatatctcggctcgggcgcggaaacgctttccgatctcgccaatggctcgcacagcttcatcgacaagctgaaatccgccaagaacccactgatcatcatcggtcagggcgctctggcacgtgccgatggtgctgccgttctcgcggctgctgcaaaacttgccgtttcggttggcgctgtcaccgaagagtggaatggcttctcggtgttgcacactgcggctgcccgcgtcggcggtctcgatatcggcttcgtgccgggcgagggcgctgttgctgccgccgagatggtgacgtccatggacgtcctgttcctactcggcgccgatgaaattgacctgtccaacaagggcgccaagttcaccgtctatatcggcagccacggcgatcagggcgcgatgaacgccgacgtcatccttccgggtgcggcctataccgaaaaatccggtatctgggtcaacaccgaaggccgtgttcaggtgggcaaccgcgccggtttcgcgccgggcgaagcccgtgaagactgggcgatcctgcgcgcgctgtccgacgtgctcggcaaaaagctgccgttcgattcgctgtctgccctgcgcggccagctttatgtcgcgcatccgcatctggcggaaaccgacgagatcgttgccggcaaggccacggatatcgaggcgctggctggtaaaaccggctcgctcacgaagtcggcgtttgcctcgccggtaaaagacttttatttgacgaacccgattgcgcgcgcctcagctgtgatggccgagtgctccgcattggcc

SEQ ID NO: 38557 - DNA, 783 bp, Agrobacterium tumefaciens; identical to SEQ ID NO: 35437

SEQ ID NO: 38558 - DNA, 576 bp, Agrobacterium tumefaciens; identical to SEQ ID NO: 35436

SEQ ID NO: 38559 - DNA, 750 bp, Agrobacterium tumefaciens; identical to SEQ ID NO: 35359

SEQ ID NO: 38560 - DNA, 777 bp, Agrobacterium tumefaciens; identical to SEQ ID NO: 38175

SEQ ID NO: 38561 - DNA, 960 bp, Agrobacterium tumefaciens; identical to SEQ ID NO: 38176

SEQ ID NO: 38562 - DNA, 1185 bp, Agrobacterium tumefaciens; identical to SEQ ID NO: 35127

SEQ ID NO: 38563 - DNA, 897 bp, Agrobacterium tumefaciens; identical to SEQ ID NO: 35126

SEQ ID NO: 38564 - DNA, 2136 bp, Agrobacterium tumefaciens; identical to SEQ ID NO: 38179

SEQ ID NO: 38565 - DNA, 540 bp, Agrobacterium tumefaciens
caagcccagttcggcgacttcgccaacggcgcgcaggtggtgttcgaccattgcatgtgctcgggtgaacgcaagtggctgcgcatgtccggtctcgtctgccttctgccgcatggttatgaaggccagggcccggaacattcgtccgctcgtctggaacgctggttgcagatgtgcgccgaagacaatatgcaggtcgccaacgttacgacgccggctaactacttccatatcctgcgccgccagatgaagcgtgacttccgcaagccgctgatcctgatgacgccgaagtcgctgctgcgtcacaagcgcgccacctcgtctctggcggaactggccggcgagtcctccttccaccgtctcctgtgggacgatgctgaagtcatcaaggacggcccgatcaagctgcagaaggatgcgaagatccgccgtgtcgtcatgtgcaccggcaaggtctattacgatcttctcgaagagcgtgaaaagcgcggtatcgacgacgtctacctgctgcgcgtcgaacagctttatccgttcccg

SEQ ID NO: 38566 - DNA, 756 bp, Agrobacterium tumefaciens
gatggcgaaggtagcaggccgctcatctgcattcacggtgtcggctcctataaggaggcgtgggacggtgtggtggacccattgaagaacgacttcacgatcttgaccttcgacctgcgcggccatggcgcatcgtctcgcatcaagggtcgctacgaaatcgaggacttcgtgcgggaggtgattgcgctcgccaaccatgtggggttcaaaaccttctcgcttgccggcttttctctcggcggcctcattgcccagaaactggcgctgacccatcaggagcgcgtcgaccaccttatcctgctgtcgaccgtcgccggtcgcacacaggaggaaaaggaccgcgtggcaggccgtcttgcggcattgacggcaggcgaacccggttctcactacgacgcatcactatcgcgctggctgaccgaagagttccagcaaaacaatcccgacaagatcgcccgcctgcgggcgcgaaatgccgaaaacgacccggattgttacgccgccgcctatcgggtgcttgcggaaacagaccttggcgaggaattatcgcagattggcgtgccgacgctgatcgcaaccggcgaagacgatagcggctccaatccgcgcatggccggcttcctccatagcaagatcgcgaactctatgctcaggatccttccgggtctgcgtcattcgatcctgacggaagcgcccgaactcgttgcgtccatcatgcgtgattttctgaacaaaacgaggaaagctcatgga

SEQ ID NO: 38567 - DNA, 1422 bp, Agrobacterium tumefaciens
ctgttcattgatggccgtttcgtcgagccccgaagcggcaaattcgtcgatagctacgatccaaccacgggcgaagcctggtaccaatttgcagaaggcggtgccgacgacgtcgatctggcgatatcctctgcacagcgtgccttccgtgatccgtcctggcggcgcatgacgcagaccgcccgcggtaagctagttcgccggctggccgatctcgtgctggaacatgctgaagatctcgctttgctcgagacgcgcgacaatggcaagctgatcaaggaaatgcgcgcgcaaatgcgggcaattccagactcctacctctattttgccggcatggccgataagctgcagggcgacacgatccccgtcaacaagctcgaccagctgaacttcaacatgcgcgagccgctcggtgtcatcggcatggtgaccccgtggaactcacctttgatgctgcttaccggaacgctcgccccgtgccttgcaatcggcaacacggtggtaatcaagccttccgaacacgcgactgcctccacactcgcgcttgcggaactgatcgtagaggcggggttcccggccggtgtggtcaatgttgtcactggcggtggcgcggtaaccggtgaggctttgacccgccacaacggtattgccaaattcgtcttcacaggtagcaccgcgactggtcggcgcatcgccgcgaacgcggcggccaacctggtgccatgccagatggaactgggcggcaaatctccgcatgtcgtgttctcggacgtcgacattgaaaagacggttaacggggtcgtctcgggtgtcttcgctgcagctggacagacctgcgttgcgggatcacgctgcttcgttgaagccaatatctatgatcggttcatcgaagcgctggtggagcgcacccgcaacatcaagctcggcgacccgatggatgacgcgaccgacatcggcccgctcgcactcgaaagccagctatcaaagctcgaggggtacgttgcctccggcgtccgcgaaggttcgcgcatcgcaatcggtggcaaacgtccgcaatcggaggaactgtcgaggggctggtacttcgagccgacggtgatggcggatgcaaccaacgacatgagcttcatgcgccatgagttgtttggcccgatggtcggggtcatgcccttttcctccgaagaggaaatgatctcgcttgccaacgatacgaattacggcctggcatcgggcatctggacgcagaacatcgatcgcgccatgcggttcgccaaccagatcgacgccggcaccgtgtggatcaacacctatcggtcggccgcttacatgtccgccaatggcggcttcaaggaaagcggttacggccgccgcggcggcttcgacgtgatgcgcgaattctctcgcgccaagaatgtcgtcatc

SEQ ID NO: 38568 - DNA, 974 bp, Agrobacterium tumefaciens; identical to SEQ ID NO: 38180

SEQ ID NO: 38569 - DNA, 1488 bp, Agrobacterium tumefaciens
tatattctggcgatcgatcaggggacgacatcgacgaggtcgatggtctttgatcgcgacatgcgggtgatcggtgtcggccagcgagaatttccgcagcatttcccggcctccggctgggtcgagcacgatgccgaagatatctggaaaagcgtgctcgaaaccatccggctggcgcttgccgatgccggcatcgccgcatccgatattgcagcaatcggcatcacaaaccagcgtgaaacaaccgtgctgtgggaccgcaacaccggcgaggccgtgcatcgcgccgtggtctggcaggatcgtcgcgccgcgccggtctgcgaggacctgaagcgccgagggctggagccgctgttttcgaaaaagaccggactgctgctcgatccctatttttccggcaccaagctgaaatggcttctcgatagcgtcagcggccttcgcgaaaaagccgtgaagggagaaatctgcttcggcaccgtcgacagtttcctgatctatcgcctgactggcggccggcgtcatgtgactgacgccactaatgcctcccgtaccttgatctacaacatcgaagacaacgcctgggatgacgaattgctgtctatccttaacattccccgcgccatgctgccggaggtgctggactgcgctgccgatttcggcgtgacggataaggcgcttctcggtgcggaaattccaatcctcggtgtggccggcgatcagcaggccgccgttatcggcaatgcctgcttcgagccgggcatgatgaaatctacctatggcacgggctgctttgcccttctcaataccggcacagaccgggtggcatccaccaaccggttgctaacgacgattgcttaccgcctcgatggcgtgacgacctatgcgcttgaaggttcgatcttcattgccggcgccgccgtgcaatggctgcgtgacgaacttggtttcatctcggttgcgtctgaagtcagcgcgctcgccgaaaaggccgatcccaagcagcgggtttatctcgtgccggcctttaccggccttggcgcgccttattgggatgccgaggcccgcggagcgattttcggcctgacgcgcggtacgggacctgcggaatttgcccgcgcggcgctcgaaagcgttgcctaccagacgttcgatctcctggacgccatgcgcaaggactgggcgggtgacaatggcaagacggtgctgagggtggatggcggcatggtcgcttccgattggaccatgcagcggctggcggatattcttgccgccccggtcgatcgtccggtctttctggaaacgaccattctgggcgcagcctggcttgcggcctcccgcgccggcatctggccggaccgcaaggcctttgccgaccattggcgccgtgaccgccgcttcagccccgacatggaagaaagcgagcggaagaacgcgatcgcgggctggcgtgacagcgttggccgttgcctctcgaaacgggacaat

SEQ ID NO: 38570 - DNA, 864 bp, Agrobacterium tumefaciens; identical to SEQ ID NO: 35283

SEQ ID NO: 38571 - DNA, 1287 bp, Agrobacterium tumefaciens
ttgagaatcggcatagcggggctcggcactgtcggcgcttcgctcgtgcgcatcctccagcagagaagcaacgaacttgcgattacctgcggacgcgcgattgagattattgcggtgagcgcgcgcgaccgttcgcgcgaccgcggcatcgatctcaagggtattacctggttcgacacgcccgagcagatggcgagcgaagccgatatcgatgtgttcgtcgaactggtcggcggtgcttccggacaggcagaaaatgcggtgcgggcagcgctttcgcgtggtctccatgtagtgacagccaacaaggcactgcttgccaagcatggcgtcgaactggcgaccattgccgaggacaagggcgcgctgctcaatttcgaggcggcggtggctggcggtatcccggtcatcaaggcgctgcgtgaatccttgaccggcaaccatgtgtcgcgcatctacggcatcatgaacggcacctgcaactacatcctcaccaagatggagaaggaaggcctgtcgttcgaggtgtgcctgaaggaagcgcagcggctcggttatgccgaagcggatccggccttcgatatcgaaggcaacgacaccgcgcacaagctctcgattctgaccacgcttgccttcggcaataagatcgctgccgacgacatctatctcgaaggcatcaccaatatctccatcgaggatattcaggcggctgccgagcttggttaccgcatcaagcttctcggcgtggcgcaggtgacggactccggcatcgaacagcgcgtgcacccgaccatggtgccgctcgactccgttatcgcccaggtggatggcgtgaccaatgcggtggcgatcgaatccgacattctcggcgaattgctgatggtcggcccgggtgccggcggcaacgccacggcgtctgccgtacttggtgacatcgccgatatcgccaagagccgtccaggcacccagcaggtgcccgtactcggccgtccggccaagtcgctgacggagtaccgccgcgccaagatgaagagccatgagggcggttatttcatccgtctgacggtgaaggatcaggcgggcgtcttcgcctccatcgccacccgcatggctgacaataacatctcgctggaatccatcgtgcagcgccagcgcgtgcatgtggaaggcgcgccgcagaccatcatcctggtcacccatgcgacgatggaagatgcgatccgcaaggccgtgaaggcgatcaagaacgagaaatatctcgtcagcgaaccgcaggtcatccgcatc

SEQ ID NO: 38572 - DNA, 2142 bp, Agrobacterium tumefaciens; identical to SEQ ID NO: 35487

SEQ ID NO: 38573 - DNA, 939 bp, Agrobacterium tumefaciens; identical to SEQ ID NO: 35486

SEQ ID NO: 38574 - DNA, 1233 bp, Agrobacterium tumefaciens; identical to SEQ ID NO: 38065

SEQ ID NO: 38575 - DNA, 1224 bp, Agrobacterium tumefaciens; identical to SEQ ID NO: 37932

SEQ ID NO: 38576 - DNA, 1395 bp, Agrobacterium tumefaciens; identical to SEQ ID NO: 38184

SEQ ID NO: 38577 - DNA, 1950 bp, Agrobacterium tumefaciens
gattatctttccggcctcaacccggaacagcgcgaggccgtggaaacgcttgacggaccggttctcgttctcgccggcgccggcaccggcaagacccgcgttctgacgacccgcatcgcccatattctcgccaccggccgcgcctatccaagccagatccttgccgtgaccttcaccaacaaggcggcccgcgagatgaaggaacgtatcggcgtcctcgtcggcggcgctgtcgagggcatgccgtggcttggcaccttccactccatcggcgtcaagcttctgcgccgccatgccgagctcatcggcctgaaatcggatttcaccattctcgacacggatgatgtggtgcggctgatcaagcagctcattcaggccgaaggtcttgatgacaagcgctggccggcaaaacagttcgccggcatgatcgacggctggaagaacaaggggctgacgccaccggatattcccgagggtgacagccgcgcctttgccaacggcaagggccgcgaactttacgccgcctatcaggcccggctgaaaacgttgaacgcctgcgatttcggtgatctcttgctgcacccgatcagcatcttccgccgccatacggatattctgaaagagtatcaccagaagttccgttatattctggtggacgaatatcaggacaccaacacggcgcaatatatgtggctgcggctgcttgcccagcgcgccaaggacgagccgcagaatgtctgctgcgtcggtgacgacgaccagtcgatctatggctggcgcggcgcggaagtggacaatatcctgcgcttcgacaaggattttcccggtgccaaggtcatcaagcttgagcgtaactaccgttccaccgaacatattctcggcgctgccggccatctgatcgcccacaacgagggccgtctcggcaagacgttgtttaccgagcgcagcagtccggacgatgaaaaggtcgtggtgcacgccgcctgggattcggaagaagaggcccgcgcggtcggagaggaaatcgagcaactccagcgtaagaactacaagctgaacgacatggccatcctcgttcgcgcttccttccagatgcgcgaattcgaagaccgcttcgtgacgcttggcctcaattaccgcgtcatcggcggcccgcgcttttatgagcgcctcgaaatccgcgatgccatggcctatttccggctggtctgccaaccggccgacgatctcgccttcgagcggatcgtcaatacgccaaagcgtggccttggcgatacgacgatccgtaacctgcacgactatgcccgcgcccgcgatatcccgatgctggcagccgccgccgacatcatcgagaccgacgagttgaagccgaaagcgcgcaaggcgctgttcgatgtggtgcaggatttccgccgctggcagggcctgctggaaaacaccgaacacaccacgcttgccgaacagattctcgacgaaagcggctataccgccatgtggcaggccgacaagacggccgaagcaccgggacggcttgagaacctgaaggaactcatccgctcgatggaatccttcgaaagcatgcgtggatttctggaacacgtcgccctggttatggatgcggaacagaatgccgagctggatgccgtctccatcatgacgctgcattccgccaagggtctggaattcgacaccgtcttcctgcccggttgggaagaaggcctgtttccccaccagcgggcgctggacgaaggcggtcgctccggtctggaggaagaacgtcgtctggcttatgtcggcatcacccgcgccaagaagctctgccatatctggttcgtctcgaaccggcgcattcacgggctgtggcaatccaccctgccctcgcgtttcctcgacgaactgccgcccgcccatgtggatgtcgcggcttccgacagcaattatggcggttat

SEQ ID NO: 38578 - DNA, 411 bp, Agrobacterium tumefaciens
atcctcaatggtccgaacctcaatttgctcggccagcgccagccggagatttacggctacgagacgctcgccgatgtcgaggccgattgccgtgccatcgctgaagccgccggccacgagctgttttttgcccagagcaaccgggaatatgagctgatcgactggatccacgaagcccgcggcaagtccgcgggcatcgtcatcaatccgggcgcctttacccatacgtcggtggcgatcctcgatgcgctgaacgccttcgaggcgccggtaatcgaagtccatatttccaacatccacaaacgcgaggtcttccggcaccattcctatgtgtcgacccgtgccgaaggcgtgatcgccggtcttggcatcgaaggttatggggtggcgctacgccacctcatcaacctt

SEQ ID NO: 38579 - DNA, 828 bp, Agrobacterium tumefaciens; identical to SEQ ID NO: 38186

SEQ ID NO: 38580 - DNA, 732 bp, Agrobacterium tumefaciens; identical to SEQ ID NO: 35194

SEQ ID NO: 38581 - DNA, 837 bp, Agrobacterium tumefaciens; identical to SEQ ID NO: 35193

SEQ ID NO: 38582 - DNA, 768 bp, Agrobacterium tumefaciens
atttccggcaaacgcgccctcgttctcgcctcctctcgcggccttgggctgggcattgccaccgcgctggcgaaagagggcgcaaacgtccttctggttggccgaagcggtgaaaagctggcggaaaattgcaaggcgatcaatgcgctcggcaagggcaaggccgactgggtgtggggtgatcttgccgatgacaatttcgtcgaatccatggttcaggccgtcgaggacaagctcggcggcatcgatattctcgtcaacaataccggtggtccgacgcccggccttgcgcaggaaatgacggtcgacaagctcgacaccttcttccagtccatggtgctgcgggtcatcacgctgaccaacgcgctgctgccgcagatgaaggaacagggtttcggccgcatcctcaccgtcgcctcgtcaggcgtgttcgaaccgatccccaatctcgccctttccaacaccctgcgcggcgcgcttgtcggctggagcaagacgctgtcgtcagaagtggcctccttcggcatcacctccaacctgctgctgcccggccgcatccataccgaccgcatcgacgagctggatggcgccaatgccaagcgtctcggcaagagcattgaggaagtgcgtgaggcctccgtcaagggcattccggccggccgtctcggcacggtggaagaattcgccgccgccggcgctttcctctgctcggtgccggcgagctatattaccggcacgatgctgcgggtagacggcggcgccgcgaag

SEQ ID NO: 38583 - DNA, 750 bp, Agrobacterium tumefaciens; identical to SEQ ID NO: 35270

SEQ ID NO: 38584 - DNA, 1218 bp, Agrobacterium tumefaciens
gaggaatcctcgcgccagaatacgctgctgctgaaggaaatcgccgcccacaagaaaaccgacgccgcccttcaggacgccaaggaaacggcagaggccgccaaccgcgccaagagccgttatgtcgtcggcctcagccacgagctgcgcacgccgctcaacgccgttctggggtacgcccagatcctcgaacgtgacgagacaattcctgccccccggcaatcggccatcaaggtcatccgccgctccgccgatcacctttccggtctgatcgacgggcttctggatatctccaagatcgaggccggccgtctgcaggtctattccaacgagatcaatatcaaggacttcctcgatcaggtcgttgatatgttccgcccgcaggcgcaggcaaaggggctggaattccgccacgagcgcaccgccgctctgccgcaatatgtccgcaccgacgaaaagcggctgcgccagatcctcgtcaacctgctctccaacgccatcaagttcaccgatgagggcagcgtcaccttcgatgtcgcctatcgcagccaggtggcaagtttcaccgtctccgataccggccgcggcattgccgaaaaggatctcgcccgcatctacgaacccttccagcgcggcgaggccgaaagcgtgcggccgatgcccggcctcggcctcggcctcaccatcaccaggcttctgaccaacacgctgggcggcgaaatttccgtctccagcgaaaaggacaatggctccaccttccgcgtccgcctgatgctttccgccgtccaccggccaagcaccgcccctgcgccggaaaagaccatccgctcctattcaggcccacgccgcaccatcgtggtggtagacgacaacgaggatcaccgcgagctgatgcgacaggtgctttcaccgctcgacttcgtggtgcttaccgcccaatcaggccccgagtgcctcaccctcatcgaaggcgtgaaacccgatcttttcctcatcgatatttccatgcccggcatgaccggctggcagcttgtgacgaagctgcgcgaggctggtcagaccgcgccgcttatcatgctctcggccaatatcggtgatggggcggtcgcgggtgcgggcgacgacaaccacaatgacgccatcgccaagccggtcgatatccgtcacctgtgcgaccggcttgccgtccatcttggcctgaaatggatctacgagacg

SEQ ID NO: 38585 - DNA, 1470 bp, Agrobacterium tumefaciens; identical to SEQ ID NO: 38190

SEQ ID NO: 38586 - DNA, 1500 bp, Agrobacterium tumefaciens; identical to SEQ ID NO: 35445

SEQ ID NO: 38587 - DNA, 561 bp, Agrobacterium tumefaciens
gccgacctcagtgatatcgacgcgatcaagcgtacggtggatatggccgcctccgccaccggcggcatcaaggtgctggtcaacaatgccgcctgggacgaccgtcacgacatcgacagcgtcacagaggcctattgggacgccaaccaggcggtcaatctcaagcagatgttcttcacggttcaggctgcccttccccatctgcgacaggcgaaggatgcctcgatcgtcaatttttcgtctatctcgtttttgctgaacatgggcgagttgccttcctatgcagcggcgaaagccggcattatcggtctcaccaagagccttgccggcaggctggggccggaaaatatccgcgtcaacacgctcctgccgggcatgatcgtgacggagcggcagaaggaactgtggctgacggatgagggcattacggccaccacggcgcggcagtgcctgaagcgcacgctcgtcgctgccgatctttccgggccgtgcctgtttctcgcatcatcggcatcgagcgccatcacggcgcaatccattatcgtagacggaggcctgtta

SEQ ID NO: 38588 - DNA, 794 bp, Agrobacterium tumefaciens
gcctacacctatgtcgatcactcctatgacgtgatcgtggtgggcgccggtggcgccggtctacgcgcaacgctcggcatggcggaacagggtttccgcacggcctgcatcaccaaggttttcccgacccgctcccacacggtcgcggcgcagggcggcattgccgcatcgcttaccaacatgacgcccgactgttggcagtggcacctttacgacaccgtaaagggctccgactggctgggcgacgtcgatgcgatgcaatatctcgccatggaagcgccgaaggcggtctatgagctggaacattacggcgtgcccttctcgcgcaatgccgagggcaagatttaccagcgcccgttcggcggtcacatgcagaattacggcgaaggcccaccggtacagcgcacctgtgctgccgccgaccgtaccggccacgccattctgcacacgctctatggccagtcgctgcgcaacaatgcggaattcttcatcgaatatttcgcgctcgacctcatcatggcgccagatggtcgttgcacgggcgtcgttgcctggaacctcgatgacggcacgatccatcgattctccgccaagatggtggtgctggcgaccggcggttacggccgcgcctatttctcggcgacctctgctcacacctgcaccggcgacggcggcggcatgattgcccgtgccggcctgccgcttcaggacatggaattcgtacagttctcatccaaccggcatcttatggtgcagcctgcttcatcatcgaaggcgcgcgtggcgaattcagt

SEQ ID NO: 38589 - DNA, 912 bp, Agrobacterium tumefaciens; identical to SEQ ID NO: 38098

SEQ ID NO: 38590 - DNA, 2448 bp, Agrobacterium tumefaciens; identical to SEQ ID NO: 35157

SEQ ID NO: 38591 - DNA, 1056 bp, Agrobacterium tumefaciens
gacaatgagcgttaccagaaatggtatcaggagagcgtcgaggatccggaaaaattctgggacaagcacggccggcggatcgactggttcaagccctataccaaggtcaagaacacctcattcaaggggcgtgtgccgatcaaatggttcgaagacggcctgaccaacgtctcctataactgtatcgaccggcatttgaagacgcatggcgagcgcacggcgatcatctgggaaggcgacaatccctatatcgacaagaagatcacctataaccagctctatgattatgtctgccgtctggccaatgtgctgaagaagcacggcgttaagaagggtgaccgcgtcaccatctacatgccgatgattcccgaggcggcctatgccatgcttgcctgcgcccgcatcggtgccgtgcattccgtcgtctttggcggcttctcgcccgaagcgctggccggtcgtatcgttgactgcgaatcgaccttcgtcatcacctgcgatgaaggcgttcgcggcggcaagccgatcccgctcaaggaaaataccgacaaggcgatcgatatcgccgccaagcaatatgtcatcgtcaacaaggttctggtcgtgcgccgcaccggcggcaagaccggctgggcgccgggccgcgacatctggtatcatcaggaaattgcgaccgtgaagccggattgcccgccggtgaagatgcgggcggaagatccgctgttcatcctctacacttcaggctccaccggcaagcccaagggtgtgttgcacaccacgggcggctatctcgtctatacgtcgatgacgcatgaatatgtgttcgattacaaggatggtgaagtcttctggtgtacggccgatgttggctgggttaccggccattcctacatcgtctacgggccactcgccaattgtgcgacaacgctgatgttcgagggtgttcccaacttcccggatcaggggcgtttctgggaggtcatcgacaagcacaaggtcaatatcttctataccgcgccgacggcgctccgatcgctgatgggggcgggcgaccag

SEQ ID NO: 38592 - DNA, 1434 bp, Agrobacterium tumefaciens; identical to SEQ ID NO: 35289

SEQ ID NO: 38593 - DNA, 1515 bp, Agrobacterium tumefaciens; identical to SEQ ID NO: 38192
  unsure (1)..(1515): unsure at all n locations

SEQ ID NO: 38594 - DNA, 672 bp, Agrobacterium tumefaciens; identical to SEQ ID NO: 37855

SEQ ID NO: 38595 - DNA, 768 bp, Agrobacterium tumefaciens; identical to SEQ ID NO: 38097

SEQ ID NO: 38596 - DNA, 829 bp, Agrobacterium tumefaciens
ttcgtaaagaacaaggacggcgtcgaaatctatttcaaggactggggcccgaaggatgcccagccgatcgtgttccatcacggctggccgctgtcctccgacgactgggatgcgcagatgctgtttttcgttcagaacggttaccgcgtcgtggcgcatgatcgccgcggccacggccgttcgcagcaggtgagcgacggccacgacatggatcattatgccgccgacgcgtccgccgttgccgaacatctcgatctcaggaatgcggttcatatcggccactcgaccggcggcggtgaagtggcacgttatgtcgcgaaattcggccagccgcagggccgtgttgccaaggccgtgcttgtctccgccgttccgccgctgatgctgaagacgccttccaatcccggcggcctgccgatcgaagtcttcgacagcttccgcaagggcgtggccgagaaccgcgcgcagttcttcctcgacgtgccggccggtcccttctacgggttcaaccggccggatgccaaaatctaccccggtgtcatccggaactggtggcgtcagggcatgatgggcagtgccaaggcccattatgatggggtcaaggccttctcggaaaccgaccagactgaagacctcaaggcgatcacggtgccgacgctcgttctccacggcgatgacgaccaggtcgtgccgatcgcagattcggccgaattgtcagtcaaacttctgaagaatggcacgctgaaggtttacaagggctatcccgcatggcatgctgacgacccatgcggacgtcatcaaccccgatctgctggccttcgtgaagggc

SEQ ID NO: 38597 - DNA, 1083 bp, Agrobacterium tumefaciens; identical to SEQ ID NO: 38265

SEQ ID NO: 38598 - DNA, 1653 bp, Agrobacterium tumefaciens; identical to SEQ ID NO: 35377

SEQ ID NO: 38599 - DNA, 1403 bp, Agrobacterium tumefaciens
gaccgcctttcaaccttccccgctttcttccgggtcgagggacggcaggtcgctgttttcggaaatggcgatgaagccttcgcgaaggtgaggctgctcgccaataccaacgcgcatatcgttgcctatgccgatcacccggaagcggattttgcgcgttacatcagcgaaaacagtatcgatcaccgtgctctggccttcgccagcccgttggttgacgacgccaccctggtgttcgccgcaacaggcgatgaagcgctggatcgcgaaatcgtctctgtagcgcgcacgaagaaaatccccgccaatgcggtggatcagcccgaattctgcgacttcttcacgcctgcactcgttgcccgcgcgccagttgccattgccattggcacggaaggggcagggccggttcttgcccagatgatccgcgcgcgtatcgaccagatgctgtcgccgtcgctcggcaagctcgcacgtcttgcggtgcaatatcgtgatgcggccgaggagaacgtgccgaagggcgcgttgcggcgcaatttctggcgccggttcttttcgggcgcggttgcggatgccgttgctctcggtgatacctcttccgcccgtcatgccgcagatcgcctgctgcaatcgccggaacgcagcgaaggtcgcgtctggcttgttggcgccggtccaggtgcagaagatctgctgacgctgcgcgcgcagcgcgtgttgatggaagccgacgtgatcgtctacgacgccctggtgccgcaggcgattgtcgatatgggccgccgcgatgctgaaaggctctctgtcggcaagcgcaagggctgccacagcaagtcgcaaaatgatatcaaccgcctgctggtgcgtctaggcctggaaggaaagcgagtcgtgcggctcaaatccggtgatccgctggtctacggccgcgcgggcgaggaaatggcagcgctgcgcgaggctggtgtcgcttatgaaatcgtgccgggcatcacctccgcctttgccgcggctgcggatttcgaattaccactgacgctgcgcggtgtcgcctcttcgctgattttcaccactggtcacgacctgatgggcgacgttctgcctgattgggcacgacttgccgtctccggggccaccattgccgtctatatgggccgcagtgttgccgcttcggtggccaagcggctgattgatgcgggacttggcgtcgaaaccaccgtcgccgtcatcgaaaatgccagccgcgcggatcgccgcctgctgcacggcacattaaacgatttgcccgacctcgaatatcgtgatgaactgatcggcccggtcatggtcatcatcggcgatgcggtggcgggcgctaatttcgacagatccgaggcgcttgcgcttgcagccaagccggcgag

SEQ ID NO: 38600 - DNA, 795 bp, Agrobacterium tumefaciens; identical to SEQ ID NO: 35477

SEQ ID NO: 38601 - DNA, 879 bp, Agrobacterium tumefaciens; identical to SEQ ID NO: 38145

SEQ ID NO: 38602 - DNA, 735 bp, Agrobacterium tumefaciens; identical to SEQ ID NO: 38196

SEQ ID NO: 38603 - DNA, 1785 bp, Agrobacterium tumefaciens
ggtatcgccccggcgatcgcgcaggcgttggaaaaacgcggctacaaagacttgacccccgtacagcaagccatgcttgcgcccgaacttgccaacaaggacgcgctggtttccgcgcagaccggctccggcaagacggttgccttcggcatagcgcttgcgaccacgctgctgtcggaaaatacacgcttcggtcaggcttccgcaccgctggcgctggcaatcgcacccacccgcgaactggccatgcaggtcaagcgcgagctggaatggctttatgaattcgccggtgtctccatcgcatcctgcgtcggcggcatggatatccgcaacgagcgccgggcgctggagcgcggcgcccatatcgtcgtcggcacgcctggtcgcctgtgcgaccatatcaagcgcaatgcactcgatctgtcgtcgatccgcgccgtggtgcttgacgaggccgacgagatgctcgatctcggcttccgcgaagatctggaattcattctggaagaatcgcccgacgatcgccgcacgctgatgttctcggccaccgtgccgcgcagcatcgccaagctggccgaaagctaccagaagaacgccgtgcgcattgccaccgcttccgaacagaagcagcatgtcgatatcgaatatcgcgcgcttctggtgtcgccttccgatcgcgagaacgccatcatcaacgcgctgcgcttttacgaagcccgcaacgccattgtgttctgctccacccgcgccgcggtgaaccacctgacggcccgcctgaacaatcgaggcttctccgtcgtggctctctccggcgaactgacccagaacgagcgcacacatgccctgcaggccatgcgtgacggccgcgcccgcgtttgcgtggccaccgacgtagccgcccgcggtatcgacctgcccggcctggaactcgttatccatgccgacctgccgaccaattccgaaacgcttctgcaccgttcaggccgtaccggtcgtgccggccaaaagggcgtcagcgccatcgtggtaccggtcagtcagcgccgcaaggccgagcgcctgcttgagggcgccaaggtcagcgccgcatgggtgcgcccgccttcggttgaagagatcgtggagcgcgatggcgcacgccttctggccgacccgacgctcagcgaagcggtaacagatgacgaacgcgatttcgtcaacaagctgcttgaacagcacggcgcggaaaaagtcgccgccgcctttgtgcgcctttatcattcgggacgttcggcaccggaagacattttcgaagtcgcgctcgacaacactcgcaagccccgccgcgacagcttcgaaacaaccgaaaacaacgcgccgcgccgcgaccgctccgatttctccgacagcgcatggttctcgctgtccgttggccgaaagcaaagcgccgagccgcgctggcttatcccgatgctgtgccgcttcggcaagatcacccgccaggatatcggcgcgatccgcatgcagcagacggaaaccttcgtggaacttgcggccgacgccgtcgaccgttttacctccgccatcggcaaggacatgatgctcgaaaagggcattcgcctgaagcagatggaaggcaagccggaaatgaccggcaacgcccgtgaagacacaaggcccgccacagcgcagcgcaaattcacgaaatccgacaatgcgggcgctccccgagacgaccgcaaggctgacgacaagccctggaaaaagaaaaaagccttcggcgacaagccgaaatacgaaggcaag

SEQ ID NO: 38604 - DNA, 2205 bp, Agrobacterium tumefaciens; identical to SEQ ID NO: 38267

SEQ ID NO: 38605 - DNA, 1260 bp, Agrobacterium tumefaciens
atggctcgcattgtcatgaaattcggcggcacgtccgtcgcgaacctcgaacgtattcacaatgtcgcacggcatgtgaaacgcgaagtggatgccggccatgaagtggccgtggtcgtttccgccatgtccggcaaaaccaatgagctggtggactgggtgcagaatgctgcgaaggtggccggcaccaatgccgcctccttttatgatgcgcgcgaatatgacgcggttgtcgcctccggcgagcaggtgacctctggccttctggcaatcaccctgcaatccatgggcatcaacgcacgctcctggcagggctggcagatcccgatccgcaccgacaatgcgcatggcgccgcccgcatcctcgagatcgacggttcggatatcgttcatcgcatgggtgaggggcaggttgccgtggttgccggtttccagggcatcggcccggataatcgcatcgcgacgctcggccgcggcggctcggatacgtcggctgtcgccatcgccgctgccgtcaaggcggatcgttgcgatatctataccgatgtcgacggcgtctacaccaccgatccgcgcatcgagcccaaggctcgccgcatgaagaagatcgccttcgaggaaatgctcgaaatggcgtctctcggcgcgaaggttctgcaggttcgctcggtcgagcttgccatggtacacaaggtgcgcaccttcgttcgctccagtttcgaggatcccgatgcgccgggcatgggcgacctcatcaacccgcccggtactttgatttgtgacgaggatgaaatcgtggaacaggaagtcgtaaccggcatcgcctatgccaaggatgaagcacagatttcgctgcgtcgcgtcgccgaccgtccgggcgtctccgccgcgattttcggaccgctcgccgaagcgcatatcaacgtcgacatgatcgtgcagaacatctccgaagatggctcgcgcaccgacatgaccttcacagttccttcgggcgacgttgccaaggctctgcgcgttctggacgagaacaagggccagatcggcttcgacgtcgcgcagaacgaaacgggcctcgccaaggtttcggtcatcggtatcggcatgcgcagccacgccggcgttgccgccagcgcgttcaaggcgctggccgagaagaacatcaacatcaaggcgatcaccacttccgaaatcaaaatttcgatcctgatcgacggcgcctatgccgaacttgcggttcgcactttgcattccgcttac

SEQ ID NO: 38606 - DNA, 294 bp, Agrobacterium tumefaciens; identical to SEQ ID NO: 35446

SEQ ID NO: 38607 - DNA, 1662 bp, Agrobacterium tumefaciens; identical to SEQ ID NO: 35265

SEQ ID NO: 38608 - DNA, 729 bp, Agrobacterium tumefaciens; identical to SEQ ID NO: 35046

SEQ ID NO: 38609 - DNA, 1005 bp, Agrobacterium tumefaciens; identical to SEQ ID NO: 35214

SEQ ID NO: 38610 - DNA, 876 bp, Agrobacterium tumefaciens; identical to SEQ ID NO: 38147

SEQ ID NO: 38611 - DNA, 540 bp, Agrobacterium tumefaciens; identical to SEQ ID NO: 35122

SEQ ID NO: 38612 - DNA, 732 bp, Agrobacterium tumefaciens; identical to SEQ ID NO: 37965

SEQ ID NO: 38613 - DNA, 1758 bp, Agrobacterium tumefaciens; identical to SEQ ID NO: 35441

SEQ ID NO: 38614 - DNA, 1404 bp, Agrobacterium tumefaciens; identical to SEQ ID NO: 38132

SEQ ID NO: 38615 - DNA, 1905 bp, Agrobacterium tumefaciens; identical to SEQ ID NO: 37924

SEQ ID NO: 38616 - DNA, 576 bp, Agrobacterium tumefaciens
gattgggatcaggtcgaccagaacccgttcttctgccctgatcccgagatggtgcccgtctgggaagagtatctcgatggtatccgcaagtccggctcctccatcggcgcggtggtcgaagtggtggcggaaggggttccggccggcatcggcgcgccgatctatgccaagctcgatcaggatatcgcctccagcctgatgtcgatcaacgccgtcaagggcgtggagatcggcgaaggttttgcctcggccgagctttccggcgaggaaaatgccgaccagatgcgcatgggcaatgacggcaagccgattttcctctccaaccatgccggcggcattctgggcggcatcgcgaccggtgagcctgttatcgcccgcttcgccatcaagcccacctcctccatcctgacggagcgcctgtccatcgataccgatggcaacaatgtcgatgtgcgcaccaagggccgccacgacccctgcgtcggcatccgcgccgttccgatcggtgaagcgatgatcgcctgcaccgttgccgaccattacctgagagaccgcggccagaccggccgactgaaa

SEQ ID NO: 38617 - DNA, 855 bp, Agrobacterium tumefaciens; identical to SEQ ID NO: 38271

SEQ ID NO: 38618 - DNA, 2460 bp, Agrobacterium tumefaciens; identical to SEQ ID NO: 38464

SEQ ID NO: 38619 - DNA, 1260 bp, Agrobacterium tumefaciens; identical to SEQ ID NO: 35063

SEQ ID NO: 38620 - DNA, 1440 bp, Agrobacterium tumefaciens; identical to SEQ ID NO: 35062

SEQ ID NO: 38621 - DNA, 1626 bp, Agrobacterium tumefaciens; identical to SEQ ID NO: 38467

SEQ ID NO: 38622 - DNA, 1869 bp, Agrobacterium tumefaciens
  unsure (1)..(1869): unsure at all n locations
cccaaaggcgcaacccgaacggaaaacggagtggagttcactgtctattcccgccacgcctcgcaaatcgatctctgcctgttcgatgacgctggcgagaaagagacggcgcgcctgccgatgatgcgcggcgaagacgacgttcatcggctcacacatgagaatgccgggcccggcacgcgatacggcttccgtgcccacggcatttacgcccccgaacatggcctgtggtttgatcctgcaaagctgctgctcgacccctatgccaccgagatcgaccgccccttccggcacgatccctcgctttatgcctttggcgctgaaaccggcgcgatcatgccgaaggcgatcctttccgcgcatgacccggtcaagcgccagccgcctcgttttgccgaaggcgggttgatttacgaacttgccgtcaaatccttcacccagctgcatccttatgtgcctgaagatatcaggggcaccgtcgcggcactggcgcatcccgccattctcgcgcatttgaaaaaaatcggcgtcgatgctgtggaattgatgccgattaccgcctggatcgacgaacgccacctgccgccgctcgggctttccaatgcctggggttataatccggtcggcttcatcgcgctcgatccgcgcctctgccccggcggtgtgcgggaacttcgcgacaccgttgcagctttgcatgcggaaggtattggcgtcattctcgatctggtcttcaaccatacgggtgaaagcgatatcgaaggctcgattctatcactgcgcggcctcgataatctcaccgctttccgtcacccgcagggaaagccgggcgtgctggtcaacgataccggcaccggcaatacggttgcctgcgaccacccctatatccgccagctcatcgtcgattcgctgcggcatttcgttctcaacgccggcgtggatggcttccgtttcgatctcgcgcccgtgctcggcagaacagccgcgggtttcgacatggcgagcgagacgctggccgccatgcattcggacccggtgctttacgaccgcctgctgatcgccgaaccctgggatatcggccccggcggttatcaactcggcaatttccctgagagtttcctggagtggaacgaccgcgcccgcgatgacatgcgccggttctggcgtggcgatgccggcacgaccggggcgcttgccaatgcgctgtccggctcctcgccgatcttttcccgccatggccgcttaaaaagtcgcagcgtcaatttccttgccgcccatgacggtttcaccctgttcgatctcgtcagccatgagcgcaagcacaatgaaaagaacggcgagaacaatcgcgacggccacaatgacaaccattcctggaacaatggttttgaaggcctgaccgatgatcccgccattgtcgccgcccgccttgcggatgtgaaagcgctgctttccacgcttttcgtcagccgcggcaccctgatgttgacggcgggcgacgagggtggccgcagccagcagggcaatancaatgcctattgccagnacaatgagatcagctgggtcgactggtcatcgcttgtccctgagttgatcgaccacacggcgtttctcgccgcactgcgcaagcgcttcggtgtgttttctgagagtggcttcttctccggcaggggcgacgtgacatggcttgccccgggcggcgaaccgatgacggttgctgactgggagaggccggatgggcaggccttcgccatggtgctttccaccccggaccgggaaaccggcaaagctaccgagcttgccgtgctcatcaatcgcggccgtgacatcgttcccttcaccttgccgggcgatggttggcgctccatc

SEQ ID NO: 38623 - DNA, 903 bp, Agrobacterium tumefaciens; identical to SEQ ID NO: 35059

SEQ ID NO: 38624 - DNA, 714 bp, Agrobacterium tumefaciens
aaggttgctatcatcaccggcgcgtcatccggcatcggccgggcgacggcgatgctgtttgtcacgcaaggcgcggcagtcgtcatcaatgcgcgcggtgaaaaggcgctgcaggaggttgcagccgacattcgtgatgccggcggccgtgtccatgcggttgcgggcgacgccggtgttgcggaaacccattcccggttggcggatgcggccgtgggcgttttcggtggcctcgatatcgccatcaataatgccggggcggtgggggctatgaagccgctggcggagatttcgcccgaggagtgggatcatgtcctcaacgtcaatctcacctccgcctttctgggggcgcgttaccagattccgccgatgctgaagcggggcggcggttccatcgtctttacgtcgagcttcgtcggcaccagcgccggcattcctggcatgtcggcttatggaactgcgaaggcagcgttaatggggctggtgaagggcattaccgccgattatgcgatcaatggcattcgcgccaatgccctgctccccggcggggtcgatacaccggccgcaggagacccggcgcagaaggaatgggccgccggcctgcatgcgatgaagcgcattgcccagcccgaggaaattgcgcaggccgctcttttcctcgcaagcccaatggcaagcttcgtcgccggggccgcattgtttgccgatggcggc

SEQ ID NO: 38625 - DNA, 498 bp, Agrobacterium tumefaciens; identical to SEQ ID NO: 37995

SEQ ID NO: 38626 - DNA, 1395 bp, Agrobacterium tumefaciens
ctgaaggatgtggtggcgggcaagcggaacgaagagggtatcgcgtctgcgctcgcggtgctgaagcagcagctgggcgataagctccagacgggccaggcgtttcgcgagcagcatggccataccaccacctacctgaccctgcaggcgcccgacggtgtcgtttttgccgaaagcgccgatgatgtgaaggccgtggtaaaggcctgcgcgcaatacaaggtgccggtcattcccttcggaacgggatcttcgctcgaagggcaggtcaacgcgcccaatggcggaatatgcatcgatttcagccggatgaatcgcatcattgaggtgaatgccgaagatcttgacgtgacggtggagcccggcgtgacgcgcgaggatctgaatgtctatctgcgcgataccggcctgttctttccgatcgatcccggcgccaatgcttcgattggcggcatggcctcgacgcgcgcttccggcaccaatgccgtgcgttacggcacgatgaaggacaatgttctggccgtcaccgccgttgtcgccaatggtgaggaaatccgcactgcgcggcgcgcccgcaagtcgtccgccggttacgacctgacgcggcttttcgtgggggccgaaggcacgctcggtgtcatcacctcggtgacgctgcggctgcagggcattccggaaaagattaccggcggtgtctgcaccttcgacagtatcaaggcggcctgcgatgccgtcatcatgacgatccagatgggcgttccggtcgcccgcatcgaattgcttgacgaggtgcaggtgcgcgcctgcaatgcctattccggtctgaactatgcggaaaagccgacactcttcgtggagttccatggcaccgaggagacggcggcgctgcaatcgcagcagttcgccgagattgcagccgaatgcggcagcgtcgatttccgctggacgggcgatgcggcggagcgcaacaagctgtggaaggcgcgccacgacgcctattgggcgtcgcgggcgctggcaccacatctcgacgggctttccaccgatgtctgcgtgccgatttcacggctggccgattgcgtcgtggaaacgcagcgggatattgccgagaacggctttctggcgccgatcgtcggccatgcgggtgatgggaacttccatgtgcttattctgtttgatggcaaggacgccgaaagcgttgcgaaaacagaggcctttgttgcccgtctcaaccgccgcgccattgccatggacggcacatgcaccggcgaacatggcattggccagggcaagatgagttttcttgccgaagaggcaggaaatgcactggatctcatgcgcgccatcaaaacgtcgctcgaccccgataacatcttcaatccgggcaaattgttt

SEQ ID NO: 38627 - DNA, 729 bp, Agrobacterium tumefaciens; identical to SEQ ID NO: 38470

SEQ ID NO: 38628 - DNA, 672 bp, Agrobacterium tumefaciens; identical to SEQ ID NO: 38471

SEQ ID NO: 38629 - DNA, 711 bp, Agrobacterium tumefaciens; identical to SEQ ID NO: 35428

SEQ ID NO: 38630 - DNA, 1407 bp, Agrobacterium tumefaciens; identical to SEQ ID NO: 35237

SEQ ID NO: 38631 - DNA, 753 bp, Agrobacterium tumefaciens; identical to SEQ ID NO: 37902

SEQ ID NO: 38632 - DNA, 906 bp, Agrobacterium tumefaciens
attgtttccatacggaatctgacaaaatcctacgcaaatggctttcaggcgctcaaaggcgtcagcctcgatattaaagagggggaaatccttgcccttctcggcccgaacggtgccggcaagacgacgctgatttccatcgtctgcggcctcgtcaatccgggggaaggttcggtgcttgtcggcggccacaatgtggtgaaggattttcggcagacccgcgcgcttatcggcctcgtgccccaggaactgacgacggacatgttcgagactgtgtggaacacggtcagcttctcgcgcggcctgcacgggcagaagaagaacccggcgctgatcgaaagcattctgaagtccctgtcgttgtgggacaagaaagacaacatgctgcgggaactttccggcggcatgaagcgtcgtgtgttgatcgccaaggcgcttgcgcacgagcctaaggtgcttttcctggatgagccgaccgccggcgtggatgtgaccttgcgccgcgacatgtggaatgtcgtttccgagctgcgcgccaagggcgtcaccatcattctgacgacgcattacattgaggaggcggaagaaatcgccgaccgggtgggtgtcatcaacggcggcgaattgctcctcgtggaagaaaagaccgcgctgatgaagaagctcggccgcaaacagctctttcttgaactgacgcaaccggtggaacggttgcctgacagtctcgccccctttgccctgacgctttcggacgaccgcagcacgatcacctacgaaatcgagggaaatggcgagcagggacgcatcgccgatctcctgggcgctctttctgccgccaacatccatttcaaggatatttcgacgcggcaaagctcgctcgaggatatcttcgtttcgctggtcgga

SEQ ID NO: 38633 - DNA, 1077 bp, Agrobacterium tumefaciens; identical to SEQ ID NO: 35370

SEQ ID NO: 38634 - DNA, 2220 bp, Agrobacterium tumefaciens
atgagctgctgcgcaccgggaacggaaggttcgctggagctcggcgaaccgcttaatccgccatcgtcggaggagttgctgctggcgagccgcgatctggggcaggggttgcgccagaccgatcttagcgtgcccggtgtttattgcggcgcctgcatcaccaccatcgagaccgcgctcggccgtctcggccaagtggagcgggcgcgggtgaacctgtcttcgaaacgtgtggcggttgtctggaaagaagaggtcaatggcgtcaggaccgatcccgccgacattgcccgcgccatccttgcgacgggatatcgcatacatcttttcgccagcgggcaggatgcttcatacgccttgcgctcgcagctgatcagggcggtggcgctgtgcggctttgcttccgccaatatcatgcttctgtcggtctccgtctggtcgggggcggatgccgcgacgcgtgacatgttccactggatatcggcgatgatcgccgcgccggcgctgatctatggcgggcgtttcttttaccagtcggcctggaacgcgctgaaacacggccgcaccaacatggatgtgccgattgcgctcgccatcacgctctcctatgccgtttcgctgtgggagaccattcatcacggcgaacatgcgtggttcgatgcgaccgtgtcgctgctgttcttcctgctgatcggccgcacgctggaccatatcatgcgcgacaaggcgcgctccgccattgccggattggcccggctttcgccgcgaggggcaacggtgatcgatgcagacggggtccgggactaccggccgcttgcggatatcgaacctggaatgtcgattgcgattgcggcgggtgaccgggtggcggtggatgccgtggtggtctgcggcagcagcgatctcgacatgtccatcgtcaatggtgaaagcgcgccgcgccgcgtcgtggccggcgacagcctgcaggccggcacgctcaatctcaccgggtcgcttgtcgcccgggtaaccgcgtccgcaaaggattctttcctgtcggaagtgatcgggttgatggaggcggccgaaggcgggcgcgcgcgttaccggcgtatcgccgaccgtgccgcgagctattattcgcccgtggtgcatcttctggcgctggtgacgtttctcggctggggcattttcggcggtgactggaaacaggcgatgctgatcgccattgctgttctcatcataacctgcccctgcgcgctcggccttgctgttccagtcgtgcaggtggtggccgcaggaaggctttttcggcgtggcatcatggtcaaggaaggctcggccatggagcgtctttcggagatcgataccgtgctgttcgacaagaccgggaccttgaccgtcggcaagcctaggctggtcgagaccgcagatgtgaagccggccatcatggcgattgcggcggggctcgctgcccattcgcgccatcctctctcgaaagccctgcatgccgcctataatggtgccttgccagcctatgaggcggtgcgggaaattccggggtcgggtgtcgaggccgagacggaagccggcacttaccggctcggcaatcgccgtttcgcctgcccggatgagacacggatcaacaatggcgatgcgcggtcggaagtggtgctgtctctcgacggccggcatctggcgagcttcggcttcgaggacaatccgcgcgcgggtgctattgcggcattgcgcagcctgtctgtgcggggccttgcgcaggaaatcgtctcgggtgaccgggccgccgccgtcagtgcgatggcgcagcggctggggatcggcaactggcgcgcggacctgtcgccgaaggacaaggcggcgcgctgtgccgcgcttgccggcgaggggcacagggtgctgatggtcggggatggtatcaacgacgcgccagcgcttgccgccgcccacgtatctatggcgcccgccaccgccgccgatattggccggcaggccgccgatttcgtgtttatgcaggaagatctcgatgccgtacctttcgcgatcgagacgtcgcagcgagccggcaacctcatccggcagaactttgcgcttgccatcggctacaatatcatcgccgtaccgattgcgattgccggttatgcgacgccgatgattgcggccattgccatgtcgacatcttcgctgatcgtcgttgccaatgcgctgcgccttgccggt

SEQ ID NO: 38635 - DNA, 1005 bp, Agrobacterium tumefaciens; identical to SEQ ID NO: 35371

SEQ ID NO: 38636 - DNA, 1182 bp, Agrobacterium tumefaciens; identical to SEQ ID NO: 38037

SEQ ID NO: 38637 - DNA, 897 bp, Agrobacterium tumefaciens; identical to SEQ ID NO: 35463

SEQ ID NO: 38638 - DNA, 1113 bp, Agrobacterium tumefaciens
cgaggcgagggcgtctggcttttcacggaaagcggcgagcgatatctggattttgcggccggcgttgcggtcaactcgctgggccacgcccacccgcacctcgtggaagcgatcaagacccaggccgagaaggtctggcacgtctccaacctctatgaagtgcccggacaggaaaagcttgcaaagcgactgacggaagcgacatttgcggacaaggtctttttcaccaattccggcgcggaagcgctggaatgcgcgatcaagaccgcgcgccgttaccattattccaagggacatccggaaaagttccgcatcatcacatttgaaggcgccttccatggccgcacgctggcgacgatcgccgccggcggccagcagaaatatctcgaaggtttcggtcccaaggtcgaaggttttgaccaggtgccgttcggtgatgtcgatgcgctgaaggctgccatcacggccgagacggccgcacttctgatcgagcccattcagggcgagggcggcatccgcgcgccggccaaggaattcctgcagctgctgcggtcgctttgtgatgagcacgacctgctcctgattttcgatgaggtccagaccggcgttggccgcacgggcaaattttttgcctatgagcagactggtgtcgcgcctgacatcatggcggttgccaagggtatcggcggcggtttcccgctcggcgcgtgccttgcaacggcggatgccgcttccggcatgacggccggcgtgcacggcaccacctatggcggcaatccgctggccatggcggtcggcaatgccgtgctcgacgtcgttctcgctgacggctttctcgaaaaggtccgtgatgtcgcactggttttccgccaggggcttgcctcgctgaaggatcgttatcccgatgtcatcgaggaaattcgcggcgaaggcctgctgcttggcatcaaggccagagttccctcgggtgagctgctgcaggccatgcgtgcggaacatctgctcggcgtaccggcgggagacaacgtcatccgccttctgccgccactcgttacgacggcggaagaggctcgcgaagggttggcacgcgtggaagcggcagccgcatccctg

SEQ ID NO: 38639 - DNA, 732 bp, Agrobacterium tumefaciens
ttgcaaggtaaaatcgctgtcatcaccggcgcttccaaaggacttggcgcggcaattgcgcgaagtttcgccgcagagggtgcatcagtcgtagtaaactactcgtcaagcaaatctgcggccgaagcagttgttgaggagatcatcgacgctggtggcacagccatcgccgtgaaggccgacatgagtgagcccgcggaagttgaagagctgtttgcggcaacaaacgcagctttcggccgcgttgacatcctggtcaacaacgccggtgtctatgacttccagccgctggaaaacctgtctatcgatctgttccgcaagcatatggagcttaatgtctttggctacctgctcgcgatcaaagaagctgtgaaatacatggcggagggcggcagcattgtgaacatgtcctcgacggtaacgattttcggcccagaaaacgcatcggtctatacggcaagcaaaggtgcaatcgacggtttgacgcgcgcgttgtcaaacgagctcgccccccgcaagattcgtgtcaacgcaatcaagcccggcgtggtcgacactgacggcgtgcaggccggaggctttctccactttgacttcggccccatgatcatggcgcagacgccgctcaagcgtctcggcgttcctgaggacattatacctgcagcgattttcctcgcatcggacgaatcgagctggacgactggcgaatttttcatcctcgccggtggccat

SEQ ID NO: 38640 - DNA, 954 bp, Agrobacterium tumefaciens
atgaaggcagccgtttacgatcaagcaggacctccggatgttttgacgtacagggacgtcgccgacccgattgtaggtccggatgatgtcctcatcgcagtggaagccatttcgattgaaggaggagacttgatcaatcgtcgatccacgccgcctcctggccgcccgtggatagtcggctatgcagcatctgggcgcgtcgtgggggccggtgcgaacgtgagggaccgcaaagtcggagacagggttactgcctttgacatgcagggttcgcacgccgaactctgggccgtgccagcgatccgaacgtggcttttgccatccggcgtggatgcagcgtcggctgccgctttgccgatatcgtttggtactgcccaccattgtctttttgccagaggtggccttctgcgcaaccagacggttcttgtacaggcagcggcgggtggagttggcctcgccgcagttcagctcgcggctcaagccggcgcaaccgtcatcgccgtctcaagtggagaaagccggctgcaaaggatatcttcccttggggctgatcacgttgtcgatcggtcgatggggaacgttgtcgaggctgtcagacagaacacgggaggcaaaggagtcgatctcgtgattgatcctgtcggtgtcaccttgtccgcttctctgactctcctggcaccagaaggacgtcttgtgtttgtgggaaacgctgggggcggaagcctgaccatcgatctgtggccagccatgcagtcaaatcagactttgctcggagttttcatgggcccgctattagagagacctcaggttcgtgcgacggtagatgagatgcttcaaatgctcgatcgtcgcgaaatccgtgtgatgatcgaaaagacgtttccgctctcggaagcggcagccgctcatgattttgcagaaaatgcgaaaccgcttggccgggtgattatggag

SEQ ID NO: 38641 - DNA, 831 bp, Agrobacterium tumefaciens
gatctttttgtcatcggtggcggcatcaatggctgcggcattgcccgcgatgcggtgggcagggggtattccgtggcgcttgcggaaaagggcgattttgcctctggcacctcgtcagcggccaccaagctcatccatggcggcttgcgttacctcgaacattatgaattccgcctcgtacgcgaggcgctgatggaacgggaaatcctctgggccatggcgccgcatgtcatctggcccatgcgtttcatcctgcccgtgcagaagggcggcgtgcgtccatcatggatggtccggctcggcctgtttctttatgacaatctcggcggccgcaagctcttgccgccgacgcggacgctcgatcttcgcaaggacccggctggcaaaccgctgaagcctgttttcgccaaggctttcgaatattccgacggctgggtggatgatgcccgtttcgtggttctcaatgcacgcgatgcggcggatcgtggcgcgacgatcatgaaccgcacacgggttgtttcggcgcggcgcgaaggcaggctgtggctcatcgagacgctggacgaaaaaaccggccggccggccatgcacaaggcccgcatgctggtcaatgccgccggcccgtgggtggacaatgtgctgtcaggtgtgttcggccgcaatgacgtgcacaatgtccgcctcgtgcagggtagccacatcatcgtgcgcaggaagttttccgatccgcgcgcctatttcttccagaatccggacaaccgcatcatcttcgccattccctatgagcaggattttacgctgatcggcaccacggaccgcgactataagggc

SEQ ID NO: 38642 - DNA, 1440 bp, Agrobacterium tumefaciens; identical to SEQ ID NO: 35475

SEQ ID NO: 38643 - DNA, 804 bp, Agrobacterium tumefaciens; identical to SEQ ID NO: 38203

SEQ ID NO: 38644 - DNA, 906 bp, Agrobacterium tumefaciens; identical to SEQ ID NO: 35234

SEQ ID NO: 38645 - DNA, 753 bp, Agrobacterium tumefaciens
ctgttcgatctttccggtcaggtggcgctcgtcaccggtgctggatccggcatcggccagcggatcgccatggggcttgcccagtccggcgccaatgtcgcgctgctcgaccgccgcaccgatgacggtctggcgcagacggccgatttcatcgccagggccggccgcaagtcgatccagatcgccgccgacgttaccagcaagcaggcgctgacggatgcggttgcccgcacgcaagccgaactcggcgcactttcgctcgccgtcaatgcggccggcatcgccaatgccaatccggccgaggagatggaagaaagccagttccagacgatgatggacatcaacctgaagggcgtgttcctgtcctgccaggccgaagccaacgccatgctgaaaaatggccgaggtgccatcgtcaacatcgcgtcgatgtccggcgtcatcgtcaatcgaggcctgatgcagtgccattacaacgcctcgaaggcgggtgtcatccacatgtcgaaatccatggcgatggaatgggtgggtcgcggcatccgcgtcaacaccatctcgccgggctacacggcgacaccgatgaacacgcggcctgaaatggtgcaccagaccaagctgttcgaagagcagacgccgatgcagcgcatggcaggcgtcgatgaaatggtgggaccggcgatcttcctgctgtccgacgccgcgagttttgtgacgggtgtggatctcttggtggatggcgggttctgctgc

SEQ ID NO: 38646 - DNA, 1350 bp, Agrobacterium tumefaciens; identical to SEQ ID NO: 35424

SEQ ID NO: 38647 - DNA, 2499 bp, Agrobacterium tumefaciens
gtggaaggcatgacctgcgcctcctgcgtgcggcgtgtggaaaccgccgcggccaaggtaccgggtgtcgcttcgagctcggtgaacttcgccacgaagaagcttaccgtcgagccggccgaaggattctcagccaggacgctcggcgcggccatcaagaaggtcggttacgatatcgcgccggagcggcaggaatttgcggtcgacggcctgcacggcgaggcagaggccgagcgactgaaggccgttctgaacgccgtcgcgaccacagtcaacgtgaaggttgatgctgccgccggcaaggtcgcggtggaaaccatcggcggccggcgggagcgggatgcgctggtggaaacggcgaagcttgccggctttgcgttgaagacaccgaaaccgcacggacattccgcccatcacgatcacggccagcaccatgcacaccatcagggccacagccagatgacggcggccggtgaaagcggcggccatgaccatatgcaacatgccggcgaggagggcgcgctgaaacgcgacctgacgattgccgcgatcctgaccgcgccgcttttcgtgttggaaatgggcggccatatttatgagccgatgcatcactggctgatgggcatcatcgagacacagaacctctattacatctatttcgtgctggcgacggcggtgattttcggaccgggactgcgcttcctcaaggccggttttcccgctttgctacgcggcgcgccggaaatgaactcgctggtggcgctgggtgtcacagcggcctatctctactccgtcgtggcgaccttcgcacccgatctgctgccggcagaggcgcagttcgtctattatgaagcggcaaccgtcatcgtgacgctgatcctcaccgggcggcttctcgaagcacgcgccagcggccgcacgggagacgccatccgcaagctgatgagcctgcaggcgaagactgcccgggtggagcgcgacggtgccaccatcgatatttctcccgatgatctggtggccggcgatatcatcgtcatccgtcccggcgaaaggctggcagtggatggtgaagtcgtcgaaggctcgtcgtatgtcgatgaatcgatgatttcgggtgaaccagtgccggtggaaaagacggtcggcgcaactgttgtcggcggcaccatcaacaagaccggcgccttcaagttcaaggcgaccaaggtcggcgccgataccatgctgtcgcagatcatccgcatggtggaggaggctcagggctccaagctgccgatccagctgctggtggaccgtgttaccgccctgttcgtgcccgtcgtcatcgccattgcggtgcttaccttcatcgtctgggcgatcttcggtcctgagcccgcctatacattcgcgctggtcaatgctgtcgcggtactcatcatcgcctgcccctgcgccatgggtctcgccacgccgacatccatcatggtcggcaccggaagggcggcggagctgggcgtactgtttcgcaaggggcaagccctgcaggaactgcgctcggcgcagatcgtggtggtcgacaagaccggcacggtgaccaagggccgcccggaactgaccgatctggtggttgcggaaggatttgccgataacgaagttctggcgctggttgccgctgttgagggccgctcggaacacccgatagccgaagccatcgtccgggctgcggaagaaaagaatgtggcgactcctgcaggactcgcgcctaccactgtcgagaacttcgaaagcgtgacgggctacggcatcgcggccaccgtcaatggccgcaaggtcgaagtcggcgcggatcgctacatggcgaaactcggccattccgtcgatatcttcgctgaagccgccgcaaggctgggcgacgagggcaagacaccgctttatgccgccatcgacggcaggttggcggctgcgatcgccgtcgccgatccgttgaaaccctcgagcgtcaccgccatcaaggcgttgcaggcgatgggcatcgaagtggcgatggtgacgggcgacaatgaacgcacggcgaacgccattgcccggcaggtcggcatttcccgcgtcgtggcggaagtcttgcccgagggcaaggtgaaggcgatccacgaaatgcgcgccggcggcaaggtgctggccttcgtgggtgacggcatcaatgacgcaccggcgctcgccgaggccgatatcggcatcgccgtcggcaccggcacggatgtcgccatcgaaagcgccgatgtggtgctggtcggcggcgatcttctaggcgcagtcaatgccatcgagatgagccgggcgaccatgcgcaacatcaaggaaaacctgttctgggcctttggttataacgtggcgctgataccggttgcggcgggtgtgctttatcccgccttcggcatcacgctgtcgccgatgatcggcgcgggtgcgatggcgctgtccagcgtcttcgtccttgccaatgcgctgcggttgaaa

SEQ ID NO: 38648 - DNA, 1038 bp, Agrobacterium tumefaciens; identical to SEQ ID NO: 35243

SEQ ID NO: 38649 - DNA, 909 bp, Agrobacterium tumefaciens; identical to SEQ ID NO: 35058

SEQ ID NO: 38650 - DNA, 609 bp, Agrobacterium tumefaciens
atcaagatttgcggattgaagacaccggaaacgctggagcgcgtcgtccggcgcggtgcgtcccatgtcggttttattttctttgaaaaaagcccccgctatatcgagccggaccttgccggccggttggccgaagccgcccgtggcgccgccaaagtggttgccgtcactgtcgatgctgataatgattatctcgatgaaatcgtcgatcttgtcaggccggatattctgcaattgcatggcagcgaaagcccggagcggctgctgcatatcaaggcgctttacggcctgccggtgatgaaggcgatttccattcgcgatgccgcggatcttgccaaaatagagccttatattggcatagccgaccgtttcctgctggatgccaaggcgcctgccggttctgatctgcctggcggcaacggcgtctcgttcgactggacgatcctgcgctcacttgacgaaagtgtggattacatgctttccggggggctgaataaggacaatgtcgccgaggctctggcggaaacccgggcgagcggattagatttgtcgtctggcgtcgaaagcgcgccgggcgtcaaggatttgtccaagattgatgcttttttc

SEQ ID NO: 38651 - DNA, 558 bp, Agrobacterium tumefaciens; identical to SEQ ID NO: 38281

SEQ ID NO: 38652 - DNA, 1647 bp, Agrobacterium tumefaciens; identical to SEQ ID NO: 35430

SEQ ID NO: 38653 - DNA, 2631 bp, Agrobacterium tumefaciens; identical to SEQ ID NO: 38205

SEQ ID NO: 38654 - DNA, 1347 bp, Agrobacterium tumefaciens; identical to SEQ ID NO: 37870

SEQ ID NO: 38655 - DNA, 843 bp, Agrobacterium tumefaciens; identical to SEQ ID NO: 38207

SEQ ID NO: 38656 - DNA, 1200 bp, Agrobacterium tumefaciens; identical to SEQ ID NO: 35256

SEQ ID NO: 38657 - DNA, 1254 bp, Agrobacterium tumefaciens; identical to SEQ ID NO: 35399

SEQ ID NO: 38658 - DNA, 732 bp, Agrobacterium tumefaciens
gtggtcgtcgtcacgggcggatcgaccggcatcggcttttcagtcgccaaattgtttctggaaggtggggcgtctacggtctatgtgacgggccgcaattcggccaatctcgatgccgccgtcgccaaacttgggaagggggcaatcggcttcgtttccgacgttgcgaagctctccgacctggagcagctcaagagccgcttagaagcagacgggcggaaagtggatgtactggtcgccaacgccggcatcgcggagaataacgatcttggcgagacccacgaggcactttacgaccggatcttcgatatcaacgtgaagggcgtattctacacggtgcagactttgttgcccgtgctgcgcgacggcggttcgatcgtattgacggggtcgatcgtcggcaacaagggcatggaaaggctgagtgcttacaatgcctcgaaagcggcggttcggtcattcgcccgcagctttgccaatgacctgaaggggcgtggcatccgcgtcaatacggtcagcccgggtgttacccgcacgccgatcatggaaaatggactgaagatggacgatgaaaagatcgccggtttcaaggcctatctgaaggatgcggcaccgatcggccggatggccgaccccgacgaaattgccgaggcggtgctgtttctggcgtcttccaaggccagctatattaccggtgtggaactttccgtcgatggtgggctggcgcagatc

SEQ ID NO: 38659 - DNA, 819 bp, Agrobacterium tumefaciens; identical to SEQ ID NO: 35402

SEQ ID NO: 38660 - DNA, 915 bp, Agrobacterium tumefaciens; identical to SEQ ID NO: 35401

SEQ ID NO: 38661 - DNA, 801 bp, Agrobacterium tumefaciens; identical to SEQ ID NO: 35400

SEQ ID NO: 38662 - DNA, 168 bp, Agrobacterium tumefaciens; identical to SEQ ID NO: 38135

SEQ ID NO: 38663 - DNA, 1377 bp, Agrobacterium tumefaciens; identical to SEQ ID NO: 38150
  unsure (1)..(1377): unsure at all n locations

SEQ ID NO: 38664 - DNA, 816 bp, Agrobacterium tumefaciens; identical to SEQ ID NO: 35175

SEQ ID NO: 38665 - DNA, 1116 bp, Agrobacterium tumefaciens
gtcaaagccgctatattgcgagagatgaatatgtctcgcccttacgccaccagcaggccgcttgcgatcgaatagattgagcttgccccgcccggccccggcgaagtcctcgtccgcatccgcgccgcaggcctttgccattccgatctttccgtcaacaacggcgaccggccccgcccgatgccgatggcgctcgggcacgaagcggcgggcgtcgtcgaggcattgggcgaaggcgtgcgcgatcttgagcccggcgatcatgtggtcatggtcttcatgcccagttgcggacattgcctgccctgtgcggaaggcaggcccgctctgtgcgagccgggcgccgccgccaatgcagcaggcaggctgttgggtggcgccacccgcctgaactatcatggcgaggtcgtccatcatcaccttggtgtgtcggcctttgccgaatatgccgtggtgtcgcgcaattcgctggtcaagatcgaccgcgatcttccatttgtcgaggcggcactcttcggctgcgcggttctcaccggcgtcggcgccgtcgtgaatacggcaagggtcaggaccggctcgactgcggtcgtcatcggacttggcggtgtgggccttgccgcggttctcggagcccgggcggccggtgccagcaagatcgtcgccgtcgacctttcgcaggaaaagcttgcactcgccagcgaactgggcgcgaccgccatcgtgaacggacgcgatgaggatgccgtcgagcaggtccgcgagctcacttccggcggtgccgattatgccttcgagatggcagggtctattcgcgccctcgaaaacgccttcaggatgaccaaacgtggcggcaccaccgttaccgccggtctgccaccgccgggtgcggccctgccgctcaacgtcgtgcagctcgtcggcgaggagcggacactcaagggcagctatatcggcacctgtgtgcctctccgggatattccgcgcttcatcgccctttatcgcgacggccggttgccggtgaaccgccttctgagcggaaggctgaagctagaagacatcaatgaagggttcgaccgcctgcacgacggaagcgccgttcggcaagtcatcgaattc

SEQ ID NO: 38666 - DNA, 792 bp, Agrobacterium tumefaciens; identical to SEQ ID NO: 35176

SEQ ID NO: 38667 - DNA, 1296 bp, Agrobacterium tumefaciens
gaaaatggcggcatcatcctgttcatcgatgagatgcacaccctggtcggcgccggcaaggccgatggcgccatggatgcgtccaacctgctgaaacctgcgcttgcccgcggtgagctgcactgcgtcggcgccaccacgctcgatgaatatcgcaagcatgtggagaaggatccagcccttgcccgccgtttccagcccgttctggtggatgaaccgaacgtcgaggatacgatctcgatcctgcgcggtctgaaggaaaaatacgaacagcaccacaaggtccgcatctcggattcggccctggttgcggctgcgacgctttccaaccgttacattaccgaccggtttctgcccgacaaggcaatcgacctgatggacgaggccgcttcgcgtcttcgcatgcaggtggattccaagccggaagaactggacgaactggatcgtcgcatcatccagctgaagatcgagcgcgaagccctgaagcaggaaacggaccagtcctccgtcgaccgtttgaggaagctcgaggacgaactggccgatacggaagaaaaggcagatgcgctgacggcccgctggcaggcggaaaagcagaagctcggccacgccgccgacctgaagaagcggctggatgaagcccgaaacgaactggcaatcgcccagcgcaatggccagttccagcgtgccggcgagttgacctacggcatcattcccggcctcgaaaaggaactggcagcggcggaagcccgcgatagcagcggtgccggttcgatggttcaggaagtggtgacgccggacaatattgcccatgtcgtctcccgctggaccggcattccggtcgacaagatgctggaaggccagcgcgaaaagctgttgcgcatggaagacgagctcgccaagtccgttgtcgggcagggtgaggccgttcaggcggtgtccaaggcggttcgccgttcgcgcgccggcctgcaggatcctaaccggccgatcggttcgttcatctttctcggcccgacgggtgtgggcaagaccgagctgaccaagtcgctcgcccgcttcctgttcgacgacgaaaccgcgatggtccgcctcgatatgtcggaatatatggagaaacactccgttgcccggctgatcggtgcacctccgggctatgtcggctacgaagagggcggtgccctgacggaagcggttcgccggcggccctatcaggtcgtgttgttcgatgagatcgaaaaacgcatccggatgtcttcaacgtactgctgcaggtgctggatgatggccgcctga

SEQ ID NO: 38668 - DNA, 993 bp, Agrobacterium tumefaciens
atgcggatcgcccgtgccgcaacggggcgcgacaagatcgtcctgtttacaggctcgtatcatggccattccgacccggccctgcacaaggcgaccaaactggaatatatccgcaggggcgcgttgctgcggtctcatccggcatggctcgtggcgctgaaaccgcttctgaaacgcatggtcctgacgaaagcagttcccggtttttcaggcgtggcaccctcctccgcccgcgatatcgtgctgctggaatacggcaatccccgctccatcgattacatcaggcgtcacggcgacagccttgccggcgtgcttgtcgaacccgttcagagccggaacccggaactgcagccccgcgaatttctgcatgagttgcgaagcgtgaccgaaaagaccggaagcgcgctgatattcgacgagatgatcactggcttccgcgtcgcacccggcggcgcgcagtcccatttcggcatcgatgccgacattgccacctatggcaagatcgccggcggcggattgccgctgtcgctcatcgccggcaaggggcggttcatggatttcgtcgacggcggagcctgggcttacggcgacagctccttcccgaaggtggctccgacattttttgccggaacctattgccgccatccgctggcgctcgcagccgcaaaggcggtcgcgacgcgattgctggaagacggcccaaccttgcaagagggcctcaacgccaggacccaggcattcgtggaacggctgaacggtgcgctgaagggtgccgggttgcccgtggcgttcatgagcttcggttcgttcttcgccatatccgctgcccgcagccgcatctcgccgcaggctgtgaccatgctttccttccttcttctgacctccggcgttcaccttcgtgccggggatcgtggcggttttctttccaccgcccatagcgatgacgacatcgcctttgttcacgacgctgttctgcaaagcctgacggctctg

SEQ ID NO: 38669 - DNA, 1257 bp, Agrobacterium tumefaciens; identical to SEQ ID NO: 38496

SEQ ID NO: 38670 - DNA, 786 bp, Agrobacterium tumefaciens; identical to SEQ ID NO: 37929

SEQ ID NO: 38671 - DNA, 873 bp, Agrobacterium tumefaciens
cgccaggcgctgcacggcatctccggcgttcccgttacggcatatgacgccgatggagagatcagtttcgacatcaccgccgaggcctacgcccgtgtggccagggccggcattcacaacatcgtcgcggctggcaatacaggcgagttttacgcgttgacgcccgctgaaatcctgacggtttacgaggccgcaatcaaaggcgtggacggcattgctcccgtcaccgcagccattggacgctcgcagcgcgaagcaattgcgatggcgcggaccgcaaaggaactcggcgcatccgcagtgatgtctcaccaaccggttgatccgttcgccgctcctcaatctcaaatcgcctatttcctggggctggctgaagacagcgcgcttcctcttgtcgcctatgtacgggccgatggatttgcggtggacgatatggtgaggctctccagccatccaaatgtcgcgggcatcaaattcgccacgacagatatcatgctgctgtcgcgcgccatcgccgcctccgacgcagacggagccttgtatatttgcggccttgcagaaagctgggccccagccttcgccgcagtcggagcgcgtggcttcacctccggtctcgttaatgtcgccccgcatttttcaatgcaggtacacgaggctctcatggcaggcgatttcgacagcgcccgaaagatcgttgagaagatcgaattgttcgagcggctgcgcacgcgctaccgaaacggcgccaatgtgactgtagtgaaagaagctatggaaatcatggggctcgccgtcggtccggtgcgcgcccctgggctcgtgcgcttggatgcgcctgaccgcgctttgctcgaaaacctgctggccagctgg

SEQ ID NO: 38672 - DNA, 1416 bp, Agrobacterium tumefaciens
tatatcgacggacgtttcgaggatggtgaggccagcttttccagcctcgatcccgcaaccggccagccctgggccgaaatgccggaaagtcgcgaggcggatatcggccgtgtggtcgaggccgcgcatcgggcgctttacgaggatactgtctggtcgaaactgacggcgacgcagcgcggcaagctcctctacaggctggccgatctcgtcgcggaaaatgcgaagacgctcgctgaactcgaaacccgcgataccggcaagatcatccgcgaaacgtcggcgcagatcgcttatgtcgctgactattatcgctattatgcgggcctcgcggacaagatcgaaggcgcctacctgcccatcgacaagccggatatggatgtctggctccggcgcgaaccggtcggcgttgtcgcggcgatcgtgccgtggaacagtcagctgtttcttgccgccgtgaagatcggtccggcgctggccgccggctgcactatcgtcgtcaaggcatcggaagatgggccggcaccgcttctggaatttgcccggctggtgcatgaggccggttttcctgccggtgtcgtcaacgttgttaccggtttcggcgcgtcatgcggcaacgccctcaccacgcatccgaaggtcgcccatatcgccttcaccggcggcccggaaacggcccgacatatcgtccgcaactcggccgaaaaccttgcctccacatcgctggaactcggcggcaaatcgccgatcctcgtttttgccgatgccgatctcgaaagtgccgccaacgcccaggtggcaggcatttttgcagcgaccggccagagttgcgtggctggttcgcggctgatcatcgaaaaaagcgtcaaggaccggttcctccagattctggcggcaaaggccgaggcgatccgcatcggttcgcctttggatatggcgacggaagtggggccgcttgcaacggagcgtcagaggaagcacatcgtttcgctggtttccgcctcggtagatgccggcgcgaaggtggtgacgggcggtgagcctgtggagggtgaaggctatttttaccggccgaccattctcgattgtgacggcattcgctcgccttccttggaaaaggagtttttcggccctgttctttcggtcgtttccttcgaaaccgaagcggaagccatttcgcttgccaatgacacggtctatggccttgcgtcgggcgttttcacgcagaacctgacacgggctcaccggctgatgaaggcgatccgcgcgggcatcgtctgggtgaatacctatcgcgctgtttcgccgattgcgccctttggcggcttcggcctttcgggcgacggccgtgagggcgggcttgcggcggcgctcgattacacacgcaccaagaccatatggctcagaacttccgac

SEQ ID NO: 38673 - DNA, 618 bp, Agrobacterium tumefaciens; identical to SEQ ID NO: 35483

SEQ ID NO: 38674 - DNA, 1902 bp, Agrobacterium tumefaciens
atggcaaaagtaatcggtatcgaccttggcacgaccaactcctgcgtcgcagtgatggatggcaaggacacgaaagtaattgaaaacgcagaaggcgcgcggaccacgccgtcgatggtggcattttccgacgatggcgaacgccttgtcggccagccggccaagcgccaggcagtcaccaacccgaccaacaccctgtttgcggtcaagcgccttatcggccgccgttatgaagacccgaccgtcgagaaggacaaggcactcgtccccttcgaaatcgtcaagggcgacaatggcgacgcctgggtgaaggctcaggacaagaattattccccttcgcagatttccgcgatgatccttcaaaagatgaaggaaacggctgaatcctatctcggcgaaaaggtcgagaaggccgtcatcaccgttccggcctactttaacgacgcccagcgtcaggccaccaaggatgccggccgcatcgccggtctcgatgttctgcgtatcatcaacgagccgacggcagcagccctcgcttacggcctcgacaagaaggaaggcaagaccattggcgtttacgaccttggcggcggcacgttcgatatttccgttctggaaatcggcgacggcgtctttgaagtgaagtcgaccaacggtgataccttcctcggtggtgaagacttcgacatgcgtctggtcgaatatctggccggcgagttcaagaaggatcagggcatcgacctgaagaacgacaagctcgctctgcagcgcctcaaggaagctgccgaaaaggcgaagatcgaactttcgtcctcgcagcagaccgaaatcaacctgccgttcatcacggctgatgcttccggtccgaagcacctgacgctgaagctgacccgcgccaagttcgaaagcctggttgacgatctggtgcaacgcactgtcgccccttgcaaggcagcactgaaggatgccggcgttaccgcggccgagatcgacgaagtcgttctcgtcggcggcatgagccgcatgcctaaggttcaggaagtcgtcaagcagctgttcggcaaggagccgcacaagggcgtgaacccggatgaagtggttgccatgggcgccgctattcaggccggcgttctgcagggcgacgtcaaggacgttctgctgctcgacgtgaccccgctgtcgctcggcatcgaaacgctgggtggcgtcttcacgcgtctgatcgatcgcaacaccacgatcccgacgaagaagagccagaccttctcgactgccgaagacaaccagtcggccgtgaccatccgcgtttcgcagggtgagcgcgaaatggcacaggacaacaagctgctcggccagttcgacctcgtcggtctgccgccgtcgccacgcggcgttccgcagatcgaagtgaccttcgatatcgacgccaacggcatcgtgcaggtatccgccaaggacaagggcaccggcaaggagcagcagatccgcatccaggcctccggtggtctctccgacgccgacatcgaaaagatggtgaaggacgccgaagccaatgccgaggccgacaagaagcgtcgcgccggtgtcgaagccaagaaccaggccgaaagcctcattcactccaccgaaaagtcggtgaaggaatatggcgacaaggtttccgagaccgaccgcaaggcgatcgaagacgccattgccagcctgaagaccgctgtcgaagccgccgagcctgacgcagacgacattcaggccaagacccagaccctcatggaagtctccatgaagcttggtcaggccatctacgaagcacagcaggccgaggccggtgatgcttccgcagaaggcaaggatgacgtcgtcgatgccgactatgaagaaatcaaggacgacaagaagtccgcataa

SEQ ID NO: 38675 - DNA, 1353 bp, Agrobacterium tumefaciens; identical to SEQ ID NO: 38016

SEQ ID NO: 38676 - DNA, 1140 bp, Agrobacterium tumefaciens; identical to SEQ ID NO: 38499

SEQ ID NO: 38677 - DNA, 810 bp, Agrobacterium tumefaciens; identical to SEQ ID NO: 38211

SEQ ID NO: 38678 - DNA, 1014 bp, Agrobacterium tumefaciens; identical to SEQ ID NO: 35150

SEQ ID NO: 38679 - DNA, 1209 bp, Agrobacterium tumefaciens; identical to SEQ ID NO: 35118

SEQ ID NO: 38680 - DNA, 1011 bp, Agrobacterium tumefaciens; identical to SEQ ID NO: 35117

SEQ ID NO: 38681 - DNA, 744 bp, Agrobacterium tumefaciens; identical to SEQ ID NO: 35201

SEQ ID NO: 38682 - DNA, 1332 bp, Agrobacterium tumefaciens
atgctgtcatcgtcgaataccccgctaacaggtcccaacgaccggcaaacgtccatcgcgttctttgaacgcgcctccaccgtttttccaggcggtgtcacacgcgcgacaattgagctggatccccacccgatctttgttgcctacggggaaggcgcgtttgtgaccgacgtcgacgggcaccgtatgctggatctaaacaataacttcacaaccctgatccacggacatgcctatcccccaataactgaagcgattgccggactactaagaacaggcagttgctttgctaatccgatgaaccatgaaatcgatctggccgaattgctagtaggcaggattccggctgttgagcaggtccgcttcgtcgcgagtggaacggaagccgttatgtttgccatcaaagccgctagagcaacgaccggccgggtcgcaatcgctcgggtggagggtgcgtaccacggcgcatatgactgggcggaggcgggccagcacgcatcgtcgaatacgccctgcgccgcctatccaggaatgccagcaagcgtcatagatgacgtcgtgctcctccaatttaactgccccgcagagttggagcaacagatcgcgatgaatgccgggcgccttgcggctattcttatcgatccgatgcccagccgggcaggcctcatagagccaacagaggagttcatcgcaactatcaacaaggtggcgaagcaacatgggatcgtcattatcgcggatgaagtcctgaacctccgccagggcttcgctggagcttcagcgcgctacggtctgaagccggatctcgtcacaatggggaagatcatcggcggtggctttccaataggggcagtcggtggacgtcgggagatcatgtcggcctttggcaagcaaggaagtaaggcgccattgacgcaaggcggaacctttgctgcaaatcccgtgtcgatggtcgctggccgtcttgcgatggaagccctgacgcaagatgctttccaacgtctcgaacatatgggcaacctggttcgcgaggggttgaggtcacgcatcgaacgtcacggcgcaaatctgagcgtgacgggagcggcttcgctttttcgaatacacgccaagaaagtggcgccggtttcttatcaggacagcattccgacagcttcggaagacgtcgttttgaaactgctgcgcaggcactttgcaaacaatgggatcttgatgccctacggcgccgctgcgtcgctatcaacgcccatgacggacaatgacatgggtgacattgtttccgtctttgacgatttcctcgtgaatctcgatcgacatgcctgggaggccgca

SEQ ID NO: 38683 - DNA, 954 bp, Agrobacterium tumefaciens; identical to SEQ ID NO: 38502

SEQ ID NO: 38684 - DNA, 798 bp, Agrobacterium tumefaciens; identical to SEQ ID NO: 38001

SEQ ID NO: 38685 - DNA, 585 bp, Agrobacterium tumefaciens; identical to SEQ ID NO: 38289

SEQ ID NO: 38686 - DNA, 1065 bp, Agrobacterium tumefaciens; identical to SEQ ID NO: 38023

SEQ ID NO: 38687 - DNA, 1053 bp, Agrobacterium tumefaciens; identical to SEQ ID NO: 35308

SEQ ID NO: 38688 - DNA, 759 bp, Agrobacterium tumefaciens; identical to SEQ ID NO: 38291

SEQ ID NO: 38689 - DNA, 1407 bp, Agrobacterium tumefaciens
gccatgagcgcaccccgcactttatatgacaagatctgggacgaccacgtcgtcaatcgtgacccggacggaacctgtcttctctacatcgaccgtcatctcgtgcatgaggtgacgagcccacaggccttcgaaggtttgcgcattgccggtagacccgtgcattcgccgacccgcacgctcgccgtggtcgaccataacgttccgaccacagccgaccggctggaaggcatcaagaacgaggaaagccgcattcaggtggaagcgcttgcgcagaacgccaaggagttcggtgtcgaatattattccgagcgcgacaagcgccagggcatcgtccacatcgtcggccccgagcagggcttcaccctgcccggcatgacgatcgtctgcggcgatagccacacctccacccacggcgctttcggcgctctggcgcacggtatcggcacgtcggaagtggagcatgttctggccacccagacgctgatccagaaaaaggccaagaacatgctggtgcgtgtcgatggcaagcttccggaaagcgtgaccgccaaggacatcatccttgccattatcggcgagatcggcacggccggcggcaccggccatgtgatcgaatttgctggcgaggcgatccgctcgctctccatggaagggcgcatgacggtctgcaacatgaccatcgagggcggcgcccgcgccggtctgatcgcacccgatgaaacgactttcgattacatcaaggacaaaccgcgtgcgccgaagggtgagacgctggaacaggccatcgcatattggaagacgctgaaatccgatgagggcgcccattacgacaaggttgtcatcctcgatgcagccaatctgccgccaattgtctcctggggttcatctccggaggatgtgacctccgttgaaggcatcgttcccaatcccgatgatatcgaggaagaaaacaagcgcacttccaaatggcgcgcgcttgactatatgggcctgaaacccggcacgcgcatcaccgatatcgccatcgaccgtgtcttcatcggctcctgcaccaatggccgcatcgaggatctgcgggcggcggccaagatcgtcgatggccgcaaggtggcttccaccgtctcggccatgatcgtgcccggctccggactcgtcaaggaacaggcggaaaaagaaggtctggacaagattttcctcgacgccggtttcgaatggcgcgaaccgggctgctctatgtgccttgccatgaatgacgaccgcctgaagcccggcgaacgctgtgcctccacctcgaaccgcaacttcgagggccgtcagggctataagagccgaacccacctcgtctcgccagccatggctgcggctgcggcaattgccggtcatttcgtcgacgtgcgcgagtgg

SEQ ID NO: 38690 - DNA, 783 bp, Agrobacterium tumefaciens; identical to SEQ ID NO: 35136

SEQ ID NO: 38691 - DNA, 1701 bp, Agrobacterium tumefaciens
gtttacacacgcgctctgcgctatctgaccgttcataaatggcgtgtggccgttgtcgtcatcgccaacgtcattcttgcagcgatcaccatcgccgaacccgtgctgttcggccgtatcattgacgccatttcctccggcaccaatgttacgcccattcttattctgtgggcgggtttcggcgtctttaataccgtcgcttatgtcgcggtcgcccgcgaggcagaccgtctggcccatggtcggcgcgcaacgctgctgacggaagctttcgggcgcatcatttcgatgccgctctcctggcatcatctgcgcggcacgtccaatgcgctgcacacgctgctgcgcgccagcgaaacgctgttcggcctgtggctggaattcatgcgcacgcatctcgccaccttcgtggcgctggtgctgctcatcccgaccgccatggccatggacctccgtcttagcttcgttctgatcggcctcggcattgtctactggttcatcggcaagtgggtgatgggccgcaccaaggacggccaggcctcagtcgaggagcattatcacagcgtttttgcccatgtcagcgattccatcagcaacgtgtcggtgctgcacagctacaaccgcatcgaggctgaaacgaaggcgctgaaatccttcaccgaaaagctgctgagcgcgcaatatccggtgctcgactggtgggccttcgccagtgcgctgaaccggacggcctccaccgtttcgatgatgattatcctcgtcatcggcactgtgctcgtcaagaacggcgaattgcgcgtaggagatgtcatcgccttcatcggtttcgccaatctcctgatcggccgtctggaccagatgcgccaattcgtgacgcagattttcgaagcccgcgccaagctcgaggacttcttcgtgctggaggatgccgtcaaggaacgggaagagcccggcgatgcccgcgagctctcgaatgtctcgggcaccgtggagttccgcaacatcaatttcggtttcgccaacaccaagcagggcgttcacgacgtctcgtttacggccaaggccggcgagaccgttgcgatcgtcggaccgaccggtgccggtaagaccacgctgatcaaccttctgcaacgtgtctacgaccctgattccggccagattctgatcgacggcaccgatatttcgacggtgacgaaaaactcgctacgcaactccatcgcgaccgtgttccaggatgccggcctgctgaaccgctccatccgcgaaaacatccgcctcggccgagaaacggccaccgatgcggaagtggtggaagcagcagcagcggcagcggcaacggatttcatcgacagccgcatcaacggctacctgacgcaggtgggcgagcgcggtaaccgcctttccggcggcgagcgccagcgtatcgccattgcccgtgcgatcctgaagaacgcgcctattctggttctcgacgaggcgaccagtgcactggacgtggaaaccgaggcccgcgtgaaggccgccgtggacgcgctgcgaaagaaccggacgaccttcatcatcgctcaccgcctttccacggtccgcgatgccgatctcgtcctgttcctcgatcagggccggatcatcgagaagggcactttcgatgagctgacccagcgcggcggccgcttcacctcgctgctgcgcaccagcggcctg

SEQ ID NO: 38692 - DNA, 1407 bp, Agrobacterium tumefaciens; identical to SEQ ID NO: 35139

SEQ ID NO: 38693 - DNA, 3453 bp, Agrobacterium tumefaciens; identical to SEQ ID NO: 38504

SEQ ID NO: 38694 - DNA, 1059 bp, Agrobacterium tumefaciens; identical to SEQ ID NO: 38293

SEQ ID NO: 38695 - DNA, 1064 bp, Agrobacterium tumefaciens; identical to SEQ ID NO: 38507

SEQ ID NO: 38696 - DNA, 2088 bp, Agrobacterium tumefaciens
gcacccggcgcacccggcattgacgcacgctggacgtcgagcgccaagaatggcgtgggaaccgcgctgtcgaacacctcaccaatctggttcacgctcagccacggcatcctcaacgaggtctattacccgaggatcgatagtgcctgcatccgcgatctcggtcttgtggtcaccagagatgacggatacttttcagaagagaaacgggactgcacctcccttacccaacctttcgagagtggaattcccgcgttccacgtcaccaatacggcgacagatggagcctatcggattgaaaaacaggtcatcaccgatccggcgcgggcctgtgttcttctgcatgtgtccttctcgcccttgaagggaaagatgggggattaccgtgtaagcgttcttctggcgccgcatctagtcaatgccggtaatctcaactccgcctggataggggattatgaagggcgtcgggtcttgtttgcggtcggccgctcacgatatctcgctctggtctgcgacggtccctggcgcgccgcaagtgcgggatttgttggcgtctccgatggctggcaacaattgcgccggcacggacgcctcattgaggaattccagcgggcggatgacggcaatgtttcgctggctgcggaaatcgattttagcgatgcccatgacaccgcgacgttggcgctcggtttcggccagaccgaatatgaagctgcatcctgtgctgtcgcaagtctgaagtccggcttcagacgcgcacacgatgcctatatcgccaactggcgtggctggcaggacagtctttgccccctcgaccgcgatacccatcacggcgtcaattcctatcgcgtctcgaccgccgtgcttgccgcgcatcgtgccgctgaccggcctggagccgtcgtggcgagcctgtcgatcccgtggggagcctccaagggcgatgacgatcttggcggatatcatttgatatggccgcgggatctggtggaagccgccggcgggtttctagcggccggtgatcacgatgaggctttggccatccttgattatctgcgccaggtgcagcaaccctcggggcggtggccgcaaaatctctggctggatggcaagccctattggccgggcgttcagatggacgaatgcgcctttccgatcctgcttgcggatatgctgcatcggcacggccacctcgaccacgccgcaagggcggattacatgccaatgatccgcagcgctgcggcttatattctggcaaacggcccgacgaccggcgaggacaggtgggaggaagatgcaggctacagcccgtttacgcttgccgtcgagatcgccgcgctgcttgccgctgctgatctgttggatatggagggcgatgcggccgaagccacgcatctgcggcagacagccgattgctggaatgagcagatcgaaaggtggacgtttgccggtgaccagaccatgtgcgcgcagcttggtatttcgggccattatgttcgcatcgcttctcccggtaccaccgatgccgttcagctctcgggcatgacgcctatactcaaccagacaccggatcgcgctttcctgccaacaagcgatgtcatcagccctgatgcacttgcgctggtccgcttcggcctgcgcgcaccggacgatccccacattctcgcaaccgtcaaggcgatcgatcattgcctgcgcgccgagctgccgcaggggccggtctggtacaggtacacgggcgacgggtatggtgagcacgctgatggaacagcatttgacggcacgggtcagggcaggccatggccccttctgaccggcgagcgcgcccattacgaacttgctgcgggcagacgcggggcggcggaagctttgctgaccacaatggaaaaatcggcggggcagagcggccttttccccgagcaggtctgggatcaacccgatcttcccgacagggagctgttttatggctccccgtcgggcagcgcgatgccgctggtctgggcgcatgcagaacatatcaagcttctgcgttcgcttgccgatggctccgttttcgacatgccgccgcagggtgtggagcgctacatc

SEQ ID NO: 38697 - DNA, 1350 bp, Agrobacterium tumefaciens; identical to SEQ ID NO: 35086

SEQ ID NO: 38698 - DNA, 894 bp, Agrobacterium tumefaciens; identical to SEQ ID NO: 35084

SEQ ID NO: 38699 - DNA, 756 bp, Agrobacterium tumefaciens; identical to SEQ ID NO: 35093

SEQ ID NO: 38700 - DNA, 1290 bp, Agrobacterium tumefaciens; identical to SEQ ID NO: 35092

SEQ ID NO: 38701 - DNA, 1524 bp, Agrobacterium tumefaciens; identical to SEQ ID NO: 38511

SEQ ID NO: 38702 - DNA, 1164 bp, Agrobacterium tumefaciens; identical to SEQ ID NO: 37944

SEQ ID NO: 38703 - DNA, 1659 bp, Agrobacterium tumefaciens
tccatgaccgcttcggtgacttccgctttgacgcctaacaaggactggtggcgtggtgcggtgatctatcagatctacccgcgctcctatcaggactccaatggcgacggcatcggcgatctcaagggcattaccgaccgtctgcatcacatcgccggtctcggtgccgatgcgatctggatttcgccctttttcacctcgccgatgaaggatttcggctacgacgtctcgaactatgtcgatgtcgatccgatgttcggcacgcttgccgatttcgacgggctgattgccgaagcccaccggcttggcatccgcgtgatgatcgacctcgttctgtcgcacacgtctgaccagcatccgtggttcgtggaaagccgcgccagccgcaacaatccgaaatcggactggtatgtctggtcggaagcgaagcccgatggcacaccgcctaacaactggctgtcgatcttcggcggttccggctggcagtgggatcccacccgcatgcaatattacatgcacaacttcctgacctcgcaaccggacctcaacctgcataaccctgaagtgcaggaggaactgcttaatatcacccgcttctggctgaagcgcggcgtcgatggtttccgcctcgacactatcaacttctatttccatgatctggaattacgagacaacccggcgctggcaccggagcgccgcaatgcctcgaccgcgcctgcagtcaatccctacaatttccaggaacatctctacgataagaaccgcccggaaaacatcgccttcctgaagcgcttccgcgcggtgctggacgaattccccgatatcgccgccgttggcgaagtgggcgacagccagcgcggtctcgaaatcgtcggtgaatacacctccggcgatgacaagatgcagatgtgctatgccttcgaattcctcgcacccgatgcgctcaccccccagcgcgttgccgatgtgcaggcggattttgcgcgcgcagcaccagagggctgggcctgctgggccttctccaaccatgatgtcgtgcgccatgtcagccgctggggcgagcatgtcgaggacaaggatgccttcgcgaagctgctgtcggcactgctgatgacgcagcgaggctccgtctgcatctatgagggcgaggaactgggcctcactgaagccgatattgctttcgaggacttacaggacccctatggcatccagttctggccggaattcaagggtcgcgatggttgccgcacgccgatggtgtgggatgcgggccatgcgcaggccggcttttcgacttcggacaagatctggctgcccattccggccgagcacaagcagcgcgccgtcagcgcccagcagggcaacgaggcgtcggtgctggagcattaccgccgcttcctcgccttccgcaaacagcacccggctttcgccaagggcggcatcgaattccagccgcttgagggagacgtgctgagctacacccgcaagctgggcaacgaaaccattctgtgccttttcaatctgtccgcaacgccggcaaatgccacgctgccgaaagggaactgggaggttctcgaaggccatggctttgcaagcggccttgaaggcacaagcgtagaacttccggcatggggcgctttcttcgcccgttacgcctga

SEQ ID NO: 38704 - DNA, 1722 bp, Agrobacterium tumefaciens
atgaaaaaagtgctgattgccaatcgcggcgagatcgcggtgcgcatcatccgggcctgtcgcgattacggcctgcaatcggtcgccgtttatgccgaccccgatcaggacgcgcttttcgtccggctggcggatgaagcctatgcgctggagggcgtgcgtcccgccgagacctatctcgatatcagcaagctgatcgcgattgccaaacgcgccggtgctgatgccgtgcatcccggttatggtttcctgtccgaacgcgccgaatttgcccaggctgtcatcgatgccggactgatctggatcggtcccgaccctgatgtcatcgaggcattgggcgacaaggtcatggcgcggcgcatcgccaccggtgttggcgcaccgctggttgccggcagcgatggccccgtttcttccgccgccgaagtcaccgcctttgccgaacagcacggcctgcccgtcgccatcaaggcggcccatggcggcggtggacgcggcctgaaagtcgcgtggaagatggaagagatcgcagagctctatgaatccgccgtgcgcgaggcgaccgtcgccttcggccgcggcgagtgttttctggaacgtttcctcgatcggccgcgtcatatcgaggcgcaggttattgctgacaagcacggcaatgtgctggtgctcggcacccgcgattgctcgctgcaacgccggaaccagaagctgatcgaagaagcacccgcccccttcctgtcggatgaacaacggcagaagatccatgatgccgccaaggcgatctgcgctgcagccggttattccggcgccggcaccgtcgaattcctgctcggtgtcgatggcacgatttccttccttgaggtcaatacccgcctgcaggtggaacatcccgttaccgaggaaaccaccggcattgatctcgtcatcgagcagtttcgtattgccgaaggccataagcttcgtgtgcttgaaacgccggaaccgcgtggccattcgatggagttccgtatcaatgccgaagatccgggccgcggctttctgccgacaccaggcttgatctcggttttcgatgcgccttccggtccgggcattcgcatggatagcggcgtcatcagcggctcaagcattcccggcgtgttcgattcgctgatggcaaagctcatcgtcaccggggttgaccgcgatcaggttctgcgccgtgcccgccgtgcgctgagggaattccgcatcgagggcatcgctaccgttctgccgttccaccgcgccgcgatcgagacggaggatttcatcggtactgacgggttcaaggttcacacccgctggatcgaaaccgatttcgccgccatgcccgatgcgatggagcgaccggcaccggccgacgacccttctatcacccgcacctatctcgagatagacggcaagcgtgtttcggttggcctgcccagcattctgctctccagcctcggcactgtcagcggtggcaatgcatccgctcccagtgctgcggtcgagaaaaaggaaggcgaaatgaccgcccccgtttccggcaccctgcaatctttcaaggtgaaggacggtgaaacggtttccgaaggtgatcttctggccgtcatggaagccatgaagatggagacgcagattgtcgccaccagggccggaaaggtccgcttgatcgtcaaggaaggcgattatctgcaggcgggagcaacccttatcgatata

SEQ ID NO: 38705 - DNA, 1707 bp, Agrobacterium tumefaciens; identical to SEQ ID NO: 35317

SEQ ID NO: 38706 - DNA, 729 bp, Agrobacterium tumefaciens; identical to SEQ ID NO: 35318

SEQ ID NO: 38707 - DNA, 1218 bp, Agrobacterium tumefaciens; identical to SEQ ID NO: 38519

SEQ ID NO: 38708 - DNA, 1434 bp, Agrobacterium tumefaciens
gtttttcaggcacgaaacgtcgaaaaagtatttccaggcgttcgggcgctcaagggcgtcaatctttcgctgcaacccggctcgatccacgccctgcttggggaaaacggtgccggcaaatcgaccctgatcaaggtcgtcacgggtgtccatcaccaaagcagcggccagatccttgttgatgggcaggccgtgcgtttcagcaatccgcgcgaggcgattgcccgcggcattggtgtcgtccatcaggaacgcaacctcattccgcgcttttcgattgccgagaatatccacatggaaaagctcggggcgcattatctcaaacccatcgactacgccgcgctgaaccgcgatgcgcgccgctggcttgaggcgctcaatctggaaatcgatccggcaacgccagtatcggagctttccgtcgcgcagatgcagctcgtggaaatcgccaaggcgctttccctgcaaagccgtgtgctgctcctcgacgagccgacgacatccttgacgccgagcgaaacggacaatctcttccgcattctacggcgcctgcgcgatgacggcgcaagccttgtcttcgtcagccacaagctggaagaggttctggatatctgcgaccgggtcacggttctgcgggacggcgaaaacgcctgtgaaagtcggtcgatggaaggtctcggacgtcaggatctcgtgcgcctgatgatcggacgcgccgaaagcggcggcggctggcgcaaacgcgcggtcgaacacaatccgatggtgctggaacttgagggcgtatcgaccgcgatcggtcatggcgatgtcagtctgtccgtgcgcaagggcgagatcgtcggcctttacgggctggtcggcgccgggcgcaccgaacttgcaaaatcgatcatgggcaaattcgcggtcacctctggcaacgtgcgtgtttcgggccggcccgcccgcatccgctccgttgccgaagcgatccacgactacggcgtgggttatgtcagcgaagaccgcaagggcgatggcctcattctccagcactcggttcttgccaatgcgggcgttcccatctggcgcaaactctcgaatacgttcggcgtgctttcggatgggcgcatccgggcggcggtaacgcctttcctgaaaaagctggaggtgaagacaccaagcctcagccagacggtcggcaatctgtccggcggcaaccagcaaaaaatcagtgtcgccaaatggctcgccgccgatgtcaaactgctgatcgtcgacgaaccctccgtcggcatcgacatcaagaccaaggcctatctgcatgatctgctgcgcgagctggcagataacggcaccgccattctcgtcattaccagcgacatgccggaaatggtggcgctggccgatcgcatcgtcgtgatggaccaatacagagtgaaaggcatcgtg

SEQ ID NO: 38709 - DNA, 744 bp, Agrobacterium tumefaciens
agacttcaaaacaagatcgccgtcgtcaccggagcaaccagcggcatcggccttgcaacggccaaacttttcgctgtcgaaggtgcacgcgtctacatcaccggccggcgcaaggatgccctggacaaggcggtggccgagatcggccatggcgctgtcggcgtacaggccgactccgcaagtaacgaaaatctcgacaagctgttcgcccaggtgaaggcggagcaaggccgcctcgacgccctcgttgtgaacgccggtggcggcagcatgcttccgctcggccagatcaccgaggagcagatcgaccacaccttcggccgcaacgtgaaggctgtcatcttcacggtgcagaaggcgcttccgttgatgggcaagggcgcatccatcgtgctgaccggttcgaccgcaggcaccgaaggcacggccgccttctccgtttactccgcctccaaggccgccgtccgcaacctggcccgctcctgggcgcttgacctgaaaggcaccggcatccgcgtcaacgtcgtctcgcccggtgcgacacgtacgcctggcctcgtcgagcttgccggtgacgacaaggaacagcagcagggcctgctcgactatctcgcctcgcgcatcccactcggccgcgttggtgaatccgaggagatcgccaaggcaaccctgttcctcgcctctgacgacgcgagcttcgtcaacggcgccgaactcttcgccgacggcggccaggcccaggtc

SEQ ID NO: 38710 - DNA, 984 bp, Agrobacterium tumefaciens
atgcaaatgcgcaagctgggtgaaagcgggttgttcgtgtccgaattgtgtttcggcgccatgacattcggcggaactgacgggctatggggaaaggtggggagacttgaccaggaggatgccgatgcactggtcaaggccgctctcgaggccggcataaacctgttcgatacggcaaacgtctatgcgcacggacgcagcgaagaaatactgggacgttcactgaagaaccttggagtgtcgcgcagcgatgtcgtgatcgccaccaaagtcgcctccgccatgggtgacggaccaaaccatcgcggcgcgtcgcgggggcacataatttccgaatgccgggcaagcctcggccggctgggtctggaccacatcgatctataccagatccacgcattcgattccgcgacaccgatcgaggaaacgctggaggcgctcgacacactcgtgcgggccggcgacgttcgctacatcggcctttcgaactgggccgcgtggcagatcatgaaggcgatcgggataacacgcgccagagccctcgcaccaatcacgtcactgcaggcatactacacgcttgtcgggcgcgatctcgagcgcgagatcggcccgctgctctcatcggaacgtgttggcctcatggtctggagtccgcttgccggcggctatctcaccggaaagtattcagctgggggcaatgccgcaggcggtcgacagacggaattggattttccacccatcgatcgcatacggggagagcccctgatcgcggtcctgaaagctgtcgcggagaaacacggctccagcccggcgcaaatcgcgatcgcctggctgctgaagcaaaaggtcgtctcgaccgtcatcatcggtgcgaagcgcgtcgagcaattgcaggaaaacattcggtccgcatcgattgagctggacgataacgacatggcgaagctcgatgaggtcagtcgtctacccgtcgagtatccgggttgg

SEQ ID NO: 38711 - DNA, 696 bp, Agrobacterium tumefaciens
gtgactggtgcgtcccgcggcattggagccgcgattgcgatcgctctggccgagaaaggcgccgacgttgcgatcacgtacgaacgcgccgctgatcgggcagcgcaagttgtcgcaacgatagaaggcaaaggacgcaaggccttggctatccaggctgatagcatggacccagaggcggtcaagcggtcggttgatcaagcggcgcaagcgttgggcggcctcgacatattggtgaacaatgcggctatcgcgatctacaaggacgtggcggatttcaccgtcgccgagatcgacgcgctttttgctgtcaacgctcgttccccaatcttggcatcacaagccgcgatgccttatcttggcaaaggtggtcggatcgtcacaatcggctccgcaggcgcggaacgcattgtcgggccatcgacggtttattcaatgaccaaatcggcacttcaatcatttacccgcggtctggcgcgagaacttggcccccgtgacatcactgtcaacctcattcagccgggatcaaccaacaccgaaatgaatccggccgagggcgagttcggagatttccagcgtgccctaataccgctcggccggtacggcgagccggaggatgtcgcggcagcggtagcgttcctcgcatctggcgcggcccgacaaatcaccggaaccatcctgaccgttgatggcggc

SEQ ID NO: 38712 - DNA, 633 bp, Agrobacterium tumefaciens; identical to SEQ ID NO: 38108

SEQ ID NO: 38713 - DNA, 1158 bp, Agrobacterium tumefaciens; identical to SEQ ID NO: 35204

SEQ ID NO: 38714 - DNA, 1437 bp, Agrobacterium tumefaciens; identical to SEQ ID NO: 35203

SEQ ID NO: 38715 - DNA, 1329 bp, Agrobacterium tumefaciens; identical to SEQ ID NO: 35300

SEQ ID NO: 38716 - DNA, 1140 bp, Agrobacterium tumefaciens; identical to SEQ ID NO: 35301

SEQ ID NO: 38717 - DNA, 1395 bp, Agrobacterium tumefaciens
aagttttacatcgatggcaaatgggtccttcccagcggctcagacaaggtcgccgtcattaatcctgccaccgagctggaatttgcagaaatagcgctcggtaatgatgaagacgttgcgctcgctgttgcagctgcaagaggcgctttcgccggctgggctcgaaccggtccggcagaccggtcggaacttctcaatcgcgtccatcagctgatgcaacagagattggaacttctggcgcaagctttgacgatggaaatgggcgcggcgatcaattatgcccgaagcgttcaagttccccttgctgccgaacatatcaaggtggctcgcgacaatgcggccagctattcgtttctttcgcaacgggggcatacggcgatcctccgcgagccgatcggcgtatgcggcctgatcacaccgtggaactggccgttgtaccagataaccgcgaaggtcggcccggctttggcggcgggatgcacggtggttttgaagccgagcgagctttcgccccttagtgcgttgctgtttgccgaaatcatcgaagatgccggctttccgcctggcgttttcaacctcgtcaacggcgaaggcaccatcgtcggcgctggcttgtccgcacatcccgacgtggacatgatttccatcaccggctcgacccgggccggaattttggtcgcacaggcggcggctccgacagtaaaacgggtggcccaggaactcggcggaaaatcgccgaacatcatccttgcggatgccgatatgacgcgggccgtgcctttgggcgtcgctgcggcgtttcgaaatctggggcagtcctgcagcgcgccgacccgcatgatcgtgccgcgctcgcaccaaaaacacatcgaggaactggcagcggcagcggctctggaaatagttgtcggcgacccgttatcggagcataccacacacggcccggtcgcgaatcacgcgcagtttgaccgaattcagcggatgatatcgatcggcatggatgagggcgccaaacttgtcgtgggggggaccggcagacccgacggcctggataccggcttttacgtgcggcccacgatcttttcagacgtagatccgaaaatgcaaattgcccagcaggaaatcttcggacccgtcttgtccattatttcttacgatacgctcgaagaggcgatagagatcgcaaacgatacggtctacggtctgggagcccatgttcaggggacggaccttcaaactgtgcgaatagtggcggagcagattcgatccggacaggtgcatctcaattatccggcgtgggaccccaatgcgccctttggtgggtacaagcaatccggcaacggtcgggaatatggcaccgagggcatggaagaatatctggagatcaagtctatc

SEQ ID NO: 38718 - DNA, 1194 bp, Agrobacterium tumefaciens; identical to SEQ ID NO: 38538

SEQ ID NO: 38719 - DNA, 1026 bp, Agrobacterium tumefaciens
ggccttagccgcaaatcgcgcctgcgtgcgcttgcgccccgggaggggatcgatttcacctccaacgactatctcgggcttgccgaagcgccgcgcctgaaggcggcgattgctcacgccattggcaaaggcgtgccggtgggcgccggcggttcacggctgctgcgcggcaatcaccccgaacatgaggcgctggaatcggaagcggcggcgtttttcggggccgaaaaagccatctatttcggcagcggttttgccgccaatgtcgcgcttttttccaccctgcctttgcgggacgatattgttctccatgatgccctgatccatgccagcgtgcatgatggcattgcggcgggcaaggcgaaggcggtggccgtgccgcataatgaggtggaggctttccagcgggagataatccgctggcggcaggcgggtggtagcggccggccgtggatcgcggtcgagagcctttattccatggatggcgattgcgcgccgcttgcagccctggccgatcttgccgaacggcatggcggttttctggttgtcgatgaagcacatgccaccggcgtcttcggccccggtgggcgtggtcttgccgcgcaactggaaggccggagcaatgtgctggcccttcatacctgcggcaaggcgctcggtgcctccggtgcgcttttgagcctgcctgcggttcttgccgattatctcgtgaaccgcgcccgcggtttcatctattccaccgcgccttcgccgctgatggcggcggcggtgcgggaggccttgcgcatcgtcgcggacgaaccctcaaggcggtcgcgactggccgagttggtaggttttgccggcgaagaattgcaaagccagctgggtgtgacacccagcggttcgcagatcctgccggtgatgatcggcgacaatgcccgctcactgaagattgctgcacggctgagccaaggcggtttcgatgtgcgggcgatccgcccgccgacggtaccggaaggcacggggcggctacgcatcgccatc

SEQ ID NO: 38720 - DNA, 954 bp, Agrobacterium tumefaciens
ggttttggtcatgccgttccggcccgttgcgtcgacaatgccgaaatagaggccagtctggggctggaagccgggtggatcgagcgacggaccggcattcgctcccgttattgggcggaggcgggcgacacgctgagcggtcttgccgaaagggctggccggatggcgctggaggatgcgaagatcaatgccgatgacatcgcgctgacgctgcttgccacctccacgccggatcatcttctgccgccttccgcgccactgcttgcgcataggctgggtttgacgcgctcgggtgcgatcgatcttgccggggcctgttccgggtttctttatgcgcttaccctcgcggatggttttgtccgcacctacggccgcgccgtcctcgtcgtcgccgccaatattctcagccgccgcatcaatccggcggaaagggcgagcgccgtcctgtttgccgatgccgccggtgccgtggtgctgaccccgtgtccggaggtgaaacggggggtgttatcggccgatctcgttgccgatggcagcggttacgatctcatccagatcgcggcaggcggcagcagccagcccttttctgccggtatgattgcagaagatgccctgatgacgatgcgcgatggccgggaggttttctctcgcgccgtggcgctgatgacaaacacctctcagcgcgtgctgcatgaggcggaactgaccgcagccgatatcagccgtttcgtgccacatcaggccaatgcccgcatgtccgacgccgtttgcggtaatctcggaatcgagcgggaaaagacggtccgcaccataggaagcttcggcaattcttccgctgctaccatcccgctttcgttgtccatcaccaatgccgagcggccccttgcgggcggcgaaaccctgcttctgacggcggcgggtgcaggcatgacgggcggggcggtggtttatcgc

SEQ ID NO: 38721 - DNA, 918 bp, Agrobacterium tumefaciens; identical to SEQ ID NO: 35057

SEQ ID NO: 38722 - DNA, 840 bp, Agrobacterium tumefaciens
gtgttggtcgactgccagaacgtctggaagatttttggcgcgcgcgcttcgaccgccgtgaaggcggtggccagaggtggattgtcaaagaagcaggtgctggaggatttcgactgcgtcgtcggcgtatgcgacgccagccttcaggttcatcgtggcgaaatcttctgcatcatggggctttccggcagcggcaaatcgaccttgatccgtcttctcaatcgcctcatcgagccgagcctcggaaaaatcacggtgaagggcaaggatatcgccaggctgaatgctgccgaattgcgcgaattgcgcgcccgcaacatcgccatggtgtttcagagcgtagcgctgctgccttaccgcactgtgctcgaaaacgccggtttcagtctcgaggttcgaggcgtagcgaaagacgagcgcaaccgtatagcacgcgccgcgcttgaaaaggtgggccttgccgactggacgtcgcggtatccccacgaattgtcaggaggcatgcagcagcgcgtcggacttgcccgcgccctggctgccgacccggaaatcattctcatggacgagccgttcagcgcgctcgaccctcttatccgtcggcagctccaggacgaatttcggcaattgacgaagtcgctcggcaagtccgccgtcttcatcacccatgacctcgaggaagcaatccgcatcggcgaccgcatcgccatcatgaaggacggcgttatcgtgcaggtgggaaccgccgaggagatcgttacgaaacccgcagatgattacgtctccgatttcgtagcgggcatctccagaattcatctggtgaaggcgcatacggtcatgcag

SEQ ID NO: 38723 - DNA, 1446 bp, Agrobacterium tumefaciens
gcctcagaccttcagttcccggccaatgccttcattgacggggctttccggcccgccggttccggcaagaccttcaagacgatcaatcccgccaccggcgaaacgctcgccgatatttcggcctgcgacgtgagtgacgtggactatgcggtcggcaaagccagggcggcattcgacgacggccgctggcgcctgctgccacctggcgaacgcaaggccattttgctcacattcgcaaaactactggagcagcatcgccacgaactagccgtcatggaaagcctggacagcggcaagccggtttccgaatgccagaccgtcgacattcctgacacgatccacaccatccgctggcatgcggagctcatcgacaagctgtatgacaataccgcaccggtgggatcgaacgcccttgcactcgtggtgcgcgagccggttggcgtcctccgctgcgtgctgccgaggaactttcctttgctgatgctggcctggaagatcggcccggcgctcgcctccggatgttcggtgatcgtcaaaccggccgaggagacaacgctgacgaccctgcgcgtcgccgaactggcgcatgaagccgggattccggctggcgtcttcaacgtcgttccgggcggcggcaaggaggtcggcgagccgatcggcatgcatatggatgtcgatatggtagcgtttaccggatcgacgccaacgggacggcggttcctgcgatatgcggccgactccaacctcaagcgcatcgtccttgaatgcggcggcaaaaatccggcggtggtgctggatgatgcggaagacctcgacctcgtcgccgagcaggtggtcaacggcgcattctggaacatgggcgaaaactgctcggcctcgtccaggctcatcgtccatgcaaaaatcaaggacgagctgctgcagcggatcggcgcctatatgcgggaatggaggatgggcgatcctctcgatccgcaaaaccgcgtcggcgcgctcgtcagcaaagcccatttcgataaggtccactccttcctcgaggacgtgaaggcagaaaatcttaccatcgttcacggtggcaagaccgagaagggaatcttcatcgaacccacggtcgtcgatgccgtgccccctgcaagccgtcttttccgggaagagattttcggcccgatcctgtcggtgacgaccttcaacacgctggcagaggcggtagctcttgccaacgacacgaattacggccttgccgcatccgtctacaccggaagccttcgcaaggcgatcaagctctcgcgcgaaatccgggcgggtgtcgtcacggtcaattgcttcggcgaaggcgacgcaacgacgccgtttggcggctacaaggaatccggtttcggcggacgcgacaaatcgatcttcgcgcacgataattattgcgaactcaaaacgatctggatcgacgtc

SEQ ID NO: 38724 - DNA, 882 bp, Agrobacterium tumefaciens; identical to SEQ ID NO: 35051

SEQ ID NO: 38725 - DNA, 2781 bp, Agrobacterium tumefaciens; identical to SEQ ID NO: 35052

SEQ ID NO: 38726 - DNA, 2556 bp, Agrobacterium tumefaciens
gacaaagaataccagatgatgcgcaacgcatcgattgcggtgttgcgcgagattggcgtcgagaccggcggctccaacgtgcagttcgccgtgaacccgaaggatggccgtctggtcgtcatcgaaatgaacccgcgcgtttcccgctcctcggctcttgcttccaaggcaaccggcttcccgattgccaaggtcgccgccaagctcgctatcggctatacgctggacgagctggaaaacgacatcaccggcggcgccacgcctgcgtccttcgagccctccatcgactacgtcgtcaccaagatcccgcgtttcgccttcgagaaattcccgggcgcctcgccgatcctcaccaccgccatgaagtcggtcggtgaagtcatggccatcggccgtacctttgccgaatcgctgcagaaggcgctgcgtggcatggaaaccggcctcaccggtctcgatgaaatcgaaatccccggttacgaggaaggcgaaggttccaagaacgccatccgtgccgccatcggcacaccgacgcccgaccgcctgcgcatggtcgcacaggcgatgcgcatgggaatgagcgaagaagaggtccacgaaaactcgaagatcgatccgtggttcatcgcccagcttaaggccatcgtcgacatggaggcccgcattcgcgagcatggcctgccgcaggatgccgaaaacctgcgcatgctgaaagccatgggcttctccgacgcccgcctcgccagcctgacgtccaagcgcccgaaggaagtggccgagctgcgtaacagcctgaacgttcgcccggtcttcaagcgcatcgacacctgcgctgcagagttcgcttcgcccactgcctacatgtattcgacctatgagacgcccttcgtcggcgctgcccgctcggaagcgcaggtttccgaccgcaagaaggtcgtcattctcggcggcggtccgaaccgtatcggccagggtatcgagttcgattattgctgctgccacgccgccttcgccctgaaggatgccggcttcgaagccatcatgatcaactgcaacccggaaaccgtttcgacagactacgacacctccgaccgcctctatttcgagccgctgacggccgaagacgtgatcgagatcatgcgcgccgagcaggaaaagggcgagctggtcggtgtcatcgtgcagttcggtggccagacgccgctgaagctcgccgaagcgctggaaaagaacggcatcccgatccttggcaccgcgcctgacatgatcgaccttgccgaagaccgcgaccgcttccagaagctgctgatgaagctcgatcttgcccagccgaacaatggcatcgcctattcggtcgagcaggctcgcctcgtcgcctcggaaatcggtttcccgctggtcgtgcgtccgtcctacgtgctgggtggccgcgccatgcagatcatccattcggaaggccaactccagacctatctgctcgacaccgttcccggtctcgtaccagaggatatcaagcagcgttacccgaacgacaagaccggtcagatcaacaccctgctcggcaagaacccgcttctgttcgacagctacctgaccaacgccgtcgaagtcgacgtcgatgcgctgtgcgacggcgaaaacgtcttcgtctcgggcatcatggagcacatcgaagaggccggcatccattcgggcgactcggcctgctcactgccgtcccgttcgctcagcaaggaaaccctcgatgaactggaacgccagacgacggcgcttgccaaggcactcaaggtcggcggcttgatgaacgtgcaatacgccatcaaggacggcacgatctacgttctcgaagtcaacccgcgcgcctcgcgtaccgtgccttttgttgccaagaccatcggcgcgccgatcgccaagatcgccgcccgcgtcatggccggcgagaagcttgatgcggcgattgccgcttatggcgagaagcccgatccgcgcaacctgaagcacatcgccgtcaaggaagccgtcttccccttcgcacgcttccccggcgtcgacatcctgctcggaccggaaatgcgctcgaccggcgaagtcatcggcctcgacaccgatttcgcactggccttcgccaagagccagctcggcgccggcgtcgacctgccgcgctccggcacggtcttcgtttcggtgcgtgacgaggacaaggaaggcgtgctttccgccatccgcattctcgtggaaagcggcttcaaggtgctggcaaccggcggcacccagcgtttcctcgccgaacagggcatcaacgccgaaaagatcaacaaggtgcaggaaggccgtccgcatatcgaggacgccatccgcaaccgtcaggtccagctggtcatcaacaccaccgacagcaacaaggcgatctcggatagcaagtcgctacgccgcgcaacgctgatgcagaaggtgccttactacacgacgatggccggtgcggaagcagcagcgcttgccatcaaggcgctgaaggccggcaatctggaagtgaagccgctgcaaagctacttcaac

SEQ ID NO: 38727 - DNA, 789 bp, Agrobacterium tumefaciens; identical to SEQ ID NO: 38297

SEQ ID NO: 38728 - DNA, 924 bp, Agrobacterium tumefaciens
gttttcgcaggcaattcgaaccggcacctcgccgaagcgatctgcaagtatctgaacgttcctctcggaaatgccactgtaaagcggtttgctgaccaggaaatattcgtagaaatcagcgagaacgtgcgcggcgaggacgtttttatcgtccagtccacctccttcccggcaaatgatcatctgatggaactgctcatcatgatcgatgccatgcgccgctcttcggcaaaacgtatcaccgcggtgcttccctatttcggttacgcccgccaggaccgcaaagccggtccccgcaccccgatttccgccaagctcgttgccaacctgattaccgaagccggcgccgaccgcgttctaacgctcgatcttcatgccggccagatccagggttttttcgacatccccaccgacaacctcttcgcagcgcccattctcgcccgcgacgtgaaggaccattacgacaccaacaatgtcatggtcgtttcgcctgatgtcggcggcgtggttcgcgcccgcgccctgtcgaagcgcctcgactgtctgctggcaatcgtcgacaaacgccgtgaccgtcccggtgaatccgaggtcatgaacgtcatcggcgatgtctccggcaaggattgcatcctgatcgacgatatcatcgattccggcggcacgctctgcaacgccgccgaagcgctgctgaaaaaaggcgcgaccagcgttaccgcctatatcacccacggtgtgctttccggcggcgcggttgcccgcgtggcctcctcgaagctgcgcgaactcgtcatcaccgacagcatccagccgaccaccggtgtgcaatccgcgcacaatatccgcgtggtcagcaccgcaggcctgcttggcgaggcgatcaaccgcaccgcgcaggaacagtcggtctccggcctgttcgac

SEQ ID NO: 38729 - DNA, 720 bp, Agrobacterium tumefaciens
ggcacgacaggtgaaggctgctccgtcggcagccgcgaacggcaggcgatcctctccagcttcattgcagcaggcattgcgccgtcgcgcatcgtcaccggtgttctggtggattccatcgaggatgcggcagaccagtcggccgaagccctgaatgccggcgcgcggaatattctgctcgccccgccctcctatttcaagaacgtcagcgatgacggcctgtttgcctggttctcggctgtcttttcaaagatcggcaaggatgcgcgcgacattctcgtctacaacatcccctccgtgaccatggtaacactgtccgtcgagctggtgggacggctgaaggccgcatttccgggcatcgtcaccggcgtcaaggattcctccggcaactggagccataccgagcgtctcctcaaggaacacggtgaccttgccatccttatcggcgacgagcgtgatctcgccaggggcgttcgcctcggtggccagggtgccatctccggcgttgccaatttcctgacgcaggaagtgcgcgccatggccgtcgatggcaaggacgatccgcgcatcgtcgatcttgttgtggaacttctgaaattcccggttacgcctgccgtcaaggtgctggtatcacacacgacaggggaaactatctggtcggatgtgcgtgcaccactcgtcgccatttcaccggaagaccgccggcagatcgaaggcgca

SEQ ID NO: 38730 - DNA, 1219 bp, Agrobacterium tumefaciens; identical to SEQ ID NO: 35271

SEQ ID NO: 38731 - DNA, 636 bp, Agrobacterium tumefaciens
gaattcgccagcccctacatgcagaagctgaaagagttcctgcttgccgaaaagaccgccggcaagcgcatctttccgaagggcgcggaatatttccgcgctctcgacctcacgcctctcgacgaggtcaaggtcgtcattcttggccaggatccctaccatgggctcggtcaggcacatgggctctgcttttcggtgcagcccggggtgcgcattccgccctcgctcgtcaatatctacaaggaattgcagagcgacctcggcattcgcccggtcaagcacggttttctggaaagctgggcaaaacagggcgtgttgctgctcaacagcgtgctgacggtggaagaggcgcgggccgcctcgcatcaggggcagggctgggaaaaattcaccgatgcggtcatccgcgccgtgaacgacgaatgtgaccatgtggtctttctgctctggggttcctatgcccagaagaaggcggccttcgtggaccagcgcaaacatctcgtgctgcgctcgccacacccgtcacccctttcagcccataacgggtttttcggcaacggccatttttctaaggccaacgctttcctcgtttcgcatggccgtgatccgatcgactggcaattgcctgacgtggtg

SEQ ID NO: 38732 - DNA, 1011 bp, Agrobacterium tumefaciens; identical to SEQ ID NO: 35273

SEQ ID NO: 38733 - DNA, 474 bp, Agrobacterium tumefaciens
atgggagtgagcggctccggcaagtccacggtcgcagagggactggcggagaagctgggtatcgccttcattgaaggcgacaagctgcacccgaaatccaatgtcgacaagatgtcggaaggcattccgctgaccgacgacgaccgctggccatggctcgatctgatcggcgcggaactgcgcaatggcagtgaaggcaagggcgttttggtttcctgctccgccctcaagaaaatctatcgcgaccgccttcgtgaggcgaccggtggcccactcgccttcgtttatcttgatggcagcctggagcttctcagccggcgcatgggtgaacgcaagggtcatttcatgccgctctcgctgcttcagacccagcttgccacgctggaagtgccgaccggggaaccgggtgtcgtcacggtcagcatcgattccacacctgaggagatcgtagcgaatgcgctggctggcctgaag

SEQ ID NO: 38734 - DNA, 1719 bp, Agrobacterium tumefaciens; identical to SEQ ID NO: 35482

SEQ ID NO: 38735 - DNA, 771 bp, Agrobacterium tumefaciens; identical to SEQ ID NO: 35481

SEQ ID NO: 38736 - DNA, 717 bp, Agrobacterium tumefaciens; identical to SEQ ID NO: 38298

SEQ ID NO: 38737 - DNA, 948 bp, Agrobacterium tumefaciens; identical to SEQ ID NO: 37854

SEQ ID NO: 38738 - DNA, 1536 bp, Agrobacterium tumefaciens; identical to SEQ ID NO: 38043

SEQ ID NO: 38739 - DNA, 744 bp, Agrobacterium tumefaciens
aatttgttcgatctttccggccgccgcgccctgatcacgggttcgtcccagggcatcggtttcgcgctggcgcaagggctttcggaagccggggcggaagtggtgctgaacgggcgcgacgaagcgaagctgaaagccgccgctgccggcatcaagggcgcgagaacacttgccttcgacgccacagatcatggcgcggtgcgcgaggctatcgaccgcttcgaggcggaggttggcgcgatcgacattctcgtcaacaatgccggcatgcagcaccgcacgccgctcgaggattttccggccgatgccttcgagcgcctgctgcaaaccaacatcgcctcggtattccacgtcggacaggccaccgcgcgccacatgatttcgcgcgggcgcggcaagatcatcaatatcgccagcgttcagacagcacttgcccgccccggcatcgcaccctacaccgccaccaagggcgccgtcggcaatctgactaagggcatggcgacggactgggcaaaatatggcctgcagtgcaatgccatagcacccggttatttcgataccccgctaaacgccgcccttgtcgcagacgagacgttttcggcctggcttgaaaagcgcacgccggccggacgctggggcaaggtggaagagcttgtcggcgcctgcattttcctgtcgtccgacgcctcgtccttcgtgaacggccatattctctacgtcgacggcggcatcaccgcctcgctt

SEQ ID NO: 38740 - DNA, 1224 bp, Agrobacterium tumefaciens
tatctttcccggttccagccggcgcgcatgaaagccaccatcgttcccctggttttcgtgctcgccatcctgccctttagctggattgcggcgcttgtgcttctgctcgccatgcccaccatcccgcttttcatggccctgatcggctggcaggcaaaggccgccagtgaaaagcagctggccgagacgggcaacatcaacgccttcctgctcgatcggctgcgcgggctggaaacgatccgcacgctcaaggccgttgacctgacggcggcgcgcctcgatgccgatgcgcagaacctcaagaagcggacgatggccgttctgaggatcgccttcctctcctccgccgtgctggagctttttgcggcgatcggcgttgccatgaccgccgtttatatcggtttccacctgctcggttttctcgatttcggcgcgtggggcgaaaagcttacgctggccgaaggcctcttcatcctgctgcttgcacccgcttttttcgagccattgcgcgaactctccgccgtctggcacgaccgcgcggccggcgaggcgtcacttaatgcgctcgccacattaacggccggcggtgctgccatcgtgggtgagggcgcggatgtggtgcgcgcgccatcttcgacacccggcctgctggagatggaaaacctttccttcgcttacccgaatgctccgcctgtcatccggaatttcaacctgacggttcagcagggcgagagagttgcgattcttggggcttccggttgtggcaaatccactatactctccttgattgccgggctggccgaggcgggtgagggcgtaatcaggatcggcggcgtcacgcttgatgacgcaacggctgatgggctgcgcggaacgatcggctgggtcagtcagaagccattcttttttgccgcgtccatgaaggcgaatattggttttggccgcttggcggtcagcgaggccatggtggaagaggtcctgcaccgcaccggactggatggattgacgcaggcgcgccggcatttgcagatcggagacggcggaaatggcatttcgggcggggaggcggtgcggctcgccatagcgcgcgctttcgccgatccggcaacgcagcttgttctggccgatgagccgaccgcgcatctcgaccgggaaacggctgctctcgtcacggataacctgctgcaactggcaaagggcaggacattgatcgtcgcgacccat

SEQ ID NO: 38741 - DNA, 1014 bp, Agrobacterium tumefaciens
gtcgcccacggggcaaaggatgtgcgcatcgaagaccggccggaggaaaagccgggtccgggcgaggtgcggctccgtctggcgaggggcgggatctgcggcagtgatctgcattattacaatcatggcggtttcggcgccgtgcggcttcgtgaacccatggtgctgggccatgaggtttccgccgtcatcgaggaactgggcgaaggcgttgaggggctgaagatcggcggtctggtggcggtttcgccgtcgcgcccatgccgaacctgccgcttctgccaggagggtctgcacaatcagtgcctcaacatgcggttttatggcagcgccatgcctttcccgcatattcagggcgcgttccgggaaattctggtggcggacgccctgcaatgcgtgccggccgatggtctcagcgccggggaagccgccatggcggaaccgctggcggtgacgctgcatgccacacgccgggccggcgatttgctgggaaaacgtgtgctcgtcacgggttgcggccccatcggcattctctccattctggctgcgcgccgggcgggtgctgctgaaatcgtcgccaccgacctttccgatttcacgctcggcaaggcgcgtgaagcgggggcggaccgtgtcatcaacagcaaggatgagcccgatgcgctcgccgcttatggtgcaaacaagggaaccttcgacattctctatgaatgctcgggtgcggccgtggcgcttgccggcggcattacggcactgcggccgcgcggcatcatcgtccagctcgggctcggcggcgatatgagcctgccgatgatggcgatcacagccaaggaactcgacctgcgtggttcctttcgcttccacgaggaattcgccaccggcgtcgagctgatgcgcaagggcctgatcgacgtcaaacccttcatcacccagaccgtcgatcttgccgacgccatctcggccttcgaattcgcctcggatcgcagccgcgccatgaaggtgcagatcgccttt

SEQ ID NO: 38742 - DNA, 726 bp, Agrobacterium tumefaciens; identical to SEQ ID NO: 35362

SEQ ID NO: 38743 - DNA, 876 bp, Agrobacterium tumefaciens
atgcgcgcctttgttatcggcaatatcgcacttgatgaaacctattccattgccgcactgcctcaggcaggcgcttcaatcttcggcgagcaggcctcgcgcagtctcggtggcaaaggctgcaaccaggccattgttcttgcacggtgcggcgtcgaaaccaccttggtcgccgccgtcggcacggatgaccgcgccattgcgatcggtaaatcgctcacccgcgagcatctgacaccaaagctcattcccgttgatagcgccaccagcgatatttccatcattctgacgacccctgacggtgaaaactcgatcatcaccacccggtccgcagccgcagcgcttgatagagacgcagccctggacgcacttggcgacactgtctccggcgacctcgtcatcctgcagggcaatctctcggaagagacaaccctcgtcatcctcaatgcggcgagatcgaaggggctgacgacggccttcaatccttcaccgctgcagccgtggtttgcaagcattctgccgctcatcgacatcgccgtcctcaatcgcatcgaggcagaggcgctgaccggtgagagcggcgccggggcgggcgcttttctgctgcgtgccggcgtcggcctcgtcatcatcacactcggcggacagggctgcgtgctcgtgtctgccaatggtgcaatcgaggtcgcggcagcgcccgctacaatcgtcgataccacgggtgccggcgattgctttacgggtgttgcgcttgcctccgccatacgtcgcggcgtcgctatcgatgcgcgcgcgctggaggatgcttcgagagcggcagccatcaccgtcggccgccgtggcacgcaggatgcctttcccagccatgaggagatg

SEQ ID NO: 38744 - DNA, 941 bp, Agrobacterium tumefaciens
atggctctggcgacaagggcgactggtggagctggccgaaggaaacccgtgagggcgcgcgccggccacgcggcctgcatctcgtgtcctgccacaaaacacagcttttggggttcacgatccgcaatgccgcctcgtggacgatccatccgcagggctgcgaggatctgacggccgccggcctcaccatcatcgcgccgcatgacagtcccaataccgatggtttcaaccctgaaagctgccgtaacgtgatgatatcaggcgtgcgcttttccgtgggtgatgactgcatcgcggtgaaggcgggaaaacgcgggcctgatggtgaggacgatcatttggcggagacacgcggtatcagcgtgcgccattgcctgatgcagcgcggccatggcgggctggtcatcggttcggaaatgtccggcggggtccatgatgtgacggtggaagattgcgacatgatcggcacggatcgcggcctgcgtctcaagacgcggcgcggtcgcggcggtatggtcggcaacatcaccatgcgccgggtgttgctggacggtgtgcagactgcactttccgccaacgcccattatcattgtgatgccgatgggcatgatgactgggtgcagtcgcgaaacccggcgccggtcaatgacggcacgccgttcgtcgacggcatcaccgtggaagatgtcgaaatccgcaatctcgcccatgcggcaggtgtctttctcggtctgccggaggctcccatccgcaacatcgttgtccgcaacctcaccatcgtctcgcatgatccttcggctgttgcgacgccgccgatcatggccgaccgcgtgcgccccatgcgccatgaggcgatcgtcttcgagcaggcggatgtcgtctgcgatgatccggcgcttctgaatgacgcccccgtttccatttcgtcatatttcgattga

SEQ ID NO: 38745 - DNA, 1569 bp, Agrobacterium tumefaciens
cgcgatctcgccctgcaggggttgcgggtgctgctggtcgagcgcaatgatttttcctccggctgtagcgcagcgccctcgcgcatgatccatggaggcctgcgttatctcgaaaatggtgaattcggcctcgtggcggaatccctgcgcgagcgcgatgcgcttttgacgcttgcgccgcatatggtgcagccgctgccgacgacgatcccgattttttcgatgttcagcggcctgttcaacgcggcggcgacgtttttcggctccggcggcaaacccgctagccggggagcgctcgccatcaaggcgggccttaccctctatgacttcgttacccggaagaaccgcctcctgccccgccacgagtttcgcggcgccggcaagacattgaagcgctggccgggcctgacgcctgacatcagatattcggccacctattacgatgcgtggataagccagccggagcggcttgcactggaattgctgatcgatacctcggccgacgcgccgcaaagcatcgcgctcaactatgcggagcttgtccgcaacggcgacgaatatcatatccgggcagaggaaacggacgaaacactgcccatccggccgcgcatcatcgtgaatgccacgggcgcatggatcgacgaaacgatcggcacgctttccgccggcccggccgcggaaaagcagaaaccaacggtctccggcaccaaggggtcacatctcatcattgccaatgatgggctcctcaaagcgctgaacggtcacatgattttctttgagaacgcggataaccgcgtttgtattctctttccttatctcggccgtgtgctcgcggggtcgaccgacatcaaggtggatcgccccgagcgggtgcgatgcgagcccgatgagcgggattacattctggacgcgatcagacaggtctttccggacatcaccgtcgatcattcagacattgtctttagtttcagcggcatacgcccgctgccgcgcagtgatgccgcttttaccgggagaatttcccgcagccattttatccaccgtgtcgccggcgatccgccgcagctttgcatgatcggcggcaagtggacgaccttcagggccttcggcgaacaggtgagcgatgaggttctggcctttcttgggcgcaagcgattgaccggcacgatgaaccgtccgatcggcggcggcaggaattttcccactggtgcaggacgcctgcccgctttgctgtcggaacagttttcaatcgaccggcgccgggcgcagcatctggccctggcttatggctcccgtgccttcgaattgatgggcttttgccggggacgaccggatgacgcgccgctttcgcaaaagtcgccgataacggccgctgaaatcctttggctgatccgctgcgaacatgtgcggcacctgacggacctcattctgcggcgcacgacactcgccatcgccggtctcatcgatgccgatcttatagacgccatcctcggcgtcgccgcgcgcgaattgggctggacacccacccgggccgccgtggaacggcagcagctcacccaggagctggaa

SEQ ID NO: 38746 - DNA, 1473 bp, Agrobacterium tumefaciens; identical to SEQ ID NO: 35285

SEQ ID NO: 38747 - DNA, 1167 bp, Agrobacterium tumefaciens; identical to SEQ ID NO: 38302

SEQ ID NO: 38748 - DNA, 1152 bp, Agrobacterium tumefaciens
aagccgaagcttttgatcgccgacgagccgacgacggcgctcgacgtcaccattcagggccagattctcgacctcatcaagcaattgcaggaagaggagggcatgtcggtcctgttcatcacccatgatatgggtgtggtggcggaagtggcggaccgtaccatcgtcatgttccgtggcgatgtggtagaaaccggcacgacggatgacatcttccatcgcggccagcatccctatacgcgcgccctgctttcggcggtgccgaagttgggctcgatgaggtcgcggttgctgcccgcccgtttcccgattatcgacatcaagaccggcgagagcccgccggtggtggagacgaaggacacggtgtcaggcggcaagacgcccattctctcggtcaaggacctgacgacgcgtttcgatatccgttccggccttttcggccgcaaatccggcgccgtgcatgcggtggagaaggtttcctttgatctcgcagaaggtgaaaccctgtcgctggtcggcgaatccggttgcggcaagtccaccacgggccgatcgatcacccggctgatcgagccgacatcgggtaatgtcacgcttgatggttacgaggtgctgaaactcgaccgaacgacgctgcggaccatgcgccgcagcgtgcagatggtctttcaggatcccttcgcttcgcttgatccgcgcatgagcgtcggcaccgcgatcatggaacccttcatggagcaccgcctcggacagaaagcgcaggcgcgcgaaaaggcggcggatttgctggaaaaagtcggcttgagccccgacatgatgaagcgtttcccgcatgagttttccggcggccagcgccagcgcatcgccattgcccgctcgctgatgctcgatcccaaggtcatcgtcgccgacgaggcggtttcggcgctcgatgtctcgatcaaggcgcaggtctgcaacctgctgctcgacctgcaacagagcctcaatctggccttcctgttcatttcccatgacatggcggtcgtggaacgcgtcagccatcgcgttgcggtgatgtatctcggcgagatcgtcgaaatcggcccgcgcgcagccgtcttcgacaatccgcagcatccgtacacgaaaaaactgatgtcggccgttccg

SEQ ID NO: 38749 - DNA, 1104 bp, Agrobacterium tumefaciens; identical to SEQ ID NO: 35351

SEQ ID NO: 38750 - DNA, 810 bp, Agrobacterium tumefaciens
ggcgcgcccgccatcttcatcgatcaggtggcgcgttgcggcggaaccgccggcatcatcgcggctgtcggcgacgatgatttcggccgcctcaacatcgagcggctgcgccgcgacggcgtcgatgtctcggccatcaccaccatagcggaccgcccgaccggcagcgccttcgtgcgttaccgggaaaacggcgcgcgggatttcgttttcaacatcgcccattcggcggccagcgaaacacggatgacggatgaggcgcaggcgctcatcgaaaaggcgggccatgtgcacatcatgggatcggccttcgcgattgccggcattggcgcgatcattctcgaggccgttaaaagcgtcaaagcgcgcggcggttcggtatcattcgatccgaatatccgcaaggaactggcgcagggcgatgaaggccgcagactgatagacgatctgcttgccgtcaccgatctcctgctgccgtcaggcgaggaacttcaggccgcctccggtctggacgatgaggaagcagcgatagaaaagctgctcgccgccggtatcggcgagatcgtgctgaaacgcggtgcaaacggcgcaagccatttcagccgcgcccatgggcgcatcgacgcccccggccttgaagtggaggaaatcgacccgaccggtgccggcgactgtttcggcgcaacctacctcacctgccgccgcctcggcatgcgtccaggaaaagcgcttgtctatgccaacgcctccggcgcgcacaacgtcacaaagcgcggcccgatggagggcgctgccagccttgccgaactc

SEQ ID NO: 38751 - DNA, 933 bp, Agrobacterium tumefaciens; identical to SEQ ID NO: 35354

SEQ ID NO: 38752 - DNA, 744 bp, Agrobacterium tumefaciens
aacaaggtcgcgctgatcaccggcgccgcccgcggcatcggccttggtttcgcccaggctttcgctgctgagggcgcaaaggtcatcatcgccgacatcgatatcgcccgcgcaactacctcggctgcggccatcggtcccgcagccaaggccgtgaagctggatgtgaccgaccttgcccagatcgacgcggtggtaaaggcggtggatgaggaattcggcggcatcgacattctcgtcaacaatgcggcgatcttcgatatggcgccgatcaacggcattaccgaagagagctatgagcgggtgttcgacatcaatctcaaggggccgatgttcatgatgaaggccgtctccaatgtcatgatcgcccgcgcacgcggcggcaagatcatcaatatggctagccaggccggccggcgcggcgaggcgctggtgacgctttattgcgcctccaaggcggcgatcatttccgccacgcaatcggcggcgctggcgctcgtcaagcatggcatcaatgtcaacgccatagcgccgggtgtggtggatggcgagcattgggaagtggtcgatgcgcatttcgccaagtgggaaggtttgaagccgggtgagaaaaaggccgcggtggccaaatccgtgccgatcggccgttttgcgacgccagacgacatcaagggactggcggtgttcctcgcctccgccgacagcgactatattctcgcccagacatataatgtcgacggcggc

SEQ ID NO: 38753 - DNA, 920 bp, Agrobacterium tumefaciens; identical to SEQ ID NO: 35467

SEQ ID NO: 38754 - DNA, 1512 bp, Agrobacterium tumefaciens
agattcagccgtttcagcgtcaaattcgatgacctgctgatggattactccaaatgtgccgtcaacgaagagatcgtcacgcttctcgaacagctcgcgcgcgaaggcggtgtcgaggccaagcgcgaggagatgttctccggcaaggccatcaacttcaccgaagaccgcgccgtgctgcataccgccctgcgcaatcgttccaacacgcccgttctcgttgatgacaaggacgtgatgcctgatgtgaacggcgttctggcagccatgggcaagtttgccgatgcgatccgttccggctccctgaaaggtgcgaccgggaaaaagattaccgacgtcgtcaatattggtattggcggttccgatctcggccctgttatggcgacgctggcgcttgcgcccttccatgacggcccgcgtgcgcatttcgtttccaatatcgacggcgcgcatattgccgatacgctgaagcttctcgatccggaaacctctctcttcatcatcgcatcgaagaccttcaccaccatcgagacgatgacgaatgccgccaccgcgcgccgtttcatcgccgaaaagctgggcgaaggcgccgtcaagcatcacttcgccgccgtctccaccgcgctggacaaggtcgccgccttcggtatcgaaagcgaccgcatcttcggtttctgggactgggtgggcggacgttattcgatctggtcggccatcggcctgccgctgatgatcgccatcgggcctgacaatttcggcaagttcctggatggcgcgcatgccatggatcgccacttccgcgaggcgccgatccgcgaaaacctgccgatgctactcggcctcatcggcttctataaccgtaacgtgctggactatccgacacgcgcgatcctgccctatgaccagcgcctgtcgcgtttaccggcctatcttcagcagctcgacatggaatcgaacggtaagggtgcgaccatcgacggcacgccggacgaatgccagtccggtccggtcgattagtgcgagcccggcaccaatggccagcacgccttctaccagctgatccatcagggcacgagcgtcattccggccgaattcatgatcgccgccaatggctttgagcccgaactgcgccatcagcaccagcttcttatcgctaattgcctggcgcagtcggaagcgctgatgaagggacgtacgcttgccgaagcgaaggcccagctcacctccaagggcatggaagacagccaagccgatttcatcgcgccgcaccgtgtcttcaccggcaatcgcccctccatcaccttcgtttacgacaagctgacgccctttgcgctcggccggctcatcgcgctctatgaacatcgcgttttcgtggaaggtgtgctgttccgcatcaactcctttgatcagtggggcgtggagcttggcaaggaactggccaccggcctgcttcccgtcgtggaaggcaaggagagcgccgccggccatgacagctcgacacaagggctggtg

SEQ ID NO: 38755 - DNA, 1653 bp, Agrobacterium tumefaciens
tggctggcatcctatccgccgggcgtgccttcagagattcccgcctcggcaaatgcctccctcattgaccttctcgaaaagagctgcaagcaatttgccgaccgcaaggccttttccagcatgggaaaatccctgacctaccgggaactcgacgctgacacccgtgcggtcgccgcatggctgcaatccagaggactggaaaaaggcgaccgggttgcggtgatgatgccgaacatcctgcaaaatcccgtcgcggtttatgggattctgcgggcgggcatggtcgtggtcaatgtcaacccgctctataccccgcgcgaactggagcaccagctcaaggactccggcgcgaaagccctgttcgtgctggagaacttcgcccatgtggcgcagcaggctgtaccgaaaaccgccgtccggcatgtggtcgtcgcagcaatgggcgatcttctcggcctcaagggacatatcgtcaatctggtggtgcgcaaggtcaagaagctggtgcccgcccatgccattcccggctcgatcagcttcaaggccatgctgaaggaaggccagggggtttccctgaaaccggtcggccttacggcgcaggacatcgccttcctgcaatataccggtgggacgacgggcgtatccaagggcgccgtcctcacccatgccaatctccttgccaacaaggcgcagatcagcctgtggctcgacgctgccttcaacggccgcaaggaccgccccgaggttctcaacttcatctgcgcgctgccgctctaccatatcttcgcactgacggtgaattcactgatgggcattgcgctgggcggccataatctgctgatcgccaatccgcgcgacattcccggcttcgtaaaagagctttcgcattaccagccgcatatcttccctggcctcaccacgcttttcaacgcgttgatgaacaatgaagagttccgcaaacttgacctgtcgtcgctcatcttcgtactcggcggtggcatggcagtgcagaggccggtggccgaacgctgggtttccgtggtcggctgccctatcaccgaaggttacgggctgtcggaaacctcgcccgtcgccaccgtcaatcggctcgatgctgcggaattcagcggcaccatcggcctgcccatctcctccaccgaaatcgatattcgcgatgaggacggcaacagtctgccaacaggcgaagtcggcgagatttgcattcgcgggccgcaggtcatggccggttactggcagaggccggatgaaaccgcgaaggcgataacggcagacggcttcttccgttccggcgatatgggcttcatggacgaacgcggttacaccaagatcgttgaccgcaagaaggacatgatccttgtttccggattcaacgtctatccgaacgaggtggaagaagtggccgccagccatcctggtgtcctcgaatgcgccgcgatcggcgttccggacgaacattccggcgaaaccgtcaagcttttcgtggtcaagaaggaccagtccctgacggaagcggagctcaaggccttctgtgccaagaacctgacgaattacaaacggccgaaaatcatcgagttccgcaccgacctgccgaaatcgaatgtcggcaagattttgcggcgcgaattgcgcaat

SEQ ID NO: 38756 - DNA, 1176 bp, Agrobacterium tumefaciens; identical to SEQ ID NO: 35287

SEQ ID NO: 38757 - DNA, 678 bp, Agrobacterium tumefaciens; identical to SEQ ID NO: 35392

SEQ ID NO: 38758 - DNA, 399 bp, Agrobacterium tumefaciens; identical to SEQ ID NO: 35393

SEQ ID NO: 38759 - DNA, 780 bp, Agrobacterium tumefaciens; identical to SEQ ID NO: 37966

SEQ ID NO: 38760 - DNA, 1596 bp, Agrobacterium tumefaciens
actggtggccaactgatcgtcgaagcgctgaaggccaatggcgtctcgcgcgtttcctgcgttccgggcgaaagctacctggcggtgctggatgcactttatgaaagcggcatcgaaaccgtcgtctgccgccaggaaggcggcgccgccatgatggctgacacctggggccgcctgacgggcgaaccaggcatctgcatggtgacgcgcggaccgggcgccaccaacgcatcggccggcctgcacattgcgagacaggattccattccgatgatcctcttcatcggccaggtacagcgcgaagcccgcgagcgcgaggcgtttcaggaagtcgaataccgccgcgccttcaccgaattcgccaaatgggtgggcgagatcgacgatgcccgccgcatccccgaattcgtcacccgtgccttcgccgttgccacctccggccgccccggcccggtggttctgacgctgcccgaagacatgctggtggaggaggtcgaagcgcccgaggcaaagccctatatgccggtggaggcgcatcccggcccttcgcagatgacggccttcgcaaaaatgctgggcgaggcgaaacggccgattttcattatcggcggtacacgctggtccgaagaaagcgtggcaaccttccgggcatttgccgaaaaccacaagctgcccgtcggctgttccttccgccgccagatgctgttcgatcatctgagcccctcttatgccggagatgtcggcatcggcatcaacccggccttagcgaaggagatcaaggaatccgatctggtggtgctgctcggcggtcgcctctcggaaatgccgtcctccggttatacgctcatcgacatcccctacccgtcgcagaagctgatccatatttatcccgaagccgaagagctcggccgcgtctatcgccccgatctggcgatctgtgctgcgccggatgatttcgtcgccgtcctctcctcgctcaccctttccggcagcgccgcctgggcggaacgcaccgccgccatgcacgcggcttacctcgcctggtcgacgccgccgcagaccggccccggcacggtgcagatggggccgatcatggactggatcgaggccaatgtggccgacgacgccatcttcaccaatggcgccggcaattatgccacctggctgcaccgcttccaccgcttccgccgctacaacacgcaatcggccccgacctccggttccatgggttacggcctgccggcggctgtcgccgccaagcatctgttcccggagcgtgaggtgatctgctttgccggtgacggctgtttcatgatgcacggacaggaattcatcactgccgtgcgttatggcctgccgatcatcaccgtgcttgttaacaatggcacctatggcaccattcgcatgcatcaggagcgggaataccccggccgtgtcagcggcaccgatctcgtcaatccggatttcaacgcttttgccaaggcctatggcggccatggcgaaacggtggaaagaacgcaagacttcgccgccgccttcgagcgggcgcgtgcaagcggcaagcctggcatcatcgaggtgaagctggacccggaa

SEQ ID NO: 38761 - DNA, 1110 bp, Agrobacterium tumefaciens; identical to SEQ ID NO: 37871

SEQ ID NO: 38762 - DNA, 1248 bp, Agrobacterium tumefaciens
aaagactgggcgcgacggccgcttgaggaccgcgttcagctggttctcaaaggtgtggcgcgccttaacgaaatggtggccgaggtggtgccggaactcgcgcatatgatgggccgtccggttcgttatggcggtgagtttaggggattcaacgagcgttccaactatgtcgcctccattgcggcggacgcgctggcgccgctcgttatcgaagaaagcggcaatttcgaacgccgcatcgagcgcgaggcgcatggcgtggtcttcgtcatcgccccctggaattatccttacatgaccgcgatcaacacggttgctccggcgctgatggctggcaatacggttgtcatcaaacatgcggcgcagacgcttctcgtcggcgagcgcatggtgcgggcctttgtcgaggctggcgtgcctgaggatgtgttcatcaatgtcttccttgatcacggcacgacctcgacgctcatctccgaaggcctgttcaatttcgtcaatttcaccggttcggtggaaggtggccgggccatcgagcgcgccgctgccggcaccttcaccggtctcgggctcgagctcggcggcaaagaccccggttatgtgatggaggatgccgatctcgacgccgccgtcgatacgctgatggacggcggcacttataattccgggcaatgctgctgcggtatcgagcgcatctacgtcaatgaaaacctctatgacgaattcgtcgagaagtcggtggcgtgggtttcgaactacaagctcggcaatccgctcgagcaggaaacgacgcttgggccgatggccaacaagcgtttcgccaaggtggtgcgggcgcagattgcggacgcggtttcgaagggtgccaaagcgctggtcgatccgaagcttttccccgctgacgatggcgagagtgcctatgtcgcgccgcagatcctcgtcaatgtcgatcattccatggaattcatgaccgaagagactttcggtcctgccatcggcatcatgaaggtcaagaacgacgacgaagccattgcgctgatgaatgacagcaaatacggcctcaccgcttcgctgtggacgcaggatgcggcgcgggctgcccggatcggccgggaaatcgagaccggaacggtgttcatgaaccgcgccgattatctcgacccggcgctttgctggaccggcgtcaaggaaaccggccgtggcggttcgctctccgtcctcggtttccagaatctgacccgcccgaaa

SEQ ID NO: 38763 - DNA, 975 bp, Agrobacterium tumefaciens; identical to SEQ ID NO: 38312

SEQ ID NO: 38764 - DNA, 1470 bp, Agrobacterium tumefaciens
ttccggattgggcgtatcgacgatcgcctatattccgccttcatcgaacatatggggcgtgcgatctatggcgggatttacgagcccggccatccgcaggcggatgcgaacggctttcgcaaggacgtcctgaaattcgtgcaggacctgaaaatcccggccatccgttatcccggcggcaacttcgtctctgcctatcgctgggaagacggcatcggcccgcgcgaccagcgtcccatccgtctcgaccttgcctggcgctcgaaggaaaccaaccagatcggcatcaatgagtttgccgactgggcgcagatggccggcatcgagatgatgcttgccgtcaatctcggttcccgtggcctggatgatgcccgcaactttctcgaatatgtgaattttccaggcggtacggcgctcagcgatctgcgccgcagccacggcaccgaaaagccgcatggcgtgaaaatgtggtgcctcggcaacgagatggacggcccctggcagatcggccacaagacggcagtggaatatggccgtctggccaacgaaaccgccaaggccttcaagggcttcgatcccaccattgaagcgattgtctgcggcagttccaatgacggcatgccgacctatcccgaatgggagcgcgaggtgctggaggagtgctacgagaatgtcgatcacatctcgctgcacaaatatttcggcaataacagccgcgacacgctgaattatttcggcaagatcgaggaaaccgggcgttacatccagaccattgccggtgtcatcgattacgtgaaggcgaagaagcgcgccaagaacgacgtgtccatctgctttgacgaatggaatgtctggtatcacatccgcgaagacgacggcaaacgcatcaagagctgggactggccggaagcgccggcgctgctggaagagacttacaacttcgaggatgcgctgtttgtcgccggcctgctcaacgaattcatccgccgttcggatcgcgtgcgcatcgcctgcatcgcccagctcgtcaatgtcatcgctcccatccgggcggaaaagaacgggcccgcctggcgccagacgatctattacccctatcagttcgcctcgctttatggccgtggcgttgcgctgaatgtcgcggtcgattgcccgacttatgattgcaacgcggccgatgacgtcaaatatctcgacgtcgccggtgtttatgatgaagccgaaggtatggtgacgctgttcgtcctcaaccggcatctcaccgaggcggccgatatcaatgtcggcctcaccgggttctcgtcggccacgctcgacctgcatcttgccatggcgggatatgatctgcgcgtcggcaacggcccggatcagccggatcgcgtcgtgccggtgccgggcagcggcgttggtgtcgaggatggggcgctgaagggttccgtgtcggcactgtcctatcacgtgctgcggctg

SEQ ID NO: 38765 - DNA, 528 bp, Agrobacterium tumefaciens; identical to SEQ ID NO: 38060

SEQ ID NO: 38766 - DNA, 1254 bp, Agrobacterium tumefaciens; identical to SEQ ID NO: 37980

SEQ ID NO: 38767 - DNA, 1359 bp, Agrobacterium tumefaciens
cagaaatcctccaaccagatgtggggcggacgttttgcttccgggccatcagccatcatggaagagataaatgcctccatcggcttcgacaagaagctttatgcccaggacatccgcggctctatagcgcacgccaccatgctggcggaaaaaggcattatttcgcaggaagataaagagaagatcgttcacggcctgaacacgatcctgtcagagatcgaagccggcaccttcgaattctcgcgcaagctcgaagatattcacatgaacatcgaggcgcgccttgcaaccctcatcggcacggcggccggccgcctgcacaccgcgcgctcgcgcaacgaccaggtggcgctcgatttccgcctgtgggttaaggaagaattgcagaagaccgagggcatgttgacagccctcatcgccgccttcctcgaccgcgccgaggaaaatgccgataccgtgatgcccggcttcacccatctgcagacggcgcagcccgtcaccttcggccaccattgcatggcctatgtggaaatgttcggccgtgaccgtgcccgtgtgcggcacgccatcgagcatctggacgaaagcccgatcggcgcagccgcgctggccggcaccggctaccccatcgaccgccatatgacagccaaggcgctcggtttccgcgagccgacccgcaactctatcgacaccgtctccgaccgcgatttcgcgctggaattcctgtcgatcgcttcgatctgcgccacgcatctgtcgcgtctcgccgaagaaatcgtcatctggtcgacgccgcaattcggtttcatccgcctctcggatgccttttccaccggctcttcgattatgccgcagaaaaagaaccctgacgccgccgaactggtgcgcgccaagactggtcgcatcaacggctcgctggtggcgctgctgactgtcatgaagggcctgccgcttgcctattccaaggacatgcaggaagacaaggaacaggttttcgactccgccgaaagcctggaattggcgattgccgccatgaccggcatgatacgcgacctcgaggtgcgcaaggaccgtatgcgtgcggccgccggttcgggttattccacagccaccgatctcgccgactggctggtgcgcgaggcgggcctgccgttccgcgatgcccaccatgtgaccggcaatgccgtggcgctggcggagaaaaagggctgcgatctggccgatctttcgctggaggaattgcaggccatccaccccgacatcaccaacggtattttcgacgttctctcggtcgaggcatcggtcgccagccgcacaagctttggcggcaccgctccttcggaagtcaggaagcagatc

SEQ ID NO: 38768 - DNA, 879 bp, Agrobacterium tumefaciens
atgaccgccccctttaaaaacatcggtgtcatcggagccggtcagatgggatgtggcattgcgcatgtttccgccattgccggctaccgggtccatatctacgatctttcgaaagaaggcatcgaggccggccttgccacgatcaacggcaatctcgcccgccaggtgaccaacaacaagctttccgatgatgcccgcaagcaggcgctggcgctcatcagtggatcgaccgacgtcaatgatctggcgccgatggatatcgtcatcgaggcagccacggaaaacgaagagatcaagcgcaagatttatgcgcaggtctgcccggtcctgaaacccgaggcgctgctcgccaccaatacgtcttcactttccatcacccgacttgcttccgccactgaccgccccgaacagttcatgggcatccatttcatgaacccggtgcccgtcatgaaactggtcgagctggtgcgcggcatcgccaccaacgaaaaaaccttcgacgcggcgaaagcctatgtgcggacgcttgaaaaggcgatcaccgtcgccgaggatttcccggccttcatcgtcaaccgcatcctgctgccgatgatcaacgaggcgatctacacgctgtatgagggcgtcggttcggtggaagccatcgataccgccatgcggctcggcgcgaaccacccgatgggtccgctgcaacttgccgatttcatcggtctcgatacctgtttgtcgatcatgcaggtgctgcatgacggtctctccgacagcaaatatcgcccctgcccactactggtcaaatatgtcgaggccggctggctcggccgtaaatccggccgtggcttctacgattaccgcggcgaaacgccagttccgacgcgt

SEQ ID NO: 38769 - DNA, 873 bp, Agrobacterium tumefaciens; identical to SEQ ID NO: 35276

SEQ ID NO: 38770 - DNA, 792 bp, Agrobacterium tumefaciens; identical to SEQ ID NO: 35427

SEQ ID NO: 38771 - DNA, 819 bp, Agrobacterium tumefaciens; identical to SEQ ID NO: 38157

SEQ ID NO: 38772 - DNA, 819 bp, Agrobacterium tumefaciens; identical to SEQ ID NO: 37889

SEQ ID NO: 38773 - DNA, 768 bp, Agrobacterium tumefaciens; identical to SEQ ID NO: 37969

SEQ ID NO: 38774 - DNA, 1776 bp, Agrobacterium tumefaciens; identical to SEQ ID NO: 38230

SEQ ID NO: 38775 - DNA, 1326 bp, Agrobacterium tumefaciens
gatacggttctcattgccaacaggggtgaaatagcagcgagaatccagcgggcctgccatgaactcgggctaaaaaccgttgcaatatgctccgaggcggacaggggcgcatcctatgtccagactgccgatagttttctttgtatcggcccttccgctgcgggcaaaagttatctcaacaaggatgccatcctgctcgcggcgcggttgacatcttcaggagcgatccatcccggttacgggtttctatcagaaaataccgccttttcggacgccgtcgaaaaagccggccttgttttcatcggaccgggcgcatcgtcgattgcgacgatgggcgacaagatcgctgctaaacgggcgatgattgctgctgctgtgccgtgtgttcccggccctgatacggcattgccggatgatccggctgccgtcgaaagcattgcgcaggaaatcggttatcctgtcatcgtcaaggctgccggtggcggcggcgggcggggtatgcgggttgtgccggatgccggatctctgcatgaggcgattcccacgacacgcgaggaagcccgtcaggctttcggctcgccggcgctctacatggagaaattccttcagcatccccggcacattgaaatacaggtgctgtgcgacacccacggacatgccgtttggctgggacatcgcgactgctccatgcagcgtcgccaccagaaggtggtggaagaagcgcccgcgcccggcatttcgcctgacgtgatccggtccgtcggacaagcctgcgtcgaggcctgccagcagatcggttatcgtggagtcggaacgtttgaattcctctacgagaacggggccttctatttcatcgagatgaacacgcgtctgcaggtcgagcatcccgtcaccgaaatgaccagcgggatcgatatcgtccaggcgcagatcagggcggcacagggggaggaactggttctacgccagcaggatgtaaaatgcgaaggccacgccttcgagtgccgcatcaacgcggaagatccgcagacgtttctgccttccgccggggtcgtgacgggtcttgcctggccgcaggggcaaggtattcgtgtcgatacccatattcatgggggttacagggtttctccctattacgattcccttgtcgccaagctcatcgtccatgcgccaacccgcagcgaggcgatggcgaagatgcgcgaggcacttgccgggacatcgattgaaggcatttcgaccaatctgccgttcctgcgcgcgctgtttgaggacgacgctttcgtgtgtggtgaaacggacattcattatctggagaaatggctc

SEQ ID NO: 38776 - DNA, 906 bp, Agrobacterium tumefaciens; identical to SEQ ID NO: 35395

SEQ ID NO: 38777 - DNA, 819 bp, Agrobacterium tumefaciens; identical to SEQ ID NO: 38094

SEQ ID NO: 38778 - DNA, 804 bp, Agrobacterium tumefaciens; identical to SEQ ID NO: 38095

SEQ ID NO: 38779 - DNA, 1212 bp, Agrobacterium tumefaciens
agaacgctcggtctttcggcccttggcggcgcgctcgaattttacgacttcatcattttcgtatttttcgccaccgtcatcggccatctgtttttcccgccggaaatgccggactggctggtgatgattcagaccttcggcatcttcgccgccggttatctggtgcggccgctcggcggcatcgtgctcgcccattatggcgacaggtatggacgcaagcgcgtcttcgccttctccatcctcctgatggcgctctccacactcggcatggcgctgatgccgacctatgccaccatcggcgtggcggccccgatcctgctcatcatcctgcgcatgctgcagggcgccgccatcggtggtgaagtaccgggagcctggacatttgtcgccgaacatgtgcccttccgccgcgttggcctcgcctgcggtttcctcacctccgggctttcgttcggcatcatgctggggtcgctgatcgcctttgcgatcaactcgctcttcacaccggaagacgtggccggctacgcctggcgcatcccgttcctgcttggcggcgttttcggcctcatcgccgtctatctgcgccgttggctggaagagacgccgatctacatggagatgaagaagtcgaagtccctcacggacaagctgccgcttggcctcgtgctgaagcatcacaggcgtggcgtgatcatttccgccctgctgacctgggttctgtcagcggccatcgtcgtcaccacgctgatgacggccaccttcctgcagaagctctacggttacaccccgacgcaggccttagccggtaccagcttcggcacgctgttcctgatcttcggcgtcatcatcgccggagcgctgatcgaccgcgtcggctccggcatctttttcatgggcgccagcatcttcttcggcatcgccaccttcaccttctacagctatgccggcacctcgctcgaaaccatgttcgtgctttatggcgtgatgggcctttcggtgggcatggccggcgccgtgccctatgtcatggtgcgggccttcccggcatcggtccgcttctccggcctctccttcgcctacaacgtctcttatgccgtcttcggcgggctgacaccgattggcgtaacgacggcgcttgccatcaatccgatggcccacgcctggtatctggtcttcatcgccttcctcgccttcgcgatcggcctctacctc

SEQ ID NO: 38780 - DNA, 870 bp, Agrobacterium tumefaciens; identical to SEQ ID NO: 35252

SEQ ID NO: 38781 - DNA, 1215 bp, Agrobacterium tumefaciens
gcgaaagctgcttcgcgaccgttgtccatcgccggcacggaccagaagaaccgtgcgctgcttgccatggcatctgccattgaggcttcgaaggaggcgatccttgccgccaaccgcaaagatctggcggctgcggaaagcgccggccttgccgcttcgttcgtcgacaggctgacactcaacgatgcgcgcatcgccggcattgccgaaggcatccgctcggttgccgcgctggccgatccggtgggtgaagtcatcgccgcctgggatcgccccaacgggctgaaaatcgagcgcgtgcgcacgccgctcggcgttatcggcgtgatctacgaaagccgcccgaatgtgacggcggatgcgggcgcgctgtgcctcaaggccggcaacgccgtgatcctgcgcggcggctcggattcgcaacattcatcgcgtgctatccatgcctgtctcgtgcagggcctgaggatcgccggtcttccggagaatgccattcaactcgtgccggtaaccgaccgcgcggctgtcggcgctcttctcagcgggcttaaaggtacggtcgatgtcatcgtgccgcgcggcggcaaaagcctggtggcgcgggtgcagtctgaagcccgtgtgccggtcttcgcgcatctggaaggcatctgccatatctatgtcgacaaatccgctgatctcgacatggcaaaagccatcgtcgtgaatgcgaagatgcgccgcaccggcatttgcggggcggccgaaaccctgctggtggatgcgtctgccgtctccagtcatctcgagccagtcgtcaaagccctgcttgacgcgggttgcgaagtacgtggttcgcagccggttcgtaatgtggttgaggggctggaggccgctacggaagaggactggcgcaccgaatatctcgatgcgatcatttcggtcgccgtggtggatggcatttccggcgcgatcgagcatatcggcacctattcgtccaatcataccgaggcggtgatcgccgaggacccggatgtggtcgcgcggtttttcaacgaactcgattcggccattctgctgcacaatgcctcgacgcaatttgccgatggcggcgaattcggcatgggcgcggaaattggcatcgccaccggcaagatgcatgcgcggggccctgtcggcgtcgagcagctcacctcgtttaaataccgtgtgcatggcaccggccagacacgg

SEQ ID NO: 38782 - DNA, 723 bp, Agrobacterium tumefaciens; identical to SEQ ID NO: 35143

SEQ ID NO: 38783 - DNA, 1179 bp, Agrobacterium tumefaciens; identical to SEQ ID NO: 35142

SEQ ID NO: 38784 - DNA, 789 bp, Agrobacterium tumefaciens; identical to SEQ ID NO: 35141

SEQ ID NO: 38785 - DNA, 1038 bp, Agrobacterium tumefaciens; identical to SEQ ID NO: 35414

SEQ ID NO: 38786 - DNA, 660 bp, Agrobacterium tumefaciens; identical to SEQ ID NO: 35415

SEQ ID NO: 38787 - DNA, 1260 bp, Agrobacterium tumefaciens; identical to SEQ ID NO: 35410

SEQ ID NO: 38788 - DNA, 735 bp, Agrobacterium tumefaciens; identical to SEQ ID NO: 35412

SEQ ID NO: 38789 - DNA, 927 bp, Agrobacterium tumefaciens; identical to SEQ ID NO: 35413

SEQ ID NO: 38790 - DNA, 1188 bp, Agrobacterium tumefaciens
gatatcagcgaaaacgatctattgatcggcggactttcggtgcgcgatatcgttgcagaaaccgggaccccgtgttttctctatgataacagcgccatgcgccaagcctatcgcgatctcgaaacggcgctttccggttttgccgatatctattattcggtgaaggccaatcccctgcccgccatcatctcacttttccgcgaagaaggcgccggcgcggaaatcgcctccgttggcgaatatcgcgccgctgtaaaggccggcgtcgcgcctgataacatcatcttcgccggccccggcaagagcatggccgaattgcgcgaagtgatcgagggcggtatcggtgaaatccacatcgagagtgcggaagaaatcgcccgtatcgaggcgatcaacaggccggtcaaggcgtcgatccgcatcaatccggtgccggatgcgcaggcgggcgccatgcgcatgggcggcaaggccacggccttcggtttcgacgaggaggaactggaaaacgtcctgaagctctttgcgaacgtcagacatatcgatctcgttggtatccatatttacggcggcacgcagatcctcgatgccgacatgcttgtctcccaatggcgacacgccatcgctcttgcaggtcgcatggcgcaaatgctcggcaaaccgctcgaaaccatcgatctcggcggcggcctcggcattccctatttcgccggggaaacatcgctcgatctcgccaaggtggctgccgccattcccgatctcaaggcgcttctaaaggcgcatccgctgatcgccgatgcccatgtcatagtcgaacccggccgcttcctcgccggccctggcggcctctatgtggtagaggtcaactcggtaaagacctcgcgcggcaccaccttcgtggtcacggatggcggcatgcaccaccacctggcagcctccggcaatctcggccagatcgtcaaacgcaactaccccatcgtcgcaccggccatgatgcaggcggcacacgatgagacagccaccatcgtcggcccgctctgcaccccgctcgatacgctcgcccgcaatgcgaccctgccgaaactgaacgccggcgatctcctcgccatcctgcaatccggtgcctatggcgcgagcgccagcccaggcggttttctcagccatacggtagcgaaggaagtgctggtg

SEQ ID NO: 38791 - DNA, 1287 bp, Agrobacterium tumefaciens; identical to SEQ ID NO: 38329

SEQ ID NO: 38792 - DNA, 414 bp, Agrobacterium tumefaciens; identical to SEQ ID NO: 35390

SEQ ID NO: 38793 - DNA, 1533 bp, Agrobacterium tumefaciens; identical to SEQ ID NO: 38162

SEQ ID NO: 38794 - DNA, 1434 bp, Agrobacterium tumefaciens
ttcatcgacggggattatgtcgaggacaataccggcacgccgttcgagagcatcttccctgcaacgggcgaaatgattgcaaaactgcatgcggcaacgcccgccatcgtcgagcgcgccatcgcctcggccaagcgcgcccagaaggaatgggcggcgatgagccccatggcccgcggtcgcatcctcaagcgcgccgccgatatcatgcgcgaacgcaacgatgcgctttccacgctcgagacgctggataccggcaagccaatccaggaaaccatcgtcgccgatcccacctccggcgccgatgccttcgagtttttcggcggcatcgcaccttccgcgctgaatggcgattatatccccctcggcggcgatttcgcctataccaagcgcgtgccgctcggtgtctgcgttggtatcggcgcctggaactatccgcagcagattgcctgctggaaggctgcaccggccctcgtcgccggcaatgccatggtcttcaagccctcggaaaacaccccgctcggtgccctgaagatcgccgaaatcctgatcgaggcgggcctgccaaaaggcctcttcaacgtcattcagggtgatcgcgataccggcccacttctagtcaatcatcccgatgtcgccaaggtctctctcaccggctcggtgccgaccggtcgcaaggtggcggccgccgctgccgggcatctgaaacatgtgacgatggaactcggtggcaagtcgccgatgatcgtcttcgacgacgccgatattgaaagtgccgtcggtggggccatgctcggcaacttctattcttccggccaggtctgctcgaacggcacgcgtgtcttcgtgcagaaaaaggcgaaggcgcgtttcctcgaaaacctgaaacgccgcaccgaggcgatgatcctcggcgaccccttggattacgccacccatctcggcccgctggtctccaaggcccagcaggaaaaggttctgtcctatatcgaaaagggcaaggcagagggtgcaacgctgatcaccggcggcggcattcccaataatgtcgcgggtgagggcgcctatgttcagccgactgtctttgccgatgtcaccgacgacatgaccatcgcccgcgaggaaatcttcgggcctgtcatgtgcgttctggatttcgacgatgaggacgaggttctcgcccgcgccaacgccaccgaattcggccttgccggcggcgtctttaccgccgacctcgcccgcgcccaccgtgtggtggatgggctggaggcgggcacgctctggatcaacacctacaatctctgcccggtggaaattccctttggcggctccaagcaatccggtttcggacgggagaattccgccgcggcgctggagcattatagcgaattgaagaccgtttatgtcagcacggggaaggtggacgcgccttat

SEQ ID NO: 38795 - DNA, 1695 bp, Agrobacterium tumefaciens
gtcacagatgtgaccgagatgaaggtgcgcgaggaggagttgcagcggctgctttcgcgtgcggaggccgcggacagggccaaatcggaatttctggccaatatgagccatgaaatccgcacgccgatgaacggcgtgcttggcatggcggagcttctggccaagtccaagctcgacacgcgccagaagacctttaccgacatcatcgtcaagtcaggcaatgcgctgttgacgatcatcaacgacattctcgatttctccaagatcgaggcggggcagatgaagctgcgcagcgtgccttttgatcccgctgaggcagtggaggatgtggtctcgctcctgtcctcggcggcgctggaaaaggacatcgagctgatcgttcgcattgatgcctcggtgtccggcaaggtcatcggcgatgccggccggttccgccagatcgtcaccaatatcgtcggaaatgccgtcaagttcaccgaaaccgggcatgtgctggtcgagctttcggcgcagtcggcggaggcgtcggaaagcattttttcactgcgtgtcgaagacagcggcatcggcattccggtcgacaagctggaaacgatctttgacaagttcagccaggtcgatggttccgcgacacggcggcacgagggaacggggctgggcctagcgatcacggtaggcctcgtcggcctgttcgacggcaagatcaatgtcgtcagcgaggtcggcaggggctcggccttcgaggtcgatattccgtttcaggtgatggagcgacggcgggacgtgccgctgctttccgtggcgatcgatgatatccgggtgcttgtcatcgacgataatgacgtcaaccgccgcatcctgaccgagcagcttcgcagctggggtatagatggccacgcggtggagaatgggccttccggcatcgccgtgttgcaggaagcggcgtctctcggctttgccatcgacgccatcatcctcgattatcatatgcctgtcatgaacgggctcgacgtggtggagcgtatccgggctgataagcgctttgacgatattgccattgttttcctgacctcgatggatgtggtgggcgacgagacgctgtttaccgatctcagcgtgcaggcgcatctgatgaaaccggcgcgggcccggctgctgcgctccaccctgttcgacgtggtgcgcgatgtgcggctgaagcgcatccgtcagcatccgcttgcgcaggggacgggtggagagaaagcccggccggaaagccggcccgccgaaaagaagcaacgagctgaggctccggccacggttcccgaacgtagccggccgtgccttctcgatgtgctggtggccgaggataacgacgtcaaccagattgttttcagccagattttgcagcaggcaggcctgcgcttcctgatcgtcggtaatggcaagagggccgttcaggcatgggaggagtataatcccgccctcattctgatggatgtatccatgcctgtcatgaacgggcaccaggcgacacaggccattcgcgctgccgagcaggcggccggtgatagccggcatgtgcctgtcatcggcgtcaccgcccatacgcaggaggcggaccgggagcgctgcctggaggcgggcatggatgattatctgtcgaagccgatcagccccgaaagcctcgaagacaagatcgcgcaatggctg

SEQ ID NO: 38796 - DNA, 1017 bp, Agrobacterium tumefaciens; identical to SEQ ID NO: 35277

SEQ ID NO: 38797 - DNA, 1452 bp, Agrobacterium tumefaciens; identical to SEQ ID NO: 38164

SEQ ID NO: 38798 - DNA, 738 bp, Agrobacterium tumefaciens; identical to SEQ ID NO: 37960

SEQ ID NO: 38799 - DNA, 1221 bp, Agrobacterium tumefaciens
gttgccaagcgccaggcaacttttggagcttcctccgtactcttttatgagcagccgatcgagatggtgagcgcgcagggcgcctatctgtatgacgccggcggacgcaagtatctcgacgtctacaacaacgtaccgtcggtcggccactgccatccacgggtggtcgaggccatcgcccgacaggtcggcgaactcaacatccacacgcgctatctcaaccgcgtcgtcgaggcttacaccgaaaatctgctatccaaattcccggcaggcctcagcaatgtcgttttgacctgtacgggcagcgagagtaacgacctcgccctgcgcatcgcccgcattgggaccggggccgaaggcttcatcgtcaccgaggcagcctatcacggcaacactgcgctggtgacggaagtctccccctcgtcgctgcgcaagcgcaaacccgccgcatttgtggcaatcattccagcgcccgccgctcgtgatggcatgagcgtggcctcaaacttcgccgcgtccgtggaacaggcaatcaacgagctcaattcacgaggcattaaattcgctgcgttgatcgttgacacaatcttttccagtgacggcatctatgccgatcctgcaggtttcctgaaggaggcggttgacgtggtgcaccgagccggcggcctgttgatcgccgatgaggtccaaccgggcttcggccggacgggaggcagcctttggggcttcgagcgtcacggtgtcacgcccgacattgtcacgatgggtaagccgatgggcaatggcttccccatgggcggcgtcgtaacacgacctgacctgctccagaggttctgcgaggaaaccggttatttcaataccttcggaggcaatccggtagctgccgccgcaggccatgccgtgctgcgagtgattgaggaggaaggtctgatcgaacgctcggccactgtcggcggttacttcaagcagtcgctccaggctttgcaaagtcggcattcggaaatcggcgatgtgcggggcgccggccttttcatcggtcttgattttgtcgaccccgccacgggggagccggacagcacacgcgctacccatgcgatcaatcagttgaggcacaacagtatattgatcggggcagcgggcaaatatggcgcgacgctgaagatccggccgccactgtgtttttcgaacgaggatgtcgacctcttcaccggcaccctggac

SEQ ID NO: 38800 - DNA, 1401 bp, Agrobacterium tumefaciens; identical to SEQ ID NO: 35097

SEQ ID NO: 38801 - DNA, 1431 bp, Agrobacterium tumefaciens
ctgcatcgacgcgatttgatcgaagaccgtgcgtttgtgaatggggcatgggtggagcgcgatcagatgttcgccatcgttgatcccgcgggaggcgatcacctcgccgacgtggcgtcctgcacgctcaatgatgtcgattttgcgatagacgcagccagcaaggctttcgccggctggcgcgatatgctgcctgttgatcgcggcgacattttgcgcaactggagtgcgcgcatgcgggagaatgcgcatgacctcgccacgatcatcagcgccgaacagggcaaaccgctggcggaatcacgcggcgaaatcgcctacgccgccaatttcctcgactggttcgcgagtgagggggagcgatcttacggcgaaacaattccaacccatctgaagggcagcaatctttccgtgcggatgcagccgatcggcgttaccgtcgccatcacgccatggaactttccctcagcgatgatagcgcgcaaggccggtgctgcacttgctgccggctgtacgatgatcgtcaaacctgctcccgaaacacctctgtcagcgctggcgctggcaagacttgccgaagagtccggcgtaccacctggcgtattgcaagttctgccgggagaagccgcaccccttgcgcgccgccttctggaaaataccgaggtgcgggcattttcctttacgggttcgaccgaggtgggacgaattcttctgacgcaatctgcggcgacggtgaaaaaagcatccttggagcttggagggcacgcacccttcatcgtcttcgcagatgcagatctcacagaggccgtcaaaggctgtctgggcgcaaaattcgccacttccgggcaggactgtcttgcggcaaaccgcatctatgtgcagcgcagcctttatccgcgatttgttgagcggtttgccgaggcgacgtccaggctgactgttggtcatggcctcgaaaccggtgtcgatatcggccccatgacgcggccgtccgtcgccgaaaagtgccgccagcaggttgcccaggcgctgtcggcgggtgcacggctcgtctgcggcggacaggacagtccgctcggcggcaacttcgtcacccccaccgtgcttgccgatgttaccgacgacatgctgatcgcccgcgaagaaaccttcggcccggtggccgccatcttgccgttcgatgacgaggcggaggtgatccgccgcgccaatgcaacagagatgggactggcggcctatctctacaccaacgatctcggccgggcgatgcgcctgaccgaccagctcgaatacggcatggttgccgtcaacacgccgaaattcaccggagcgcccattccattcggcggctggaaacaatcaggccttggccgcgagggctcgcgtcatggcctcatggaatatctcgaacccaaatatgtctgcttcggc

SEQ ID NO: 38802 - DNA, 1293 bp, Agrobacterium tumefaciens
tattttcaggttctggtggccatcatcgccggtatcgcactcggccatttttacccgaccttcggcgaacagctgaagccgctcggcggacgagcttcatgcgtctcgtcaagattgatcatcggtcccgtcatcttcctcaccgtcgcaaccggcattgccggcatgaacgacatgaagaaggttggccgcgtggccggagcggctcatgatctacttcctgggcttctccacggctcgcgctcatcgtcggcctgatcgttgccaacaccggtgcagccgggcgccgggatgaacatcgatccggcgaccctggatgccaaggctgtcgcgacctatgccgacaaggcccatgagcagaccatcaccggcttcctgatgaacatcattccgaccaccatcgtcggtgcgtttgccagcggtgatatcctgcaggtgctgttcttctccgtgctgttcggcatcgcactcggcatcgtcggcgaaaagggcaagcccgtcaccgatttcatgcatgccatgatgtacccgatcttcaagctggtcgcgatcctgatgaaggccgcccccatcggcgctttcggtgccatggcatttaccatcggcaaatacggcatttcctccgtcaccaatctcgccatgctgatcggcaccttctacatcacgtccgcgctcttcgtgttcgtggttctcggcgcggtctgccgttataacggcttctccatcgtcgcgctgatccgctacatcaaagaagagctgctgctggttctcggcacctcttcatcggaagcagccctgccgggcctgatgagcaagatggaaaaggctggctgcaagcgctccgtcgtcggcctcgtcatccccaccggttactccttcaaccttgatggcaccaacatctacatgacgctggccgccctcttcatcgcgcaggcaaccggtatccacctgtcctttggcgaacagatcctgctgctgcttgtggccatgctctcctccaagggcgctgccggcatcactggcgctggcttcatcacgctggccgcaaccctctcggtcgtgccttcggttccggtcgccggcatggcgctgatcctcggcatcgaccgcttcatgtcggaatgccgcgcgctcaccaacttcgtcggcaatgctgtcgccaccatcgtcgtcgcccgctgggaaggcgaactcgaccaggagcagctcgcgcgcgtcctcagcggcaaggaagaattcaccagcattgccgatgtggacgccctgccggcatcggtgcagcccgccgaataa

SEQ ID NO: 38803 - DNA, 1209 bp, Agrobacterium tumefaciens; identical to SEQ ID NO: 35345

SEQ ID NO: 38804 - DNA, 1198 bp, Agrobacterium tumefaciens; identical to SEQ ID NO: 35344

SEQ ID NO: 38805 - DNA, 1302 bp, Agrobacterium tumefaciens
gcccatctggtgcaccctgtctcctccttccgcggccatgaaaagctcggcgtgcgggtgctgaaatctgcaagcggcgccaccgtcaccgatatgaccggccatcagctgatcgatggttttgccggcctctggtgcgtcaatgccggttacgggcacgacagcatcgttgaagcggcggcaaagcagatgcgtgaattgccctatgccaccgcttatttcgacattggcagcgaaccggcgatccggctggcctcggaacttgccgaccgcgcgccgggtgatctcaaccacgtctatttcacgcttggcggttccgatgccgtggacagcaccatccggttcatccggtattactggcatgcgaaaggccagccgcagcgcgaccagttcatttccatcgaacaggggtatcacggctccaccaccgccggctccggcctcactgcgctacccgctttccacgcgggtttcggcgtgccctatgactggcagcacaaaattccgtcgcattatgcctatcgcaatcccgccggcagcgatccggccgccatcatcgcatcctccctgcaaattctgaaggacaagatcgaggccatcggcccggaccgcgtggccgccttttatgccgaacccatccagggatcgggcggcgttctggtgccaccgccgggctggatcaaggccatgcgcgagctctgcagttcctatggcattctcttcgtcgccgatgaagtcatcaccggcttcggccgcacgggaccgctctttgcctgcgccgacgaggacatcgtgcctgatttcatcacggccgcaaaaggcctcacgtcaggttatgtgccgatgggcgccgtcttcatggccgaccatgtttatgatacaatagccgacttcgcgggcgaggccgccatcgggcacggatatacctattccgcccaccccgtcagcgccgctgtcggtctggaagtgctgaaactttatgaaggcggactgctggagaacggccgtcgcgccggtcaacggctgatggccggccttgaaggattgagaaaccacccgctggtgggtgatgtgcgcggccggggcatgctcgccgccattgaactcgtgaccgacaaggacaagaaaacgcccttgccggccgcagccgcccccgcgcgaaaagttttcgaccgcgcctgggaaaacggcctcatcgtacgcgccttcgcgaacggcatcctcggttatgcgccgccgctctgctgcaccgatggcgaaatcgacgccatcgtcgagcggacgctgaagacgctcgatcag

SEQ ID NO: 38806 - DNA, 1716 bp, Agrobacterium tumefaciens
aaaaagttgctgacgcggctttttaaagaaaatttcaaaaaacacgttggctggtattctgcggcgattgtggcaatgttgctggttgcgggcacaacctcgctcagcgcgtggatcatgcgtgacattgtcaacagcgtctatttgaaacaaggtttcgatgtcgttcttgagattgcctttgccgttgcagccatcttcatcgtcaaggggctcgctaccttcgtgcaaagctactatcttagcaaagcggggaacagcatcgttgccgaacaacaacgcaagatctacgatcggcttctgaagcagggcgtgtccttcttccagaacctgccatcttcagaactccttgtccgcgttacttacaacgctcaggctgcgcgcagcgtgatcgacacgatcgtgacatctttcgtccgcgacctattttcccttcttggcctgatcatcgtgatgtttgcccagaatttccttctgagcgcgatttccatgattatcggccctgtggcgatatttagcgttcgtctcgtgctgcggcgcgttcgaaagatcatggaggcggaacttgcttcactgggcgaaatcgtcaacgtcgtgcaggaaacgagtattggcgttcgcgttattaaggcattttcgcttgagaaactaatgcgccagcgcatgaacaaggccgtgtccgacgtcgagcatcgtgcaaacggcattgcgaagcttgaagcagcaaccagcccgatcatggagaccctgtctggcctcgccattgcagtcgtcatcgccgtttccggttataccgtgcttgaaaaaggcggatcaccgggtgacctgatggcctttatcaccgctttgcttcttgcttacgaaccagcaaagcgtctggcccgcatgcgagtccaaattgaaggcggcatgatcggcgtgcgcatgatgttcgaggttttggacgctccattgacacttgccgagaaaaaggatgcccagccgctccccaaggcaagcggcaatgtggaactcaagaacgtcagcttcgaatatgttgctaaccagcctgttctgaaggacgtcagcgtcctcttcgaaggtggtaagatgactgcgctggtcggaccttccggcagcggcaagtcgacgatcatcaacctcatgatgcgtctttatgatccgcagagcggttccgtcgagatcaacgggatggatttgcgcgacgtgtccttcgccagcctgcgcgagcatgtttcttacgtcggccaggaaaccttccttttctctggaacggtgaagcacaatatttccgtcggtcgcgacaacgctaccgatgaggaaatcatcgccgcggccaaggcggcaaacgcacatgatttcatcatgaacatgcctgatggttacgacagcaagcttggcgaaaacggctccggtctgtctggtggccaaaggcagcgcgttgcaatcgcccgcgcgatgctaagagacgcagacatattgatcctcgacgaagcaacaagcgcgctcgattcggaatccgaagcgcttgtccgggacgcgcttgagcgtttgacgcttaacaagacatccattgtcattgcccaccggctctctacaataaaccgggccgacaagattgtcgttatggataatggtcaggttgtggagcaaggaagccgtcgcgagttgctcgccacggatggtctctacaagcgcctgcacagcatccagttc

SEQ ID NO: 38807 - DNA, 639 bp, Agrobacterium tumefaciens
atattttcgcaagagttcgcggccttcctgttcgacatggacggaacgctggtcaattcgattgccgttgtcgagcgcgtctggcgggagtgggccgttgcaaacggtatcgagccgaacgcatttctgcaacgtatccatggcatgcgggcttccgaggtaatacgccgcgaggcggttcccggcctggacgtggatgccgaggccgacatgatcttgcgcgccgagatggatgacgtggagggcatcattccgataccgggcgccgcagactttcttgcgtctttgcccgcgggaaaatgggctatcgtcacctccgccgtgcgtgaactggcggaaaaacggctcgcggcggccggcatcacaccgccacccgtgatgatctgcgccgacgatgtggtcaacggcaagcccgatcccgaaggttaccggaaggccgccgaaaggctcggcgttgcgccggaaagctgcgtcgtcttcgaagatgcgcccgcgggcatccaggccggcgaacgcatgggggctgcggtggtggtcatcaacgtgacccattcccacccgatcgagacgccgcatcttgccatcggcagttacggtgaactggatgtggtgatcgacgggaatggtggcctgaagctg

SEQ ID NO: 38808 - DNA, 1005 bp, Agrobacterium tumefaciens; identical to SEQ ID NO: 35347

SEQ ID NO: 38809 - DNA, 1173 bp, Agrobacterium tumefaciens; identical to SEQ ID NO: 35132

SEQ ID NO: 38810 - DNA, 588 bp, Agrobacterium tumefaciens; identical to SEQ ID NO: 35156

SEQ ID NO: 38811 - DNA, 762 bp, Agrobacterium tumefaciens
ctcaaagcccgcattattccctgcctcgacgtgaaagacggacgtgtcgtcaagggtgtgaacttcgtcgacctgatcgatgctggcgacccggtcgaggcagcaaaagcctatgacgcggcgggagcggatgaactctgcttcctcgacatcaccgcgtcctcggacaatcgcgacaccatcttcgatgtcgtctcacgcactgcggaccattgcttcatgccggtgacggtcggtggcggggttcgtagcgtcgcggatattcgtaagctgcttctttgcggtgcggacaaggtctctatcaactccgcagctgtcaaggatcccgacttcgttgcgcaggcggccgacaagttcggcaaccaatgcatcgtcgtttccatcgacgccaagcgggtttccaaagatggcgaagctgaccgctgggaaatttttacccatggcggacgccagccaactggtatcgatgccgtggaattcgccatcaagatggttgaacggggtgccggcgaattgctcgtcacctcgatggatcgcgacggcaccaagagcggttatgatatcggcctgacgcgcagcattgccgatcaggttcgcgtgcccgtcatcgcctcgggcggcgttggtacgcttgatgatctggtggcaggtgttcgcgatggccacgcgacggcagtgcttgccgcttccatcttccacttcggcacctattcgatcggtgaagccaagagctacatggccgaacatggcattgccatgcgt

SEQ ID NO: 38812 - DNA, 1392 bp, Agrobacterium tumefaciens
cttgagaaggactacatcgtcgccgacatcaaccttgccgcattcggccgcaaggaactggacatcgccgaaaccgaaatgccgggcctgatgtcctgccgcaaggagttcggtgaaagcaagccgctgaagggcgcacgtatcaccggctctcttcacatgacgatccagaccggtgttctcatcgaaacgctcaaagaactgggcgcggaaatccgctgggcctcctgcaacatcttttcgacccaggaccatgcggcagcggccattgcagcagccggcattccggtcttcgccgtcaagggtgaaagcctgacagaatattgggaatataccgacaagatcttccagtggaccgatggcggcctctccaacatgatcctcgatgatggcggcgatgccaccatgtatatcctgcttggcgcacgcgccgaagccggtgaggatgtgctttccaatccggggtcggaagaagaggaaatcctcttcgcgcagatcaacaagcgcctcaaggcttcccccggctggttcaccaagcagcgtgatgcgttgaagggcgtgacggaagaaacgacgaccggcgttcatcgtttgtacgatctcgccaagaagggcctgctgcccttcccggccatcaacgtcaacgacagcgttaccaagtcgaagttcgacaacaaatacggctgcaaggaatcgctcgtcgacggcattcgccgtgcaaccgacgtgatgatggccggcaaggttgccgtggtctgcggttacggcgatgtgggcaagggttccgcggcctcgctgcagggtgccggcgcccgcgtgaaggtcacagaaatcgaccctatctgcgcacttcaggccgcgatggacggtttcgaggtggttcgcctggaggacgtggtttcctccgccgatatcttcatcaccaccaccggcaacaaggacgtgatccgcatcgagcatatgcgcgagatgaaggacatggccatcgtcggtaacatcggccacttcgacaatgaaattcaggtcgcctcgctgcgtaacctgaagtggacgaacatcaagccgcaggtcgacatgatcgagttcccgaagggcaaccgcatcatcctgctttccgaaggccgcctgctgaaccttggcaacgctaccggtcacccgtccttcgtcatgtcggcatccttcaccaaccaggtgcttggccagatcgagcttttcaccaagccgggtgaatacaagaacgaagtttacgtgctgccgaagcacctcgatgagaaggtcgcgcgcctccacctcgagaagctcggtgtgcggctaaccgaactttccgaccttcaggcagattatatcggcatctccaagcagggtccgttcaaggctgaacactacagatat

SEQ ID NO: 38813 - DNA, 2667 bp, Agrobacterium tumefaciens; identical to SEQ ID NO: 37992

SEQ ID NO: 38814 - DNA, 1051 bp, Agrobacterium tumefaciens
gtgctcatcggcggcacgtcctatgccggtgaaaacaagaagtcggtcttcacggtgctgaactacctgctgccggccaagggcgtgatgccgatgcattgctcggccaatgtcggtccctgagggtgattccgccgtgttcttcggcctctccggcaccggcaagaccacgctctccgccgacccggcacgcacgctgatcggcgatgacgaacatggctggggcgaacacggcatcttcaacttcgagggcggctgttatgccaaggcgatcaagctttcgtccgaggccgagccggaaatctacgccgcgaccaatcgtttcggcacggttctcgaaaacgtcgtgctggatgaaagccgggttcctgatttcaacgacaactcgctgacggaaaacacccgcagcgcctatccgctgcacttcattccgaatgcatcggaaacgggcattgccggccatccgaagacgatcatcatgctgacggcggatgccttcggcgtgctgccgccgatcgcgcgtctgacgccggaacaggccatgtaccacttcctctccggttacaccgccaaggttgccggcacggaaaagggcgtgaccgagccggaagccacattctccacctgcttcggcgcacccttcatgccgcgtcatccggcggaatacggcaacctgctgcgtgagctgatcggcaagcacggcgtcgattgctggctggtcaataccggctggaccggcggcgcctatggcatcggcaagcgtatgcccatcaaggcgacgcgcgcgcttctgaccgccgcacttaccggcgacctgaagaatgcgcaattccgcaccgatgcgaatttcggtttcgccgtaccgctgtcgctcgacggcgtcgatggtgcgatccttgatccacgttccacctgggccgatggcgcagcttacgacgcgcaggcgaagaagctggtatcgatgttcgtttcgaacttcaccaagttcgaagatcacgtcgacagcaaggttcgcgacgcagccccgggccttctgctcgcggctgaatga

SEQ ID NO: 38815 - DNA, 921 bp, Agrobacterium tumefaciens; identical to SEQ ID NO: 35349

SEQ ID NO: 38816 - DNA, 507 bp, Agrobacterium tumefaciens; identical to SEQ ID NO: 37998

SEQ ID NO: 38817 - DNA, 1110 bp, Agrobacterium tumefaciens; identical to SEQ ID NO: 38343

SEQ ID NO: 38818 - DNA, 987 bp, Agrobacterium tumefaciens
aaaaaacttgatcttatcacgatcgggcgctcgtctgtcgacctatacggttcgcaggtcggcggccgtctggaggacatggcctcctttgccaaatatattggcggctctcccaccaatatcgcagcgggtgctgcgcgccttggattgaacagcgccgtcattacccgcgtgggtgatgagcatatgggccgcttcatccgcgagcagctggtgcgcgaaggcgtcgatgtgcgtggcgtgaagacagacccggagcgactgaccgcgctggttctgctcggcattcgtgaccagaaccagttcccgctgatcttctatcgcgagaactgtgccgacatggcgctcagcgaagacgatatcgacccggccttcattgccgacgccggctgcatctgcgccactggaacgcatctgtcgcatccgaacacggaagctgccgtactgaaggcgctgaagctcgcccgtgaaaacggtgcaaagaccgcactcgatattgattaccgtcccaatctctggggtgttgccggccatggcgatggcgaaagccgtttcgtcgaatcgcagaaggtcactgccaagctgcaatccaccctgcatctctttgacctgatcgtcggcacggaagaggaattccacatcgccggcggctccaccgatacgctgaccgcgctcaacgccgtccgcaaggtctcgaatgcgacgctggtgtgcaagcgcggcccgatgggcgcttcggtcttcaccggcgatattcctgatagcctcgacgatggagaaacgggcgaaggtttcccgatcgaggtcttcaatgttctcggtgcgggcgatggtttcatggccgggctgttccgcggctggctgcgcggcgaggactggccgacgacactgaaatatgccaatgcctgcggcgctttcgcggtctcccgccatggctgcacgcctgcctatccgagctgggaagagctgcaatatttcttcaaggcc

SEQ ID NO: 38819 - DNA, 2883 bp, Agrobacterium tumefaciens
atggcccttgtaaccgaattcgactacggcaccccgaaatccaacgcgacggatatggtgacgctcacgatcgacggtcggcaggtcaccgttccgacgggaacctcgatcatgcgcgcctcgcgcgaagctggcatcgatgtcccaaaactctgcgccaccgacatggtggatgccttcggttcctgtcgcctctgtcttatcgaggtggagggccgcaacggcacccccgcctcctgcaccacgccggttgctgccggtctcgtcgtgcatacccagaccgagcggctgaagcagatccgcaagggtgtgatggaactttatatctccgaccacccgctcgactgtctgacctgcgccgccaatggcgattgcgaattgcaggacatggcaggtgccgtgggccttcgcgatgtgcgttacggttacgagggcgacaaccacgtcaagtcccgcaccggagggggcgatatcaatgcccgctggatgccgaaggacgaaagcaatccctatttcacctatgatccgtccaaatgcatcgtctgttcccgctgcgttcgggcctgcgaggaagtgcagggcacctttgcgctgacgatcgaaggccgtggtttcgagagccgcgtatcgcccggggcgcacgaggcgtttctcgattccgactgcgtttcctgcggcgcctgcgtgcaggcctgtccgaccgcgacacttaccgaaaaatcggtgatcgagatcggccagccggaacattcgatggtgaccacctgcgcctattgcggcgtcggctgctccttcaaggcggaaatgcgtggcgaggaattggtgcgcatggtgccgtggaaggacgggcaggcaaaccgcggtcattcctgcgtcaagggtcgcttcgcctatggttatgcgacccacagggatcgcattctcaacccgatgatccgcgagaatatcggcgatccctggcgggaagtgagctgggatgcggcctttgcctatgttgcttcggagtttcggcgcattcagggcaagtatggccgggagtccattggtggcatcacctcgtcgcgctgcacgaatgaggaaaccttcctcgtgcagaaactcgttcgcgccggcttcggcaataataacgtcgatacctgcgcccgcgtctgccattcgccgacgggttatggtcttggccaggccttcggcacctccgcaggcacgcagaatttcgacagcgtcgaacaatccgacgtggtgcttgtcatcggtgccaacccgaccgacggccatccggttttcggttcgcgactgaagaagcggctgcgtcagggcgcgaaactgatcgtcatcgatccgcgccgcattgatcttgtgcgcacgccgcatgtggaggccgctttccatctgccgttgctgccgggaacaaacgttgccgtcctgacagcactggcgcatgtgatagtcacggaagggttgttcaacgaggccttcattcgcgagcgttgcgactggtcggaattcgaggactgggccgcttttgtcgccgagccgcagcatagcccggaagagacggaacgtttcacgggcgtaccggctgaagatctgcgtggtgcggcccgcctttatgccaccggcggtaatggcgcgatctattacggtcttggtgtcacggaacacagccagggttcgaccaccgtcatggcaatcgccaatcttgccatggtcacgggcaacatcggccgccccggtgtcggcgtcaacccgctgcgcggtcagaacaatgtgcagggctcctgcgacatggggtctttcccgcatgagctgccgggctatcgccatatctccgacgatgcgacacgcgacgtgttcgagaaactctggggcgtgaagctcaacaacgaaccggggctgcgtattcccaacatgctggacgccgccgttgatggcagcttcaaaggcatctacatccaaggtgaggacattctccagtccgatccggacaccaagcacgtatccgccggcctagctgccatggaatgtgttgtcgtgcacgatctcttcctcaacgagacggcgaattatgcccatgtgttcctgccgggttccaccttcctcgaaaaggacggcaccttcaccaatgcggagcgccgcatcaaccgcgtgcgcaaggtcatgtcgccgaagaacggttatgctgactgggaagtgacccagaaactggcgcaggccatgggccttacctggaactacacgcatccctccgagatcatggacgaaatcgcggcaacgacgccaagctttgccagcgtttcctacgcctatctggaagagaaggggtcggtgcagtggccctgcaacgaaaaattccctgaagggtcgccgatcatgcatgtggacggtttcgtgcgtggcaagggtaagttcatccgcaccgaatatgtggcgacggatgaacgcaccggtccgcgtttcccgctgctgctcaccaccggccgcatcctgtcgcaatataatgtcggcgcgcagacacggcgcaccgaaaacgtcgtctggcacgaggaggatcgcctggaaatccatccgcacgatgccgaacagcgcggcgtgaaggatggcgactggatcaagctcgtcagccggtccggcgatacgacgctccgggcgctgatcaccgaccgtgtggcaccgggtgtggtctatacgaccttccatcaccccggcacgcaggcgaacgtcatcaccaccgacttctccgactgggcgaccaattgtccggaatacaaggtgacggcggttcaggtgtcgccctccaacgggccgacggaatggcaggaagaatatgatgcgctcgcgcgtcagtcccgccggatcgccggcaagctcgaagctgcggaataa

SEQ ID NO: 38820 - DNA, 1329 bp, Agrobacterium tumefaciens; identical to SEQ ID NO: 35421

SEQ ID NO: 38821 - DNA, 1032 bp, Agrobacterium tumefaciens; identical to SEQ ID NO: 35420

SEQ ID NO: 38822 - DNA, 714 bp, Agrobacterium tumefaciens; identical to SEQ ID NO: 35171

SEQ ID NO: 38823 - DNA, 1581 bp, Agrobacterium tumefaciens; identical to SEQ ID NO: 37983

SEQ ID NO: 38824 - DNA, 723 bp, Agrobacterium tumefaciens; identical to SEQ ID NO: 35173

SEQ ID NO: 38825 - DNA, 1008 bp, Agrobacterium tumefaciens; identical to SEQ ID NO: 35174

SEQ ID NO: 38826 - DNA, 1026 bp, Agrobacterium tumefaciens; identical to SEQ ID NO: 35374

SEQ ID NO: 38827 - DNA, 1383 bp, Agrobacterium tumefaciens; identical to SEQ ID NO: 35224

SEQ ID NO: 38828 - DNA, 891 bp, Agrobacterium tumefaciens
atggacgttcgcgccgccgttgccattcaggcaggaaaaccgctcgaggtcatgaccgttcagcttgaaggtccccgcgccggtgaagtgctgatcgaagtcaaggcgaccggcatctgccacaccgacgatttcaccctctctggcgctgacccggaaggcctgttcccggcaatcctcggccatgaaggtgcgggcatcgtcgtggatgtcggccccggcgtcacctcggtcaagaagggcgaccacgtcattccgctctacacgccggaatgccgcgaatgctactcctgcacctcgcgcaagaccaatctctgcacctccatccgcgccacccagggccagggcgtgatgcctgacggcacctcgcgcttctcgatcggcaaggacaagattcaccactatatgggttgctcgaccttctcgaatttcaccgtcctgccggaaatcgcgctggccaagatcaacccggacgcgcccttcgacaaggtctgctacatcggctgcggcgtcacgaccggtatcggcgccgtcatcaacaccgccaaggtcgagattggctccacggcgatcgtcttcggtctcggcggcatcggtctcaacgtgctgcagggcctgcgtcttgccggtgcggacatgatcatcggcgtcgatatcaacaacgaccgcaaggcctggggcgaaaaattcggcatgacccacttcgtcaatccgaaggaagtcggcgacgacatcgtgccctatctcgtcaacatgacgaagcgtaatggcgacctcatcggcggcgcagactatacgttcgactgcaccggcaataccaaggtcatgcgccaggcgctggaagcctcgcatcgcggttggggcaagtcggtcatcatcggcgtcgccggc

SEQ ID NO: 38829 - DNA, 837 bp, Agrobacterium tumefaciens; identical to SEQ ID NO: 35470

SEQ ID NO: 38830 - DNA, 885 bp, Agrobacterium tumefaciens; identical to SEQ ID NO: 35469

SEQ ID NO: 38831 - DNA, 852 bp, Agrobacterium tumefaciens; identical to SEQ ID NO: 35468

SEQ ID NO: 38832 - DNA, 1962 bp, Agrobacterium tumefaciens; identical to SEQ ID NO: 35110

SEQ ID NO: 38833 - DNA, 2427 bp, Agrobacterium tumefaciens
agtcatcagattgcgatcgacggcatgacctgcgcctcctgtgtgggtcgtgtggagaaggcgatcgccagggtgccgggcgttttgaaggcctcggtcaatcttgcgacggagcgtgccgatatctccttttccggaccacctgatgtgcccgccgtgattgccgctgtacggcatgcgggttatggcgtcgaagaaaaaaccgtcgaactcgatattgaaggcatgacctgcgcctcctgcgtcggacgtgtcgaaaaggcgctgaaggctgtttccggcgtttccgatgcaagcgtcaatcttgcgaccgagcgcgccgccattcgtgtggcgggcaatgccgcttccgccgccactctggcggaggcgatcaagcgggcgggctatcaggcgaaagagatcgtcgccgacaaagccggcgatgcggaacaggacaggcgcgcagcggacatgcgcagtctgaaaatcagccttgccgtcgccgttgtcctgacattgccggtcttcgtgctggaaatgggttcgcacctggtgcctgccatccatgatttcgtcatggaaacggtcggcatgcggaaaagctggtatctgcaattcgtactgaccacgctggtcctattcgggcccggcctgcgcttcttcaagaagggcatacccgcccttatgaggctcgcgccggacatgaattcgcttgtggtgctgggcactgccgccgcctggggattttcggtggtcgcgaccttcctgcccgaaatcctgccgcgcggcacggccaatgtctattatgaggccgcggcggtcatcgtcacgctgatcctgctcggccgtttccttgaagcgcgcgccaaaggccgcaccagcgaggcgataaagcggctcgtcggtcttcaggccaagtcggcccgcgtgctgcgcgacggcgaaaccatcgatgtgcctcttcaggacgtgcgaacgggcgatgtgatcgtcgttcgccccggcgagaaagtgccggtcgacggtctggttctcaacggatcttcttatgtcgatgaatcgatgatcacgggtgagccggttccggttaccaagaccgagggttccgaggtcgtcggtggcacggttaaccgcaatggctccttcaccttccgcgccaccaaggtcggcagcgatacgctgatcgcgcagatcatccgcatggtagaagaagcgcaggccgacaagctgcccattcaggcgctggtggacaaggtgaccaactggttcgtgccagccgtgatgctggcggcacttgtcaccttcgccgtctggttcgtctttggacccgatccggccttgaccttcgcgctcgtcaacgcggttgcggttctcatcatcgcctgtccctgcgccatgggccttgccacgccgacgtcgatcatggtcggcaccggtcgcgccgccgaaatgggcgtgctgttccggcgcggcgatgcgctccagacgctgcgtgacgccgatgtcatcgcggtcgacaagaccggcacgctgacactcggcaagccgaaactggtgcattttaatacgacccagggtttcgatgcggatgaggtgctgcggctcgtcgcctcgcttgagaaccggtctgaacatccgattgccgaggcgatcgtcgaggctgcaaaacatggtggcctgacgcttgccgaagctgaagctttcgaggcgacccccggcttcggtgtcgcggcgacggtcgatggtcgcagggtagaggcgggtgctgaccggttcatggtgaaactcggttatgatgtcggggcctttgccacggatgccgagcggatgggcagggaagggcagtcgccgctttatgccgccgtcgatggccggctggccgcgatcatcgccgttgccgatcccatcaagcagacgacacccgaggcgattgcggcgctgcatgcgctgggcctcaaggtcacgatgatcacgggtgacaatcgccgcacggcggaagccattgcccgtcgcctcggcattgacgaggtggtggccgaagtgttgcccgacggcaaggttgaggcggtcaagaggctagccgccggcgggcgacgggtcgcctttgtcggggacggcatcaatgatgcgccggcgcttgccgcagccgatgtcgggcttgccatcggcacgggcacggatgtcgcgattgaaagtgccgacgtggtgctgatgtccggcgatctgcgcggtgttgccaacgcgattgctctctccaaggcgacgatccgcaatatccgccagaatctcttctgggccttcgcttacaatgccgcgcttgttcccgtggcggccggcatattgtatcctgtcaacggcgttctgctgtcgccagtccttgctgccggagccatggcgctttccagcgtcttcgtattgacgaatgcgctgcgtcttaaaagcttc

SEQ ID NO: 38834 - DNA, 966 bp, Agrobacterium tumefaciens; identical to SEQ ID NO: 35404

SEQ ID NO: 38835 - DNA, 861 bp, Agrobacterium tumefaciens
aagaaaattcggaaggccgtatttccggtcgcaggtctcggtacacgtttcctgcccgccaccaaggcagttccgaaagaaatgctcaccgtcgtcgacaagccggtcattcagtacgttgtcgatgaggcggcggaagcgggtatcgagcattttgtatttgtcaccggccgcggcaaggcagtgatcgaagattattttgatattcaatttgaacttgaacagatgctgcgcgagcgcaacaagaatgccgagctgacattgctggccggccttctgcccaaggcgggcacggcaagcttcacgcgccagcaggtgccgctcggtctcggccatgcggtttggtgtgcgcgtgatatcgtcggcgatgagccttttgccgtgcttttgcccgacatgatcatgcattcgcaaaaaagctgcctgaagggcatggtcgaactttacgaccagacccagggcaacgtcatcgcggtgcaggaatgcgctcccgaccagacgcataaatatggcattgttggcgtgggaaatgccgtcggcgaaggcttcaagattaccgaaatggtcgaaaagccagccaagggtacggcgccgtcgaatttctacatcaacggtcgttatatcctgcagccggaaattttcgatattctcgaaaatcaggaacgcggcgccggtaacgaaatccagttgacggatggcatgctgacgctcgccaagtcgcaagaattctccggctatacatcttccgtgggcagaccttcgattgcggcgccaaggatggtttcatcctggcaaacgtcgctttcgcactggagcgcggcgatatccgtccggcgatcgaggagccgatcaaggctttga

SEQ ID NO: 38836 - DNA, 915 bp, Agrobacterium tumefaciens
aaccagctcatcctttccagggccggttccgatgtccagatgatacccgaggtggccaaccatcttatctcctccggcggcaaacgcctgcggccgatgctgacgctcgcctcggcctcgatgttcggttatgagggagataaccacatcaagctcgccaccagcgtggagttcatgcatacggcgacgcttctgcacgacgatgtggtggatgaaagcgatctgcgtcgcggcaaatccaccgcccgcaccatctggggcaaccaggcgagcgttctcgtcggcgacttcctgctcggccaggctttccgcatgatggtggatgtcggttcgctggatgcgctggatgtgctctccaccgccgcttccgtcatcgccgagggcgaggtgctgcagctttcggtcgccaagaacatggaaacgaccgaggacgattacctgcaggtgattcgcgccaagacggccgccctctttgccgccgcggccgaagtcggccccattgtcgccaagacggacaaggcgagccgcagcgcgctgaaatcctatggcatgaatctcggcctcgctttccagctggtcgacgacgtgctggactatggcggcaagtccgccgatctcggcaagaacaccggtgacgatttccgcgagggcaagatcacgctgccggtcatcctgtcttatcgccgcggcacgcaggatgagcgcgccttctggcgcaacgccatcgaaaagggcgaaagcagcgacgagaacctggaaaaggctcttggtctgatcaccaagtataacggcttgggcgacacgatcggtcgcgccacacattacggcacgattgcccgtgacgcgcttgcgccgttgccgcagagcccatggaaaaatgcacttctcgaggtcatcgacttctgcatcgagcgt

SEQ ID NO: 38837 - DNA, 783 bp, Agrobacterium tumefaciens; identical to SEQ ID NO: 35451

SEQ ID NO: 38838 - DNA, 1200 bp, Agrobacterium tumefaciens
cacccgctttccggcaaggtggagccgcccggctccaaatccatcaccaaccgcgcgcttctcttggccggcctcgccaagggcaaaagccacttgtcaggcgccctgaaaagcgacgatacgctttatatggccgaagctctgcgggagatgggcgtgaaggtcaccgagcctgacgccaccaccttcgtggtggagggaacgggcgtgctgcagcagccggaaaagccgctgttcctcggcaatgccggcaccgccacgcggttcctgactgccgccggggcacttgtcgatggcgccgtcatcatcgatggggacgaacatatgcgcaaacgcccgatactgccgctggtgcaggcgctgcgggctctcggcgtggaagcggatgcgccaaccggctgcccgcctgtcaccgtccgtggcaagggtatgggttttccaaagggcagcgtcaccatcgacgccaatctctccagccagtatgtgtcggcactgttgatggccgccgcctgcggtgacaagcccgtggatatcatcctgaagggtgaggaaatcggcgcgaagggctatatcgacctcaccacatccgccatggaagccttcggagcgaaggtggagcgggtcagcaacgccatctggcgcgtgcatccgaccggttacacggcaaccgatttccacatcgagccggatgcctccgccgccacctatctctggggcgcggagcttctgaccggcggtgctatcgatatcggcacgcccgctgacaaattcactcagccggatgccaaggcttatgaggtcatggcgcagtttccgcatctgcccgccgaaatcgacggttcgcagatgcaggacgccattccaaccatcgcggttatcgccgccttcaacgagacgccggtgcgtttcgtcggcatcgccaatctgcgcgtcaaggaatgcgaccgcatccgcgccgtctcgctcggcctcaacgaaatccgcgagggtctggcgcatgaagagggtgacgacctgatcgtacatgccgatccgtcgctcgccgggcagacggtcgatgcctccatcgatacctttgccgatcaccgcatcgccatgagttttgcactggcggcgctcaagatcggaggcatcgccatccagaatcccgcctgcgtggccaagacctatccgggctactggaaagcgcttgcctcgctc

SEQ ID NO: 38839 - DNA, 1011 bp, Agrobacterium tumefaciens
acaatgaaggcggcggttgtccgcgcatttggaaaaccgctgaccatcgaggaagtggcaataccggatcccggccccggtgaaattctcatcaactacaaggcgacgggcgtttgccacaccgacctgcacgccgcaacgggggattggccggtcaagcccaacccgcccttcattcccggacatgaaggtgcaggttacgtcgccaagatcggcgctggcgtcaccggcatcaaggagggcgaccgcgccggcacgccctggctctacaccgcctgcggatgctgcattccctgccgtaccggctgggaaaccctgtgcccgagccagaagaactcaggttattccgtcaacggcagctttgccgaatatggccttgccgatccgaaattcgtcggccgcctgcctgacaatctcgatttcggcccagccgcacccgtgctctgcgccggcgttacagtctataagggcctgaaggaaaccgaagtcaggcccggtgaatgggtggtcatttcaggcattggcgggcttggccacatggccgtgcaatatgcgaaagccatgggcatgcatgtggttgccgccgatattttcgacgacaagctggcgcttgccaaaaagctcggagccgacgtcgtcgtcaacggccgcgcgcctgacgcggtggagcaagtgcaaaaggcaaccggcggcgtccatggcgcgctggtgacggcggtttcaccgaaggccatggagcaggcttatggcttcctgcgctccaagggcacgatggcgcttgtcggtctgccgccgggcttcatctccattccggtgttcgacacggtgctgaagcgcatcacggtgcgtggctccatcgtcggcacgcggcaggatctggaggaggcgttgaccttcgccggtgaaggcaaggtggccgcccacttctcgtgggacaagctcgaaaacatcaatgatatcttccatcgcatggaagagggcaagatcgacggccgtatcgtcgtggatctc

SEQ ID NO: 38840 - DNA, 861 bp, Agrobacterium tumefaciens; identical to SEQ ID NO: 35263

SEQ ID NO: 38841 - DNA, 1461 bp, Agrobacterium tumefaciens
gtgcgctggcaatcctatatgcatgtggcgcggcaatcgctgacctttttccagaatgatttttccggccgcatcgtcaccaaggtctggtccggcgggcaggcggcgggcgatctcgtcacctcgctgatggaaagtgtgtggttcgtcggtatctattcggtttcaatgctgttcctgatcggcgggctggactggcggcttgcggttctcgtcgtcgtctgggtagcgatcttctcgctgctggcgcggtatttcgtgccgcgcatccgccatcattcaaaggagacggcggaagccgcctcgatgctgtcaggccgcatggtggatgcctatagcaatatccagacgctgcggctgttcgggcgcgacgacgccaatgatcgctacatgcgtcagggcttcgatattttccagacctcgacgatgaagtttacgcggttcatcaccggcgtgcgcgcctccatggcgctgctatcgggcgtgatgatcacctccatggcggcgctctgtatcgatttgtggctgtccggcaagatcagctccggtgcggtggctttcacgctggcgctggtactgcgcctcaacttcctgctcgggcggttgatgacgcagttcaacggaatcatgcgcaatttcggcacggtgcagaatgccgccgaattgatctcgcagccgatcggtctcgttgatgcgcccgacgcggcggtgcttgaggtcaagaagccgagcatccgttttgagaatgtcagcttccattacgggcgggcgaatggcgtcatcgacaatctcaacctcgagatcagggccggtgaaaaggtcggcatcgtcggccgctccggcgccggcaaatccacgctcgtcaacctgctcctgcggttttacgatgtcgagaaaggccgtatcctgatcgatgggcaggatatagcccgtgtcagccaggaatccctgcgcgcccatatcggcatggttacgcaggatacatccctgctgcatcgttctatcagagacaacatcatgttcggccgcacggatgccacagaagcgcaattgattgaggcgacgcgtcgggccaaggcggatgatttcatcacaaggctggaggaccagcgcggccgcacgggttttgacgcgcatgtgggcgaacgtggcgtgaagctctccggcggccagcgtcagcgcatcgccattgcccgcgtgatgctgaaggacgcgccgatcctcgtgctcgacgaggcgacctcagcgctcgattcggaggtggaggcggcgatccagagcaatctggacgagctgatgcagggcaagacggtgctggccatcgcccatcgcctgtcgacgattgccgctctcgaccggctgatcgtgatggatcaggggcttatcgtggaagaagggagccacgctgagcttgtcgcacagggggggctttattcggagctttgggcgcggcaatcgggc

SEQ ID NO: 38842 - DNA, 1566 bp, Agrobacterium tumefaciens
ggctggcatctgatcgtcatggcggggctggtgctattcctgctgccgctgatgggcgcgatccacaccatgacgatgcaccagacgcttgccggcaatttcggtatgatcgcgcgctggaaaatgcaccgtttcctgctgcgccactccatgaactttttcgccaacgagtttgcgggccgggtttcgaccaaggtaatgcagacggcgctggcgatccgcgaagtggcgctgaaggtgatcgacgtcttcgtctatgcgatcagctttgtcgtctcgatgctgttcatggtcgcggcggcggactggcggttggtgatcccgctgctgatctggctcggtatctatatggcgatccttgcctatttcgtgccgaaactcggccggctggcgcaagaacaggccgatgcacgctcgatgatgacgggacggatcgtcgacagctacaccaatatctcgacgatcaagctgttttcccatgcggggcgtgaggaaagatatgcgcgtgagggcatgaatgtgttcctcggcacggttcaccgccagatgcgcaagatttccggcttcaacatcctgatcgacctcaacaatgccgtggtgctgttttccacggcaacgcttgggctgtatttctggatgcagggttcggtgacggccggttcggtcgccatcgccatcagccttgccatgcgcgtcaacggcatgtcgcagtggatcatgtgggaagtcacgtcgctgttcgaaaatatcggcactgtctatgacggcatgtcgatgatgacgaagcctcatgatattgtcgacgttccgaaagcgcctgagcttgcagcgccgcagggtgcaatccattatgacaacgtccgcttccactacggcaagaacaagggcgtgatcgacgggctgacgctcgacatcaagccgggcgagaaggttggccttgtcggccgttcgggtgcgggcaagacgacgctgatgaacctgcttctgcgcttctatgatctagaaggcggcaggatcacgattgacgggcaggatatttccaaggtgtcgcaggacagcctgcgcgagctgatcggcgtcgtgacgcaggatacctcgcttctgcaccgttcgatccgcgacaacatcgcctatggccatcccgaggccaccgacgagcaggtgatcgcggcggcgaagcgggcaaacgcctgggacttcatcgaaacgcttgtcgacatgcatggtcgtcagggtctcgatgcccaggtgggcgaacgcggtgtcaagctgtccggtggccagcgccagcgcatcgcgattgcccgcgtcttcctcaagaacgcgccgatcctggtgcttgatgaggcgacctcggcgctcgatagcgaagtcgaggcggcgatccaggagaacctgttctcgctgatggagggcaagacggtgatcgcgatcgcccaccgcctttcgacgctgaccgaaatggaccggctcatcatcctcgacaagggccggatcgtggaggcgggcagccatgcggaactggcggcgatgggcggcatctatgccgacctgtggcggcgtcag

SEQ ID NO: 38843 - DNA, 1314 bp, Agrobacterium tumefaciens; identical to SEQ ID NO: 35264

SEQ ID NO: 38844 - DNA, 831 bp, Agrobacterium tumefaciens; identical to SEQ ID NO: 35321

SEQ ID NO: 38845 - DNA, 1425 bp, Agrobacterium tumefaciens; identical to SEQ ID NO: 35320

SEQ ID NO: 38846 - DNA, 966 bp, Agrobacterium tumefaciens; identical to SEQ ID NO: 35405

SEQ ID NO: 38847 - DNA, 1071 bp, Agrobacterium tumefaciens; identical to SEQ ID NO: 35406

SEQ ID NO: 38848 - DNA, 726 bp, Agrobacterium tumefaciens; identical to SEQ ID NO: 35044

SEQ ID NO: 38849 - DNA, 819 bp, Agrobacterium tumefaciens; identical to SEQ ID NO: 35331

SEQ ID NO: 38850 - DNA, 666 bp, Agrobacterium tumefaciens
acctttctcatcaccggcgcatccgatggtatcggcgccgtatatgccgaacgcctcgcaggacgcggccacgatcttatcctcgtggcgcggcgtgccgagaagctgaaggcactggcagcgcagctggaaaaggaccacggcattgccgtcgaggttctcagcgccgatctttccagcgcggaagacctcgaaaaggtcgaggtccggctgcgcgaagaccagcgtatcaccggcctcgtcaacaatgccggcatagccggggaaggcgcgatcacggcactggacccggcctatgtgacgacgatgatcaatctcaacattcttgccgtcacccggctggcggcagccatcgcgccccgccttgccgccgcaggcaaaggcacgatcatcaacatgacttcggtcacggcgctgatgccggcggcattcaccgccgtctatccggccacaaaggccttcgtgctcgccttcaccgaagcactgcaggcgcagctttcgccgtccggcgtgcgggttcaagccgtgctgcccggcatcacccgcaccgcgatatgggaagaggaacggctcgatgccatcccggccgccatggtcatggacgtgcacgacatggtggacgcggcccttgccggtctcgatctcggtgaggcgctgaccattcct

SEQ ID NO: 38851 - DNA, 1116 bp, Agrobacterium tumefaciens
gaaatcgcagcattgcgcgacagcgccagtgcattcgcagatgataaaattgcgccgctcgccaccgagattgatcgcaacgaccgcttcccgcgtcagctctggccgcaaatgggtgagcttggcctgcacggcatcaccgtttcggaagagtttggcggtgccgatatgggttatctcgcccattgcgtggcgatggaggaaataagccgggcttccgcttccatcggcctttcctatggcgctcattccaacctctgcatcaaccagattcaccgctggggaaccgatgagcagaagcacagatatctgccgaaactcgtctccggtgaccatgtcggttcactcgccatgagcgagacggaagccggttccgacgtcgtatcgatgcggctgaaggcggaacgcaagggtgaccgttacgtactgaacggcgcgaagatgtggatcaccaatggccatgaagccgatacgctggtggtttatgccaagacggacatgtccgccggtgcgcgcggcatcaccgccttcctgatcgaaaagggcttcaagggtttccgcccggcccagaaactcgacaagctcggcatgcgcggctcgcccacatcggaactggtgttcgaggattgcgaggtgccggaggaaaacatcctcgggcgtttgaatgacggcgtgacggtgctgatgagcgggctggattacgaacgcgccgtgctggccgccggccctgttggcatcatgcaggcggccatcgatctggtgctgccctatgtccgcgagcgcaagcaattcggcaaggctatcggcgagttccagctggtgcagggaaagcttgccgatatctattcggccatgaatgcatcccgcgcctatgtctatgccgtggcccgcgcctgcgacaatggccgtatcacaagacaggatgcggcgggcgcgattttgtttgccgccgagcgggcgacacaggtggcgctggatgcgatccagcttctcggcggctccggttatgtcaatgaaagcccggccggacggctgctgcgcgacgccaagctttatgagatcggcgcaggcaccagcgaaatccgccggatgctgatcggccgcgaactggtcaag

SEQ ID NO: 38852 - DNA, 1956 bp, Agrobacterium tumefaciens; identical to SEQ ID NO: 38375

SEQ ID NO: 38853 - DNA, 1494 bp, Agrobacterium tumefaciens
aaacccgttgtcctgactattctcgatggctgggggctgaacgaggacacatccagcaatgcgccggttctggcgaatacgccgaccatggaccggcttttcgccacctgcccgaatgcaacgctgaccaccttcggcccgaatgtcggcctgcccaccgggcagatgggcaattccgaagtcggtcacaccaatatcggcgccggccgcatcgtcgccatggatctcggccagatcgatctggcgatcgaggatggcagctttttccgcaatgcggcgatgcttgatttcgccgccacggtgaaggccgcaggcggtgtggcgcatctgatgtgcgtcgtttccgatggcggcgtgcatggtcatatcctgcacggccaggcggcggtgaagctgatggtcagccacggtctgaaggtcgtggtgcatgccatcaccgatggccgcgatgtcgcgccgcaatcggcggaagatttcgtggcggcgcttgtggcaagcctgccgcagggcgcgagtatcggcacagtgatcggccgttattatgcgatggatcgcgacaatcgctgggagcgcgtcgagaaagcctatgacgccatggttctcggtaagggcgaacacgcgcgggatgcggtgagtgccgtggcccagagctacgcgaacaaagtcacggatgaattcatcctgccgacggtgatcgatggctacgaaggcttcaaggctggcgacggcctgttctgcctgaatttccgcgctgaccgtgcccgtgaaatcctgctcgccatcggcgcggatgatttcgacggttttgcgcgcgaaaagcccgtgctttcggcgctgctgggcatggtggaatattcgacgcggcacagtgatttcatgacgacggcttacccgaagcgcgatatcgtcaacacgctcggcgcctgggtggcaaagcagggtctgacgcagtttcgcctggctgaaacggaaaaatacccgcatgtcaccttcttcctgaatggcggcaaggaagagccggaagtgggcgaggaccgcttcatgccgaaatccccgaaggtcgcgacatacgatctgcagccggaaatgagcgctgccgaggtcacggagaaattcgtcgaggtgatcggcaagggttatgacctgatcgtcaccaactacgccaatcctgacatggtcggccataccggtgatctgcaggcggccatcaaggcgtgcgaagccgtggatcgcgggcttggtgccgtcgttgctgctctcgaaaaggtgggcggcgcgatgctcgtcattgccgaccacggcaattgcgaaaccatggtcgaccccgtcacaggtggcccgcatacggctcacaccaccaatccggtgccggtgatcctgtttggcggcccggaaggcgcaaaagtacatgatggcattctcgccgatgtcgcgccgacgctgctgcaactgatgaacgtgccgttgcccccggaaatgacgggcaagagcctg

SEQ ID NO: 38854 - DNA, 1275 bp, Agrobacterium tumefaciens; identical to SEQ ID NO: 35328

SEQ ID NO: 38855 - DNA, 759 bp, Agrobacterium tumefaciens
atgacgatgatcgaagccgtccgcagcgccatggatgtatccatggagcgaagcgacgatgtcgtggtgtttggcgaagacgtaggttacttcggcggcgttttccgcgccacgcaggggctgcagggaaaatacggcaagacccgctgtttcgatgcgccgatcagcgaatccggcattgtcggcacggcgatcggcatggccgcttatggcttgcggccctgcgtcgaaatccagttcgccgattacatgtaccccgcctatgaccagatcactcaggaggcggcgcgtatccgttatcgctccaatggcgatttcacctgcccgatcgttcttcgcatgccgaccggcggcggcatttttggcgggcagacgcatagccagagcccggaggcgcttttcacccatgtctgcggactgaaagtggtcgttccctccaatccctatgatgccaagggcctgctgatcgcctccatcgaagaccctgaccccgttatgtttctggagcctaagcggctttataacgggcctttcgacggtcatcacgaccggccggtgacgccgtggtcgaaacacgaaatgggtgaggtgccggaaggtcattacaccatccccatcggcaaggccgaaatccgtcgccccggaaacgatgtcaccgtcatcgcatacggcaccatggtgcatgtggcattggcgcgcggcggaggagacgggcgtggatgccgaaatcatcgatctgcgcagcctgctgccgcttga

SEQ ID NO: 38856 - DNA, 1227 bp, Agrobacterium tumefaciens; identical to SEQ ID NO: 35326

SEQ ID NO: 38857 - DNA, 765 bp, Agrobacterium tumefaciens
tttgcgctgaccgaaccgcaggccggttccgatgcctccaacctcaagacccgggcgcggcgcgacggcgatcgctatgttctcgacggcgcgaagcagttcatcacatcgggcaagaacggcgatgtcatcatcgtttttgccgtcacagatgcggcggcgggcaaaaagggtatcaccgccttcatcgtgccgacggatacgccgggttacgaggtcatcagggtcgaagaaaaactcggcctgcattcctccgatacctgccagatcgccttcaccgagatggcggttccagtcgacttgcggctgggcgaagaggggcagggttaccgtatcgcgcttgccaatctggaaggcggccgcatcggcatcgccgcacaggccgtcggcatggcacaggcggccttcgaggcggctcgggactacgcccgcgaacgcaaggctttcgggcaggcgatcatcgagcatcaggctgtggcgtttcgtctggcggatatggcgacgcggattacggcggcgcggcagctggtgctgcatgcggcggcgctgaaggaagcgggtgagccctgtctttcggaggcgtcgatggccaaactctttgcgtcggaaatggccgaacgcgtctgctcggacgccatccagattcacggcggttatggctacatggcggattatccggtggagcggatctatcgcgatgtgcgcatctgccagatttacgaggggacaagcgatgtccagcgcatggtgatcgctcggaacctg

SEQ ID NO: 38858 - DNA, 1137 bp, Agrobacterium tumefaciens; identical to SEQ ID NO: 38373

SEQ ID NO: 38859 - DNA, 651 bp, Agrobacterium tumefaciens; identical to SEQ ID NO: 35375

SEQ ID NO: 38860 - DNA, 2019 bp, Agrobacterium tumefaciens; identical to SEQ ID NO: 38377

SEQ ID NO: 38861 - DNA, 708 bp, Agrobacterium tumefaciens
atgaacggcacccgtgcctcgctcgatcagatcaaggccatggcagagggcgttaagggcgcgctgtccgagaaggtggatgcgctgatctgcccgccctcgacattgctctacgtagcaacggcgctctgcgatgacagcccgctgctgatcggcgcgcaggattgccaccagaatgataccggcgcccataccggcgatatttccgccgagatgattgccgattgcttcggcacccatgttatcgttggccattccgagcgccgcaccgaccacgccgagaccgatcacctggttcgcgccaaggcatccgctgcccatcaggtcgaccttatcgccatcgtctgcatcggcgagactgcggatgagcgcaaggcgggacagacgctggatattctcaagcgccagttggccggctccctgccggatgaagcgactgctgaaaacaccgtcatcgcctatgagcctgtgtgggcgattggcaccggtcttaccccgaccacgcaggacgtgcgcgaagcccatgccttcatgcgcgacgagctggtcaagcgcttcggtgacgccggcaagaccatgcgcattctctatggtggttcggtgaagcccgccaatgcgctggaactgatgggcgtcgagaatgtcgatggcgcgctgatcggcggcgccagcttgaaagccgcagacttcctttccatctatgcggca

SEQ ID NO: 38862 - DNA, 1389 bp, Agrobacterium tumefaciens
gaggcggtcgcgcggcagtcgcgcgggcgaaaaaagggtaagaacatggcacagaattggacccccggcagctggcggcagaaaccgatccagcaggttcccgaatatcctgatgcggccgcacttgcggctaccgaagccacgcttgcgacctatccgccgctggtttttgccggtgaagcccgtcgcctcaaaaaacagctcgccaatgtggcggaaggcaacgccttcctgctgcagggtggcgactgcgccgaaagcttcctcgagcatggcgccgacaatatccgcgacttcttccgcgctttcctgcagatggccgtggtgctgacctatggcgcacagctgccggtggttaaggtcggtcgcattgccggccagttcgccaagccgcgctcttccaacgtggaagtgctcgatggcgtgacgctgccgtcctaccgcggtgacatcatcaacggtatcgaattcaacgaggcctcgcgcattccgagcccggagcgccagctcgacgcctatcgccagtcggccgcgacgcttaacctgctgcgcgctttcgcgatgggcggttacgccaaccttgaaaacgtccaccagtggatgctcggtttcatcaaggacagcccgcaggcggaccgctaccgcaagctggccgaccgcatttccgaaaccatgaacttcatgcaggcgatcggcatcagcgcggaaaacaatccgagcctgcgcgagaccgatttcttcaccagccatgaagcgttgctgcttggttacgaagaagcgctgacccgtatcgattccacctcgggcgactggtacgcgacgtcgggtcacatgatctggatcggtgaccgcacgcgtcagctcgaccatgcgcatgtggaatatttccgcggcatcaagaatccgatcggcctgaagtgcggtccgtcgctgacgcctgacaatctgatcgagctgatcgatgcactgaacccggcaaacgaagccgggcgcctgacgctgatctgccgtttcggccatgacaaggtggcggacagcctgccgaagctcatccgtgcggtggagaaagaaggccgtaaggttgtctggtcctgcgatccgatgcatggcaatacgatcacgctcaaccactacaagacgcgtccgttcgagcgcatcctgtcggaagtcgaaagcttcttccagatccatcgcgccgaaggcacgcatccgggcggcatccacatcgagatgaccggcaaggacgtgacggaatgcacgggtggcgcgcgcgccgtgacggcggattcgctgtccgaccgttaccacacccattgcgatccgcgcctcaacgccgatcaggcgctggaactggcgttcctgctgtccgagcgtatgaagagcggtcgc

SEQ ID NO: 38863 - DNA, 1233 bp, Agrobacterium tumefaciens; identical to SEQ ID NO: 35367

SEQ ID NO: 38864 - DNA, 981 bp, Agrobacterium tumefaciens; identical to SEQ ID NO: 35368

SEQ ID NO: 38865 - DNA, 1202 bp, Agrobacterium tumefaciens
ggtctcgaccccaaggtgggagatgccatcatcgccgccgcgcaggaagtcatcgacggcaagctgaccgagcatttcccgctcgtcgtctggcagaccggctgcggcacccagtccaacatgaatgccaacgaggtgatttccaaccgcgcgatcgaaatgctcggcggcgaatgggcaccaagaagcctgttcacccgaatgaccacgtcaatatgagccagtcctcgaacgacacctacccgacggcgatgcacatcgcctgcgtggaagagatcgttcaccacctgttgccggccctcaagcacctgcacacggcgctggaagccaaggtcaagcagttcgaaaagatcatcaagatcggccgtacccacacgcaggacgcgaccccgctgacgctcggccaggaattctccggttacgccgctcaggtcgcctcggcgatcgccaatatcgaactcacactgcccgcactgtcgaagctcgcccagggcggtacggcggttggcacgggcctcaatgcccctgttggttttgccgaaaaggtcgccgaggaaatctctgagattaccggcctttccttcgtcaccgcgccgaacaagttcgaagcgcttgcctcgcatgattccatggtcttctcgcacggcgcgatcaacgccgctgccgctgcactcttcaagatcgccaacgacatccgcttcctcggttccggcccgcgcgccggtctcggcgaattgtcgctgccggaaaacgagcccggctcgtcgatcatgccgggcaaggtcaacccgacgcagtcggaggcactgacgcaggtttgcgcccatatcttcggcaacaatgcagcgctttccttcgcaggctcgcagggccacttcgaactcaacgtctataatccgatgatggcctacaactttctgcagtcggtccagcttctgggcgatgcggccgtgtccttcaccgacaactgcgtcgtcggcatcgaggcgcgcgaagacaatatccggaagggcgtcgagaactcgctgatgctcgtcacggcgctcaacggcaagctcggctacgacatctgcgccaagatcgccaagaccgcccacaagaacggcacgacgctgcgcgaagaagccgttggtggtggatacctcaccaacgaggaattcgaccagtatgtgcgccccgaaaacatgatcggcccgaagtaa

SEQ ID NO: 38866 - DNA, 1203 bp, Agrobacterium tumefaciens; identical to SEQ ID NO: 35158

SEQ ID NO: 38867 - DNA, 1413 bp, Agrobacterium tumefaciens; identical to SEQ ID NO: 37912

SEQ ID NO: 38868 - DNA, 963 bp, Agrobacterium tumefaciens; identical to SEQ ID NO: 38385

SEQ ID NO: 38869 - DNA, 2334 bp, Agrobacterium tumefaciens
tttgccattggcggctggcagctcgtcgccctcggtggcagcccctatttcatcatcgcaggtctttcgctcatcgtttcgggcctgctgatcctgctgcgcaagccggcaggcgcgcttcttttcggtcttgttttcatcctcaccggcgtctgggctgtatgggaagcgggccttcatttctggccgctgatttcccgtctgctggccatcggggttggcgcaaccgtcgttgccctgtcatacccgctgctgcgccgtgcagccggcaaaacgccggcatatggctcttctttcgcggtagccgctgttctcgccatcgcttccggggccggttttgccggcatgttcgtggcgcatccgaccgttgccttcaatggcgagccggcggcgctgacgccggtcaagccggaaacggagcagaagaactgggaacattacggcaatacgtccggcggcagccgtttcgtggcgcttgatgaaattacccgagacaacatcaagaacctcgaagtcgcctggacctaccacaccggcgataccccgatcagccccggcgccaacggtgcggaagaccagcagacgccgctgcaggtaggtgacaccgtgttcctgtgcacgccgcacaacaatgtcatcgctctcgatgccgataccggaaccgagaagtggaaggcggaaatcaattcgaaatcctccgtctggatgcgttgccgcggccttgcctatttcgatgccaaggcgccgctgaagcaaccgactgcgccgggctccacgcccgtcacggccgcggttgtggccgaaggcgcactttgccagcgccgtattctgatgaacaccatcaatgcggaactcatcgcgcttgatgcggacacgggcgcgttttgccctgacttcggcacaaatggccgcgtcgatctgaagatcggtatgggagatgcaccggacccgcaatatgtcctgacctcggcacccacgctggccggcacgaccgtcgttgtcggcggccgtatcgccgataacgtgcaggtggacatgcccggcggtgtgatgcgcggtttcgacgtggtcacgggcgagcttcgctgggcttttgaccccggcaatcccgatatcaccaagctgccgcctccgggccagacttacacacgttccacgccgaacgtctgggcatccatgtcctacgatccggacctgaacacggtcttcatgcccgtcggcagcccttcggtcgatctttatggcgcgacacgcacgccgctcgaccataaatatggtgcctccatgctggcgctcgatgccacgaccggccgcgaaaagtgggtataccagacggttcataacgacctctgggacttcgacgtgccgatgcagccgagcttcgtcgatttcccgaaggctgacggaaccagcgttccggcgctggtcttcggcaccaaggcggggcagctctacgtgctcgaccgcgcgacgggacagccgctgaccaaggtggaagaggtttccgtcaaggctgccaatattcccaatgagccctacgcccccacgcagccgcgttccgtcggcatgccgcagatcggtgcgcagacgctgacggaagccgatatgtggggtgcgaccccgttcgaccagcttttgtgccgcatcgccttcaagggcatgcgttatgaggggctgtatacggcgcccggcacggacctctcgctcgccttcccgggttcgctcggcggcatgaactggggcggtctgtcgaccgatccgaccaccaacactatcttcgtcaacgatatgcgcctcggtctctggatcgagatgaaggaagccgcccccaccaaggccgttgccagcggtggcgaaagcgtcaataccggcatgggcgtcgttccgatgaagggcacgccctatgcggtgaacaagaaccgcttcctgtcggctctcggcatcccatgccaggctccgccctatggcaccatgaccgcgatcgacatgaagacgcagcagatcaagtggcaggtgccggtcggcaccgtcgaggatacgggtccgctcggtatcaagatgggtctgccgatcccgatcggcatgccgacgctcggcggcacgctcgccacccagggcggcctcgtcttcatcgccggtacgcaggattattatctgcgcgccttcgatacggcgaccggcaaggaagtctggaaggcccgccttccggtcggcagccagggcggaccgatgagctacaagtctccgaagacgggcaagcaatatgtcgtcatctcggccggcggtgcccgccagtctcccgatcgcggcgactacgtcatcgcttatgcattg

SEQ ID NO: 38870 - DNA, 357 bp, Agrobacterium tumefaciens; identical to SEQ ID NO: 35340

SEQ ID NO: 38871 - DNA, 1923 bp, Agrobacterium tumefaciens; identical to SEQ ID NO: 38115

SEQ ID NO: 38872 - DNA, 1572 bp, Agrobacterium tumefaciens; identical to SEQ ID NO: 35070

SEQ ID NO: 38873 - DNA, 768 bp, Agrobacterium tumefaciens; identical to SEQ ID NO: 35072

SEQ ID NO: 38874 - DNA, 2349 bp, Agrobacterium tumefaciens; identical to SEQ ID NO: 35073

SEQ ID NO: 38875 - DNA, 1497 bp, Agrobacterium tumefaciens; identical to SEQ ID NO: 35075

SEQ ID NO: 38876 - DNA, 1302 bp, Agrobacterium tumefaciens; identical to SEQ ID NO: 38392

SEQ ID NO: 38877 - DNA, 681 bp, Agrobacterium tumefaciens
ctctatcactccccgatgtcgaccgcatcccggttcgttcgtctgatccttgcggaatacggcttccagaccgatctcgtggaggagcagccgtgggaaagacggcgggagtttctggcgctcaatcctgctggcaccctgccggtctatctcgatgacaatatgcgctccctcagcgggccttatgtgctggccgaatttctggacgaaacccatggggttttgaagcgcgaccggcggcttctggcggaagacccgtttcagcgcgcggaaatccgtcgcctgacggaatggtttctgcagaagatggaaaatgacgtgacccggccgctggtgcgcgaaagggtctataaattgcaaatgaccgcggcgcagggtggcggaccaccggattccaagctgctgcgcaccgcgcgcaacaatattcgccagcacatcaaatatctggagtggctggccggttcgcgcacctggctggccggcgatcggctgagctacgccgatcttgccgcagcggccggtgtttcggtgctggattatctcggcgagatcaactggctcgaagcgccgattgccaaggaatggtatcagcgggtgaaatcccgcccctccttccggccgtttctcagcgaacgcattccgcgtcttgccccctcttcccactacgccgatctggatttc

SEQ ID NO: 38878 - DNA, 983 bp, Agrobacterium tumefaciens; identical to SEQ ID NO: 35461

SEQ ID NO: 38879 - DNA, 1203 bp, Agrobacterium tumefaciens; identical to SEQ ID NO: 35460

SEQ ID NO: 38880 - DNA, 420 bp, Agrobacterium tumefaciens; identical to SEQ ID NO: 35409

SEQ ID NO: 38881 - DNA, 2117 bp, Agrobacterium tumefaciens; identical to SEQ ID NO: 35407

SEQ ID NO: 38882 - DNA, 1293 bp, Agrobacterium tumefaciens; identical to SEQ ID NO: 35232

SEQ ID NO: 38883 - DNA, 1209 bp, Agrobacterium tumefaciens; identical to SEQ ID NO: 35233

SEQ ID NO: 38884 - DNA, 1799 bp, Agrobacterium tumefaciens; identical to SEQ ID NO: 38403

SEQ ID NO: 38885 - DNA, 1314 bp, Agrobacterium tumefaciens; identical to SEQ ID NO: 35114

SEQ ID NO: 38886 - DNA, 851 bp, Agrobacterium tumefaciens
ggcctgagcccggcacccgtcaccgcgttcacgcgggatggcgaggtcgactatgcagccaatgccaaaatcgctagatggctcgcctcgatggaaggcgtaaagagcctggtcattctcggccacgccggcgagggcacgttcctgaccgaagacgaacgcctcgaactcatccgcgtttacgtcgatgccgttggcggttctctccccatcatcgccggtattaccggtgaaggaacccgcgtggctgctgcagaggccaagaagtgcaaggccgctggtgccaccggtgcgcttgtttatccaaaccacggctggcttcgtttcggtttccagagaggcgctccgcaggaccgctacaaggcgatctgggaagaatcgggcctgcaggaaatcctgttccagtatcctgacgtgaccaaggcgtcatatgaccttgatacgcagcttgcaatcgcaacccagcccggcgtcgttgcgacgaagaacggcgtgcgcaacatgaagcgctggtatgtggaaatcccggaactaaagaacgccaatccgaacctccaggtcctcagttgccatgacgagtggctgctgccgacgatgtttgatgtcgacggtctacttgttggctatggcaatatcgcgccggagcttctgattgatctgatcaaggcgggtaaggctcaggactatccgcaggcgcgaaagattttcgaacagctgctgccagtcacccgtgcggtctaccaccgcggctcgcatatggagggcacagtcgctctcaaactcggccttgttcaccggggtgtcctcgatcatgcgacgatccgcgagccgctgaagaacctcggcgagaa

SEQ ID NO: 38887 - DNA, 1254 bp, Agrobacterium tumefaciens
atcgttggggcggcgactttcttcgacggttacacggttatcgctatcgcctatgcgatgccggttctcgtccgggagtgggggcttactccatctcagacaggtatgatcctgtcgatgggatatttggggcagctcatcggcgccatcctgttcggctggctcgcggaaaggattggccggctcaaggtcctcctgttcaccattctcctgttcgtcagcatggatgtcgcctgcctgttcgcggctggtgcaggaatgatgatggcgttccgctttgtgcagggaattggcactggcggcgaagtgcccgtcgctagcgcctacatcaacgagctgatcggctcgaaaggtcgcggacgcttttttctgctctatgaagtcatgttcctgctcggcctcgttggcgcgggtctaatcggctacttcatggttcccctctacggctggaaagcgatgttcatcgttggcctggtccctgccatgctgatgatcccgctgcgttggtttctgaaggaatctccacgctggctggcagcaacaggccgatacgatgaggccaacgtcatcgtaaaacgcatggaagaaagcgctcgggcggccgggaaggcgcttcccgaaccaaggatcattgcaacgccggccaaacgcgtgtccgactggagagaactcttccaggggatctacctgaaacgcaccctgtcgatctgggctatgtggttctgcgcctatatggtggcgaacggcacgatcacctggctgccaacactctatcgccagacgttcaatctgccgctcgaaacaagcattctctatggcttcatgacgtctgcggcaggcgtggtcgctgccgtcatctgcgcgcttctgatcgacaaggtcggtcgcaaacgctggtacgcaggggcattgcttctggctcctgtgccgcttgccattctggcatggcttggcgcaacatcgccaatgcaggtcctgatctttgcaggccttgcctatgccatcgtgcagactgtgaccttctctctgtatctgtattcggccgaaatctacccgacccgcatgcgagcaatagggacgggtgctggcagtgcctggctgcgcttgggttcctctgccggtccgatgcttgtggggttcgtgatgtcatcgatgggtattcagtacgtgtttgcgaccttcgccttcattctgatcatcggcgctgttgtgaccatgctgtttgccgtggaaaccaaaggcaaggtcctggaa

SEQ ID NO: 38888 - DNA, 726 bp, Agrobacterium tumefaciens; identical to SEQ ID NO: 35188

SEQ ID NO: 38889 - DNA, 711 bp, Agrobacterium tumefaciens; identical to SEQ ID NO: 38410

SEQ ID NO: 38890 - DNA, 1104 bp, Agrobacterium tumefaciens; identical to SEQ ID NO: 35457

SEQ ID NO: 38891 - DNA, 1110 bp, Agrobacterium tumefaciens; identical to SEQ ID NO: 38411

SEQ ID NO: 38892 - DNA, 975 bp, Agrobacterium tumefaciens; identical to SEQ ID NO: 38129

SEQ ID NO: 38893 - DNA, 1308 bp, Agrobacterium tumefaciens; identical to SEQ ID NO: 35146

SEQ ID NO: 38894 - DNA, 3312 bp, Agrobacterium tumefaciens; identical to SEQ ID NO: 35147

SEQ ID NO: 38895 - DNA, 999 bp, Agrobacterium tumefaciens; identical to SEQ ID NO: 35149

SEQ ID NO: 38896 - DNA, 978 bp, Agrobacterium tumefaciens
aaggtcggcgtcctgctcgtcaatctcggcacgcctgacggcacggattattggccgatgcgccgttatctggcggagtttctaagcgacaagcgcgtgatcgaatggtctcgtctctactggtatccgatcctctacggcatcgtcctcaacaagcgtccgcagaaggtcggcaaggcctatgaggaaatctggaaccacgagcgcaacgaaagctatctgcgcacctatacccgcagccagggcgagctgatggctgcggcgctgaaggactttccgaatgtcgtggtcgactgggcgatgcgttacgggcagccttccatcgcatccaggatcgatgccctgaaggaacagggttgcgaaaaaatcttgctcttcccgctttatccgcaatatgccgcctcgaccacggcaaccgtgaacgacaaggctttcgagcatctgatgaagctgcgctggcaaccggccatccgcaccgtgccgccctatcatgacgatccggcctatatcgaggggctcgccgcctccgtgaaaaaccatctggcgacgctggactgggagccggaaatgctgatcacctccttccacggcattccgcaatcctatttcaaaaagggtgatccctattattgccattgccagaaaaccgcccgcctgctgcgggaggctctggggcggaccgagaagaatttcatgatcaccttccagtcccgcttcgggccggaagaatggctgcagccctataccgacaagaccgtggagaagctggcctcggagggcatcaagcgcattgccgtcatgaatcccggcttcgtatcggattgtcttgagacgctggaagaaatcgccggtgaagccggggagattttcctgcataatggcggagagaaatttacccatatcccctgtctgaatgacagcaccgaaggcatgaacgttctcgaaaaggttgtaagacgggagttgcaaggctgggtg

SEQ ID NO: 38897 - DNA, 1524 bp, Agrobacterium tumefaciens
tacgagctcaacattcttcacatcaacgattttcactcccgtattgaatcgatcaacaaattcgattcgacttgctcagcggaagaggaaggcaaaaacgagtgcttcggcggcgccgcgcgcctgctgaccgcaatcaaccagacgcgtgacgcgctgaaggcaggcgggaaaaatgttctcctgctcaatgccggcgacaatttccagggctcgctgttctacaccacctacaaggggacggtggaagcggaagtgctgaacgccatgaagttcgacgccatgactgtcggcaaccacgagttcgacgatagcgaagacggtctcgccggcttccttgacaaggtgcagttccccgtcgtaaccgccaatgtggtggccaccgccgcctcgaaaatcggcgaccgcgtcaagccctccatcgtgcttgaagtcggcggccagaaaatcggcatcgtcggcgccgtcgccaacgacacggcggaactggcaacacccggtcccaatatcaccatcgcagaagatgtcgccaagatcggcgaacaggtgcagaagctgaagcaggacggcgtcaacaagatcatcgcgctcacccatgtcggttatccgcgtgacctcgaattcattgccaaaatccctgatgtcgacgtcgtggtcggcggccactcgcatacgctgctgtccaataccgaccagaaggccgaaggcccctacccgacgctcgttgacaatcccggcggctataaggttccggtggttcaggccggtcagtacagcaaatatctcggtgacctcaaagtggtcttcgacgacaatggcgtggtcaaggaaagcaagggcgaccccatcctgatcgactccaccttcaaacctgacgaagccacgctgaagcgcatcgatgagctgaaggcaccgatcgaggcgttgaaatccaaggtcgtcggcacctcggaaggtccgatcgaaggcgaccgcaaggtttgccgcgtgaaagaatgctccatgggcaatctggtggccgatgcgacactggcgcgcgtcaaggatcagggcgtcaccatcgcttttgcaaacagcggcggcctgcgctcctccatcgatggcggcgacgtctcgatgggtgaagtgctcacggttctgccgttccagaacaccgttgcgacctttcagctcaagggcgaggatattcgcgccgccctcgaaaatggcgtcagccagatcgatgatgtcgcgggccgcttcatgcaggtttccggcatgaaatactccttcgaccgttccaagccggccggcagccgcatcgtttcggtcgacgtcaaggaaggcgacggcttcgtgcccctcgatcccacaaagacctatactgtcgcagccaataattacgtgcgcaccggtggtgatggcttcaaggtctttgcgaccaacgccatcaacgcctatgacttcggccccaatctcgaagacgcagttgcggcctatatcaccgccaacagcccctacaagccctataccgacggccgcatc

SEQ ID NO: 38898 - DNA, 1413 bp, Agrobacterium tumefaciens; identical to SEQ ID NO: 35293

SEQ ID NO: 38899 - DNA, 1752 bp, Agrobacterium tumefaciens
aaagcggcgaaacagagaagcctgaagccgcttcttggcctgtttccctatctcaggcggtatcgtggcctgatggcggcggccctttttgcgcttgtactttcctccgccacaacactggctctgccgcttgccgttcgccgtatcatcgatcacggtttccagacgccggatggtggcatgatcaacagctatttcgccatgcttctggcgattgccgttgtcctcgcgctcgccagcgccatgcgctattattacgtgatgaccataggcgaaagggtcgtcgccgatctgcgccgcgatgtatttgcccacctcaccacgctgtcacagcaatttttcgatagcaatcgatcgggcgagctcacttcgcggctgaccgccgatacggtgcagattcgttccgccttcggctcctccgcctcggtcgcgctgcgcaacatcatcatgtgctgcggtgctgtggcgatgatgatctataccagccccggcctttccggccttgcgctgcttgccattcccttcatcgtttttccgctgatcgccttcgggcggtccgttcgcgcccgctcccgcaccacgcaggatacattggccaattccgccgcctatgcttcggaaacgatcgcggcgagccgcaccgtgcagtccttcaatgccgaggtgctggcgaatgcccgttacggcgcctccgtggaagccgcctatcagggcgcacgcgcggcgatcggcgcgcgctccgtcctgactgccgtcgcaatcgctctcgttttcggcagcgttgtcggcattctctggtatggcgcgcagaacgttctggcgggcagcatgaccgcgggtacgcttggccagttcgtgctttattccgtcatcgcagccagtggcctcggccagctttcggaagtctggggtgaactcgcccaggcgggcggcgcggctgaaaggctttccgagcttctgaatgaacgctcacccgttgcagagcccgcagcccccgtcgccatgccgcaaccaccgcggggcgaggcggagttcgacaatgtcgacttcgtctatccactcgcaacagggcggccgattgtctccggcctctccttgaaggtcgccgccggcgaaaccgtcgccatcgttggaccttccggcgccggcaaaagcacggtcttttcgctgctgatgcggttttacgatccgcagcagggccgcatcaccatcgatggcgtggatatccgcaacgtcagccttgccgatcttcgcgcacggctctccatcgtgccgcaggatgtcgcgatcttcgcctcctccatccacgataatatcgcatttggccggcccgaagcgacacgcgaggacgtgcgcgccgccgccatcgccgcgcaggccgacggcttcatcgagcgtctcggcgatggttacgatacgcaggtgggcgagcggggtgtgacgctgtcgggtggccagcggcagcgcatcgccatcgcccgcgctattctgcgcgatgcaccaatcctgctgcttgatgaagcgacctcggcgctcgatgcggaaagcgaaacgctggtgcagaaggcgcttgatgagctgatgaaaacccgcaccaccatcgttattgcccatcgcctcgccaccgtgctgaaggccgatcgcattctggtgatggatgaaggccgtatcatcgaggaaggcacgcatcagagcctcattcgccagaatggcctttatgcccgcctcgcccggctgcaattccagaccgga

SEQ ID NO: 38900 - DNA, 957 bp, Agrobacterium tumefaciens; identical to SEQ ID NO: 38085

SEQ ID NO: 38901 - DNA, 1182 bp, Agrobacterium tumefaciens; identical to SEQ ID NO: 35296

SEQ ID NO: 38902 - DNA, 765 bp, Agrobacterium tumefaciens; identical to SEQ ID NO: 38428

SEQ ID NO: 38903 - DNA, 1728 bp, Agrobacterium tumefaciens; identical to SEQ ID NO: 35384

SEQ ID NO: 38904 - DNA, 1227 bp, Agrobacterium tumefaciens
atcctcaacgaagcggcgcgttttgccgaaaccgtgcttgaaccgctcaatacacccgccgatcgtgaaggctgcaccgtggtcgatggccgcgttcgcgttcccaccggttttgccgatgcttttcggcggcatgcgggcgatggctggctggccatggatgtgccggaacgcttcggcggtcaggctctgccgctggtgttacaggccgcctgcgctccacttttcgaacggggctgcgtggcgctgatgatggcgtcaggctcgacccgcgccgcctgtcaccttcttgccgagaccgcggaaggagccgttgcggacgaatgggtgccgcgccttgcggcgggggaatgggctgccaccatctgcatttccgagcctgatgccggttccgacctcgcccgtctgcgcagtcgcgccgtcttcagggaaggcgcatggcgcatcgagggtcggaaaatctggatatccttcggcgaccatgacatggcgatgcgtatcggccattgtcttctcgcccgcaccggcgaagaaaccgggacgcgcggcctcagccttttccttgtgccggatgagatcgatggcgaacgcaacggcgtcaccgtcgagcggatcgaggaaaaaatggggctgcacggctcgcccacctgcgcgctgcgtttcgacggtgcccgcggcctcttactgggtgaggaagggcgcgggctggcgcagcttttcgccatgatcgaattgatgcggttgcagaccggctgtcaggggctgggactggcctcggccgccatcgatattgccgaaacctatgcgcaggagcgccaacaaggcggcgatccggcaaaacccgccgtcgccatcgcacaccaccccgatattcgccgccagcttcaggaagcccgcctgcgcacggaaacattgcgggcagcaacactggaactcgcaacagtcatggatcttgcccgcatggagccgaaggaagagctgcgcggcgatttgcaggcgctctcgcgctggctgctgccgcttgtcaagaatttcggtgcggatgccggcttcaccgtctccaatcaggccatccagatacttggcggtgcgggttacacccgggaatggccgcttgagcaatatctgcgcgatgcccgggtgatgacgatctatgaaggcaccaccggcatgcaggcgatcgaccttctgacaaggcggctgtggcgggaaggcggaaagggtctc

SEQ ID NO: 38905 - DNA, 1440 bp, Agrobacterium tumefaciens
atggctcaatcttatgacgtcatcatcatcggttcgggaccgggcggttatattgccgcgatccgcgcagcccagctcggcatgaaggttgccgtcgtcgagcgcgaacatctggcgggcatctgctccaactggggctgcattcctaccaaggccctgctgcgcaccgccgatgtcatgcacaccgccacccacgccaaggattacggcctgacgctggaaggttcgatcaagcctgacgtgaaggcaatcgtggcgcgctcgcgcggcattgctgcgcgcatgaacaacggcgtcggtttcctgttcaagaagaacaaggtcgatatcatctggggtgaagcgaaaatcaccaagcccggcgaaatcgttgtcggcaagtccaccaagccggtggttcagccgcagggtccggttccgaagaacacgctgggcgagggcacttacaccgccaagcacatcatcgtcgcaacaggcgcccgcccgcgcgcgcttccgggcatcgagccggacggcaagctgatctggacctatttcgaggcgatgaagccggaagagctgccgaagtcgctgctcgtcatgggttcgggcgccatcggcatcgaattcgccagcttctaccgcaccatgggcgtcgatgttaccgtcgtcgagatcatgagccaggtcatgccggtcgaagatgcggaaatctctgcctttgccaagaagcagctggaaaagcagggtatcaagattcatctggagaccaaggtttccaaggtcgagaaggccgcgaattccgttaccgcgacgttggagaagaaggacggttcgtccgagaagatcatcgctgaccggatgatttcggctgtcggcgtcgtggcgaatgtcgaaggcatcggccttgaggccgccggcgtgaagaccgatcgcggtttcatcatcattgacggttacggcaaaaccaacgtgcctggtatttacgccatcggcgatgtcgccggcccgccgctgctcgcccataaggccgagcacgaggccgtcatctgcgttgaaaagatcgctggtctgccgaatgtccatccgatggacaagctcaagatccccggctgcacctattgcaacccgcaggtcgcctcggttggtttgaccgaagccaaggccaaggaacagggccgcgacatccgcgtcggccgtttctcctttgcggcgaacggcaaggcggttgcgctcggtgaagaccagggcatggtcaagaccatcttcgacaagaagaccggcgaactgctcggtgcccatatggtcggtgcggaagtgaccgaactcattcagggcttcgtcgttgccatgaacctcgagacgacggaagaagatttgatgcacacgatcttcccgcatccgaccatttcggaatcaatgaaggaaagcgtgctcgacgcttacggacgtgtgctgaac

SEQ ID NO: 38906 - DNA, 1356 bp, Agrobacterium tumefaciens; identical to SEQ ID NO: 35380

SEQ ID NO: 38907 - DNA, 1419 bp, Agrobacterium tumefaciens; identical to SEQ ID NO: 35381

SEQ ID NO: 38908 - DNA, 1041 bp, Agrobacterium tumefaciens; identical to SEQ ID NO: 35382

SEQ ID NO: 38909 - DNA, 1269 bp, Agrobacterium tumefaciens
atgactgccattaccgatatcatcgcgcgcgaaattctcgacagccgcggcaatccgaccgttgaagtcgatgtttacctcgaagacggctccatgggccgtgcggccgttccgtccggcgcctccactggcgcgcatgaggcggttgagctgcgcgatggcggcaagcgttatctcggcaagggcgtggaaaaggcggtcgaagccgtcaataccgaaatcttcgacgccatcggcggtttcgacgctgaaaaccagatccagatcgatcagatgatgatcgcgcttgacggcacgccgaacaagtcgcgcctcggcgccaacgccatcctcggcgtctcgcttgccatcgccaaggctgcggctgaagcctccggcctgccgctttaccgttatgttggcggtccgaacgcccatctgcttccggttccgatgatgaacatcatcaacggcggcgtgcatgaccataaccccatcgacttccagcaattcatgatcctatcggttggcgcggaaaacatccgcgaagccgtgcgtatgggttcggaagtgttccacacgctgaaaaaagaactgtccgcacagggccacaacaccaatgtcggtgatgagggcggttttgcaccgggcctcgagagcgcgccggcagccctcgatttcatcatgaagtcgatcgaaaaggctggctaccgtccgggcgaagacatgtatgtcggcctcgactgcgcatcgaccgagttctttaaggacggtaagtacgttctggaaggtgaaggccgcacgctggagcccggcgccatggccgaatatctggccgagcttgtcaataaatacccgatcatctcggttgaagacggcatggccgaagatgactgggaaggctggaagacgctgactgatctcgtcggcaacaaatgccagctcgtcggcgacgatctcttcgtcaccaactccgcgcgtcttcgcgacggcatcaagatgggcgtcgccaactccattctcgtcaaggttaaccagatcggttcgctttccgagacgctggatgcagtcgaaacggcacacaaggccggttacaccgccgtcatgtcgcaccgctctggcgagacggaagattctaccatcgccgatctcgctgtcgccaccaactgcggtcagatcaagaccggttcgcttgcccgttctgaccggctcgcaaagtacaaccagctgatccgcattgaggaaatgctgggtccgcaggctgcctacgccggccgttcgatcctgcgc

SEQ ID NO: 38910 - DNA, 756 bp, Agrobacterium tumefaciens
atgagcaatcagatcatcttcgatctcggcgggcgcacggcgcttgttaccggttcttcacgcggcctcggccgcgcaatggcagaaggacttgccgtcgcgggggcacgcatcctcattaacggcaccgatccgtcgcgtgtcgcgcaaacggttcaggagtttcgcaatgtcggccatgacgccgaggcggtcgcctttgacgtcacctccgaaagcgaaatcattgaggctttcgccaggcttgatgagcaggggatagacgtcgacattctcgtcaacaatgccggcatccagttccgcaaaccgatgatcgagctggagacggccgactggcagcgggtaatcgacaccaacctcactagcgccttcatgattggccgtgaggcggcaaaacggatgatcccgcggggatatggcaagatcgtcaatatcggctcgctgaccagcgaactggcccgcgcgacggtggcgccctacaccgtggccaagggcggcatcaagatgctgacccgcgccatggcggcggaatgggcgcaatacggcattcaggcgaacgccatcggccccggctacatgctgaccgacatgaatcaggcattgatcgacaatccggaatttgacgcctgggtgaaggcgcgcacgcccgcgaaacgctggggcaagccgcaggaacttgtcggaaccgccgtgttcctgtctgcttcggcctccgactacgtcaatggccagataatctatgtcgatggtggaatg

SEQ ID NO: 38911 - DNA, 564 bp, Agrobacterium tumefaciens; identical to SEQ ID NO: 35434

SEQ ID NO: 38912 - DNA, 1209 bp, Agrobacterium tumefaciens
acccggctttcgtccgggttgaccgttgttacggaaagaatgccacatctcgaaagcgttgctcttggggtgtggatcaaatccgggtcccgcaacgagacgactgccgagcacggcatcgcccatcttctcgaacatatggccttcaagggtacggcgcgccgcaccgcccggcagatcgccgaagagatcgaaaacgtcggtggcgaagtcaacgccgcaacatcgacggaaacaacctcctattatgcccgcgtcctgaaagaccatgttcctctcgcggtcgatatccttgctgatatcctgacggaatcgctgttcgacgaagacgagctggagcgcgagaaaaacgtcattctccaggaaatcggcgctgcgaccgatacgcctgacgacgtgatcttcgacaatttctccggcgtcgcctatcgcgaccagaccattggccggccgatcctcggcacgcccgacaccgtgcaatccttcacgagcggtgagatcaggcattatctcgcccgcaattacacgacggaccggattttcgtcgtcgccgccggcgcggtcgatcacgaaagctttgtgaagcaggtggaagagcgttttgcctcgctgccgctcgtgccggcggcaccgcccgtcatggaaaaggcgatctataccggcggggaaatccgcgagacccgcgacctgatggatgcgcaggtgctgctcggtttcgagggcaaggcctatcacgcccgcgacttctattgctcacagattctcgccaatattctcggcggcggcatgtcatcgcgtctcttccaggaagtgcgcgaggcgcgcggcctgtgttattccgtttatgccttccattggggtttttccgataccggcattttcggcgtgcatgcggcgaccggcggcaatgacctgccggaactgatacccgtcatcgtcgatgaattgcgcaagtcttctgagactatccatcaggacgaaatcaaccgcgcccgcgcacagattcgggcgcaattgctgatgggacaggaaagcccggctgcccgcgccggccagattgcccggcagatgatgctttacggccgccccatccccaatgaagaaatgatgacgcgcctcgaggacatcacccgggagcgcctgaccgatcttgcaggccggctatttttcgatacagttccgacattgtctgccattggcccgctggaa

SEQ ID NO: 38913 - DNA, 2643 bp, Agrobacterium tumefaciens; identical to SEQ ID NO: 35432

SEQ ID NO: 38914 - DNA, 3451 bp, Agrobacterium tumefaciens
ctccgcgtcgtcggtttcaagtccttcgttgaaccctccgaattcatcatcgagcccggtctgaccggcgttgtcggcccgaatggctgcggcaagtccaatctggtcgaagcgctgcgctgggtgatgggcgagaattcctacaagaacatgcgcgcatccggcatggatgacgtcatcttttccggctccggcaaccgcccggccagaaacaccgccgaagtcggcctttatctcgacaattccgaccgcaccgcgcccgccgctttcaacgatgccgatgaaattcaggtgacgcgccgcatcgagcgcgaaaacggctccgtttaccgcatcaatggcaaggaagcccgcgccaaggatgtgcaactgctgtttgccgatgcctccaccggcgcccgctcgccctccatggtggggcaagggcgtatcggcgagctcatcaatgccaagccacaagcccgtcgccagctgctggaagaggcggccggcatttccggcctgcattcgcgccgccacgaggccgagcttcgcctgcgcgccgccgagaccaatctggagcgtctggaagacgtgactgcccagctggaaagccagatcgaaagcctgaaacgtcaggcgcgccaggccaaccgcttcaagatgctgtccgccgatatccgcgctcgcgaggcgacccttctgcacatccgctgggtggaggcgaaggaagcggaaggcgaggcggaaagcgcgctcaatcaggcgaccaacatcgtcgccgaaaaggctcaaggccagatggaagcggccaagcagcagggcatcgccagcctgaaattgccggaactgcgcgaggacgaggcccgcgtggccgccgccctgcaacgcctgcagatcgcccgcacccagctggatgacgaggcaaaccgcctgctgcgccgtcgtgacgaactggcccgccgtctctcgcagcttggcgaggatatcgtccgcgaggaacggctggtcgccgataatgcccagatactcgcacggctggacgaagaagaggccgaacttctcgacatcctctccgattccggtcgtcatgcggatgagatgcgcgaagccttcgaggctgcggccgtcaagctggcggaaagcgaagccgttttcacatcaatcaccgccgaacgcgccgaggcggcggccggccgtcagcagttggagcgggcgatccgcgatctttctgaccgcaagctgcggctggagcggcaatcgcaggaagcctctgccgagattgacaccatcgacgaaaaactctccggtcttcccgaccccgcggagcggcgcgaagcggtggaagcggctgagattgccgtcgaggacgcgttgatcgtggcggaggaggccgaggccgccggttgccgaggcgcgttccgccgaagcgctggcgcgcgggccgctggaaacggcgaagaaccggctgaatgcgctggataccgaagcacgcaccatcaccaaaatgctcgccaccagcgctgccgccaatggtagtttcacgccggtggcggaagaaatgacggtggagcgcggttatgaggccgcacttggcgcggcgcttggcgacgatctcgaaagcccgctcgatgcgagcgcccccgcctattggggcggcaatggaaacggtgcggatgatcccggcctgccgcagggcgctaaaccgcttctggactatgcgcaggcgccggatgccctccggcgcgcccttgcacagattggtgtcgttgcagacgtatcggaggcccgacgccttctgccgtcgctgaaagccggccagcggctggtaacgcgcgaaggcgcgctgttccgctgggacggccatatcgccagcgccgatgcgccgggtgctgcggcccttcgcctgtcgcagaagaaccgcctcgccgaaatcgaagccgaactggacgaggcccgctccattctggaagaggccgaagaccagcttgccgcgaaaaccgaggacatcagaagcagtgaattgcggctctcggaggtgcgtgaccggagccggctcgcgacccgtcagcttgccgaggcacgcgaggcgctgacatccgccgaacgggcctcgggcgatctgctgcgccgccgggatgtcgtttccgaagcgcagaaccagatcggcgcgcagatcgacgagatcgccgttcaggaagaaaatgcccgcatcgaaatggaagatgcgccggatctttccgtgcttgatctccggctgcgtgaaagccagctggaagtcgcgaccgaccgcggcctgctggcggaggcccgcgctcgccatgaaggcgtgagtcgcgaggcggaaagccgccagcgcagaattcaggccatagggcaggagcgttccacctgggcatcgcgcgctgcaagtgcggccgatcatatcgccacattgcgcgaacgcgaggaagaggcgcgcgaggaaatcgccgagcttgatatagcgccggaggaattcgacgagaaacgccgcaacctcctcaacgaattgcaaaagaccgaagacgcccgccgcgccgccgccgaccggctggccgaggcggaaaacctgcagcgtgccgccgatcgggtggcggcaacggcgctttccgaactggccgaagcccgcgaaaagcgcggccgtgccgaagaacgtctggtttccgcccgcgagaaacggctggaaaccgaacaccgcatccgcgaaacactgaataccgagcctcatatggcatttcgcctgaccggccttggcccggatcagccgaagcccgatatccgcgatgtcgagcgcgatctcgaccggctgaagatcgagcgcgaaaggcttggtgccgtcaatctgcgcgccgaggaggaacaggcggagctttccggcaagctcgaggcgctgatcaaggagcgggatgatatcatcgatgccgtgcgcaagctgcgcgccggcatccagagcctcaaccgcgagggtcgtgagaggctgattgccgccttcgacgtggtcaattcacagttccagcggctgttcacccatcttttcggtggcggcacggcagaattgcagctgatcgaatccgacgacccgctggaagccggcctcgaaatcctcgcccgcccgcccggcaagaagccgcagaccatgacgctgctttccggcggcgagcaggcgctgacggcgatggcgctgatctttgcggtcttcctcaccaatcccgcgcccatctgcgtgctggacgaggtggatgcgccgctcgacgaccacaatgtcgagcgctactgcaacctgatggatgagatggtggcctccaccgagacgcgattcgttatcatcacccataatcccatcaccatggcgcgcatgaaccgcctgttcggtgtcaccatggccgaacagggcgtctcgcaactcgtctccgtggatttgcagactgccgaacagctgcgcgaagccgtc

SEQ ID NO: 38915 - DNA, 1443 bp, Agrobacterium tumefaciens; identical to SEQ ID NO: 35416

SEQ ID NO: 38916 - DNA, 612 bp, Agrobacterium tumefaciens; identical to SEQ ID NO: 35227

SEQ ID NO: 38917 - DNA, 768 bp, Agrobacterium tumefaciens; identical to SEQ ID NO: 38438

SEQ ID NO: 38918 - DNA, 678 bp, Agrobacterium tumefaciens
gccatcgcaaggcggcttattgaatccggcgcgaaggtcagcctttgggatatgagcgagacggcgattgagcaggcctgcggcgtgcttggagagggcgccagcggcaaggttgttgatgtcaccgattttgccggcctcgcccgcgttcacgccgaggtcgaagccgagaccggaccggtgtcgatcctcgtcaattccgccggaattgcgggcagcaatgcgacccttgaggattatgacatcgaggaatggcggcgcgtcgtcgagattaatctgaacggcaccttttatgtcaacaagaccgtgatcccctccatgaaggccaggaactatggcaggatcgtcaatatctcctcggttgccggcaaagagggcaatcccaagctctcagcctattccgcagccaaggcgggcgtgattggcttgaccaaatcactcggcaaggaactcgcggcacacgatattgccgtcaacgcgatcacgccggcgacggcgcgcacacggatcctcgaaactctgacaccggaatttatcgattacatgctgacacgtattccgcgtggccgttttctggaagtcgaagaggctgcggcaatggtcgcatggctggtgagccgtgaaaacagcttcactaccgcctcggttttcgacctttccggtggccggacgacctat

SEQ ID NO: 38919 - DNA, 1179 bp, Agrobacterium tumefaciens
agcgaacgcgcagcatttcattggcaggacccttttctgctcgaagaccaactgaccgacgacgagcgaatgatccgcgacagcgccgaggccttcggcaaatccgaactgctgccgcgcatctcggaagcctatctttccgaaaccaccgaaccggaactcttccgtctgatgggacgcaccggcctgctcggcgtcaccctgccggaagaatacggcgcagccaatgccagctatgtggcttacggcctcgtcgcccgcgaggtggagcggatcgacagtggttaccgctcgatgatgagcgtgcagtcctcgctcgtcattcacccgatcttcgcttacggctcggacgaacagaagaagaaatacctgccgggcctcgtttccggtgaactgatcggctgtttcggcctcaccgagccggatgccggctccgatcccggcggcatgaagacccgcgccgaaaagatcgagggcggttatcgcctgcgcggttcgaaaatgtggatttccaacgcgccgatcgccgatgttttcgtcgtctgggcgaaatcggaagcgcatgacaatgagatccgtggtttcgtgctggaaaagggcatgaaaggtctttccgcccccaagatcggcggcaagctttcgctgcgcgcctccattacaggcgaaatcgtcatggatggcgtggaagtgggcgaagatgcattgcttccgaatgtttccggactgaaaggcccgttcggctgccttaaccgcgcccgttacggcatttcctggggcgtgatgggggctgcggaagattgctggttccgttcccgccaatatggcctcgatcgcaaacagttcggcaagccgctcgccggcacgcagctttaccagaagaagctcgccgacatgcagaccgaaatcgcgctcggccttcaggcatcgctgcgcgtcggccggctgatggacgaacataagatggcgccggaaatgatctccatcgtcaaacgcaacaattgcggcaaggcgctggatatcgcccgccaggcccgcgacatgcatggcggcaatggcattcagatcgaatatcacgtcatgcgccatgcccagaatcttgaaacggtgaatacctatgagggcacgcatgacgtgcacgcgctgatcctcggccgggcgcagacgggcattcaggcgttt

SEQ ID NO: 38920 - DNA, 2550 bp, Agrobacterium tumefaciens
ccgccaacatggttttcgaacacgtcgatacagaggagacaggcggcgatgagcagcgaactgacgcggcgtaatctattgaaggcgcatgctgccggcattgcggcggcaacggcgggcattgcgctgccggccgccgcccagccggtgccgggcggtgtttccgcattgcagatcaaatggtccaaggcgccctgtcgtttctgcggcacgggttgcggcgtcatggtcggcgtcaaggaaggcaaggtcgttgccacccatggcgacatgcaggcggaggtcaatcgtggcctcaactgcatcaagggctatttcctctccaagatcatgtatggcaaggaccgcctcgagaccccgcttctgcgcaagaaaaacggcgtctacgccaaggatggcgagttcgagcctgtcagctgggacgaggccttcgacgtgatggcgcagcaatgcaagcgcgtgctgaaggaaaagggaccgacggccgtcggcatgttcggttccggccaatggacgatcttcgaaggttatgccgcgaccaagctgatgcgcgccggcttccgctccaacaatctcgaccccaatgcccgccactgcatggcgtcggccgcttatgccttcatgcgcaccttcggcatggatgagccaatgggctgctacgacgatttcgaacatgccgatgccttcgtgctctggggctcgaacatggcggagatgcaccccattttgtggacccgcatcgccgaccggcgtctgggtttcgaccatgtgagggtggcggtgctttcgaccttcacccatcgcagcatggatcttgccgatatccccatggtcttcaagccgggcacggatctcgtcatcctcaattacatcgccaaccacatcatcaagaccggccgcgtcaacgaagacttcgtgaggaaccacacgaaattcgtgcgcggcgtcaccgatatcggttatggcctgcggccagacgatccggttgaggtgaatgccgccaattctgccgatccgaccaagacggaagcgatcgatttcgagaccttcaaggaatttgtctccgaatacacgctggaaaaaaccgccgccatgaccggggtggaagccggcttcctggaggaactggccgagctttatgccgacccgaaacgcaaggtcatgtcgctctggaccatgggtttcaaccagcatgtccgcggcgtctgggccaaccagatggtctacaacatccatcttttgaccggaaagatttccgagcccggcaacagtccgttctcgctcaccggccagccctcagcctgcggcacggcgcgtgaagtgggaaccttcgcccaccgcctgccggccgacatgacggtgaccaacccggaacaccgcaaacatgccgaggaaatctggcgcattccgcatggcatcatcccggaaaagccgggttaccacgccgtgcagcaggaccgcatgctgcatgacggcaagctgaatttctactgggtgcaggtcaacaacaacgtccaggccggccccaacaccaagaacgagacctatctgggttatcgcaacccggaaaacttcatcgtggtttcggatgcctatccgaccatcaccgccatgagcgccgatctcatcctgcccgccgccatgtgggtggagaaggagggggcctatggcaatgccgagcggcgcacccatgtctggcaccagctggtggaggcctcgggcgaggcgcgttccgacctctggcagctggtggagttttccaagcgtttcaccaccgacgaggtatggccggccgaaatactcgacgccaatcccgcctatcgcggcaagacgctttacgaggtgctctacaaggacagcgatgtcggcaagttcccgctgagcgaaatcaacgccgactacaagaaccaggaatccagtgatttcggcttctatctgcagaagggcctgtttgaggaatatgctgctttcgggcgcggccacggccacgatctggcgccttacgatgcctatcacgaggtgcgcggcatgcgctggcctgtcgtcgatggcaaggaaacgctgtggcgttaccgcgagggttacgacccctatgtcaaacccggcgagggtgtgaagttctacggcaacaaggacggcagggcggtcatcatcgccgtgccttacgagccgccggcggaatctcccgaccaggaattcgatacgtggctggtgacgggccgggtgctggagcactggcattccggttccatgaccatgcgcgtaccggaactctacaaggcgtttcccggcgcccgctgtttcatgaatgccgatgatgcgcgcaagcgcgggctcaatcagggcgcggaaatccgcatcgtctcgcggcgcggggaaatccgctcgcgggtggaaacgcgtggccgcaaccgcatgccgcccggcgtcatcttcgttccctggttcgatgccagccagctgatcaacaaggtgacgcttgacgcaaccgatcccatctccaagcagacggatttcaagaaatgcgcagtcaagatagagccagtcgca

SEQ ID NO: 38921 - DNA, 855 bp, Agrobacterium tumefaciens; identical to SEQ ID NO: 38442

SEQ ID NO: 38922 - DNA, 2136 bp, Agrobacterium tumefaciens
tgtcccgtcatgcatggaggcaatacggcctccggcaaatcggtgaccgaatggtggccgaacgcgctaaacctcgacatcctgcatcagcacgacaccaagaccaatccgctcggcacctccttcaactaccgcgaagcgctgaagacgcttgatgtcgaagccctcaaggccgatctgcgcgcgcttatgaccgacagccaggaatggtggccggcccactggggcagttatgtcggcatgatggcccgtgttacctggcatgccgccggttcctatcgtgtcacagacggtcgcggcggcgccaataccggcaaccagcgttttgcaccgctcaattcctggccggacaacgtcaacaccgacaagggccgccgcctgctgtggccgatcaagaagaaatacggcaacaagatttcctgggccgaccttatcgcgctcgccggcacgatcgcctatgacgtcgcgggtctgaagaccttcggcttcgccttcggccgcgaagacatctgggcgccggaaaaggacacctattggggtgacgaaaaggaatggctggcgccgagcgacggccgttatggcgacgtgagcaagcccgagacgctggaaaacccgcttgccgccgtgcagatgggcctgatctacgtcaacccggaaggtgtcaacggcaagtccgatccgctggcgacggcggcgcagatgcgcgaaacctttgcccgcatggggatggatgacgaggaaaccgttgccctgacggccggcggccacaccatcggcaagtcccatggcaatggcagtgctgccaatctcagccccgatccggaagctgctggcccggaatatcagggtctcggctggatcaataccaagggccgcggcattggccgtgacaccgtggtgtcgggtatcgaaggcgcatggacaagcgaaccaaccaagtgggacaacggcttcttcgacatgctgttcaagcacgagtggaccctgacgcacagccccgcgggtgcatcgcaatgggcgccgattaccatcgccgaagaagacaagcctgttgatgtcgaggatgcgtcgatccgcaccatcccgatgatgaccgacgccgacatggccctgaaggtcgatccgatctaccgcgagatttcgctgaagttcaaggacgatcaggaccatttctctgatgtcttcgcccgcgcctggttcaagctgacgcatcgcgacatggggccgaagtcccgttacgtcggcccggatgttccggctgaagacctgatctggcaggatccgatcccggcaggctccacgagctacgatgtcgctgccgtcaaggctaagatcgctgcctccggcctttctgtcgccgatctggtttcaaccgcatgggacagtgcccgcaccttccgtggttcggacaagcgcggcggcgccaatggcgcgcgtattcgtctcgcaccgcagaaggattgggaaggcaatgagcccgcccgtctttcccgcgtgctttcggttctggagccgattgcccgcgaaaccggtgcaagcatcgccgatgtgatcgttctggctggcaattacggcgtggagcaggcggcgaaagcggctggtttcgatatcgccgtgcccttcgcggccggtcgtggtgacgcttccgccgagcagacggatgccgacagctttgcgccgcttgagccgctggcggatggtttccgcaactgggtgaagaaggactatgtcgtcagccccgaagagctgctgctcgatcgggcacagcttcttggcctcaccgcgccggaactcaccgtcctcatcggcggcctgcgcgtcatcggcgccaattacggcggtgcggcgcatggcgtcttcaccgataagccgggggcgcttacaacggacttcttcacgacgttgacggacatggcctattcctgggtcccgaccggcaacaatctctatgagatccgtgatcgcaagaccggcgcagccagatattcggcaacccgcgtcgatctcgtgatcggctccaactccatcctgcgcgcttatgcggaagtttatgcgcaggacgacaacagggaaaaattcgcccgcgacttcattgccgcctggacgaaggtgatgaacgccgaccgtttcgatctg

SEQ ID NO: 38923 - DNA, 1449 bp, Agrobacterium tumefaciens
atgcagactgtaaatcttttcatcggcggcgatcattgcgcggccgcgaacggcaagcgcttcgaacggaacaacccgatcaccggcgatgccgtaacgagtgccgccgccgcttcggttgaagatgcgacgaacgcggccgatgctgccgctgccgctttcccgaaatggtccgccaccacgcccggtgaacgccgccgccacctgcttgcggctgccgaggcgctgcgcgcggcgggcccgcaaatcattcaggcgatgatggaggagatcggcgcgacggaggcctgggccggttttaacgtcatgctcgccagcgatatgctggtggaggcggccagtctaaccacgcacatcacgggcgaagtcatcccatcgaaccgcccgggaaccatggccatggcgctccgtcagccggcaggggtcgtgctgtcgatggcgccgtggaacgcgccggtcattctcggcgtgcgctccatcgccaccccgcttgcctgcggcaatacggttgtcatgaagacctcggaactttgcccgcggacccacgccctgatcatcgaagcggttgcctccgcaggactgccgaaaggcgtgctgaacgccatttccaacgcgccggacgatgcggcgaagatcgttgaaacgctgattgcccatccggcggtcagaagggtgaacttcactggctccacccgtgtcggccgcgtcattgcggaaacggcgggccgctacctcaaacccgccctgctggagcttggcggtaaggcgcccttcatcgtgcttgacgatgccgatatcgacgcggcggtcgctgccgctgcattcggcgcctacatgaaccaagggcagatctgcatgtcaaccgagcgtatcatcgtgcttgacagcattgccgatacattcgtcgaagctttcgcgaaaaaggccgccagcctgacggcgggcgatccgcgcgagggcaagacaccgctcggctcactggtcagtgccgaagcagcctcgcgtatccgggtgctggtcgatgacgccgtctccaagggtgcaaggcgggttgccggtggcggtggcgatggcacgatgcttgacgcgatcgccgtcgatggcgtcaccccggccatgcggctttattcggaggagagcttcggcccggtcgtatccatcatccgggccggcagcatcgatgaggccgtgagcatcgccaatgaaagcgaattcggtctttccgccgccgttttcggcagggaccaggcgcgggcgctttccgttgccgcgcggattgaaagcggcatttgccatgtcaacggcccgaccgttcatgatgaggcccagttgcccttcggcggggtcaaggcttccggttatggccgtttcggcggcacagcgggtatcgccgaattcaccgaattgcgctgggtcacgctgcaggacgggccgcttcactacccgatc

SEQ ID NO: 38924 - DNA, 1503 bp, Agrobacterium tumefaciens; identical to SEQ ID NO: 35106

SEQ ID NO: 38925 - DNA, 1452 bp, Agrobacterium tumefaciens
agtttcaaaatcgctattattggcgcaggcagcgtcggtttcacgaaaaaactgttcaccgatctcctgtgcgtgccggaatttcgtgatatcgaagtcgcgctgacggatatcagccagcacaatctcgatatgatcaaggcgatcctcgaaaagatcgtcgaggccaatggttttccggtgaaggtgacagcggataccgatcgccgccgggcgctggagggggcgaaatatatcatcagctgcgtgcgggttggtggtctcgaagcctatgccgacgatatccgtattccgctgaaatatggcatcgaccaatgcgtgggcgatacgatctgcgccggcggcatactctatggccagcgcaacattccggtcattctggatttctgcaaggatatccgcgaagtcgccgcaccaggcgcaaaattcctgaactatgccaaccccatggccatgaacacctgggcggccatcgaatatggcaaggtggatacggtcggtctctgccacggcgtgcagcacggcgcggaacagatcgccgaaattctcggtgcggaatccccgtccgagctggattacatctgctccggtatcaaccaccagacatggttcatcgatctgaggctcaacggccgcagaatcgaaaaggacgagctggtcgctgccttcgaggcgcatccggtcttttcgcagcaggaaaagttgcgcatcgatgtgctgaagcgcttcggtgtctattcgaccgagagcaacggccatctctccgaatatctgccgtggtatcgcaaacggccggaagaaatcgcccgctggatcgacatgtccgactggatccacggcgaaaccggcggttatttgcgccactctaccgaaacgcgcaactggttcgaaaccgagtttccgcaattcctggcctccgccgccaagcccatcgagccggcgaaacgctctaacgaacatgcgagccacattctggaagcgcttgagaccgggcgtgtctatcgcggccatttcaacgtcaagaacaacggcgtcatcaccaaccttccttccgacgcgatcattgagtcgcccggtttcgtcgatcgtttcggcatcaatatggtgtcgggcatcacgctgccagaagcctgtgccgcgacctgcatggcttcgatcaatgtgcagcgcatgtcggtgcatgcggcggtgagcggcgatatcgatctcctgaagcttgccgtgctgcatgacccgctcgtgggtgccgtcgccaccccggaggaggtctggcagatggtggacgagatggtcgtcgcgcaggcacgctggctgccgcaatatgccgatgccgtgccggctgccaaggagcggctggcgaaatccaccgtcaagacgcgtgactgggcgggggctgcgcgccgcaacgtgcgctccatcgaggaattgcgggccgaaaaatcggctctgaaa

SEQ ID NO: 38926 - DNA, 1341 bp, Agrobacterium tumefaciens
atggcaagagatcccaagatcacatttatcggcgcaggctctacggtgttcatgaagaacatcatcggcgacgtgctgcagcgtccggccctttcgggcgccaccattgcgctgatggacatcaatcgcgagaggctggaagaaagcgccatcgtcgtcaacaagctgatttcgacattgggggcaaaggcgaaagccgagacctataccgaccagaaaaaggcgcttgccggtgccgattttgtcgaggtcgccttccagatcggcggatatgaaccctgtacggttaccgatttcgaggtgccgcgcaaatatggcctgcgccagaccattgccgatacgctcggcgtctgcggcatcatgcgtggtcttcgcaccgtgccgcatctgtggaaaatctgcgaggatatcctcgccgtctgccccaacgccgtcatgctgcaatatgtgaacccgatggcgatcaacacctgggcgattgccgagaaatacccgacgatccggcaggttggcctttgccattccgtgcagggcacggccatggaactcgcccatgatctcgatatcccttatgaggagatccgctatcgttcggccggcatcaaccacatggcgtttttcctcgaattcgagcatcgccagcccgacggcagctataggaacctctatcccgatctcgtgcgcggctaccgcgaaggccgtgcgccaaaacccggctggaacccgcgttgccccaacaaggtgcgttacgagatgctgacgcgactcggttatttcgtcaccgaaagctcggaacatttcgccgaatatacgccctatttcatcaaggaggggcgcgacgacctgatcgagaaattcggcatcccgctcgatgaatatccgaagcgctgcatcgaacagatcgagcgctggaaggggcaggcggcggcctatcgttcggccgagaagatcgaggttaagcaatcgaaggaatatgcctcctccatcatcaactccgtctggactggcgaaccctccgtcatctatggcaaccagcgcaacaacggctgcatcacctcgctcccatcggattgcgcggcagaagtgccctgccttgtcgaccataacggcgtgcagcccacctttatcggcgaattgccgccgcaactccgcgcccttgatgcgcaccatcatcaacgtgcaggaactgcaggtgcgggcgcctgatgagcgaaaaccgtgcccatatcttccacgcggcgatgatggacccggacaccggcggcggaactggatctcgaccagatatggtcgctggtagacgacctactgctcgcacaccgcgactggttgccggaatgg

SEQ ID NO: 38927 - DNA, 1296 bp, Agrobacterium tumefaciens; identical to SEQ ID NO: 35221

SEQ ID NO: 38928 - DNA, 1419 bp, Agrobacterium tumefaciens; identical to SEQ ID NO: 38452

SEQ ID NO: 38929 - DNA, 843 bp, Agrobacterium tumefaciens; identical to SEQ ID NO: 38453

SEQ ID NO: 38930 - DNA, 516 bp, Agrobacterium tumefaciens
atcgaaaggcttgaggttcaaaatgcgacgttgcgctataaccagcggatcatcgctgaggatttgtctgtgaagattccagacggttcctttaccgttatcgttggacccaatgcctgcggtaagtccacattgctgcgtgccctgtcgcggctgctgacgccttcagcaggagaggttattctcgacggcaaggcgatcgccggctatcccgccaaacagcttgcccgcgcgattggccttttgccacagagctcgatcgcccccgacggcatcaccgtcgctgagctcgtcgctcgcggccgctatccccatcaatccctcttccggcaatggtcgagcgaagacgaagcggcagtcgcattggcaatggctgcgacgcagacgacgcagctttccactcgtcttgtcgacgagctttccggcggccagcggcagagagtgtgggttgccatggtgctggcacaggaaacaccgatcctgctccttgatgagccaaccactttcttggatatc

SEQ ID NO: 38931 - DNA, 915 bp, Agrobacterium tumefaciens; identical to SEQ ID NO: 35220

SEQ ID NO: 38932 - DNA, 1278 bp, Agrobacterium tumefaciens
gtgcgcgaaggcgtcgtgctggctttgccgtccgatgacctgcctgccccggcacaattgttgaaagccgcgctgaaacctttcgcccgcagcaaggcaaaacgggcgcagcgcagcgaccggctagccgtggcggtcgagcggcttgggccttcctatgtgaagatgggccagtttctggccacccggccggatgtggtgggcgccgatttcgccgacgatcttgcgagccttcaggaccgcatggcttttttcccggccgctgcggcgaaggccaatatcgaaggttcgctcggacgatcaatttcggagctttatagagaattcggcgacccgatcgccgccgcctccatcgcccaggtgcacccggccatggtggatacaccaaagggaccgcgcaaggtggccgtcaaggtcattcgacccggcgtgcgtcagcgtttccagaacgatctcgaggcgatgtatctgattgccgacctgcagcagcgtttcgttcgctccgcccgtcgcctgcggccggtggaagtgacacgcacgctggagcagacgaccaagatcgagatggatctgcggctcgaggccgccgcactttccgaacttgcggaaaataccagacaagatcccggcttccgtgttcccgaagtggattgggaacgcaccggccgcgacgtcgtcaccatggaatggatcgacggcgtcaagatgtcggatatcgagggactgaaggcagccggccacgacctgaacaagctggccgatacgctgatccagtccttcctgcggcatacgctgcgcgacggttttttccatgccgacatgcatcccggcaacctcttcgtcgatgcgaagggcgagatcgtcgccgtggatatgggcattgccggtcggctcggcaaaaaggaacgccgcttccttgccgaaatcctctatggcttcatcacgcgtgactacatgcgggtggcggaagtgcatttcgaggccggttacgtgccgggccatcacgacaaggccagcttcgcccaggcgatccgcgccattggcgaaccaatccacggccagccggccgagacgatctcgatgggcaagctcctgactctgctgttcgaagtgaccgagcttttcgacatggaaacgcggccggaactggtgatgctgcaaaagaccatggtggtggtggaaggcgtgtcgcgcatgctcaatccgcgcttcaatatgtggaaggcggccgatccggtcgtcggcggctggatccgtgacaatctcggtcccaaacgc

SEQ ID NO: 38933 - DNA, 2649 bp, Agrobacterium tumefaciens
gccactccgatgatggagcaatatatcgagatcaaggcgaacaatcccggttcgctgctgttttaccgcatgggcgatttttacgaattgttctttgacgatgcggtcgaagcctcccgcgcgctcggtatcacgctgacgaaacgcggccagcatatggggcacgatattcccatgtgcggcgttcccgttcacgctgccgatgactatctccagaagctcatcctgcgcggctaccgtgtcgccgtctgcgaacagattgaagacccggctgaagcgaagaagcgcggatcgaaatccgtggtcaagcgtgatgtggtgcggctcgtcacgcccggaacgctcactgaagaaaagctgctgtcgccgacggaatccaactatctgatggcgcttgcccgtattcgcggcagtgcggaggcgcagttcgcgctggcctggatcgatatttccaccggcgtcttccgtctggcggaaaccacgctgacgcggcttctcgccgatatctggcgtatcgatccgcgtgagctgatcgttgccgacagcctgttccacgacgaggaactacggccggttttcgatgtgctgggccgtgtcgcggtgccgcagccggccatcctcttcgacagtgcggtggcagaaggccgtattgcgcgttatttcaacgtctcgacgctggatggtttcggaacgttttcacgggtggaaatggcagccgcagcagcagccgtggcctatgtcgaaaagacccagattgccgagcgtccgccgctcggcgcgccggaacgcgaaagtgcggcatcgacgctcttcattgatcccgccacccgcgccaatctggaactggtgaaaacactatccggcgaccgggatggatcgctcctgcacgcgcttaaccgcactgtcactggcggcggtgcgcgacttctggccgaacgactgatgtcgccattgaccgatccggaaaggatcaatgcccgtcttgatgccgtggcctatctcatcgatgacgtctccctgtgcgatggtctgcgtgacgcgctgaaacatgtcgcggatatgcctcgtgcgctttcccgccttgcgctggaacgtggcggcccgcgcgatcttggcgccatccggcagggtctggtttcggccgaaaaaattgcggtcattctcgacggtgggctgctgccggatgagctggcgaaagctctcagggatttgaaagccctgcccggcgctcttgaagccatgctcggctcgatgctggccgacgatctgccgcttctgaaacgcgatggtggtttcctgcgtgagggcgccaatcccgaactcgacgaagttcgcgcactgcgcgaccagtcacgccgggtgatcgccgggttgcagctgcaatatgccgatgagaccggcatcaagtcgctcaagatcaagcataacaacgtgctgggttattttatcgaggtgacggcgggcaatgccgatgtgatgatggcaacggatgaggccaaagcgcgctttatccatcggcagaccatggcgggcgccatgcgcttcacaaccacggagcttgccgatctcgaaagccgcatcgccaatgccgcggccgaggctctgaccatggagctggaagccttcgagcgcatggtcgaggccgtggtgcagcaggcggaggcgatcaaggccggggctctggcgcttgcggtgatcgatgtcgcctcaagcctcgcctatcttgcgaccgaacaggcctattgccgtccgatcgtcgatgccttcatgaccttttcaatcaagggcgggcggcaccccggttgttgagcaagcgctgcggcggcagtctgccgggccgttcattgcgaataattgcgatctctccgccgtcaatggtggcaagaacggtgcaatctggctgctcaccggcccgacatgggcggtaaatcgaccttcctgcgccagaatgcgctgatcgccatcctcgcgcagatcggttccttcgttccggcggaggctgcccatatcggcgtcgtagaccggctgttttcgcgcgtcggcgcctccgacgatctggcccgtggacgctcgaccttcatggtggagatggtcgaaaccgccgccattctcaatcaggcgacggatcgctcgctggtgatcctcgacgagatcggccgtggcaccgcaacttttgacgggctttcgatcgcctgggcggccgtcgagcatctgcatgaggtcaatcgttgtcgcggcctcttcgccacgcacttccacgaactgacggtactgtcggaaaaactcggccgcctttccaatgccacgatgcgggtgaaggagtgggaaggtgatgtcatcttcctgcatgaggtcgggccgggcgctgcggatcgttcctatggtattcaggtcgcgcgacttgcgggcctgcctgcctcagtggtggagcgtgcccgtgaggtgctgacgaagctcgaggatgccgaccgcaagaacccggccagccagctgatcgacgatctgccgctgttccagattgccgtccgccgcgaggaaacccgcaaggcggggccatcgaaagtggaggaggccctgaagagcttcaacccggacgaaatgacgccgcgtgaggcattgtacgcgctctatgcgttgaagaaagaactt

SEQ ID NO: 38934 - DNA, 2040 bp, Agrobacterium tumefaciens; identical to SEQ ID NO: 38456

SEQ ID NO: 38935 - DNA, 717 bp, Agrobacterium tumefaciens
atggatctacgtctaattttcggtccaacttgcacaggaaagacatcgactgcgatagctcttgcccagcagactggcctcccagtcctctcgctcgatcgcgtccaatgctgtcctcaactatcaaccggaagcgggcgaccaacagtggaagaactgaaaggaacgactcgtctgtaccttgatgatcgccctttggtaaagggtatcattacagccaagcaagctcatgaacggctcattgcggaggtgcacaatcacgaggccaaaggcgggcttattcttgagggaggatctatctcgttgctcaggtgcatggcgcaaagtcgttattggaacgcggattttcgttggcatattattcgcaacgagttagcagacgaggagagcttcatgagcgtggccaagaccagagttaagcagatgttacgcccctctgcaggtctttctattatccaagagttggttcaactttggagggagcctcggctgaggcccatactggaagggatcgatggatatcgatatgccctgctatttgctacccagaaccagatcacgcccgatatgctattgcagctcgacgcagatatggagaataaattgattcacggtatcgctcaggagtttctaatccatgcgcgtcgacaggaacagaaattccctttggtgggcgcgacagctgtcgaagcgtttgaaggaccaccatttcgaatg

SEQ ID NO: 38936 - DNA, 720 bp, Agrobacterium tumefaciens
atggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtat

SEQ ID NO: 38937 - DNA, 501 bp, Agrobacterium tumefaciens
atgacggtagctaattggcaggttcgagatttgacgcttatcctgcgcaccggcgagatgaagagtcgcttggaacaggcgagaacggatttcggagcgttactgtccgaaactgtatactttcagccttccgcgattagacttggtgagtttgatgacgagtacatccactctcgacaagagctggtctatgtataccttcgtgaagatattgcacgccaatgcgccttgcgtcgaaacctaccgtccaactcctctaacttcggaacaatggcaactgcaataccgccgtggctgatgaatgcacgcagcctgaatcgagttatgcaggaaaggtgcgatcaaggtggcctcgtcaactactatcaaggcccacatacaaatcagttctttttggcgattatgccaagcaactgctttgttcggttcgggaccgacataatcaacaatgaaaactacggttttaagcccggggaggaatacactagaggaaggagaaga

SEQ ID NO: 38938 - DNA, 972 bp, Agrobacterium tumefaciens; identical to SEQ ID NO: 35043

SEQ ID NO: 38939 - DNA, 972 bp, Agrobacterium tumefaciens; identical to SEQ ID NO: 35043

SEQ ID NO: 38940 - DNA, 720 bp, Agrobacterium tumefaciens; identical to SEQ ID NO: 38936

SEQ ID NO: 38941 - DNA, 729 bp, Agrobacterium tumefaciens
atgatactccatctcatctacggaccgacttgcagcggcaaaacggacatggcgatccaaatcgcacaagaaaccgggtggccggtggttgcccttgatcgtgtgcaatgctgtcctcaaatcgcgacaggtagcggaagacctttggaatcggaattgcaatcaacgcggagaatatatttggattcccgccccctcaccgagggcatccttgacgctgagagtgcccatcgtcgactcatattcgaagtggattggcggaagtccgaagacggtcttattctcgagggcgggtcgatttcgcttctcaattgcatggctaaaagtccgttttggagatcgggttttcaatggcatgtcaagcggctacgtcttggggattcggacgcctttctcacccgagccaagcaacgcgttgcggaaatgtttgccatccgggaagatcgcccctcgttgttggaggagttggcggaactctggaactaccctgccgctcgaccgattttggaagatatcgacggatatcgctgcgcaattcgttttgcgcgcaaacacgatctcgcaatcagccagttgccaaatattgatgcagggcggcacgtagagctcatagaggccatagctaatgaatatcttgaacatgcgctctcgcaggagcgcgattttcctcagtggccagaagatggcgcaggacagcctgtttgcccggtcacgctgacgcgaattcgg

SEQ ID NO: 38942 - DNA, 729 bp, Agrobacterium tumefaciens; identical to SEQ ID NO: 35046

SEQ ID NO: 38943 - DNA, 816 bp, Agrobacterium tumefaciens
atgcgtgtttgtggcgtcggtgacaatgtagtcgaccggtattttaatcagaagctcatgttcccgggcggcaatgcggtcaacttcgccgttcacgcccaacggagtggaatggatgccgcctatatcggcgtcattggcaccgacgctgacggcgatctcatccgctccagcttgcaggcggagggcgttgagctcaagcacctccgcgtgaaggaaggtccaaacgcgttcgccacggttcacatggatgaggacggcaataaccgtgtttggggcctttgcgagaaaggcgtgtcgatgtttcaactcgacaccgccgatcttgagtaccttggtaagttcgacctggctcacaccggtgaaaccagccagttggacagccagcttcctgcaatgcgggagcgagttgcaatttctttcgacttctctgatcgcagtctggattacgctgcttccgtgctgccctacatcaaaatcgccgcgttctcgagatccgatgcaagcgatgatgaggtaaaacgcgttttggacaccgcagtctcagcaggtgtcgagctcgtgacggtaacgcagggcgcgagaggcgccactgtttgccacaggggtaacgtcttgtttgctccggcagtgccggtggatgccgtcgacacgcttggtgcgggcgacgcgtttctcagtcggctcgcgtgccgcgtgctggctggagtaacgttaaatgaagcagcacgcgacggggcgcagtatgcggctcacatctgcggcacacgcggcgcattcgggcatgctcgccctattacacgagagattccggca

SEQ ID NO: 38944 - DNA, 744 bp, Agrobacterium tumefaciens
atgaaactgcaaggcaaaaccgccgttatcacgggcgctggccgcggtattggacgtgcgaccgctctggagctggcaaaagaaggctgcaatgtcgtcttggcagcgatcgaactaaacgaagtcgaagcggtcgctgaagaggttcgagcgataggttccgaggcgcttgcacttcggactgacgttcagcacaagtccgaggttgatgcgttggcgaaggcggcattcgagcgttttggagccgttgatattcttgtgaataatgccggtgtcgcgatccacaataccattccaaacatcaaggaagcggattgggactggatgatggccatcaacttgaagggcactttcctgtgcacgcaggcctttttccagcatatgtgcgatcgtcgacacggccatatcatcaacgtcgtttcgcgtgcgcgcaaggttgcttctgcaaagttcggcgcatacgccgcatcgaagttcgggatgcttgggtttactcagacgaccgaccaggaaggtattgaattcggtgtgaaggccacggcagtttgccccggcgccgttgatacccagcagcggtccgacaaccacgtcgatgaccggtcgcagttgctgcagcccgaggacgttgctgagtacattgcattcattgtcaccagacacgatcgcgtctacatcggcgaagtctccccgattgcgcaacaactgaagcctctgccgggcagcggctggctgaagcccggtatt

SEQ ID NO: 38945 - DNA, 1062 bp, Agrobacterium tumefaciens
atggaatatcgcctgcttggacgttcgggcctcaaggtgtcaaccctgaccgttggaacaatgacgttcggtggtgttggctgggccaaaacagttggagacctcggcgtcacggaggcaaaacgacttgtcgatctttgtctggacgccggcatcaacctgatcgatacagccgacgtctactccgacggaaagtctgaagaaatcctcggcgagatcttgggcgggaagcggaaaggtggtgcattggtcgcgaccaaagcgcgcttcaatatgggaccaggcccgaacgatggtggtctatcgcgtcagtatttgattgccgcctgcgaggccagcctaaagcggctaaagaccgacgtgatcgacctctaccagcttcacgaatgggacggtcagacgcccctcgaagaaacgatggaggcgctcgacactctcgttcgacagggcaaggtccgttacatcggctgttcaaacttcaccggctggcagattatgaaagctctcggcatcagtgaaaaagacaagcggcagcgctttgtcagccagcagatacattacacgctcgaagcgcgtgatgcggaatatgaactgctgccaatttcggtggaccagggcttgggcgttctcatctggagtccactggcaggcgggctgctctccggaaagcaccgccgcaaccagtctgcaccggaagggagccgtcagtttgcgggctggaccgaacccccggttcgtgatgaagagcggctctggaacatcgttgacacgctcttatcggttgccgatggccggggtgtatcggctgcacaggtagcgcttgcttggcttattggacgcaaggccgtcacatccatcatcattggtgggcggaccgaggcacagttcaaggacaatcttgctgccgcagacctgcagctttcggccgaggagcgaaagcgtctcgatgatgtcagcctcctgcagctgctctatccgtattggcatcagcgcaataatgccagcgataggctgagcgaagccgatctggaattgctggctccgcacctttcgaaaaaaggg

SEQ ID NO: 38946 - DNA, 1734 bp, Agrobacterium tumefaciens
aaccgcttgaaaagacgctcggactggattgaaaatttgaccttgtttcaggtttacacacgcgctctgcgctatctgaccgttcataaatggcgtgtggccgttgtcgtcatcgccaacgtcattcttgcagcgatcaccatcgccgaacccgtgctgttcggccgtatcattgacgccatttcctccggcaccaatgttacgcccattcttattctgtgggcgggtttcggcgtctttaataccgtcgcttatgtcgcggtcgcccgcgaggcagaccgtctggcccatggtcggcgcgcaacgctgctgacggaagctttcgggcgcatcatttcgatgccgctctcctggcatcatctgcgcggcacgtccaatgcgctgcacacgctgctgcgcgccagcgaaacgctgttcggcctgtggctggaattcatgcgcacgcatctcgccaccttcgtggcgctggtgctgctcatcccgaccgccatggccatggacctccgtcttagcttcgttctgatcggcctcggcattgtctactggttcatcggcaagtgggtgatgggccgcaccaaggacggccaggcctcagtcgaggagcattatcacagcgtttttgcccatgtcagcgattccatcagcaacgtgtcggtgctgcacagctacaaccgcatcgaggctgaaacgaaggcgctgaaatccttcaccgaaaagctgctgagcgcgcaatatccggtgctcgactggtgggccttcgccagtgcgctgaaccggacggcctccaccgtttcgatgatgattatcctcgtcatcggcactgtgctcgtcaagaacggcgaattgcgcgtaggagatgtcatcgccttcatcggtttcgccaatctcctgatcggccgtctggaccagatgcgccaattcgtgacgcagattttcgaagcccgcgccaagctcgaggacttcttcgtgctggaggatgccgtcaaggaacgggaagagcccggcgatgcccgcgagctctcgaatgtctcgggcaccgtggagttccgcaacatcaatttcggtttcgccaacaccaagcagggcgttcacgacgtctcgtttacggccaaggccggcgagaccgttgcgatcgtcggaccgaccggtgccggtaagaccacgctgatcaaccttctgcaacgtgtctacgaccctgattccggccagattctgatcgacggcaccgatatttcgacggtgacgaaaaactcgctacgcaactccatcgcgaccgtgttccaggatgccggcctgctgaaccgctccatccgcgaaaacatccgcctcggccgagaaacggccaccgatgcggaagtggtggaagcagcagcagcggcagcggcaacggatttcatcgacagccgcatcaacggctacctgacgcaggtgggcgagcgcggtaaccgcctttccggcggcgagcgccagcgtatcgccattgcccgtgcgatcctgaagaacgcgcctattctggttctcgacgaggcgaccagtgcactggacgtggaaaccgaggcccgcgtgaaggccgccgtggacgcgctgcgaaagaaccggacgaccttcatcatcgctcaccgcctttccacggtccgcgatgccgatctcgtcctgttcctcgatcagggccggatcatcgagaagggcactttcgatgagctgacccagcgcggcggccgcttcacctcgctg

SEQ ID NO: 38947 - DNA, 1110 bp, Agrobacterium tumefaciens
atgacagtccgttcggttttcctgctgcccggtgatggtatcggccctgaagccatgactgaggtccgcaagctgatcgaatatatgaacagcgcgcacaatgccggctttaccgtttctgagggcctcgtcggcggttccgcttacgacgcgcatggcgtcgcgatttccgatgcggacatggaaaaggcgcttgccgccgatgcaatcctgttcggtgccgttggcggcccgaaatgggatggcgtgccgtatgagcatcgcccggaagccggactcctgcgcctgcgcaaggatctcgaacttttcgccaatctgcgcccggccatctgctatccggcgctcgctgccgcctcatcgctaaagccggaactggtcgagggtctcgatatcctcatcgttcgcgaactgaccggcggcgtttatttcggtgaaccgaagcagatcatcgatctgggcaacggccagaagcgcggtatcgacacgcagatctacgacaccttcgagatcgagcgcatcgccagcgtcgctttcgaactggcccgcagccgcgacaaccgcgtttgctcgatggaaaagcgcaacgtgatgaaatcgggcgttttgtggaaccaggtcgtcaccgaaacccacgcggccaaatacaaggacgtgcagctagaacatatgctagccgatgccggcggcatgcagctggtgcgcaagcccaagcagttcgacgtgatcgtcaccgacaacctcttcggcgacatgctgtccgacgtggccgccatgctgactggctcgctcggcatgctgccatcggcctcgctcggcgcacctgatgccaagaccggcaagcgcaaggccatgtatgagccggtgcacggttctgcccctgacatcgctggcaagagcattgccaacccgatcgccatgatcgcgtccttcgccatgtgcctgcgctactcgttcaacatggtggacgaagccaccaagctcgaggcggcgatcgccaatgtattggacaagggcatccgcaccgccgacatcatggccgacggttgccgtcaggtcggcacgtctgacatgggtgacgcggttctcgccgaattcaaggcgctttcggcg

SEQ ID NO: 38948 - DNA, 936 bp, Agrobacterium tumefaciens
atggctctggcgacaagggcgactggtggagctggccgaaggaaacccgtgagggcgcgatgcgcacgcggcctgcatctcgtgtcctgccacaaaacacagcttttggggttcacgatccgcaatgccgcctcgtggacgatccatccgcagggctgcgaggatctgacggccgccgcgtccaccatcatcgcgccgcatgacagtcccaataccgatggtttcaaccctgaaagctgccgtaacgtgatgatatcaggcgtgcgcttttccgtgggtgatgactgcatcgcggtgaaggcgggaaaacgcgggcctgatggtgaggacgatcatttggcggagacacgcggtatcacggtgcgccattgcctgatgcagccgggccatggcgggctggtcatcggttcggaaatgtccggcggggtccatgatgtgacggtggaagattgcgacatgatcggcacggatcgcggcctgcgtctcaagaccggcgcgcgttccggcggcggtatggtcggcaacatcaccatgcgccgggtgttgctggacggtgtgcagactgcactttccgccaacgcccattatcattgtgatgccgatgggcatgatgactgggtgcagtcgcgaaacccggcgccggtcaatgacggcacgccgttcgtcgacggcatcaccgtggaagatgtcgaaatccgcaatctcgcccatgcggcaggtgtctttctcggtctgccggacgtcccatccgcaacatcgttgtccgcaacctcacccatcgtctcgcatgatccttcggctgttgcgacgccgccgatcatggccgaccgcgtgcgccccatgcgcatgaggctcgtcttcgagcaggcggatgtcgtctgcgatgatccggcgcttctgaatgacgcccccgtttccatttcgtcatatttcgat

SEQ ID NO: 38949 - DNA, 720 bp, Agrobacterium tumefaciens
atggatctgcgtctaattttcggtccaacttgcacaggaaagacgtcgacggcgatagctcttgcccagcagactgggcttccagtcctttcgctcgatcgggtccaatgctgtcctcagctgtcaaccggaagcggacgaccaacagtggaagaactgaaaggaacgacccgtctgtaccttgatgatcggcccctggtgaagggtatcatcgcagccgagcaagctcatgagaggctgatcgcggaggtgtataattatgaggcccacggcggacttattcttgagggaggatctatctcgttgctcaagtgcatggcgcaaagcggttattggagcgccgattttcgttggcatattattcgccacaagttagcagacgaggagaccttcatgaaagcggccaaggccagagttaagcagatgttgtgccccgctataggcccatctcttattcaagagttggtttatctttggaatgagcctcggctgaggcccatactgaaagagatcgatggatatcgatatgccatgttgtttgctagccagaatcggatcacgcccgatatgctattgcagcttgacgcagatatggagggtaagttgattcatgggatcgctcaggagtatctcatccatgcgcgtcggcaggaacacgaattcccgccggtgagcgcggcagctttcgaaggatttgaaggcccaccattcggagcgtac

SEQ ID NO: 38950 - DNA, 1899 bp, Agrobacterium tumefaciens
atggcaaaagtaatcggtatcgaccttggcacgaccaactcctgcgtcgcagtgatggatggcaaggacacgaaagtaattgaaaacgcagaaggcgcgcggaccacgccgtcgatggtggcattttccgacgatggcgaacgccttgtcggccagccggccaagcgccaggcagtcaccaacccgaccaacaccctgtttgcggtcaagcgccttatcggccgccgttatgaagacccgaccgtcgagaaggacaaggcactcgtccccttcgaaatcgtcaagggcgacaatggcgacgcctgggtgaaggctcaggacaagaattattccccttcgcagatttccgcgatgatccttcaaaagatgaaggaaacggctgaatcctatctcggcgaaaaggtcgagaaggccgtcatcaccgttccggcctactttaacgacgcccagcgtcaggccaccaaggatgccggccgcatcgccggtctcgatgttctgcgtatcatcaacgagccgacggcagcagccctcgcttacggcctcgacaagaaggaaggcaagaccattgccgtttacgaccttggcggcggcacgttcgatatttccgttctggaaatcggcgacggcgtctttgaagtgaagtcgaccaacggtgataccttcctcggtggtgaagacttcgacatgcgtctggtcgaatatctggccggcgagttcaagaaggatcagggcatcgacctgaagaacgacaagctcgctctgcagcgcctcaaggaagctgccgaaaaggcgaagatcgaactttcgtcctcgcagcagaccgaaatcaacctgccgttcatcacggctgatgcttccggtccgaagcacctgacgccgaagctgacccgcgccaagttcgaaagcctggttgacgatctggtgcaacgcactgtcgccccttgcaaggcagcactgaaggatgccggcgttaccgcggccgagatcgacgaagtcgttctcgtcggcggcatgagccgcatgcctaaggttcgggaagtcgtcaagcagctgttcggcaaggagccgcacaagggcgtgaacccggatgaagtggttgccatgggcgccgctattcaggccggcgttctgcagggcgacgtcaaggacgttctgctgctcgacgtgaccccgctgtcgctcggcatcgaaacgctgggtggcgtcttcacgcgtctgatcgatcgcaacaccacgatcccgacgaagaagagccagaccttctcgactgccgaagacaaccagtcggccgtgaccatccgcgtttcgcagggtgagcgcgaaatggcacaggacaacaagctgctcggccagttcgacctcgtcggtctgccgccgtcgccacgcgcggttccgcagatcgaagtgaccttcgatatcgacgccaacggcatcgtgcaggtatccgccaaggacaagggcaccggcaaggagcagcagatccgcatccaggcctccggtggtctctccgacgccgacatcgaaaagatggtgaaggacgccgaagccaatgccgaggccgacaagaagcgtcgcgccggtgtcgaagccaagaaccaggccgaaagcctcattcactccaccgaaaagtcggtgaaggaatatggcgacaaggtttccgagaccgaccgcaaggcgatcgaagacgccattgccagcctgaagaccgctgtcgaagccgccgagcctgacgcagacgacattcaggccaagacccagaccctcatggaagtctccatgaagcttggtcaggccatctacgaagcacagcaggccgaggccggtgatgcttccgcagaaggcaaggatgacgtcgtcgatgccgactatgaagaaatcaaggacgacaagaagtccgca

SEQ ID NO: 38951 - DNA, 294 bp, Agrobacterium tumefaciens
atgacaagcaccaatttccgtccgcttcatgatcgcgtcgtcgttcgtcgcgttgagtccgaagcaaagaccaagggcggcatcatcattcccgataccgccaaggaaaagccgcaggaaggcgaaatcgtcgccgtcggttccggcgcgcgcgatgaggccggcaaggtcgtcgctctcgacgtcaaggttggcgatcgcgttctgttcggacagtggtcgggcactgaagtcaagctcgacggcgaagattcctcgatcatgaaggaagccgacatcatgggtatcatcggc

SEQ ID NO: 38952 - DNA, 1629 bp, Agrobacterium tumefaciens
atggcagctaaagaagtcaaacctggcgcctcagcgcgcgaaaagatgctgaagggcgtcgacattcttgccgatgcagtgaaagtaaccctcggcccgaagggccgtaacgtcgttatcgacaagtccttcggcgctccgccgatcaccaaggacggcgtttccgtcgccaaggaaatcgaactggaagacaagttcgagaacatgggcgcacagctcgttcgcgaagttgcctccaagaccaacgacatcgccggtgacggcaccaccaccgcaacggttctggcccaggccatcgttcgcgaaggtgcaaaggcagttgctgccggcatgaacccgatggacctcaagcgcggtatcgatctggccgttgctgaagtcgtcaaggaccttcaggccaaggccaagaagatcaacacgtctgaagaagttgcacaggtcggcacgatctctgcaaacggcgagcgtcagatcggtctcgacattgctgaagcaatgcagcgcgtcggcaacgaaggcgtcatcaccgttgaagaagccaagactgctgaaaccgaactcgaagtcgtcgaaggcatgcagttcgaccgcggatacctgtcgccttacttcgtaaccaacccggaaaagatggttgcggacctcgaagacgcttacatccttctgcacgaaaagaagctctcgaaccttcaggccatgctgcctgttctcgaagccgtcgttcagaccggcaagccgctcgtcatcatcgctgaagacgtcgaaggcgaacgtcttgcaacgctcgtcgtcaacaagctgcgtggcggcctcaagatcgctgccgtcaaggctcctggcttcggcgatcgccgcaaggccatgctggaagacatcgccatcctgaccggtggtaccgtcatttccgaagacctcggcatcaagctcgaaagcgttaccctcgacatgctcggcaagtcgaagaaggtttcgatctccaaggaaaacaccacgatcgttgacggtgccggccagaagtccgacatcgaaggccgcgttgcccagatcaaggcacagatcgaggaaaccacttccgactacgaccgcgaaaagctgcaggaacgtcttgccaagctcgctggcggcgttgccgtgatccgcgttggcggttcgacggaagttgaagtgaaggaaaagaaggaccgcatcgacgacgctctcaacgcgacgcgcgctgctgttcaggaaggcatcgtaccgggcggcggcgttgccctgctgcgttcttccacgaagatcaccgtcaagggtgtgaacgacgatcaggaagccggcatcaacatcgtgcgcaaggctctgcagtctctggttcgccagatcgcagaaaacgctggtgatgaagcttccatcgttgttggcaagatcctcgacaagaacgaagacaactacggctacaacgcccagaccggcgaatatggcgatctgatcgctctcggcatcgtcgacccggtcaaggttgtacgtaccgctctgcagaacgcagcttcggttgcttcggtgctgatcaccaccgaagcgatgatcgccgagcttcctaagaaggaatcggcaatgccgcagatgcccggcggcggcatgggcggcatggac

SEQ ID NO: 38953 - DNA, 720 bp, Agrobacterium tumefaciens; identical to SEQ ID NO: 38949

SEQ ID NO: 38954 - DNA, 720 bp, Agrobacterium tumefaciens
atggatctgcgtctaattttcggtccaacttgcacaggaaagacgtcgaccgcggtagctcttgcccagcagactgggcttccagtcctttcgctcgatcgggtccaatgttgtcctcagctgtcaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattcttgagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaagagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtatctcatccatgcacgccgacaagaacagaaattccctcgagttaacgcagccgcttacgacggattcgaaggtcatccattcggaatgtat

SEQ ID NO: 38955 - DNA, 2463 bp, Agrobacterium tumefaciens
atgatcaataatcttaccgccgccgatcttccccgccccgccccgcgcagttccaacccggaaatcatggccgcggaaatcatcgagcgactgacctaccgcatcggcaaggacgtcaaggttgcgaaaccgcacgactggctgaccgcaaccatcctcgtcgtgcgcgacccccgcatcatcgacaaatggatggcatccacccgcaaggcctatgccgacaattccaagcgcgtttattatctgtcgctggaattcctgatcggccgcctgatgcgcgacgccatctccaatatcgggctgatgcatgaaatccgcgatgcgctgtcctcgctcggcgtcgatctcgacgtgattgccggtcttgagccggatgccgcacttggcaatggcggcctcggccgcctcgccgcctgtttcatggaatccatggcgaccgtcgacattcccgcctatggttatggcatccgttacgtgcacggcctcttccgccagcagatggcggatggatggcaggtggaactgccggaaacctggctggcgcatggcaatccctgggagttcgaacgccgcgaaagctcctatgaaatcggcttcggcggatcggtggagacgatcggcggatatgaagacccgcagcgtttcgtctggaaaccggccgaacgtgtgatcgccatggcctatgacaccccggtcgtcggctggcgcggcacccgcgtcaacacgttgcggttatggtctgcgcagcctatcgaccccattctcttggccgcctttaatgccggcgaccatatcggcgcattgcgcgagagcaacaaggcggaaagcctgacgcgggttctctaccctgcggacgcgaccccggccgggcaggaactgcgcctgcggcaagagttcttcttctcctccgcctcgctgcaggacattctgcgccgccatctccagcaatatcctgacttcacctcgttgccggacaaggtctcgattcagctcaacgatacccatccggccatttccatctgtgaaatgatacggctgctctgcgatgtgcacggtcttgaattcgacgaggcctggaggatcacccagggcaccttctcctacaccaaccacacgcttctgcccgaagcgctggaaagctggccggtgccgctgctcgagcgtcttcttccaagacatatgcagatcgtctacgcgatcaacgccaatacgctgctctttgcccgcaaggaaaagaagatggcggatcagcagatccgctcgatctcgctgatcgatgaaggcggcgagcgccgtgtgcgcatgggcaatctcgctttcatcggctcgcattccatcaatggcgtttcggcgcttcatactgagttgatgaaggaaacggtttttgccgacctgcacagcctctatcctgaacggatcaacaacaagaccaacggcatcaccccgcgccgctggctgatgcagtgcaaccccggcctcaccgggttgatccgggaagcgatcggcgacgatttcctcgacgatgcggaaaagctcatcgcgctcgaccgtttcgccgacgatgccggtttccgtgagaaattcgctgaagtgaagcgcctgaacaaggtgcgcctcgccaacaccgtggcacagcgcatgggactccgcgtcgatccttcggccatgttcgacatccagatcaagcgcatccacgaatataagcgccagcttctgaaccttatcgaaacggtggcgctttacgaccagatccgttcccacccggaactggattgggtgccgcgcgttaagttcttcgcaggcaaggcggcgccgagttatcacaacgcgaagctgatcatcaagcttgccaacgatattgcccgggtcatcaacaacgacccggccgtgcgcgggcttctgaaggtggtgtttattccgaactacaacgtctcgcttgcggaaatcatggttcccgccgccgatctttccgaacagatttcgaccgccggcatggaagcgtccggcaccggcaacatgaaatttgccctgaacggcgcgctcaccatcggcacgctcgatggcgcgaatgtggaaatgctcgaacatgtcggcgctgacaacatcgtcatcttcggcatgacggcggaagaagtctccagggctcgcgccgaaggccataatccccgcgccatcatcgaagggtctgcggaattgtcgcaggcgctgtcatcaatcgcgtcgggtgtgttttcaccggatgaccgttcgcggttttccgccctgatggatggcatctacaacagcgactggttcatggtggctgccgatttcgacgcctatgccgatgcacagcgcaaggtggacgcgatctggagcgatcaggatagctggaacacgaaagcagtgcgcaacacggcgcgtatgggctggttctcgtccgacaggacgatccgccaatatgccaccgagatctggagagcc

SEQ ID NO: 38956 - DNA, 1260 bp, Agrobacterium tumefaciens
atgtcggaaaaaagagttcagcctttggcgcgtgatgcaatggcctatgtcctcgcaggcggaagaggaagccgtctgaaggaactgacggaccgccgggcaaaacccgcggtttattttggcggcaaggcgcgcatcatcgattttgcgctttccaacgcgctcaattccggcatccgccgcatcggcgtcgccacgcaatataaggctcactccctcatccgccacctgcaacgcggctgggacttcttccgtcccgagcgtaacgaaagcttcgacattctgccggcttcgcagcgcgtgtccgaaacgcaatggtacgaaggcaccgccgacgcggtttaccagaacatcgacatcatcgagccctatgccccggaatatatggtcattctggccggcgaccatatttacaaaatggactacgaatacatgctgcaacagcatgtggattccggtgccgacgtcacgatcggctgccttgaagtgccgcgcatggaagcgaccggcttcggcgtgatgcatgtgaacgaaaaagacgagatcatcgacttcatcgaaaagccggccgatccgcccggcattcccggcaatgaaggttttgcgctcgcctcgatgggcatctacgtcttccacacgaagttcctgatggaagccgtgcgccgcgatgccgccgatccgacctccagccgcgacttcggcaaggacatcattccctatatcgtcgaacacggtaaagccgttgcgcaccgcttcgctgattcctgcgtgcgttcggatttcgagcacgaaccctactggcgagacgtcggcaccatcgatgcctattggcaggccaatatcgacctcacggatgtggtgccggacctcgatatctacgacaagtcctggccgatctggacctatgcggaaatcaccccgccggcgaaattcgtgcatgacgatgaagatcgccgtggttcggccgtatcgtcggtcgtctcgggcgactgcatcatttccggtgcagcgctcaaccgcagcctgctgttcacaggcgtgcgcgccaattcatactcccgccttgagaatgccgtagtactgccgagtgtgaagatcgggcgtcatgctcagctcagcaatgtcgtcatcgaccatggcgtggtcattccggaaggactgattgtaggagaagaccccgaactggatgccaaacgcttccgccgcacggaaagcggcatctgccttatcacccaatcgatgatcgacaagctggacctg

SEQ ID NO: 38957 - DNA, 1440 bp, Agrobacterium tumefaciens; identical to SEQ ID NO: 35062

SEQ ID NO: 38958 - DNA, 1626 bp, Agrobacterium tumefaciens
atgatcaagactatcaagacgacgccttatcaggaccagaagccgggcacatccggcctgcgcaagaaggtgccagtcttcgcccaggaaaattatgccgagaacttcatccagtcgatcttcgacgcgcttgaaggttttgagggccagacgctggtgatcggcggcgacggccgttattacaaccgcgaagtcatccagaaggcgatcaaaatggccgccgccgccggtttcggcaaggtgctggtcggtcagggcggcattctctcgacgcccgccgcctccaacgttatccgcaaatacaaggccttcggcggcatcgtgctttccgccagccataatcccggcggcccgaccgaagatttcggcatcaaatacaatatcggcaatggcggcccagcaccggaaaagatcaccgacgcgatctatgctcgctctaaggtcatcgacagctacaaaatctctgatgcagccgatatcgatctcgacaagatcggcagcttcaaggtggatgaactaacggtcgacgttatcgatccggttgccgattatgctgcgctgatggaagagctgttcgattttggcgccatccgttctctcatcgccggcggcttcaaggtcgtcgtcgattccatgagcgccgtcaccggcccctatgccgttgagatcctcgaaaagcgtctcggcgctcccaagggctccgtccgcaacgcaacaccgctgcccgatttcggcggccaccatcccgatccgaaccttgtccatgccaaggagctttatgacgacgtcatgagcccggaaggcccggatttcggcgcggcttccgatggtgatggcgaccgcaatatggttgtcggcaagggcatgttcgtcactccctccgatagtctcgcgatcatcgccgccaatgccaagctggcgcccggttatgccgccggcatttccggcatcgcccgctcgatgccgaccagtgcggcagccgaccgcgtcgctgaaaagctcgggcttggaatgtacgaaaccccgaccggctggaaattcttcggcaatctcatggatgccggcaaggtgacgatctgcggcgaggaaagctttggcaccggttcgaaccatgtgcgtgaaaaggatggcctgtgggccgtgctttactggctgaacattgtcgcggcgcgcaaggaaagcgtgaaggacatcgtcaccaagcactgggcggaatatggccgcaactattattcgcgccacgactatgaggaagtggattcggatgccgccaatacgctggtggccatcctgcgcgaaaaactcgcgacactgcccggcaccagctacggcaatctgaaggtcgcggcggcggatgattttgcctatcacgatccggtcgaccagtctgtcagcaagaaccagggcatccgcatcctgttcgaaggcggctcgcgcatcgtgctgcgcctttccggcaccggtactgcgggcgcgacgcttcgactctacgtcgagcgttacgagccggatgcggcccgccacggcatcgaaacgcagtcggcgctcgccgatctgatttccgttgccgataccatcgccggcatcaaggcccatacggccgacagcgaaccgactgtcattacc

SEQ ID NO: 38959 - DNA, 732 bp, Agrobacterium tumefaciens
aggctcgatggaaaagttgctttgatcaccggcggaacgcgcgggatcggtctcgcgaccgcctatgcattcggggaggcaggtgcgaagctctacctgagtgctcgccgtgaagaatatgaggacgccggtgccatactcacagccggctatgatgtgaccttctatccggcggacttgaaaacgcgcgaggcagcgtgcgccctcgtgaagagggtcgccgacgacgcggggcgacttgatattctcatcaacaatgcgggtatcgccaatggtggcgacactccgctctttaccgaacaacaatggcgagacgtcatagcaaccaacgttgagactgttttctggtgctcgcaggccgccatcccggtgatgcgcgagggtggtcgaggcgcgattgtgaatgtcggatcaatgtcgggtattgtatcgaatattccgcagaaccaggtcgcgtataacagttccaaggcagcggtccatatgatgaccaagagccttgctagcgagttggccctcgacaatatcagggtcaacgctgtcgcacccggctacatcgacaccgatatgtcgcgaggcgggatggtacatcctgtcaggggaccaatctggcttgagatgacgcctatgaagcgatttggccgcccggatgaaatcgcaacagcaatacttttcctagcgtcagaagcgtcgagctacgtcacaggagatattcttgtcgttgatggcggc

SEQ ID NO: 38960 - DNA, 732 bp, Agrobacterium tumefaciens; identical to SEQ ID NO: 38959

SEQ ID NO: 38961 - DNA, 918 bp, Agrobacterium tumefaciens
atggatatcaggctgatcggtgcgccgttgcaaatcggagccgggcaattggggtgtgagatggggccgagtgcgtatcgcatcgccggtctcacgcgggcgctcgaagatttgggccatcgggtggtggataccggcaatgtgacgccggcgccgctgagggagtttagccaccccaatccggcggtgcatcatctcgctgagacggtggcctggaccgaggcgctgacggaggcggcctatcgcgaaagtgctgccgccgttccgatctttcttggcggcgaccacgcaatttccgcgggaaccgtcgccggcatggcgcggcgggtggcgcagagtggccggccgtttttcgtgctctggctcgatgcccataccgattaccacacgcttgaaacgacgcgcagcggcaacctgcatggcacgccggtcgcctatttcagtggtcgcgacggattttcgggttactttccgccgctctcgcatgcggttcctgaggaaaatatcggcatgatcggcatccgcagcgtcgatccagccgagagagccgcactggaagacagcggcatcaccgttcacgacatgcgctcgatagacgagcatggtgtcgcggttctgctgcgcgcgttccttgcgcgggtgcaggcggcaaacggcctgttgcatgtcagtctcgatgtcgatttcctcgaaccgtcgatcgcgcctgcggtcggcaccacggttccgggtggggcgacgttccgtgaggcgcatctggtgatggagatgctgcatgatagcgggcttgtgtgcagtcttgatctcgtggagcttaacccgtttctcgatgagcgcggcaggacggcgacgctgatggtcgatctggctgccagcctgatgggcaagcgggttatggaccgcccgacacgggccggc

SEQ ID NO: 38962 - DNA, 3684 bp, Agrobacterium tumefaciens
atggccgatggtgcaagcaaagccgatgtaaacccgcagcagacggtgaacggtattttccagaattttgcaccgcccgtgcgcgagcagagcccgttgcgcaaagcaattaccgccgcttaccgccgcccagaggaagagtgcctggcgcctctgatcgatgctgcgaccgtcacgcccgagcaggccgcagccattcgcaccacggcaaccaagctgatcgaggcgttgcgcgccaagacgaaaggcaccggcgtcgaggggctggtgcaggaatattcgctctccagccatgagggcgtggccctgatgtgccttgccgaagcactgctgcgcattcccgacaccgccacccgcgacgcgctgatccgcgacaagatcgcccgcggcgactggaagtcccacatcggcggcgggcgctcgctgttcgtcaacgccgcaacctggggtcttgtcatcaccggcaagctgacctcgacggtcaatgacagcggcctttcggcggcgctgaccaagctgatcgccagggctggcgaacccgtcattcgccgcggcgtcgatatggcgatgcgcatgatgggcgaccaattcgtgaccggcgaaacgattggggaagcgatcaagcgctcgaaaccgctggaggaacagggtttccaatattcctacgacatgctcggcgaagcggcgaccaccgccaaggatgcggagcgttattacaaggactacgaaaacgcgatccacgccattggcaaggcctccgccgggcgtggcatctatggtggccccggaatttccatcaagctttcggccctgcatccgcgttatgcccgtgtgcaggcagagcgggtaatggcggagcttctgccgcgtgtgaaatccctgatgctgctcagcaagaaatacgatatcggcctcaacattgacgccgaggaagccgaccggctggaactgtcgctcgatcttctggaggaactggcgctcgacaaggatcttgccggttggaacggcctaggcttcgttgtgcaggcctatggccgccgctgcccctttgttctcgactacatcatcgatctcgcccaacgtgccggtcgccgcatcatggtgcgtcttgtcaagggcgcctactgggatgcggagatcaagcgcgcacaggtggacgggctggaagacttcccggtcttcacccgcaaagtgcacacggatgtctcctatatcgcctgcgcccgcaagctgcttgccgcgcgtgacgtcgtgttcccgcaatttgcgacccacaacgcccagtccatggctaccatctaccatctcgctggtccggacttcaaactcggtgattacgagttccagtgcctgcacggcatgggcgaaccgctttacagcgaagtcgtcggcaagaaaaagctcgatcgtccctgccgcttttatgcgcctgttggcacccacgagacgctgcttgcctatctcgtccgccgtctgctggaaaacggcgcgaactcctccttcgtcaaccgcatagcagatcccgccgtgccggtggcttccctgctggaagatccggtcaccgtggtcaaggcttaccccgttcccggcgcacggcacgaccgcattgctgcacccgctggtctcttcggccccgaacgggcaaattccgccggcctcgatctttcgaatgaaacggcacttgccgcgctggacaacgtccttaaggcaggtgcgacgacggaatggaaagccgcagcaccgcatgcaggcggaaagacacgcccggtcctcaatcccggcgaccacaatgatgtcgtcggttatgtaaccgaaccgacagaggccgatgtcgaagcggcaatgcaacgggccgcagcctccaactggtcttccacgccggtcgaggagcgcgccgcctgcctggagcgcgctgccgaccggatgcaggccgaaatgccggccctgcttggcctcatcatgcgcgaggccggaaaatccatgccgaacgccattgccgaggtgcgcgaagcgattgacttcctgcgttattacgcagcggaagcccggaagaccttcaaggccaacgagacaccgctcggcccggtcgtctgcatcagcccgtggaacttcccgcttgccatcttcatcggccaggtaacggcagcactggttgccggtaatccggtactggcaaagcccgccgaagaaaccccgttgatcgccgcgcagggggtacgcctgctgcatgaggcaggcgttccgcaggacgccgtgcagcttctgccaggtgacggcaagaccggtgcggcactagtcggctcagcgctcacggcgggtgtgatgttcaccggatccactgaagtggcgcggctcatccagggtcaactcgcaggccgggttctcgcaaacggccagcccgttcccctgattgccgagaccggcggccagaacgccatgatcgtcgattcctcagcgcttgccgagcaggtcgtcgccgacgtcatcgcctctgccttcgacagtgccggccagcgttgctcggcgcttcgcattctctgcctgcaggaagatgtggccgaccgaaccctgacgatgctgaagggcgcgctgcacgaattgcgcatcgggcgcaccgatagcctttccgtcgatgtcggccccgtgatcaccgctgaagctaaaggcatcatcgaaaaacacgttgacagcatgcgcgcactcggccaccggatcgagcagatttcgcttgccggcgaaaccggcaagggcaccttcgtgccaccgacaatcatcgagatgaaatcgctcgccgatcttaagaaagaggtcttcgggccggtgctgcacgtcatccggttcaagcgcgacaatctcgaccggctgatcgacgagatcaacgccaccggctatggcctgaccttcggcctgcatacgcgtcttgacgataccatccagcatgtcctgtcgcgcgtcgcggccggtaatctctatgtgaaccgcaacatcatcggcgccgtggtcggcgtccagccctttggcgggcgaggcctctccggcaccggccccaaggcgggcggtccgctctatctcggccgcgtcacacaaaccgcgccgaagatcgaccgcgttgccagccagcaggaccaggcggctgtcgatctcgcccgctggctggatgaaaacggccagagcgttgcagccgaagccgcaagacaggccgcagccctatccggcctcggtttcgaaaccgaactggcaggcccagtcggcgaacgcaacgtctatgcgctgcatccgcgcggcaaggtgctgcttattccggccacggagcaagggctctatcgccagcttgcggcagcgcttgccaccggcaactcggtcgttatcgataatgcgtcggggctggaaaagtcgatctacggattgccggcaaccgtcacctcgcgcatcacatgggctgacagctgggaaaaatccgcaccgttcgccggcgcgctgatcgagggcgatgcggaacgtgtcgttgcgatcaacaagaaaatccccgccctgcccggtcctctggttctggttcaggccgccacgacggaagcgcttgaccgtgaaacccagccctacaatctcgactggctggtggaagaagtctccgtcagcgtcaacacaacggctgccggcggcaatgccagcctgatgagcatcggc

SEQ ID NO: 38963 - DNA, 1182 bp, Agrobacterium tumefaciens
atggacactggcgaccgcgccgacttcaagcgggaacttctagatggcatgcaggctatgacgcgggaaaaccgctggcgcgacgtcaccgggcgtgtcgccgcttacgatgccgcagccgaaaagatcgaaacggtggaagtggaacggcctaatctttatgccacccgggcattttcactctcgaactggaggctgatcgccgccaactggctgtcttccaacgttctttcctattcgctggcattcattggttttggtgtcgctgctcggttttgccaccttcgtaatgctgcgcatgatggggcggcatcgatgaagagcgggatttcgaaaattgccggtattgtctcgctgtcggccatgatgctgtttgccggcctctccctcagccgcgcggcttcgatcccgacggacgcatgggctgcctataagggcgcgtttctcgatcccggtggccggatcatcgataccggcaacagcaatatcagccacagcgaagggcagggctatggcatgtggctcgccgtgcttgccgacaacctgtccgacttcgagctgatctggagcttcacccgcaccgaattgctggtgcgcgatgacgggctttccgcctggaaatgggatccgcgcaccagaccgcatgtcaccgacatcaataatgcgacggatggcgacatcctgatcgcctatgccgtggcgctggcggccgggcagtggaaccggcaggattatgccgaagcatcggcggccatcgcctccgtcatcctcaaaaagaccgtggtgcagcgtggcgggcgcacgctgcttctgccggccgccaagcggttttggcgagggcggatcgggccgatgggccgggtggtcaatccgtcctatctgattttcgaagcctttccggtgctcaatctcgtcgcgccgtcgccgctctggaaagcggtggcagatgatggggtggcgcagatcggcgccttcgccttcagtgacagaaaactgcccgccgactgggtatcggtgaagacgaagccgcagccggcatcgggatttcagccggaattcggatataatgcggtgcgcataccgctttatcttgcaagggcgaatatgggcgcgcccgagctgctttcccggctgaaagacggcatgacgctggaaagccggtgcctgccggcaccttcgatc

SEQ ID NO: 38964 - DNA, 720 bp, Agrobacterium tumefaciens; identical to SEQ ID NO: 38936

SEQ ID NO: 38965 - DNA, 501 bp, Agrobacterium tumefaciens; identical to SEQ ID NO: 38937

SEQ ID NO: 38966 - DNA, 720 bp, Agrobacterium tumefaciens; identical to SEQ ID NO: 38936

SEQ ID NO: 38967 - DNA, 501 bp, Agrobacterium tumefaciens; identical to SEQ ID NO: 38937

SEQ ID NO: 38968 - DNA, 720 bp, Agrobacterium tumefaciens
atggatctgcgtctaattttcggtccaacttgcacaggaaagacgtcgaccgcggtagctcttgcccagcagactgggcttccagtcctttcgctcgatcgggtccaatgttgtcctcagctgtcaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattcttgagggaggatctatctcgttgctcaagtgcatggcgcaaagcagttattggagtgcggattttcgttggcatattattcgccacgagttagcacacgaggagaccttcatgaacgtggccaaggccagagttaagcagatgttacgccccgcttcaggcctttctattatccaagagttggttgatctttggaaagagcctcggctgaggcgcatactgaaagagatcgatggatatcgatatgccatgttgtttgttagccagaaccagatcacatccgatatgctattgcagcttgacgcagatatggaggataagttgattcatgggatcgctcaggagtatctcatccatgcacgccgacaagaacagaaattccctcgagttaacgcagccgcttacgacggattcgaaggtcatccattcggaatgtat

SEQ ID NO: 38969 - DNA, 720 bp, Agrobacterium tumefaciens
atggatctgcgtctaattttcggtccaacttgcacaggaaagacgtcgaccgcggtagctcttgcccagcagactgggcttccagtcctttcgctcgatcgggtccaatgttgtcctcagctgtcaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattcttgagggaggatctatctcgttgctcaagtgcatggcgcaaagcagttattggagtgcggattttcgttgggatattattcgccacgagttagcagacgaggagaccttcatgaacgtggccaaggccagagttaagcagatgttacgccctgctgcaggcctttctattatccaagagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtatctcatccatgcacgccgacaagaacagaaattccctcgagttaacgcagccgcttacgacggattcgaaggtcatccattcggaatgtat

SEQ ID NO: 38970 - DNA, 1419 bp, Agrobacterium tumefaciens; identical to SEQ ID NO: 38409

SEQ ID NO: 38971 - DNA, 777 bp, Agrobacterium tumefaciens
atgatacacttctcgaacccaaaaaatatcaatttgtattcaagatatcgcaaaacacttatggatctccgtctaattttcggtccaacttgtacaggaaagacatcgaccgcgatagctcttgcccagcaaaccgggcagccagtcctttctctcgaccgggtccaatgctgtcctcaactgtcaaccggaagcggacgaccaacagtggaagaactgaagggcacgacccgtctataccttgatgaacagcctcttgtgaagggtatcatctcagccaagcaagctcacgagaggctgatcgcggaggtttataataatgaggctcacggtgggcttattcttgagggaggatctatctcgttgctcaagtgcatggtgcagagcagttattggagcaacgattttcgttggcgtattattcgccacaagttagcagacgaggagaccttcatgaaagcggccaaggccagagttaagcagatgttgcaccccgctgcaggcctttctatcatcgaagagttggttcatctttggaatcagcctcagctgaggcccatactggaagggattgatgggtatcgatacgccatgttgtttgctagccaaaaccagatcacacccgatatgctattgcagcttggcgcagacatggaggataagttggctcatgggatcgctcaggagtatctcatccatgcgcgccgacaggaacaggaattcccttcaattaacgcagtcgctttcgaaggattcgagggtcatccgttcggaatg

SEQ ID NO: 38972 - DNA, 874 bp, Agrobacterium tumefaciens
gtatcgtttcagggtgtcacgcggcgcttcggccctgtcaccgccgttgacaacgtcagcctcgatatctcgcagggtgagttcttcgccctgctgggttcgagcggctctggcaaaacaacacttctcacgttgcttgccgggttcgacaatccgaacgaaggccaggtgttgatgtcgggtgtgtccgtttcggatgtcccacctcacaagcggcagataggtgtggtgttccagaattatgctctcttcccgcatctgacagctgccgagaatgtggcctatcccttgaggatgcgtggagtggctcgtcacgagcgcgaagaacgcgtcaaagccgcactcgcgctggtcaatctttccgatcggctcggtgcttatccgatccagctttcgggtggtcagcaacagcgggtagcgctcgcacgagcgcttgtcttcagtcccgccatcttgctgatggacgaaccgctgggcgcgctcgaccggcgcctccgcgaccagatgcaacaggaattgaaacgcatccagcatgagttgggcatcacggttatctatgtgactcatgatcagtccgaagcaatggctatggcggaccgcatcgggatcatgtctgccgggcgtctccttcaggtcgccgatcccgaggcaatctatgcagcgccatccagtcacttcgttgcacgcttcatcggagagtgttcgatcctgcgggtcagtggcaccaatgaaggcaggggttacgaaatcgcaggagcgcgccagtcactgccctcccccgccaatgggccattcgatatcgtcgttagaccggaagacgtcgcgatccggtccccatcgacagcatccatcgactctttcggtgtttccgcca

SEQ ID NO: 38973 - DNA, 1332 bp, Agrobacterium tumefaciens; identical to SEQ ID NO: 38682

SEQ ID NO: 38974 - DNA, 1434 bp, Agrobacterium tumefaciens
aagctaaaaaatgcggcgctgttgcgtgatgcctgcctggtgaatggtcgctggctgaaagccgcggatggcaagacgattgcggtggaaaatcccgccaactcgatgatcatcggtcacgttccttcattgtcggcagatgaggttaaagctgcagtcgagtcagcaggcaaggcattttccgagtggagccgccgttctgcgaaggaccgcgctgccatattgcgtcgatggtttgatctcatggtggcgaacgctgacgatcttggtgcgttgatgactgccgagcagggaaagccgtttgcggaagcaaagggcgaagccctttatgcggcatctttcgtggaatggttcgcggaggaagccaaacgtgtttatggcgataccattccttcgccgaccacggacaagcgcattaccatcctgaagcagccgatcggtgtctgcgccgcgatcacgccatggaacttcccggccgcgatgatcacccgcaaggcggccccggcacttgccgcaggctgcgcgatgatcgtcaaaccggctgagcagacccctctcaccgcacttgctctgggtgttctcgccgaagaagcgggcgttcccgccggtgtcttccaggtggtgacgggcgccgcacgcgatatcggcaaggtgtttaccgaaagcgacacggtgcgaaagatctcctttaccggatcgactgaagtcggtcgtctgctgatggcgcaatcggccccgacgatcaagaaactgtcgctggaacttggtggcaatgcgcctttcatcgtctttgatgatgccgatctggatgcggccgttgagggcgcgatcgtgtcgaaataccgcaatgccggacagacctgcgtgtgctccaaccggatctatgtccaggatggtgtttacgacgcattcgcggaaaagctggtcaaaagggtcgaaagcctgtccgtcggtgagggcacggaacctgttgttctgataggtccactgatcgaccaggaggccgtgccaaaggtcgaggatcacgttgctgatgcccttggcaagggagcaaagatcgtcatcggtggaaagcgtcatgctcttggaggcacattctacgaaccaacggttctgactggtgcaacccaggccatgaaggttgcccgtgaggagacctttggacccgtcgccccgctctttcggttcgggacggaagacgaagcggtcgccatggcgaacgataccgaatttggtctggcggcctatttctacaccgagaatgtccgccggacatggcgtgtcgcagaagcgctcgaatacggcatggtgggccacaatacaggcctcatctccaacgaagtcgcaccattcggtggcgtgaagcagtccgacttgggccgcgaaggctcgcactacggcatcgatgaatatcttgaaatcaaatacctgtgc

SEQ ID NO: 38975 - DNA, 1158 bp, Agrobacterium tumefaciens; identical to SEQ ID NO: 35204

SEQ ID NO: 38976 - DNA, 633 bp, Agrobacterium tumefaciens; identical to SEQ ID NO: 38108

SEQ ID NO: 38977 - DNA, 2142 bp, Agrobacterium tumefaciens
ggcaagtgtcccgtcatgcatggaggcaatacggtctccggcaaatcggtgaccgaatggtggccgaacgcgctaaacctcgacatcctgcatcagcacgacaccaagaccaatccgctcggcacctccttcaactaccgcgaagcgctgaagacgcttgatgtcgaagccctcaaggccgatctgcgcgcgcttatgaccgacagccaggaatggtggccggccgactggggcagttatgtcggcatgatggcccgtgttacctggcatgccgccggttcctatcgtgtcacagacggtcgcggcggcgccaataccggcaaccagcgttttgcaccgctcaattcctggccggacaacgtcaacaccgacaagggccgccgcctgctgtggccgatcaagaagaaatacggcaacaagatttcctgggccgaccttatcgcgctcgccggcacgatcgcctatgacgtcgcgggtctgaagaccttcggcttcgccttcggccgcgaagacatctgggcgccggaaaaggacacctattggggtgacgaaaaggaatggctggcgccgagcgacggccgttatggcgacgtgagcaagcccgagacgctggaaaacccgcttgccgccgtgcagatgggcctgatctacgtcaacccggaaggtgtcaacggcaagtccgatccgctggcgacggcggcgcagatgcgcgaaacctttgcccgcatggggatggatgacgaggaaaccgttgccctgacggccggcggccacaccatcggcaagtcccatggcaatggcagtgctgccaatctcagccccgatccggaagctgctggcccggaatatcagggtctcggctggatcaataccaagggccgcggcattggccgtgacaccgtggtgtcgggtatcgaaggcgcatggacaagcgaaccaaccaagtgggacaacggcttcttcgacatgctgttcaagcacgagtggaccctgacgcacagccccgcgggtgcatcgcaatgggcgccgattaccatcgccgaagaagacaagcctgttgatgtcgaggatgcgtcgatccgcaccatcccgatgatgaccgacgccgacatggccctgaaggtcgatccgatctaccgcgagatttcgctgaagttcaaggacgatcaggaccatttctctgatgtcttcgcccgcgcctggttcaagctgacgcatcgcgacatggggccgaagtcccgttacgtcggcccggatgttccggctgaagacctgatctggcaggatccgatcccggcaggctccacgagctacgatgtcgctgccgtcaaggctaagatcgctgcctccggcctttctgtcgccgatctggtttcaaccgcatgggacagtgcccgcaccttccgtggttcggacaagcgcggcggcgccaatggcgcgcgtattcgtctcgcaccgcagaaggattgggaaggcaatgagcccgcccgtctttcccgcgtgctttcggttctggagccgattgcccgcgaaaccggtgcaagcatcgccgatgtgatcgttctggctggcaattacggcgtggagcaggcggcgaaagcggctggtttcgatatcgccgtgcccttcgcggccggtcgtggtgacgcttccgccgagcagacggatgccgacagctttgcgccgcttgagccgctggcggatggtttccgcaactgggtgaagaaggactatgtcgtcagccccgaagagctgctgctcgatcgggcacagcttcttggcctcaccgcgccggaactcaccgtcctcatcggcggcctgcgcgtcatcggcgccaattacggcggtgcggcgcatggcgtcttcaccgataagccgggggcgcttacaacggacttcttcacgacgttgacggacatggcctattcctgggtcccgaccggcaacaatctctatgagatccgtgatcgcaagaccggcgcagccagatattcggcaacccgcgtcgatctcgtgatcggctccaactccatcctgcgcgcttatgcggaagtttatgcgcaggacgacaacagggaaaaattcgcccgcgacttcattgccgcctggacgaaggtgatgaacgccgaccgtttcgatctg

SEQ ID NO: 38978 - DNA, 1821 bp, Agrobacterium tumefaciens
atgggtcagtcccttatgttacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggccaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaa

SEQ ID NO: 38979 - DNA, 468 bp, Xanthomonas campestris
  unsure (1)..(468): unsure at all n locations
gtcgccacggcactcgaatgcatccatgtctattcgctgatccatgacgacctgccggcgatggacgatgacgacatgcgccgcggcaagcccaccgtgcacaaggcgttcgacgaggcgaccgcgatcctcgccggcgactgcctccacgatctcgctttcgagctgctcgcgcatgaggcgacgcatgccgacccgttcgtccgtgtcgaactgatttccgaactggcccgttcctcgggccccgccggcatggccggcggccagatgatggatctggaggccgagaaggccagcttcgatctcgccaccgtcacccggctgcaggcgctgaagacgggcgcgctgatcagttgcgcggtcgaatgcagcgcgatcctcggccgcgtgcagcacgccggccgcacgggcctgcgcggctatacgcggaacatcggcctcgccttccagatcgtcgncgccattctc

SEQ ID NO: 38980 - DNA, 687 bp, Xanthomonas campestris
cagctgccgttcccggcgatcagggtcaacgacagcgtcaccaagtcgaagttcgacaacctctatggctgcaaggaatcgctggtcgacgctatccgtcgcgccggcgacgtgatgctcgccggcaaggttgcgtgcgtcgccggcttcggtgacgtgggcaagggctcggcccagagcttgcgcaacggcggcgcccgcatgatggtcaccgaaatcgatccgatctgcgcactgcaggcggcgatggaaggcttcgaggtcgtcacgatggacgaggccgtgaagcgcgccgacatcttcgtgaccgcgaccggcaacgccgacgtgatcaccgccgatcacatgaaggcgatgaagccgatgtcgatcgtgtgcaacatcggacacttcgacagcgagatccagatcgccgcgctgtcgaactacaagtggaccgaagtgaagcccggcaccgacctggtcgagttcccggacggcaagcagatcatcatcctcgccaagggccgcctggtgaatatgggctgagccaccggccaccccagcttcgtgatgtcggccagctttaccaaccaaacactggcgcatatcgagctgtggacccgcggcgagcactacaaaaacgaagtctacgtcctgccgaagcacctcgacgagaaggtcacggcgctgcacctcgaaaagctg

SEQ ID NO: 38981 - DNA, 2466 bp, Xanthomonas campestris
ccaacgccttccgcccgcaccgtggtgcataaattcggtggcacctcggttgccgatgccgagcgttaccggcatgtggcgcagctgttgctggcacgcgatgagaccgtgcaggtgacggttgtctcggcgatgaaaggcgtgactgatgcgttgatcgagctggccgaactggccgcgcagaatcgtccagagtggcgcgagcgctggcatgaaacgcgtgcgcgccatcgcggtgcggcggtggcgttgctgggcgagcattccgggcccaccgtggagtggctggacgagcgcttcgagcatctgtcacagatccttgcggcgcttgcagtcatcggcgagctgccgcgcgaagtgcttgatcgcgtgcaggggctgggtgaggtgtattccgcgcagctgctcggcgaccacttccgtgcactgggcgaagactgcgcagtgctggatgcacgcgatgtgctggtggtcaatcgtggcgagctgggcgtggatgtggactgggcggtgagcgcgcagcggctggacacctggcggcaggcgcatccgcagacgcgggtggtggtcaccgggtttgtcgcgcgcgatcgcggcgaccgcatcaccacgctggggcgtaacggcagcgattattcgggcgcgatcttcgcggccttgttcgatgctcacgagctgcacatctggaccgacgtggatggggtgctctcggccgatccgcgcgtggtgcccgaggcggtgcagctggaaaccctgagttacgacgaagcctgcgagctagcctatttcggcgcgaaggtcgtgcatccgcagaccatgtcgccggcgatcgagcgcggtttgccgatcatcatccgcaatacgttccaacccgaacatccgggcacgcgcatcaccgccagcagtgcggtgagcgggccgatcaaggggctgacgctcagcccggatctggcggtactgaatctggaaggcaccggcctgatcggtgtgccggggacggccgagcgtgtgttcgcggcgctgcgcacggcgcaggtgtcggtggtgatgatctcgcaaggctcgtcggaacattcgatctgctgcgtggtcaagcagcatgaatccgagcgtgcgcgcaatgcgctgctgcaggcatttgcgcacgagatcacggttggccaggtgcagcgcgtgcagttgaccaccggcatcagcgtgctggcggcggtgggcgatggcatggccgggcaacccggtgtggcggcgcggctgttcgagtcgctgggccgcgcgcaggtcaatatcctggcgattgcgcagggctcttcggagcgcaacatctcggtggcgatcgatgcggcgcatgccaccaaggccttgcgcgcggcgcatgccggcttctggttgtcgccacagacgttctcggtgggtgtcatcgggccgggcaatgtgggtgcggcgttgctggatcagctgcgtaccgcgcagccgcaactgctcggcaaggccaacctggatctgcgcctgcgtggcgtggtgtcgcgcgggcgcatgttgctggaagagcgcagcgtgaccggcgattggcgcgatgcatttgcagcggcgtctacgcccaccgatctggagcgcttcaccgcgcatctgctctccgcgcacctgccgcatacggtgatcatcgattgcagcggcagtgcggaagtggccgaccgctatgcgggctggctggcagccggcatccatgtggtgacgccgaacaaacaggccggctccgggccgttggcgcgctatgaggcgatccgtgccgccgccgatgccagcggtgcgcgcttccgctacgaggccacggtcggcgccggcctgccggtgatcaccacgctgcgcgacctggtcgataccggcgatgcagtgacctcgatcgaaggcattttctccggcacgctggcgtggctgttcaataaatacgacggcagcgtgccgttctccgagctggtgacgcaggcgcgcggcatgggctacaccgagccagacccgcgcgatgacctgtccggcgtggatgtggcgcgcaagttggtgatcctggcgcgcgaggcggggcgggcgatcagcctggacgatgtcagcgtggaaagcctggtgcccgaggcgttgcgccaggccagcgtggatgacttcatggcacagctgcagacagtggacgccggctttgcgcagcggctggccgacgcgcatgcgcgcggcaacgtgctgcgctatgtcgcgcaactgccgccagatcgcgcgcccagcgtgggcctggtggaattgcctgcgcaccatgcgttcgccaatcttcgcctgaccgataacgtggtgcagttcaccacgcgccgctactgcgagaacccattggtggtgcaaggcccgggcgcagggccggaagtgaccgcggccggcgtgtttgccgatctgctgcgcgtggcggcaggcgagggggcgcgcttg

SEQ ID NO: 38982 - DNA, 1419 bp, Xanthomonas campestris
atgtccagtgtctccattgacggcgcccccgatgccggcgagaacacccgtttcatcatcctgatcagctgcgtggccacgatcggcggctttctgttcggcttcgacagtggcgtgatcaatggcaccgtcgacgggctcaagcagaccttccagtccagtgccttctttactgggttagaagtagcctcaatgttgatcggctgcgccattggcgccttctttgccggtagccttgccgaccgctggggccgccgcgcggtcctgattatttctgcggcactgtttctggtctcggcgatcgccgctggcgccgcgcacaactcctggttttttattttcgctcgcatgatgggcggacttgcggtgggcgcagccagcgtcatctcgccggcctacatcgccgaggtcgcctccgcgcgctatcgcggccggctcgccaccatgcagcagatcgccatcatcagcgggctgttctgcgcgttcttgagcaactacctgctggccaatgccgccggtgcgtccaccgagccgttgtgggcagggcaggctgcctggcgctggatgttctggatgcaggccatcccgtcgctgttgttcctgctgctgttgctggtcatccccgaaagcccgcgctacctggtggtcaagggccgtcgcgagcaggcgctggtggtgctcaagcggctgtacggtaacgcggccgcacagaccaaactgggcgaaatctccgcctcgatgtcggccgaccagcacaagcccaagttctccgacctgatcagcaagaccaccggcaagatccgcccgatcgtatggattggcgtcggcctggcggtgttccagcagctggtcggcatcaacgtggtgttttattacggcgcggtgctgtggcaggcagtgggcttctccgaacaggacgccttgctgatcaacgtgctctccggcggcctcagcattggtgcctgcctggtcacggtgatgctggtcgacaagatcggccgcaagccgttgctgtggatcggctcggccggtatggcggtatcgctggcactggtgacctacgccttcgccaccgcctcgctggatcccaacggcaagctcgcgatgtccgatgccatgggcatgctcgcgctggttgccgccaacgtctacgtggtgttcttcaacgcctcgtggggcccggtgatgtgggtgatgctgggcgagatgtttcccaaccagatccgcggttcgggcctggccattgccggcgctgcacagtggacttccaacttcgccatcaccgtcagcttcccgatcctgctcggcagcatcggtcttgccggcgcctacggcatctacacggttgccgccttcatctcggtgttcttcgtgctcaagtacgtctacgagacgaagggcaaggagctggagcagatg

SEQ ID NO: 38983 - DNA, 1392 bp, Xanthomonas campestris
tttgcagacctcggcctctcagatgctgtgatgaaggcggttgccgccgtcggctacgagaccccttcgccgatccaggccgccaccatcccggcgctgctggccggtcgcgacgtgctcggccaggcccagaccggtaccggcaagaccgccgcgttcgcgctgccggtgctgtccaatgccgacctgaaccaggtcaagccgcaggcgctggtgctggcgccgacgcgcgagctggccatccaggtggccgaagccttccagaaatatgccgaagccatccccggtttccgcgtgctgccggtgtacggcggccagccgtatgcccagcagctcagcgcgctcaagcgcggcgtgcacgtggtggtgggcaccccgggccgggtgatcgatcacctggaccgcggcaccctggacctgtcgcagctgaagacgctggtgctggacgaagccgacgaaatgctgcgcatgggcttcatcgacgacgtcgaagcggtgctgaagaagctgccggaaaagcgccaggtggcgctgttctccgcgaccatgccgccggcgatccgccgcattgcgcagacctatctgaaggacccggccgaagtcaccatcgcggccaagaccaccacctcggccaacatccgccagcgctattggtgggtgagcggcctgcacaagctggatgcgctgacccgcatcctggaagtcgagccgttcgacggcatgatcattttcgcgcgcaccaaggccgctaccgaagagctggcgcaaaagctgcaggcgcgcggtctggccgcggccgccatcaatggcgacatgcagcaggccgcccgtgaaaagaccattgcccagctcaaggacggcaagctcgacatcctggtcgccaccgacgtggccgcgcgcggcctggacgtggaacgcgtcagccacgtgctgaactatgacattccgtacgacaccgaaagctacgtgcaccgcatcggccgcaccggccgtgccggccgcaacggcgacgcgatcctgttcgtcaccccgcgcgagaagggcatgctgcgcgcgatcgagcgcgccacccgtcagccgatcgaagagatgcagctgccgagcgtggacgcggtcaacgacacccgcgtggcgcgtttcatgacccgcatcaccgagaccctggccggcggtcagatcgagatgtatcgcgatctgctgcagcgctacgagagcgagaacaacgtgccggcgatcgacatcgctgcggcaatggccaagttgctgcagggcgacgccccgttcctgctgactccgccggtgcgtggcgcgcgcgaagacttcgcaccgcgtgagcgcaccgaccgcgccgaccgtggcgagcgcccgcgcttcgagcccaagttcgagcgt

SEQ ID NO: 38984 - DNA, 1483 bp, Xanthomonas campestris
atgtctgtccttgccccgctcgccccgctgcgtgcccacgccggccgccgcctgaccgccggccttgacgatgccaccatcgaacgcctggccaccgaccaccccaccctgcgccaggccatcgaggctgccggcagcgaatacgcgctggtgcaggcggaggtcgccgacctgctggacctggacgaagacgcgcagatcagcgcggtgcaggacggcttcatcaatttctatgccgacgatgcggtgaccccgtacgtggccctggccgcgcgcggcccatgggtgatcacgctcaagggcgcggtgctgtacgacgccggcggctacggcatgctcggtttcggccatacgcccgaggcggtgctcgacgccatggcgcgcccgcaggtgatggccaacgtgatgacgcccagcctggcgcagcgcaagctcgaccgcgccctgcgcgcggagatcggccacacccgcggcggctgcccgttcgcgcgcttcatgtgcctcaactccggctccgaagcggtgggcctggccgcgcgcatcgtcgacaccaacgccaagctgcacaccgatccgggtgcgcgccacgccggcgccaccatcaagcgcctggtggtcaagggcagcttccacggccgcaccgatcgccccgggctgtattccgattccagccgcaagacctacagcaagtacctggccagctaccgcgacgaagactcggtgattgcgattgcgccgtatgacatcgcggcactgcagcacgcctttgacgaggccgcgcgcaaaccactggttcatcgaggcggtgttcctggagccggtgatgggcaaagacgacccggaccgtgcgctgccggcggagttctacgccgctgcgcgcacgctgacccgcaaccacggcagcctgctgctggtggattcgatccaggccggcctgcgtgcgcacggtgtgctgtcggtggtggattaccccggtttcgagcagctcgatccgccggacctggagacctattccaaggcgctcaatgccgcgcaatatccgctctcggtgctcgcggtgaccgagcaggccgcgcaggtgtaccgcaagggcacctacggcaacaccatgaccaccaacccgcgcgcgctggatgtggcttgcgccacgctggcgctgttcaccccgcagatccgcgacaacatccgcctgcgcggtgcacaggcgctgcgcaagctggaagcgctgcaggccgagctcggcggcctgatcaccaaggtgcagggcaccggcttgctgttctcctgcgaactggcaccgcagtacaagtgctacggcgccggctccaccgaggagtggctgcgccaccacggcgtcaacgtgatccacggcggcgagaattcgctgcgcttcaccccgcacttcggcatggacgaagccgaactcgacctgctggtgggcctgatcgccaaagcgctcaaggaaggcccgcggcaggcgcag

SEQ ID NO: 38985 - DNA, 1218 bp, Xanthomonas campestris
atagctcccatgtcggcccagcccatcagtgactttcatgcgtacccggatgccgccggccatttcggcaagtttggcgggcgcttcgtcgcggaaaccttgatcgcgcccctgcaggaactgtctgccgcctacgatctggcgcgccaggatccggccttcattgccgagtacgacaaggatctcaaacattacgtcggccgccccagcccgatctaccacgccgagcggctgagccgcgaagtgggcggggcgcagatcctgctcaagcgcgaagacctgaaccacaccggcgcgcacaagatcaacaacaccatcggccaggcgctgctggccagccgcatgggcaagacccgcatcattgccgagaccggcgccggccagcatggcgtggccagtgccaccgtcgcggcgcggctgggcctggaatgcgtggtctacatgggcgcgaccgacatcgaacggcagaagatcaacgtctaccgcatgcagttgctcggtgcgaaggtcatcccagtcacctcgggctcggccacgctcaaggacgcgctgaatgaagcgatgcgcgactgggtcagcaacgtgcaggacaccttctacatcatcggcaccgtcgccggcccggatccgtatccgcgcatggtgcgcgatttcaacgccatcgtcggccgcgaagcgcgtgcgcagatgctggaagactacggccgcctgccggatgcgatcagcgcctgcgtgggcggcggcagcaacgccatcggtttgttccatgcgttcttgaacgaccccggcgtcaagatctacggcgccgaagcggcgggtgatggcattgccagcggccgccatgcggcatcgatcgccgccgggcgccccggcgtgctgcacggcaatcgcacgtatgtgatctgcgatgacgacggccagatcatcgagacccattcggtctcggcgggcctggactacccaggcgtggggccggagcatgccttcctctccgacagcggccgtgccgtgtaccagggcatcaccgacgacgaagcgctggccgcgttccacttgctggcgcataccgaaggcatcctggccgcgctggaatccagccatgcggtcgcgcagtcgatcaagcttgcgcgcgaaatgcccaaggacgcgctggtgctgtgcaacctgtccggccgtggcgacaaggacgtgcacaccatcgccgcacgcgaaggcatg

SEQ ID NO: 38986 - DNA, 531 bp, Xanthomonas campestris
atgaaccccgctcccaatctcgtgatgatcggcccgatgggcgccggtaaaagctgcatcggccgccgcctggccgagcgcttcgggctggatttcgtggatgtggaccaggccatcgtcgagcaggtcggcagcagcatccccgcgatcttcgaacagcacggcgaagcgcgctttcgccagcacgaagccgaggccctgcacggcctgctcgcgcagagcaacaaactggtctccaccggcggcggcgcgatcctggatgcgggcaatcgccagcgcatccgcgagcgcggcttcgtggtgtacctgcatgtgagcgtgccggcccagctcacccggctggcgcgcgaccgcaatcgcccgctgctgcagcgcccggaccgcgaacaggtgctgcacggcatggccgcgctgcgcaccccgctgtaccaggaagtggccgacctcaccctggaaaccgatcacctttcccccgccgaggccaccgcgcagctggtgctgcgcctggccgcgcaatggcgcatgtcgagt

SEQ ID NO: 38987 - DNA, 1110 bp, Xanthomonas campestris
atgactcttcccccctccttgcgcagcgtcgaagtcgacggcgcgcagccgtacaccatctccattgcgccgggcctgctggccgacggcgcgcgcctggcccgccacgtacgcggccgccacgtgctgctgctcagcgacacccaggtggcgccgcactatgccgccggcgtgcgcgctgcactgttgcaggcgcggccggacctgcagcttggcgaactggtcatcgccgccggcgaagcctccaaaaccctggacaacttctccctggcgatcaccgcactggccgaactgggcgccacccgcgatgcctgcgtgttcgcgctcggcggtggcgtggtcggcgatctggccggctttgctgccgcctgctggatgcgcggggtggattgcgtgcaactgcccaccagcctgctggcgatggtggattcctcggtcggtggcaagaccgcggtggacatcccgcagggcaagaacctggtgggggcattccacccgccacgcgcggtgattgccgataccgacaccttgcgcaccctgcccacgcgcgagctgcgcgctggcctggcggaggtaatcaagtacggcgccatcggcgacccgttgttcttccagtggctgcatgccgaacgccgcgcgctgctggacggcgacccggccgcgctggcgcaggcgattgcacgcagttgcgagcacaaggccgacatcgtggcgcgcgacccgctggaaaaaggcgagcgcgccctgctcaacctgggccacaccttcggccacgccatcgagacagaacagggctacggcgcgccgggtaacgacaacctcaaccatggcgaagcggtggcagtgggcatggtgctggcagcgcggctctcggccgcactgggcatggccgacgcccaggacaccgaggcactgcgcaccctgctgcatgaattcggcctgcccacccagatcccgaccggcctggcaccggaagccctgctcggccgcatgcggctggacaagaaaaacatcgccggccgcctgcgcctggtgctgtggcgcgggatcggcaaggccgaagtcgtccccgacgtggacgaagctgcggtgctggagattctggccgac

SEQ ID NO: 38988 - DNA, 1458 bp, Xanthomonas campestris
aagtctctgttgagggtcaaaccgatcgagcccgccggacgtgtggatgcgggcgaaccggtcgaaggcagcctgcagggcgaagcgacgctgcaacggaccctcaccgccaagcacctgatcatgctcggcatcggcgcggtgatcggcgcaggcatctttgtgatgaccggccaggcggctgccaaccatgctgggccagcggtgatgctgtcgtttgtcttcgcgggtatcgcctgcacgtttgccggcctgtgttacgccgagttcgcggcaatgatgccggtctccggaagtgcttactcgtattcctacgcgacgcttggagaaggcatcgcctggttcattggctggtgcctggtgctggaatatctgttcgcagggtcaagcgtcgcggtggcgtggtctgcctatctgatcagcttcatcaccggcacgctgggtcttccgttccccacagagctgaccaacgccccgcttgcctggatcaatggcgaattcgtggcgtctggcaacatcctcaacctgcctgccgtgctcatcgtggctgcggtgagtgggttgtgctatgtcggcattacccagtcggccttcatcaacgcaattgtcgtggcgatcaagatcgcagtgatctgtctgtttgttggcttcggcgcggcatatatcgacccggccaactggcatcctttcattcccgaaaataccgccccaggcgtatttggctggagcggcgtattccgcgctgcctcgatcgtgttctttgcctacattggcttcgatgcggtatcgacctcggctggagaaaccaaggacccgcaacgcaacatgccgatcggcatcctcggctcgctggcggtgtgcaccatcatctacatcatcgtgtgtgcagtgctgacaggtttgatgccatatacccagcttggcactgccaagccggtggccactgcgctggaagcgcacccgcaactgacttggctcaagactgcggtggagatcggcgcgatcgccggcctgtcctcggtggtgctggtgatgctgatggcacagccgcgcatcttctacaccatggccaaggatgggttgatgcccaaactgttcggcaaggtgcacccgaaattccacacgccatatgtcggcaccgtgatcgtgggggtggtcgccgcatcactggcggggttgatcccgctcagcgtgctgggtgaactggtgtcgatgggcaccctgctcgccttcgccaccgtgtgcgccggcgtaatggtgctgcgtttcaccaagcccgagctggagcgtccgttccgtgtaccgctggcaatgatagtttgtccgttgggtacgcttgcgtgcctggccctgttcttccaggccttccaggaacactggaaggtgttcgtgggctggaccgtgatcggcctggtcatctatttcggctacggcatccaccatagccgtctggctcgc

SEQ ID NO: 38989 - DNA, 1416 bp, Xanthomonas campestris
atgttcaaacaactttgggccaccaaacacccgcacgccagccatgaggcggccgacgggctgggcctgcaacgcgcgctcggtccctgggggctgaccgccctgggcatcggcgcggtgatcggcggcggcatcttcgtgatcaccggccaggccgcggccgaccatgccggcccggcgatcgtgctgtcgttcgtgctcgcggcgatctgctgcgcgttctgcgccatggcctacgccgaatttgcggcgatggtgccagtctccggcagcgcctacacctatacctacgccaccttcggcgagctggcggcctggttcatcggctggatgctggtgctggaatacggcgtctctgcctcggcggtcgcggtcagctggaccggatatttcctcagtctgctggaacacttcggcatccatttgccggccgccctggtcagcgcaccgctggacggcaagctgcagcgcaccggcgcgatcgccaacctgcccgccgccggcatcgtgttgttgctgacctggctgtgctatgtcggcatccgcaagtcgtcggcgatgaacatggcgatggtgatcctcaaaaccgggctgatcatcctggtcattgcggcgggctggaagtacgtggacccggccaactggcatcccttcatccccgccaacgaagcaccgggcaagtacggcatggaaggtgtgctgcgtggcgcggcgatggtgttcttcgcctacatcggcttcgaggcggtgtcggtggcggcgcaggaatcgcaccgtccgcaacgcgatctgccgatcggcatgatgctgtcgctggtgatctgcaccgtgctctacatcgccatggccgcggtgatgaccggcctggtgccgttcacccagctgggcaccgatgagccggtagtgaccgcagtggccgcgcatccgcagctggcctggttgcgcgtggtggtggaagtgggtgcgctgatcgggctgtcgtcggtggtgctggtgatgatcatcgggcagccgcgcatcttcatgatcattgcgcgcgatggcctgctgccggcggtgttcacgcgcatccatcccaagtaccgcacgccgcacatcaacacggtgattaccggcatcggcatcgctctgcttgcggccgtcttcccgctggatgtgctgggtgagctgacttcgatgggcacgttgatcgcctttgctgccgtgtgcgccggtgtattgatcctgcgccgcacccatccggaactgccgcgtccgttccgcatgccggccgcgtggctgatctgcagcgccggtgtactcagctgcctggctttgctgtcggctatgacgctgcacaactggatgctgatggggctatggaccctggtcgggctggtggtctatttcggctacggctatcgccacagtcgtctg

SEQ ID NO: 38990 - DNA, 1719 bp, Xanthomonas campestris
gtgtcgtcctggcagacctatcggcgtctgctggcattcgctaaaccttaccggctgctgttggtggccgcgttgatcgccgcattgatcgaggccgccgggaccaccggcttcctggccttgatgaagccgatcaccgacgagaccttcatttacaagaacgccgaggtcagccgctggctgccggtgcagatcatcctgttgttcgtgatccgcggtgcggccggttacatcaccgacatggcaatgggcaagtctgcgcgcagcatcgcgcgcgatctgcgcgtcaaggtcatgtccaagtatctgcgcctgccgggctcgcgcttcgactccgaaccggtgccgtcgatgctgatccgcctcggctcggactcggatcaggtcgcgcaggccgccgtggatgccgtgaaggtgatgatccagcagtcgctgcaggtgatcggcgcgttggcgttgatgctgtggcatagctggcaggtcacgctcaccattctggtgctggcgccggtgctggcttgggtgatggacaaggtggcgcgccgttatcggcggatcagtcacagcatccaggagagtggcgcgcatctgttgcaggccgccgaccagaccttgtccagccatcaggaggtcaagatctacggcgcgcagcagagcgagatggagcgctactcgggcctggccgaccgcaatctcaggctggccatgaaagtcgaatccacgcgcggcatttccaccgccaccgtgcagatgatcggcgcgatcggtctgtccgcgctgctgttcgtggcgggcgcgcaggcattggccgggcgcctgacggccggcgattttgtggtgttgatgacctcgatgctgacgatcattccgggcctcaagcagctcaccaatgtgcagaacatggtgcagcgcggcctggcgtctgccgaacgcctgttctcggtgctggacagccctgacgagcccgaccagggccaggtgccgttgacgcgcgccaagggtttgatcgaattccgcgatgtcaccgcgcgctatccggggcaggccaatcctgcgttggccgatgtcagcttcgtggcacagccgggcaccgtcacggcgatcgtcggccgctccggcagcggcaaatccagcctgatcaagctgattccacgcttttatgaggccgagtccgggcagatcctgctcgacggtcacccggtgcaggcctatgcattggccgatctgcgccgccagattgccctggttggccaacaggtgatgctgttcgacggcagcattgccgagaacgtggcatacggcgaaatgcgccagtgcgatgccgggcaactggagcgcgccatccagggtgcgaatgcgatggagtttgtcgcgcagctgccggagggcctgcagtcgcacgtgggtaccaagggcgggcgcctgtccggcggccagcgccagcgtctggcgatcgcacgcgcgatgctcaaggacgcgccgatcctgatcctggacgaggcgaccgccgcactcgataacgaatccgagcggctggtgcaggacgccttgcacaagttgatgcccgaccgcaccaccttggtgatcgcgcaccggctgtcgacgatcgagcatgccgaccaggtgctggtgatggaccagggccgcatcgtcgagcgcggtacgcatcaggaactgctcgcgctgggcgggctgtactcgcacctgcacggcatgcag

SEQ ID NO: 38991 - DNA, 3007 bp, Xanthomonas campestris
ctggtcagccattccagcgaagcgatcgtggccgaaacaccagacggtgagatcacgcactggaacccggcagccgaagccatgttcgggtatccggccgatgtggcaatcggccaggatctgaccacgctgctgtcgccgcaaccctatgccatgccgcagatcgaccaggacgaggcaccgccggttgcggccctctccgccgcgcagaccatgcgccaccgcgacgggcatcaggtgttcgtgctggcgagcaaggcgccgatcatcgagcacgacaatgcggtcagcggccactcgcatttcttccgcgacatttccgagcgtgtgcgctcgcatcagcgcattgtcgatctcaacgcctcgctcgagcatcaggtcgccgaacgcaccagcgagctggtgcagttctcggtgctgcaacgcgcgatcctggcgcatgccggttacgccatcatcgccaccgattccagcggctttgtcaccctgttcaatccggccgcagaaaaactgcttggctacagcgccgacgatgtgatcggccggcgcaaggccagccagttcattgaagcggacgaactgcaggagcgcgcattgcggctggccgaacagaccggcacgccggtcgccggcacgctggaagcggtcgctgcgctcaccagcctcggccgcagcgacaccagcgaatggacctatgtcagccaggacggccgtcgcctgccagtgctgctgaccttgagcacgttgcgcgacgacaacgaccaggtgatcgggtacctgggcgtggcggtggacctcaccgagcagaaactgcacgaaaaacagctgcgtctggcaatggacgcggccagaagcgccaaccagtccaagtcggatttcctggccaacatgagccatgaaatccgcacgccgatgaacgccatcctgggcatgctgtacctgctccagcgcagcgagttgccgggcgccgcgcaggacatggtgaccaagatcgaccgctcggcgcgctcgctgctggagatcatcaacgacatcctggacttctccaagatcgaggccgggcgcatcgatctggagcgcgcaccgttcgacctcaatcaattgttcgacaacatcgccgacctgatgcgctcctcgctcagcgccaagccggtggagatgatcgtcgagccgttgccgcgcgaatgccgctggctgctcggcgatgcgctgcgcatcaaccaggtgctggtcaacctggtcggcaatgcgatcaagttcaccgaacaaggcgaagtggtgctgtcggtgcgccgcttccccagtggcgaccccaacaagatcaagctgctgttctcggtacgcgacaccggcatcggcatctccaaggaaaagcagagcctgatcttctcgccgttcctgcaggcggatacctccaccagccgccgctacggcggcagcgggctgggcctcaccatcagccggcgcttgatcgaactgatgggcggcgcgctggaagtggaaagcgtgcccgggcgtggcagcgagttctatttcgtcatcacgctggaaagaaccgatccacccaaggcccagcaggaagccgcgctattgccgcccgaatccatgccgcgcgtgctgattgccgacgaccacgatgcggccttgaacaacctggtgcgcatcgccaccgagctgggctggcgggtggatgcggtggccagcggccaggccgcgatgcaggcgatcgaagacgccaccgaaccgtacgacatcttcctgctggactggcgcatgcccgacatcgacggcgtggcgatcgcgcgccaggtgcgtgcccgcgccacaccgggccggcatccggtgatcgtgatggtcaccgcctacgaacgccggctgctggagcaacaccccgagcagcaggacctggatgcggtgatgaccaagccggtgaccagcgctgcgctgcatcggctggtggaacaattggtcgacgagcgccccaaggcgcgcccgagcacgccaaccttcgtcgcgcgccggctggaaggcgcgcagctgctgctggtggacgacagcgagatcaactgcgaagtggcacagcgcatcctcgaaggcgaaggcgccatggtcaccgtggcccacgacggcgagcaggcggtgaacacgctcaagcgcgcgccggacctgttccacctggtgctgatggatgtgcagatgccggtggtggatggctacgaggccacccgccgcctgcggcagattccgtcgctggccagcctgccggtgatcgcgctgaccgccggcgccttccgcccgcagcaggaaaaagcgctggaagcaggcatgaatggtttcatcgccaagcccttcaacgtggaggaactggtcaccgcaatccggcacttccggcagcccggcagccggcgggtatcctcgctgccgcacgaacgcgcgccggccgcaggcccggagtgggcgcacaccgatccgctgctgctggatgccgcacgcgcgcaaagcctgtggcgcgagcgtgagccttactaacgctacctgctgcaagttgctgtgcgacaactcagacccggctcggaccgacggcgctcatctgcgcaacaacgagctgtacgcgattggcgcactggcacacaagttgcgcggcgccgccggctcgctggccatgcccgccctggccggcgtgtcgggcgatctggaatcgcgtgtggaacagggccatgacctgtccgccgcactgctcgcgctcaaggacaccatggcgcagaccaccgcggccatccacgccttcctgcagaccagccccagcacacaagacaccgggcaaaccggtgccgccttggacgacgacagcgcgctgatcctggaaaacgcgttgcgcagcgatgatgccgacaagatcgaccatgcgctgctgatctgtgccccgcgtctgccaccgccgttgcaggaagacctgcagcgcgccgtggacgacttcgatttccgccgcgccgaagccaccctgcgc

SEQ ID NO: 38992 - DNA, 624 bp, Xanthomonas campestris
atgaagttgaccatccccacgtggctgacactgctgaggatcgtgatgatcccggtgttggtcgtggtgttctacctgccgtacaagtggaccaatttcgcctcggccggtgtgtttgccctggccgcgatcaccgactggctggatggctgggtcgcgcggcgttatcaccagtattcggcgtttggcgcatttctggacccggtggccgacaagctgatggtcgccgtggcgttgttcctcatcgtgcaagggcatcccacgccgtggatggcgttctgggcggcggtcatcgtgggtcgcgaaatcgcggtgtctgcattgcgcgagtggatggccgagatcggccagcgtgccaaggtgcgcgtggcaatgatcggcaaggtcaagaccaccgcacagatggttgcgttgctctgtttgctgtattcggtcacgccggggcagatgcccacgcatgaaatctggctgggcaacctgatcttccaggcggggtactggaccctggcaatcgccgcattgctgacgttgtggtcgggtttccagtatctgcaggccgcatggccaagtttgcgtgccgatgaaaaggccgcgattaccaacaaaccgaaaaaagtcgaaagc

SEQ ID NO: 38993 - DNA, 729 bp, Xanthomonas campestris
cccccacaaccgcaacgcgtgctgatcgccggcggcagccgcgggatcgggctggcgattgcgcaggcctttgtccaaagcggcgcgcaggtttcgctgtgcgcacgcaatcccgaaggcctggcaaatgccgctgcccagctcgcggcggacggagcgccggtgcatacgtttgcctgcgacctggccgacgccgcgcagatcgagcgctatgtgcatgccgctgcgcaggcgtttggcggcctggacgtggtggtcaacaacgcctccggctacgggcacggcaatgacgacgaaagctggcaagccggcctggatgtcgacctgatggccgcggtgcgctgcaaccgcgccgcagtgccgtatctgcgccagagtggcaatgcggtgattctcaacatcagctcgatcaacggccagcgccccaccccgcgcgcgatcgcctattccaccgccaaggccgcgctcaactactacaccaccacgctggccgccgagctggcgcgcgaacgtatccgcgtcaacgcgatcgcacccggctcgatcgaattccccggcgggctgtgggaacaacgcagccgcgacgaaccggcgttgtatgcacgcatccgcgacagcattccgttcggcggcttcgggcaggtgcagcatattgccgacgccgcgctattcctggcctcgccacaggcacgctggatcacagggcaggtgctggcagtggatggcggg

SEQ ID NO: 38994 - DNA, 1029 bp, Xanthomonas campestris
ccacgccagctgctgcgctgcgcgttggtcatgctgtgcatcgccacgatgtccatcgcacaggcgcaaagccccaatcgtctgaaatacgcaggcgtcaacatctccggtgcggagatccagtcgtccaaaaaaccgggcgtgctcaatatcgactaccgctatccaaccgcgtccgagtacaggtacttcgcgggcaagcaaatgaacatcgtgcgcctgccgatcctgtgggagcgcatgcagcccaaagctcaaggtccgctggatcaggcacaactggcattgctgaagcaggcagtggccaacgccaaggccgccaatcaatacctgattatcgatgtgcacaactacgccaagtactacggccagaagattggcagtaagcgggtgccggtgcgcacgttcaccgatctctggcgccgtctggccatcgcgttcaagagcgacaacgccgtgattttcgggctgatgaacgagccgtacgacatctcgccagagagttgggccgccgccgcgcaggcgtccatcgacagcattcgtgccaccggtgccaccaacctgattctggtgcccggtgcattgtggtcgggcgcacacagctggtattccaccgtggccgggcagtccaatgcagtggcgcttgcgaacatccgcgacccattgaatcgctatgcgatcgaagtccatcaatacctggacaccgactccagcggcaccagtgccggttgtgtgagccgcacgatcggtgcggagcgcttgcgcagtttcaccggctggctgcgcgcgcaaggcaagcgcggttttcttggcgaattcggcaccgccaataacgcaacctgcactgcggcgctggacggcatgctcggttatctcgaaaccaaccacgatgtgtggatcggttggacgttctgggcggcaggcgcgtggtggaacaccagctatccgttcaatgtgcagcccgatgcgcaaggccgcgacaagccgcagatgaaaaccttgagcgcacgcgcgcatcgcgtcacccga

SEQ ID NO: 38995 - DNA, 1020 bp, Xanthomonas campestris
tcctgcgcggtgttcttcctgctgctcggtgttctgccgatgggccatgcacaaacgcgtgcactcaagtacgccggcgtcaatttggcgggtgcggaatttgcgtcatcgaaaaaacctggcgtcctcaacaaggactacatgtatcccgccagcaccgattacagctatttcgctgggactggaatgaacgtgattcgcctgccgatcctgtgggaacgtctgcaacctgccgcacgcggcgagctggatccggcgcagctggcactggtgcagcaagcggtggcacgcgccaaggcatcgggcatgtatctggtgctggatatccacaactacagcaagtactacggttataaaatgggtgggccggaagtgccgctcgccacctttgccgatctgtggcggcgcctggcggtgatcttcaacagcgataacgccgtgatcttcgggctgatgaatgagcccaacaacatctctgccagcgaatgggccggtgcagcgcaggcaggcatcgatgcgatccgtgccaccggcgccaacaatctgatcctggtaccgggcgcgctgtggaccggcgcacacagctggcactcgctgaccagcgatgggtattccaatgcaaccgcgttggcatcgatcagcgaccctctcaatcgctatgcgttcgaagtgcatcaatatctggatgccgattccagcggcacctccagtgtctgcgtcagtgaaaccatcggcgccgatcgcctgcgtgcgttcaccgaatggctacgcaccaacaacaagcgtggttttctcggtgagttcggcaccgccaacaacgccgtctgcaataccgcgctgcaaggcatgctggcctacatggaaaactacgccgatgtctggctgggctggacatggtgggcagcgggcgcatggtggaacaccagctacgcctacaacgtgcatccgaacaaggacggcaccgacaagccgcagatggtcatcctctcgccgcaggccgcgcgcgctacacgctgacac

SEQ ID NO: 38996 - DNA, 918 bp, Xanthomonas campestris
gcctcatccgcgcacgccggcttgtccgtgtcgggcacacagctgaaggaatccaatggcaataccttgatcctgcgcggcatcaacctgccgcatgcctggtttgccgatcgcaccgatgccgcgctggcgcagatcgcggccaccggtgccaacagcgtgcgggtggtgctcagttccggccaccgctggaaccgaacgcccgaggccgaggtggcgcgcatcatcgcgcgctgcaaggccctggggttgatcgcggtgctggaggtgcacgacaccaccggctatggcgaagacggcgccgccggcagcctggccaatgccgccagttactggaccagcgtgcgcactgcgctggtgggccaggaagactacgtgatcatcaacatcggcaacgagccgttcggcaatcagctcagtgccagcgaatgggtcaacggccacgccaatgcgatcgccacgctgcgtggcgccgggctcacgcatgcgctgatggtggatgcgcccaattggggccaggactggcagttctacatgcgcgacaacgcggcggcgttgctggcgcgcgacagccgccgcaacctgattttcagcgtgcacatgtacgaggtattcggcagcgacgcggtggtggacagctacctgcgcaccttccgcagcaacaatcttgcgctggtggtgggcgagttcggcgccgatcatcgcggcgcgcccgtggacgaggcggcgatcatgcgccgcgcgcgcgagtacggcgtgggctatctcggctggtcgtggtcgggcaacgacagcagcacgcagtcgctggatatcgtgctcggttgggatcctgcgcgtttgagcagttggggacgcagcctgattcagggcccggacggcattgccgcgacctcgcgccgtgcgcgggtgttcggt

SEQ ID NO: 38997 - DNA, 1902 bp, Xanthomonas campestris
  unsure (1)..(1902): unsure at all n locations
atgaccgttgataccgacaagcagacgctgggcttccagaccgaggtcaagcagctgctgcagctgatgatccactcgctgtattccaacaaggaaatcttcctgcgcgagctggtgtccaatgccgccgacgccgccgacaagctgcgcttcgaagccttggtcaagcccgacctgctggaaggcagcggcgagctgcgcatccgcgtcgacttcgacaaggacgcgcgcaccgtcaccatcgacgacaatggcatcggcatgagccgcgaggacgcggtgtcccacctgggcaccatcgccaagtccggcaccgccgacttcctcaagcatctgagcggcgaccagaaaaaggacgccaacctcattggccagttcggcgtaggcttctacagcgccttcatcgttgccgaccaggtcgacgtgtattcgcgccgcgccggcctgcccgccagcgacggcgtgcattggtcctcgcgcggtgagggcgagttcgaagtcgccagcgtcgacaagcccgagcgcggcacccgcatcgtgttgcagctgaaggaaggcgaagagtcctttgccgatggctggaccctgcgcaacatcctcaagaagtattccgatcacatcggcctgccgatcgagatgcgcaaggagcactacggcgaagacgccgacaaacccgccgaacccgagtgggaagtggtcaaccgcgccagcgcgctgtggacccgccccaagtccgagatcaaggacgaggagtaccaggagttctacaagcacgttgcgcacgatgccggtaatccgctggcgtggagccataacaaggtcgaaggcaagctggattacacctcgctgctgttcgtgcccggccgcgcnccgttcgacctgtaccaccgcgattcggccaagggcctgaagctgtacgtgcagcgcgttttcatcatggaccaggccgaacagttcctgccgctgtatctgcgtttcatcaagggcgtggtggattcggccgacctgtcgctcaacgtctcgcgcgagatcctgcagtctggcccggtggtggactcgatgaagtccgcgctgaccaagcgtgcgctggacatgctggaaaaactggccaaggacaagccggatgactacgccaccttctggcgcaacttcggccaggcgctgaaggaaggccccgccgaggactacgccaaccgcgaaaaggtcgccggcctgctgcgtttctcgtccacccacgacaccaccggcgcgcaaagcgtggcgctggccgattacgtgggccgcatgaccgagggtcaggacaagctgtactacctcaccggcgagagctacgcgcagatcaaggacagcccgcacctggaggtgttccgcaagaagggcatcgaagtgctgctgctcaccgaccgcatcgacgaatggctgatgagctacctcaccgaattcgacggcaagtcgttcgtggacgtggcacgcggcgacctcgacctgggcaagctggattcggaagaagacaagaaggcgcaggaagaagtggccaaatccaaggagggcctggcctcgcgcatcaaggcagcgctcggcgacgacgtggccgaagtacgtgtctcgcaccgcctgaccgactcgcccgcaattctggcgatcggccaaggcgacctgggcctgcagatgcgtcagctgctcgaagccagcggccaggccgtaccggaaaccaagccagtgttcgaattcaacccggcccacccgctgatcgaaaagctggatgcggaacaggatatggaccggtttggtgacctgagccgggtgctgttcgaccaggctgcgctggcggcgggcgacagcctcaaggacccggccgggtatgtgcggcggttgaataagttgttgttggagttgtcggct

SEQ ID NO: 38998 - DNA, 663 bp, Xanthomonas campestris
gcaacctcgctgatcccggtcgattggctggaacaggactcctacgactggtacgcgcgccaccacgccgcactggccaccgcgcgcagcctcaagccggaggtggtgatgattggtgattcgatcacgcatttctgggccggcccgccgcaggccacgcgcgtcagcgggcctgcgtcctgggcttggctgtatggcaagcggccggtgttgaatctgggctttggctgggaccgcacccaaaacgtgctgtggcgcattcgccagggcgaactcgatgggctcgatccgcgctgggtggtgctgcatatcggcaccaacaatctcaccggcaccgcgcaatcgcgcgccagtacacccgccgagaccgcgcagggcgtggaagcggtggttgccgaagtgcgccagcgcctgcccaacagcaagttgatcctgatggcgatcatgccccgcggccatcgccccgacagcccgcagcgagcgccgatcgccgaaaccaaccgcctgcttgctgcgcgctttgccggtgacccggcggtgcggctggtggatatcgggccgcaaatgctgcaacccgacggcgccttgcccgaggcgctgatgcccgacggtacccaccccagcgaggccggctataggatctgggcacaggcgctgcgcgcg

SEQ ID NO: 38999 - DNA, 728 bp, Xanthomonas campestris
cagacgccgccaccgtcgatcgtgccgaccgaccggctgcaggagccttggtgggcgcaacggcatgcgcgggtgctggagcaggcgaagcaacacgccgacacgccgctgctgctgatcggcgattcgatcacccagaactacgacaaggcccaggcgcccgacgagaatttccagcccacctggcagaccttttacggcagccgtggtgcgctcaacctaggcttcagcggcgatggcaccgagcacgtgctttggcgcctggccaacggtgaagtggatggcctgcatcccaaggtggccgtggtgttgatcggcaccaacaacaccgggcacctgcagcacaccgccgagcagacccagctgggcatcgatgcggtggtcgcggcgatcgaacagaagctgccacgcacgcacatcctgttgctgggtgtgctgccaagtgcggtctcggccgaaaagtcgcgccgcgacgcgcaggtcaaccaggccctggcgatgcgctatggcgataatccgcgcgtgacctacctggatgtggggtcgatcttcctgcgcgacggcgcgctgcgcaccgagctgttctacgatacccgcttccgcccgccggccggtgccctgcatccggacacgcagggccagcgcatgctggcggaagccatcgagccgaccctggcaaagctgctgggcgagccaccggtcaagctggtcgccgagctgagccgcgg

SEQ ID NO: 39000 - DNA, 1128 bp, Xanthomonas campestris
gtggatttcagctttaccgaagaacaactgatgatccaggacgtggcccgccggatcgcgcaggaaaagatcgcccccagcgccgagcagttcgaccgcagcggcgagtttccgctggagaacatccagttgctgggcgagaacggcctgatgggcatcgaggtgccggccgagtacggcggcgccggcatggacccgatcagctatgcgctggcgatgatcgagattgccgccgccgatggcgcgcactccaccatcatgtcggtcaacaattcgctgttctgcaccggcatcctgaagaacggcaccgaggcgcagaagcagctgtacgtgcgcgcaatcgccgaaggcacgcacatcggcgcatttgcgctgaccgaaccgcagtccggctcggatgcctcggccatgcgttgccgtgcgatcaagcagggcgatggcagcttcgtcatcaatggcaagaagagctggatcacctccggcccggtggccaagtacatcgtgttgttcgcggtgaccgagccggacaagggctcgcgcggcattactgctttcatggttgatacggcgcgcgccggcttccatcgcggcaagaccgagcccaagctcggcatccgcgcctcggccacctgcgagattgagttcgccgattacgtagcgcagccggacgaggtgctgggcgcggaaggcgagggcttcaagactgcgatgagcgtgctcgatgcaggccggatcggcattgcctcgcaggcagtgggcgttgcgcgcgcggcctatgaggccacgctggcctatgtgaaggagcgcaaggcgtttggcgcggcgatcggcaccttccagatgacccaggccaagatcgccgacatgaagtgcaagctcgacgcagccttgctgctcaccttgcgcgcggcctggctcaaggggcagggccagaagttcggcaccgaagcagcggtggccaagctcatcgcctcggaagcggcgatgtggatcacccatcaggccgtgcaaatccacggcggcatgggctattccaaggaaatgccgctggagcgctacttccgcgatgccaagatcaccgagatctacgaaggcacctcggagattcaacgcctggtgatcgcgcgg

SEQ ID NO: 39001 - DNA, 933 bp, Xanthomonas campestris
caactgcgtgacctgtccgttgtcgttgccgatacgggcgactacgacgcgatcaagcggctcaagccggtcgattgcaccaccaatcccaccctggtcaagaaagccctggatctgccggtgtatgccgacctgatcgagcgcgagctggcctggggccgtgcgcacggtggcgaagaccgcaacagcaccatcaacgaagtagctgatcgcctgaccgtcggcgtgggcaccatgttgtcggaactggtacccggccgcgtgtccaccgaagtggacgcggacctggcgcacgacacccaggccaccatcgccaaggcacgcaagttcatcgcgatgtatgccgagcgtggcgtgtccaaggacaagatcctgatcaagatcgccgccacctgggaaggcatcgaagccgcacgccaactgcagcaggaaggcatcgactgcaacctgacgctgatcttcaaccgctcgcaggcgctggcctgtgccgaggccggtgtgttcctgatctcgccgtttgtcggccgcatcctggatttctttgtcgccaagggccagaccccggccagcatcgacgaagatccgggcgtggtgttcgtgcgcggtgtctacgacgagttcaagcgccgcggctcctccactgtggtcatgggcgcctcgttccgctccactgcgcagatcgaggcgctggccggctgcgaccgcctgaccatctcgccggacctgctggagaagctcgacgccgaccacggcgacctgccgcgcaaactgtcgccattgaatgcggacaacgcggccatcacgccgatcaacagcgacagcttcgccaccgacttggccgctgacgatatggccaccgagaagctggccagcggcatcgacaccttcgccaaggacctggaggcgctgcgcaagaccatcgccgacaagctc

SEQ ID NO: 39002 - DNA, 612 bp, Xanthomonas campestris
agtgaaactacggccgcgggcgatgcgctcgatgcgctggactggaacaagggcgacggcttgctgcctgtgatcgtgcaggacgccgacaacctgcgcgtgctgatgctgggctacatgaacgccgaggcgcttgcggtgacgcgtgcgcgtggcgaggtcacttttttcagccgcagcaagcagcgcctctggaccaaaggcgagagctcgggaaatgtgctgcgcgtggtcgcgatcgaaaccgattgcgatgcggacaccttgctggtgcaggcacgtccgcacggcccgacctgccacctgggccgcaccagttgcttccccaccgcgcccagccagttcctcggcagcctggacgccttgatcgccgagcgcgagcacgagcgcccgcatggcagctacaccaccaagctgtttgagcaaggcatccgccgcattgcgcagaaggtgggcgaggagggcgtggaaaccgcgctggccggggtggtgcagggcgatgccgagttgctgggcgaatccgctgacctgctgtaccacctgatcgtgctgctgcgcgcacgcgggctgggcctgggcgatgcagtggcgctgctggaatcgcggcacaag

SEQ ID NO: 39003 - DNA, 768 bp, Xanthomonas campestris
atgctgagccgtcgcatcattccctgcctggacgtgcgcgatggccgcgtggtcaagggcgtcaagttccgcgaccacatcgacatgggcgacatcgtcgagttggcgatgcgctaccgcgaccagggcgcggacgagttagtgttctacgacattggcgccagcccggaagggcgttcggtggactatgcgtgggtcgagcgcgttgcgcgcctgatcgacatcccgttctgcgtggccggcggcatccgcgatgtagaaaccgcgcgtgcggtgctgcatgccggcgccgacaagatctccatcaactcgccggcattggggcggccgcagctgatctccgagctggccgacgcctttggcgtgcaatgcgtggtggtcggcatcgactcgatccgcgaagaggacgggcagtggcgcgtccgccgctacaccggcgacccaagcaagacccaggcgctgccgatgcgcacgctggactgggtggccgaggcgcagcgactgggtgcgggcgagatcgtgctcaattgcatggataacgacggggtccggcatggctacgatattgcgcagctgcgccaggtgcgcgcgttgtgccgggtaccgctgattgcctccggcggcgctggcgagatgcagcacttcgccgacgtgttcgaccaggccgacgccgatggtgcgctggcggccagtgtcttccatagcggcgcgattccgattccggaactcaagcgcttcctgcgtgcgcaacagatcgaggtacgtgat

SEQ ID NO: 39004 - DNA, 1128 bp, Xanthomonas campestris
cgcatgaccccgattcttttcgtcgaccgtgatggcacgctgatcactgagccggccgatttccagatcgacgcctacgaaaagctgcgctttgtcgacggcgtgattccggccatgctcaagctgcgcgatgccggctaccagttcgtcatcgtcagcaaccaggacggcctgggcagcgagagctacccgcaggcatccttcgacggccccaacaacctgatgctgcagatcttcgccagccagggcatcgtgttccgcgaagtgctgatcgactgcagctggccggccgacaacgcgccgacgcgcaagccgggcgttggcctgatggtgccatacctgcaggaccgcacgatcgactggagccgttcggcgatggtgggcgaccgcatcaccgacatccagttcgcgcagaacctcaacatccgcgggttccagctgcgcaccgagcagttcggcggcgattgggactgggccggcatcgcacacgaactggccgatgccccgcgccgcgcggtggtccagcgcaataccaaggaaacccgcatccgcgtggagctcgacctggatcgcgtggccgaaccgcacaccgccaccgggctgccgttcttcgatcacatgctcgagcagatcggcaagcacggcgggtttgcgctggatatccgcgccgaaggcgacctgcacatcgatgagcaccacaccatcgaagacaccggcttggcgctggggcaggccttgcgcgaagccttgggcgacaagcgcggtattggccgctatggctttgatccggacgacagcccatggcgcgtagcgggcgacaccacacagcacggctttaccttgccgatggacgaaaccatcgccagtgctgcgctggatttcagcggccggccatacttcgtgttcgacggcgacttcaaacgcgagcgcgttggcgacatgcccaccgagctggtgccgcacttcttccgttcggtgtgcgatgcatccggattgaatctgcatctgcacgtgcgcggcgagaacgatcaccacaaggtggaaggctgcttcaaggcattggcgcgtgcactgcgccaggcgatccgccgcgagggcaccgcgttgccatccaccaagggggcgcta

SEQ ID NO: 39005 - DNA, 1071 bp, Xanthomonas campestris
acggcatcggtaatggatctggtgcgtgacgatctgcgcgcatttgcaggctatgcgtcggcgcgcacgagtgcattgcaaggcgatgtgtggctcaacgctaacgagtcggcctggggaaatccggccgatcccgacgccagcacgcgtcgctatcctgatccgcagcccaagggcctgcgtgcggcgctggcgcagctgtatgggtgtgcgcccgagcaattgctgatcggccgtggcagcgacgaggccatcgatctgctggtgcgtggcctgtgcgtgcccgagcgcgatgcggtggtggtcacaccgccggtgttcggcatgtatgcggtgtgcgcgcgcctgcagagcgcgccgctggtcgaagtgccgttggtggatggggcggacggtttgcatgccgatgtgccggcgatcgtgcaggccgcgctggacgccaaggccaagctggtgttcctgtgctcgccgtccaatccggccggctcggcgatcccgctggccgagatcgaagctgccttgcaggcgctgcagggcaaggcgctggtggtggtggatgaagcctatggcgagttctccgatgtgccctcggccattggcctgcttgcgcgctacgacaatctggcggtgttgcgcaccttgtccaaggcgcacgcgctggcggctgcgcgcatcggcagcctgatcgccaacgctgagttgatcgcgctgttgcgccgttgccaggcgccgtatccggtgcccacgccatgcgcggtgatggccgagcaggccttgtctgcacctgcgctggcagtgacgcagcggcgggtgaccgagatccgtgccgagcgcgcacgcctgcatgccgcgctggtgcaggtggccggcgtgcgccaggtctacccctcgcagggcaatttcctgctggtgcgtttcgacgacgccgaagcagcgttccaggcgctgctcgaagcgggtgtggtggtgcgtgatcaacgcgcggtgccgcgtctgtccgatgcactgcgcatcaccatcggcacgcccgaccagaacgaccgtgtgttgggcgcgttgcagcgcaagcag

SEQ ID NO: 39006 - DNA, 1284 bp, Xanthomonas campestris
atgaacacgcttgattggacccaactcactgcagacgcacgcacccaggcgttgacgcgcccggtgcagaccgtcgccacgcagacacgcgaggcggtcgccaccctgatcgccgatgtgcgtgcacgtggcgatgtggcgctgcgcgagatcaccgcacgcttcgacggcgtcacgctggagagctttgcggtcagcgatgccgaatttgccgcggcagatgccgccatcgcgccggaactgcgccaggcgatgcaggacgccgtggcgcgcatcgacacctttcaccgcgccggcatgagcgaaggctatgcggtggaaaccgcacctggcgtggtctgcgaaaagatcgtgcgcccgatcggccgcgtgggcctatacgtgccggccggcagcgcgccgttgccgtccaccgccttgatgctgggcgtgccggcgcggctggctggctgccgcgaagtggtgctgtgcacgccgccgcgcaaggatggcagtgtcgacccggcggtgctggtggccgcgcaactcaccggcgtgcgccgagtattcaagctcggtggcgcgcaggcgattgcggcaatggcctatggcaccgactccattcccagctgcgacaaattgttcggcccgggcaacagcttcgttaccgaagccaagcagcaggtggcgcaatccggcgcggccgcgatcgacatgccggccggcccgtccgaggtgctggtgattgccgatgccggcgcgcaaccggcatttgtcgcggccgatctgttgtcgcaggccgaacatggcccggattcgcaagtactgctgttgtccgacagcgatgcattgattaccgcagtgcaggagcaactggacctgcaactggcgcaactctcgcgcgccgacatcgcgcgccaggcgttggcgcagtcgcggttgatcaaggtggcgacgctgcaggacgcgttcgagatcagcaaccgctatgcaccggagcacctgatcctggccttgcgcgagccgcgtgcgtggttggcgcaggtggaggccgccggctcggtatttctcggcgactacacgcccgaagcactgggcgattactgcagcggcaccaaccacgtgttgccgaccagcggtgcggcgcgtgcctatagcggcgtgagcgtggccagcttccagaacatggtgagcgtgcaggcggcgagcaaggccggtatcgatggaatcggcgcatgcgcagtgattctggcgcgcgccgagggcctggatgcgcacgccaacgcggtggcgctgcgcatggga

SEQ ID NO: 39007 - DNA, 909 bp, Xanthomonas campestris
atgagtgcttccacggcagcaccggcacgtgaccggttgcgcattgccatccagaaaaacggccgcctggccgagccggcgcgcagcctgctggccgcttgcgggctgagctggcggcagagccgcgacaaattgttctgctacggcgaatcgctgccggtggacctgctgctggtgcgcgacgacgacatcccgggcctgatcgccgatggcgtctgcgacctgggcatcgtcggccagaacgagttggacgagcaggcatcggcgcgtcgtcgcgctggcctgccggccgcgtatcacgccgtgcgcggggtcggtttcggccagtgccggctgatgctggcggtaccggaagagtgggactggcagggcgtggcgcagttggcgggcaagcgcatcgccaccagctacccggcgatcctggccgactggctggagcgccagggcatcgacgcatcggtggtcgagctctccggctcggtggaaatcgcgccgcgcctgggcaccgccgatctgatctgcgacctggtctccagcggcgcgacgctagccgccaaccaactcaagccggtcgagctggtgatggaaagcgaggcggtgctggccggtgccgtgcgcgagccagccgatgcgcgcgcggcgctgctggcgatgctgctgcggcgcatggatggcgtgctcaagctgcgcgacagcaagctgctgatgttccgcgccgagcaaggcaacgtggatgcgctgcgccgcttgctgcccgatgccgacccgctggtgcagttgcccgacgacggcaatggcgccttgcgcctgcagaccatgtgccacggcgcggtgacctggcaacgcctggaagaattggaacgcgcaggtgcgcaaggcttgatggtattgacggtggagcgctcgctc

SEQ ID NO: 39008 - DNA, 1413 bp, Xanthomonas campestris
atgcatcgacatgttcatgagcccgaaatcctagcagacccggcagccttcgaagctgccgaacattggcggcaacgcgatcttgcggtggtgtggcacccctgcacccagatgcgcgagcacccgcacacactacccctggtgccgatcgcacgtggcgacggcgcctggctgatcggccacgatggccgccactatctggatgcggtcagcagctggtggaccaacctgtttggacacgccgaaccgcgcatcggcgcggccatcgcgcagcaggccggcaggttggaacaggtgatgctggccggcttcacgcatgcgcccgccgtgcaactggccgagcggctgttggccatcgcgccgcgccagcccgaccgcgcgccactggccaaggtgttctacgccgacaatggctcggccggggtggaagtcgccttgaagatggccttccactatttccacaaccgtgacgagcaccgccgcacgcgtttcatcgcgctggagaacggttaccacggcgagaccatcggtgcgctgtcggtgggcgacattccgctgtaccgccgcgtgtacgcgccgctgttgctggaatcgatcttcgcgccttcgcccgatgcgtacctggccgagccgggacagagcgccgaggactacgcgttgcaggcggccgatgcactgcagcatctgctggagcaatccccgggcgaaatctgcgccttgatcctggagccgcgggtgcagtgcgccggcggcatgcgcatgtatcacccggcctacctgcgccgcgcgcgcgaactgtgcgatgcgcatggcgtgttcctgatcgccgacgagatcgccaccggctttggccgcaccggcaccttgttcgcctgcgaacaggccggcgtgatgccggatctgttgtgcctgtcgaaaggactcaccggtggcttcctgcccctgtcggcggtactggccacgcagcagctgtatgacgcgtttctggatgactcgcgcgagcgcgccttcctgcattcgcacagctacaccggcaacccgctggcgtgtgcggcggcgctggcgacgctgcagatcttcgccgacgacgacatcattgcgcgtaaccaacgtaccgctgcacacatgacccagctcgctgcgcagatcggcgagcacagcgcggtggccgacgtgcgccaggccggcatgatcgtggccttcgagctcacccagggcggcgacaagcgcacgcccttccccgccgccgcgcgcgtgggcctgcaggcctaccgcgctgcattggcacgtggcgtggtgctgcgcccgttgggcgacgtgctgtactggatgccgccgtattgcgtggacgacgcacagcttgcgctgcttgccgacaccacccgccacgccatcgccaaggccgttgcatgc

SEQ ID NO: 39009 - DNA, 585 bp, Xanthomonas campestris
gtgcatggcatgtccagctcgggcaactgctacaaggtgcgtctgctgctggagcagctcggcagccgctaccactgggtcgaggtcgatagcgtttccggcgagacccgcacgcccgagtacctggccaagaatcccaacggcaaggtgccgatggtggaacgcgacgacggccgcgtgctgaccgaatccaacgccatcctgttctggctggccgaaggcacgccgtacctgcccaccgatacctggcaacgcgcgcaggcgctgagctggatgttcttcgaacagtacagccatgagccctatgtggcggtagcgcgcttcatcagcctgtggacgccgcgcgatgccgcacgccgtgccgagctgccgcagctgcgcgcgcgcggcgagcaggcgctgacggtgatggaacagcacctgcgccagcacgcctggttcaccggcgccgactacggcatcgccgacatcgcgttgttcgcctatacccattgcgccgaagacggcggcttcgatctggagcgctggccggcgattgacggctggttgcagcgcgtgcgcgcgctgccgggcttcgtggcgatg

SEQ ID NO: 39010 - DNA, 936 bp, Xanthomonas campestris
ctggtgttctccggcaatgccaataaaccgcttgcccaaagcatctgcaaggagctgggcgtgcgcatgggcaaggcgctggtcacgcgcttctccgatggcgaagtgcaggtcgagatcgaagagagcgtgcgccggcaggaagtgttcgtcatccagccgacctgcgcgcccagcgccgagaacctgatggaactgctggtgctgatcgacgcgctcaagcgcgccagcgccgcgtccgtcaccgcagtgatcccgtatttcgggtattcgcgccaggatcgccgcatgcgctcctcgcgcgtgccgatcaccgccaaggtcgccgccaagatgatctgcgctatggaggccgaccgggtgttgacggtcgacctgcatgccgaccagatccagggcttcttcgatgtgccggtcgacaacgtgtacgcctcgccgctgttgctggccgacatctggcgcgcctacggcaccgacaacctgattgtggtctcgccggacgtgggcggtgtggtgcgcgcgcgcgcagtcgcaaagcgcctggacgatgcggacctggccatcatcgacaagcgtcgcccgcgcgccaacgtcgccacggtgatgaacatcatcggtgacgtgcagggcaagacctgcgtgctggtggacgacctggtcgataccgccggcaccctgtgcgcggctgctgctgcactcaagcagcgtggtgcgctcaaggtcgtggcctacatcacccacccggtgctgtccggcccggcggtggacaatatcaacaattcgcagctcgacgagctggtggtcactgacacgatcccgctgagcgcggcggcacgcacgtgccccaagattcgccagctgagcgtggccgaactgctggccgagaccatccgccgcatcgcctttggcgagtcggtcagctcgctctacgtcgac

SEQ ID NO: 39011 - DNA, 882 bp, Xanthomonas campestris
atggacgctctcgccctgatgtctgcgtcgaaccctgcctggtcggcctggcctgcgccggccaagctcaacttgttcctgcaaatcgtcgggcgccgcgccgatggctatcacctgctgcagaccgtgttccgcctgctcgactggggggacaccgttcatgttcgtttgcgcaccgacggccagatccagcgcattggcgccagcctgccgggcgtcgccgaagacgacgatctcatggtgcgtgcggcgcgcgcgctacaaattcatgccggcaccgcgctcggggctgagttgcgggtcgacaagcgcatccccgccggcggtggcttcggtggcggctcctcggatgccgccaccgtgctggtggccctgaatgccttgtggggcctgggcttgccggtcgacaccctggccgaactgggcctgcgcctcggcgccgatgtgccggtattcgtgcgtgggcacaacgcctgggccgaaggtgtgggcgaaaaattgaccccgatcagcctgccgcaggcggcctacgtgctggtcgaccccggtattcacgtgcccacgccggtcctgtttcaatcacaggaattgacgcgggatgctgcgcccgcgaaaatagcggacttcgcttccggttctctgctcgacaatgcgttcgagccggtcctgcggcgccgggaacctgccatcgaggccgtgttccaggcgctttccaggatcggaacgccacgtttgacagggtcggggagcggttgtttcgtcgaattcgccacgcgcgctgctgcagagcaggccatggcgcatttgccgggcaacctgcgggcgtgggtcgtggagggtgcagcgcactcgccattgctcgacgcactggacgcgatacag

SEQ ID NO: 39012 - DNA, 1293 bp, Xanthomonas campestris
atgacgttgtgggtgctcggactgaatcaccagaccgcacccgtggacctgcgcgaacgcgcggcgttcgcgggtgacgcgttaccgcgcgcgctcgattcgttgcgcatcctgccgcaggtgcgcgaggccgcgctgctgtccacctgcaaccgcaccgagctgtatgcgatggccgacgacccgcagacgctggtggcctggctggacatgcacgcgcccgggctgagcggttatctgtaccagcaccgcgatgccgaggcggtgcgccacctgttccgcgtggccaccgggctggactccatggtgctcggcgagccgcagatcctgggccaggtgaaggacgcctgggcggtggcacgcgcgcacggcgcgctgggcagtggcctggaccggctgttccagcagaccttttcggtggccaagcgcgcacgcaccgacacccgcgtgggcgccaacccggtgtcggtggcatccaccgcggtgcggctggcgcaggaatcgttcgcacgcctgaatgaatcgacggtgctgctggtgggcgccggcgagaccatcgaactggcggccaagcatctgagcgaaggccgcgtgcggcggctgttgatcgccaatcgcaccctggcccacgcacagacgctggcgacccagcatggcggcgtggcgctgccgctaaccgagctggatcgccacctggccgaggccgatgtggtgttttccgccaccgccgcgcgcgagccggtggtgacccgggtgcaggtggaacaggcgctgcgcacgcgcaagcgcaagccgatgctgctgttcgacctggcggtgccgcgcgatatcgaggcctcggtggccgagctgagcgacgcctacctgtacacggtggacgacctggaacgcgcggtggaagacaaccgccgcagccgccgcgaggcggccgaccaggccgaagccatcatcgacctgcaggtggcgcgctatgtggaaacgctgcaggccaatgagcgccaggcgccactgaaacggctgcgtgccttcggcgacagcacccgcgacgaactgctggccaaggcgcggcagcaattgagcaacggcaagccggccgatgaagtgctggaacagttggcgcatgcgctgaccaaccgcctgctgcatccgccaaccgccgcactgcgcgatgccgcgctcaacaacgacctcgacctgaccagcgcggccgaccggctattccccgagaaacccggttaccgccatccccctgtagctaccccgatcgtgaggactgatgacgccaaccctgcg

SEQ ID NO: 39013 - DNA, 1008 bp, Xanthomonas campestris
atgtcactgaagcacttcttgaacacccaggactggagccgcgccgaactggatgcgctgttgacccaggccgcgttgttcaaacgcaacaagctgggaagcgagctgaagggcaagtcgatcgcgctggtgttcttcaacccgtccatgcggacccgcaccagcttcgagctgggcgcgttccagctggctgggcatgcggtggtgctgcagccgggcaaggatgcgtggccgatcgaattcaacctgggcacggtgatggacggcgataccgaggagcacatcgccgaggtggcgcgcgtgctgggccggtatgtcgacctgatcggcgtgcgtgcgttcccgaagttcgtcgactggtccaaggaccgcgaagaccaggtgctcaagagctttgccaagtattcgccggtgccggtgatcaacatggagaccatcacccacccatgtcaggagctggcgcacgcgctggcgctgcaggagcattttggcacccaggacctgcgcggcaagaagtacgtgttgacctggacctaccatcccaagccgttgaacaccgcggtagccaattcggcactgaccatcgccacgcgcatgggcatggacgtgaccctgctgtgcccgaccccggactacatcctggacgagcgttacatggactgggcggcgcagaacgttgcagagagcggtggctcgctgcaggtcagccacgacatcgacagtgcctatgccggcgccgacgtggtgtacgccaagagctggggcgcattgccgttcttcggcaactgggagccggaaaagccgatccgcgaccagtatcagcatttcatcgtcgacgaacgcaagatggcactgaccaacaacggcgtgttttcgcactgcctgccgctgcgtcgcaacgtcaaagccaccgatgcggtgatggatttgcccaattgcatcgccatcgacgaggccgaaaaccgcctgcatgtgcagaaggcgatcatggcagcgctggtgggtcag

SEQ ID NO: 39014 - DNA, 1191 bp, Xanthomonas campestris
atgagcagcaaagatatcgtcctcgctttctccggtggcctcgacaccagcttttgcattccgtacctgcaggagcgcggctatgccgtgcacaccgtgttcgccgataccggcggtgtggatgccgaagaacgcgatttcatcgagaagcgcgccgccgagctgggcgcagccagccatgtcaccgtcgatggcggcccggcgatctgggaaggcttcgtcaagccgttcgtgtgggccggcgagggctaccagggccagtacccgttgctggtgtccgaccgttacctgatcgtcgatgctgcgctcaagcgcgccgaagaactgggcacgcggatcatcgcgcacggctgcaccggcatgggcaacgatcaggtgcgtttcgacctggcggtaaaggcgctgggcgactaccagattgtggcgccgattcgcgagatccagaaagaacacacccagacccgcgcctacgagcaaaagtacctggaagagcgcggcttcggcgtgcgtgccaagcagaaggcctacaccatcaacgagaacctgttgggcgtgaccatgtccggcggcgagatcgatcgctgggaagcaccgggcgaaggcgcacgcggctggtgtgcaccgcgtagcgcgtggccgaccgaagcgttgacggtgacgctgaagtttgtcgaaggcgaggccgtggcgctggacggcaaggccctgccaggtgcgcagatcctggccaagctcaacaccttgttcgcgcagtacggcgtgggccgtggcgtgtacaccggcgacaccgtgatcggcctgaagggccgcatcgtgttcgaagcgccgggcctgatctcgctgctcaccgcgcaccgtgcgctggaagacgcggtgctgaccaaacagcagaaccgcttcaagccggacgtggcgcgcaagtgggtggagctggtgtacgagggcttctatcacgacccgctcaagaccgacatcgaggcgttcctgaagtcgtcgcagtccaaggtcaatggcgaagtgacgctggaaacccgcggcggccgcgtcgatgcggtggcggtgcgttcgccgcacctgctcaacgccaagggcgcgacctacgcccagtcggccgactggggcgtggaagaggccgaggggttcatcaagctgttcggcatgagctctacgctgtacgcgcaggtgaatcgc

SEQ ID NO: 39015 - DNA, 1326 bp, Xanthomonas campestris
ccgatgaccaatctgttgtggcaaaaacccggcgtggcggtggacgccaagatccagaccttcctggccggcgatgacgtcatcctggaccgcgagttcttcctgtatgacatcgcggccagcaaggcgcatgcgcaggggctgcagcacatcggcatcctgtcgctggaggaactgggcgggctgagcgagcagctggatctgctagccgacgacttccgtagcggcgcgttcgtgctcgatgcgcattacgaggattgccattcggccatcgaagcgcggctgaccgaacgcctgggcgatgccggccgcaagatccacaccgggcgcagccgcaacgaccagatcctggtggccacgcggctatggttgaaggacaagctgcagcgcgtggccgcgctcagcaccgaggtggccaaggtggcgctggaccgcgcacaggccgaagccgagctaccggtgcccggctacacgcacatccagcgagcggtggtgtcctcggccggcatgtggtgggcggggtgggccgaggccttcatcgacaacgccgtgcgcgccaacgacaccttcaagctggtcgacaccaacccgctgggcaccgcggccggttacggcgtcaatctgccgctggaccgagcgcacaccaccgccgaacttggcttcgcgcgcctgcaggtctcgcccatctacgcacagctctcgcgtggcaagttcgagctggctgcactggaagcgctgggtggcgcaacgctggacctgcgccggattgcctgggatctgtcgttgttcaccagcggcgagttcgcctttgtcgcgctgccggcgcagtacaccaccggcagttcgatcatgccgaacaagcgcaaccccgatgtcatcgaactgatgcgcgccacccacgccagcgtggcagcggcgcgcaccgagatcgaacagctgctgtcgctgccgtccggctaccaccgcgatctgcagagcagtaaaggcgcgatcgtgcatggttttgcgcgcggcctggccgcgctggagctgttgccggccttgctggccaacctggaatggcggccggacaagctgcgcgcggcgatcgattcgggcatgtacgccaccgatgtcgcggtggaagccgccgtggccggggtgccgttccgcgacgcctacaaggcggccgccgccgcgtctgacagcgcagggcaggggcgcacaccggaagccagcctggccgcacgcgtctcgcccggtgcggcggccgacctgcagctggatgtgctgcgcgcccgctgggaggcgctgcaatgatcccgaccctcagtgccgacaccgccg

SEQ ID NO: 39016 - DNA, 1515 bp, Xanthomonas campestris
tccatgagtgagcaagtgaccaccccgccgtgcatcatcgtggtgttcggtgcgcgcggtgatctgacccggcgcctggtgatgccggcgctgtacaacctgcgccgcgccggtgcacttggcgaggaattcgccattgtcggcatggaccatggcgatatcaccgagcgtgcctggcgcaccaacatgggcaaggcgatgaccgagctgctgagcagccgcgatgccgagttccaggccgatggattcgataccgatacctgggactggttgcgcgagcgcatgcattacgtgcgcggcgacttcaccgacctgcgtgcctatcaggcgctcgacggcgtgctggaaaaactgcacaagcgctatggcacccgcggcaatgtgctgttctatctggccaccgctgcgcgcttcttcgagccggtgctgctgaatctgggcgaggccgggctggtcaagcagcacgagggcgccggctggcgccgggtgatcgtggaaaagccgttcggccacgacctgcccagtgccaagcatctcaatgccaccgttgcgcgcgtgctgcacgaagaccaggtgttccgcatcgaccatttcctgggcaaggaaaccgtgcagaacatcctggcgttccgcttcgccaatggcctgttcgagccggtgtggaaccgcgaccgcatcgaccacgtgcagatcaccgccgccgaaaccatcggcgtggaagggcgcgggcgtttctacgatcccaccggctgcctgcgcgacatggtgcccaaccatctgttccagctgctggcgatgattgcgatggagccgccggccgcgttcaccaccgaggcgatgcatcgccgccgcgccgaagtgatcgaagcggtgcgcccgatcaaacccgaagacgtggtgcgtgggcagtacgcgtccggtgcggtcaatcgcagcgccgtgccgggataccgcgaggaagacacggtaccggacgagtcggaaaccgaaaccttcgtggcgatgaagttgcaggtcgacacctggcgctgggccggcgtgccgttctatctgcgcaccggcaagcgcctgcgcgaacgcaccaccgagattgcgatccgcttcaagcccgcaccgctggcgccatttcgtagcaccgaagtgggcggctacggccccgactggctggtgctgcatatccagcccgacgaaggcatctcgctgcagttcgacgtcaagcgcccgggcgcgcaagtggcgttggcgccggtgcggatggacttccgctaccgcgactggttcccgaaggaatacaccgttggctacgagcgcttgctgcaggactgcatgaatggcgaggccggtctgttccaggatgcagcgatggtggaaggcgcgtggcgcatcgtgcagccgatcctggatgcgtggaaacaaccgcccagtgactttcccaattacgcggctggcagtgccggcccgtcggcggccgatgcgttgctggcgatgaacggcgggcacgcctggcgtgcgctc

SEQ ID NO: 39017 - DNA, 1872 bp, Xanthomonas campestris
atggcgatccggcaattgcccgagatcctgatcaaccagatcgctgccggcgaggtggtcgagcgcccggcatcggtcgtcaaggaactggtcgaaaacgccctcgatgccggcgccacccgcgtggatatcgatctggaagagggcggcgtgcggctgatccgcatccgcgacaatggcggcggcattgcgccggaagagctgccgctggcggtgtcgcgtcatgccaccagcaagatcgcctcgctggatgatctggaaaccgtcgccacgctgggcttccgcggcgaagcgttgccgtccatcgcctcggtcagccgctttacgctggcctcgcgtcgcccggatgccgagcacggctccgcgctgcagatcgaaggcgggcgcctgggcgaggtgatgccgcgtgcgcatgcgccgggcaccaccgttgaggtgcgcgagctgttcttcaacgtgccggcacggcgcaagttcctgcgcgccgagcgcaccgagttgggccatatcgaagagtggctgcgttcgctggcactggcgcgcccggacgtggaattgcgcgtctcgcataacggcaaaccgtcgcggcgctacaagccgggcgatctgtattcggacgcgcggctgggcgagaccttgggcgaggatttcgcgcgccaggcgctgcgcgtggaccacagcggtgccggcctgcgcctgcacggctgggtggcgcagccgcattactcgcgcgccagtaccgatcagcagtatctctacgtcaacggccgctcggtgcgggatcgcagcgtggcccatgcggtgaagatggcctacggcgatgtgctgttccacgggcgccagccggcgtatgtgctgtttctcgagctggaccctgcgcgcgtcgacgtcaacgtgcatccggccaaacacgaggtgcgcttccgcgaggcgcggctgatccacgacttcgtctatcgcactctgcaggacgcactagcgcaaactcgcgccggcgcgttgcccgctgatgttggcctcggcgggtcggcagccctcggtatcggcgccggtgcggcgcagggcgacggaagctacgttgctgacgccggtgcagggcatccgggcgctggcagtggctccggctatgcaagctgggcgccgtcgcaggcaccgctgggtttgcgcgtagacgaggcgcgcgccgcctacgccgcgttgtatgcccctgcggccggcagcgcgttgcgcgacgacgggcaaccggtgctgtccggcaccggcttgccggcgaccgcgcacgacagcggagtcccgccattgggctacgcggtggcgcagttgcacggcatctatatcctcgcggaaaacgccgaaggcctgatcgtggtcgacatgcatgccgcgcatgagcgtatcggctacgaacgcctcaagcaggcgcacgacagcattggcctgcatgcgcagccgctgctggtaccgatgacgctggcagtgggcgagcgcgaggccgacaccgccgagcgcgaggccgatacgcttgccagcctgggcttcgaaatcacccgcagcggtccgcaatcgctgcacgtgcgcagcattccggcgctgctcgccaatgccgacccggaggcgttgttacgcgatgtgctcggcgatctgcgtgagcacggccagagccggcgcatcgccaccgcgcgcgacgagttgctgtccaccatggcctgccacggcgcggtgcgtgcaaaccgccggctcaccgtgccggaaatgaacgccttgctgcgcgacatggaagccaccgagcgctcgggccaatgcaaccatggccggccaacctgggcccggtttacgctgggcgaaatcgatcgctggttcctgaggggacgt

SEQ ID NO: 39018 - DNA, 1333 bp, Xanthomonas campestris
gctgtcgcgccatccgcgcatcatcgccgcactgttggtgcgcgatcacgaccgcggccgcgacgattgcagtgtgtttgtcatgcgcttgggaggcatgtcatgagtcacgcaaatgaggttcccgccatcgacgcgatggctgaactggagagcttgcgccagcagaatcaggcgctgcgcgaggaactggacgaaaccaaccagggcgtgctggcgctgtatgccgagctggatcagcaggctgagcaattgcgcgacgtgtccgagctcaagagccggtttctgtcgtacatgagccacgaattccgcacgccactgggctcgatcctgagcattacccggctgctggaagacggcatggatggcccgctcaacgccgagcagctcaagcaggtgcgctttgtcagcgcgtccacgcgcgagctcagcgaaatggtggacgacctgctggacctggccaagatcgaagccgggcgggtcaccatctcgccgggctggttcgatctgatggatctgtttgcggccttgcgcggcatgttccgcccgctcaccgacgccaaccgcaccaccttgatcttcgaagatccgccggtgttgccgatgctctacaccgacgacaagaagctggcgcagatcctgcgcaacttcatttccaacgcgctcaagttcaccccgcaaggccatgtgcgcgtgttcgcgcaactgcagggcgacacccacgtgcgcttcagcgtgcaggacaccggcattggtatcccggccgaactgcacgacgcgctgttcgaggatttcgtgcaggtggattcgccactgcaaaagcgcctcaccggcactggccttggcctgtcgatctgcaagcgctttgccgagttgctgggcggcaccgtaggcatcaacagcgtggttgggcagggctcggaatttttcgtggtattgccggtgacgctggcgccgcagcaggaggatggtcttgcctagcagtcatcggattctggtagtggacgacaacgcggtcacccgctattcggtgcggcgcgtgctcgaacaccaccagttcgtggtcgaagaagccggcaccggtggcgaggggctggtgcgcctggccgccgaggcattcgccgctgtggtgctggacgtcaacctgccggacatgagcggcttcgacatcgtgcgcacgctgcgcgccgagccgcgtaccgcgctgctgccggtggtgcacgtgtcggcggcctcgattgccaccggtgacatgatcaccggcctggacgccggcgccgatgcctacctgatccatccggtcgaccccaacgtgctggtcgccaccttgcgc

SEQ ID NO: 39019 - DNA, 759 bp, Xanthomonas campestris
atgcgactcaccgccctgcccgcattcgacgacaactacatctgggcgctggtcgccaatgatggccgtgcagtgatcgtcgaccctggccaggcagcgccggtgctggaggccgcgcagcgtgagggcttcactccggtggccgccctgctgacccaccaccatgccgaccatatcggcggtgtggcggagctgcagcagcattttccggcgctggaactgtacgggccggacgacgaacgcatgcctgcggccacccgccacgtcgcgcacggcgacactgtgacggccctggatatcgactttgcggtgctggatgtccccggccatacccgcagccatgtcgcgtatgtgggtgacgggcacctgttcagtggtgataccctgttcagcctaggctgtgggcggatgttcgaaggtacgcccccacagatgttcgacgccttgcagcgcctggcctccctgccaggcgagacgcttgtgtgttgcggccacgagtacaccttggccaatgcggccttcgcgctgcacgtcgatcccaccaacgctgccttgcagcgccgtcaacaggaagcccaggcaatgcgtcatgcagcccgtcctaccctgccgatttcgctcaagagtgaactggccaccaatccgttcctgcgtctgcatactcccgaaattcgcgccgcggtcgccgcgcacgcaagtatctcgataacgagcgatgtagacgtatttgccgaacttcggcgctggaaagacgtattt

SEQ ID NO: 39020 - DNA, 1335 bp, Xanthomonas campestris
atgtcatttgcccacctctcgctgtcgccaacgctgcagccctgtttcgataccgcactggccaaggccgggcaccacacgcccacgccgatccagcagcaggcgattccggccatgctggccgggcgcgacctgatcgccatggcgcagaccggctccggcaaaacgctggcctatgcgctgccgctgctgcaacagcgcatgcaggcgccggaccaggcgccgcgcgtgctcggcggcctgatcctggtgcccacccgcgaactggcagcccaggtggagcagagcctgctgcagctggccgcgcatctgccacgacggctgaagatcgtcgccgccaccggcggcagctccatcaacccgcagctgatggcgttgcggggcggcgccgacatcgtggtggccacgccggggcgcctgctggacctggtggaacacaacgcgctgcagctgggcacagtggccacgctggtgctggacgaagccgaccgcctgctcgacctgggctttggcgccgagctcgaacgcatcctggcgctgctgccggcgcaacggcagagcgtgctgttttcggccacgtttccgccggcaatcacggtcttggccaagcgccgcctgcgcgacccgctgcgcatcaccattgcggccaccccggagcaggccccggcgatcgcccagcgcgccatcgccgtggacgccggcctgcgcacccagctggtgcggcagttgctgcaagaccacggctggccgcagctgctggtgttcgtcgccagccggcacaccgctgaaaaagtcgccgagaagctggaaaaaaccggcatcaccgcactgccgctgcatggtgacctgagccagggccggcgcgagcgcacgctgcacgccttcaaacaggccgaggtgcaggtgctggtggccaccgatctggctgcgcgcggcatcgacatcgccgcgctgcccgcagtgctcaactacgacctgccccgcgtcacggtcgactacacccaccgtatcggccgcaccgcgcgggccggtgccaacggcaccgcgatcagcttcgtcacaccggagagccggccgcagtggcgcctgatcgaaaaacgtgaggatgtgcgcgtgccggtcgaggtgttggcaggcttcgagccggtggccgcgccgcagaccgatgcaaccgcgcgtgcgccggacgccaccggcggcatcaagggcaagcgcccgaacaagaaggacaagctgcgcgcggcccaggccgccgcggcatccggcgaccagcactgacaccggcgcgccgatgcgcgcttcaaccccagtggggtgcggctggtgcgtaggcgc

SEQ ID NO: 39021 - DNA, 1428 bp, Xanthomonas campestris
atgcacaacaccctgatcctgttcggcgccaccggcgatctcgcccagcgctatctctttccatccctgctgcgcctgtttgtcgacggcctgttgccggaggacttccgcatccgtgcgttggccctgtcgcagcacgacaccgacgccttccgcgaggtactgcgcccgcgcctggcccaggcgctgccgattgccaccgccgcgcagatcgatgcgctgctgcagcgcatcgactaccgctcggcggacctgcgcaatgccgaatcggtggccgaggccgtgcgcgaactggccagccgccagtgcgtaagctatctggcgattccaccgggcctgtacatcagtacctgccagggcctggccctgggcggcgcgctggctgcaccgcaccggttgatgctggaaaaaccgatcggccacgattcggacagcgcccgcgagatcctgcagtcgatcggcgcactgatcgacgaagaccgcgtgttccgtctcgaccactacctgggcaaggccgcggtgcagaacctggtggcgctgcgcttcggcaacaccttgctggaagcggtgtggaaccggacctacatcgaatcggtacagatcctggtggccgagagcgaaggcgtggacggccgcgatgcctactacgcccgctccggcgcgctgcgcgacatggtgcagagccatatcctgcagttgctgtgcctggtggccatggagccgccggcctcgctggaagccgaccgcatccgcgacgagaaggtcaaggtgctgcgcgccttgcgcccgatgaccgccgagcacgccgcgcaagacagcgtgcgtggccgctacaccgccggcagcatcaacggcgagccggcgcaggcctaccacccgccggaaggcagcgatgtggaaaccttcgtcgcggtcaccgcgcacatcgacaactggcgctgggctggcgtgccgttccacctgtgcaccggcaagcgcctggctgagcgctccacgcgcatcgtggtcacgctcaagccggtgacgcattggttgttcgagcgtccggaccgccagaacgcggtgcccaaccgcctgaccttccagctgcagccgctggaaaacatcgagctgggcctgatgagcagcctggccggcccggaatggggtgcgatcgaactgcagccgctggaactggagctgtccgtgcccaccggcctgcaccgccgtatcgcgtatgaacgcttgttcgtggatgccttcaacggcaacccggcgctgttcgtgcgcgatgacgaggtcaaggccgcctgggcctggatcgacagcgtcagcgatgcctggtcggacgcacagctgccgctgcagccgtatccggccggtagctggggccccgagaccgccgcaccgttcctgcccccggccaccgacgcacagggaaacaacgca

SEQ ID NO: 39022 - DNA, 1800 bp, Xanthomonas campestris
atctataattcgatgtccgcttacaagattacagaacacaagtacgacatggtcgtggtgggcgccggcggcgccggcttgcgcgcgaccttcggcctggcccagaagggcctgcagacggtctgcctgaccaaggtcttcccgacccgttcgcacaccgtggccgcgcagggtggtatttccgccgcgctgggcaatatgggtgaggacgactggcggtatcacttctacgacaccatcaagggctccgattggctgggcgaccaggacgcgatcgagtacatgtgccgtgaggcgatcccggccatcatcgagctcgagcactacggcgtgccgttctcgcgcaccgaagagggcaagatctaccagcgcccgttcggcggcatgaccaccaagtacggcgaaggtccgtctgcgcagcgcacctgcgccgccgccgaccgcaccggtcacgcaatgctgcatacgttgtaccagcagtcgctggcgcacaacgcacgcttcatgatcgagtacttcgcgctcgacctgattttcgacgaagaaggtgtgtgccgcggcgtgctcgcgctggacatggccgaaggttcgctgcacctgttccgcgcccacggcgtggtgctggccaccggcggctacggccgtgcctacttcagcgccacctctgcccacacctgtaccggtgacggcggcggcctgatgatgcgtgctggcctgccgatgcaggacatggagttcgtgcaattccatcccaccggtatctacggtgcgggctgcctgatcacccaaagcctgcgttgctaaggcggcattttgcgcaacagcaacagcgagcgcttcatggagcgctatgcaccgcactacaaggatctggcctcgcgcgacgtggtgtcgcgttcgatgaccatcgagatccgcgaaggccgtggcgttggcgagcacaaggaccacattctgctcgacctgacccacctcggcccggaagtgatcaacgacaagctcccaggcatcgccgagagcgcgcacatcttcgctggcgtggacgtggccaagcagccgatcccggtgctgccgacggtgcactacaacatgggcggcatcccgaccaactaccacggtgaagtcgtgcgcaagcagggcgacaacccggatgcggtggtgcccggtttgtatgcgatcggcgaagcggcttgcgtgtcggtacatggcgccaaccgtctggggtccaactcgctgctggatctggtggtgtttgggcgtgcggtagccaaccgctgcgcggaaaccgtcaagaccaatcagccgcacaagccgctgccgtccgatgcctgcgacaaggcgctgggcttgctggacaagttgcgccatgccaatggctccacgccgacctcggtgatccgcgacaacatgcagcgcaccatgcagtcggacgcagcggtgttccggaccagcaagacgctgaaggaaggcgtcgacaagatggccgagatcttcgccaccttcgaggacgtcaaggtatcggaccgctcgctggtctggaattcggacctgatcgagacctacgagttgaacaacctgctgctcaatgcagtggcgacgatcaactcggccgaacagcgcaaggaaagccgtggcgcgcacgcgcacgaggatttcccggaccgcgacgacgtcaactggcagaagcacacactggtcaccgtggacgacaagggccagtgcgacttcgaataccgcccggtccacatgtacacgctgagcaaggaagtggacgtggttccgccgaagccgcgcgtctac

SEQ ID NO: 39023 - DNA, 807 bp, Xanthomonas campestris
ggtctcccatcgcaccgcgcatcgcctgagccaacgagagcagctatggcagagttcaccctccccaagaattcaaagatcggcaagggcaagcattaccctgcacaaggcgccaagaacaagcgcaccttcaaggtctaccgctgggatccggatggcgacgccaatccgcgcaccgacagctatgaaatcgatctggacaagtgcgggccgatggtcctggacgcgctgatcaagatcaagaacgagatcgacccgaccctgaccttccgccgttcctgccgcgaaggcatctgcggttcgtgcgcgatgaacatcgacggcaccaatacgctggcctgcaccaaggcgattgccgcgtgtggcaaggccgaggtgccgatctatccgctgccgcacatgagagtgatcaaggatctggtgccggacctgacgcatttctatgcgcagtacgcctcgatcaaaccgtggatccgtacccagaccccgccgccgccggaccgcgagcgcctgcagtcgccggaagaccgcaagaagcttgacggcctgtacgagtgcatcctgtgcgcgtgctgctccaccagctgcccgagctactggtggaacggcgaacgctacctgggcccggcgatcctgctgcaggcctaccgctggatcatcgactcgcgcgatgaagacaccggtgcgcgcctggacgatctggaggatccgttcaagctgtatcgctgccacaccatcatgaactgcgcccgcacctgcccgaaggggctgaacccggcgctggcgatcgccgagatcaagaagctg

SEQ ID NO: 39024 - DNA, 1386 bp, Xanthomonas campestris
cccatgcgatttggcaacggggcagtgtgcggcgataatccggcagcttgtttccggtgtacttccccccttactggtaaccgatcggacctatgaccactatcgccaagattctcgcccgtgaaatcctcgactcccgcggcaatcccacgctggaggcggaagtcacgctggcagacggctcgttcggccgcgccgccgtgccctcgggcgcctcgaccggcaccaaggaagcggtggaactgcgcgacggcgacaagacccgctacctgggcaagggcgtgcgcaaggccgtggaaaacgtcaacggcaccatcgccgagacgctcaaggacttcgatgccgccgaccagcagggtctggaccgtcgcctgatcgacctcgacggcaccgagaacaagggccgcctgggcgccaacgcgttgctgggtgtgtcgctggccgccgcgcatgcggtcgccgcctcgcgcaagcagccgctgtggcagtacctgtccaccatcaccgaatccgatgtcgccctgccggtgccgatgatgaacatcatcaacggcggcgcgcatgccgacaacaatgtcgacttccaggaattcatggtgctgccggtgggctgcagctcgttttccgaagcgctgcgcgcaggcaccgaaatcttccattcgctgaagtccgtgctcaagggccacggcctcagcacggcggtgggtgacgagggcggcttcgccccggacttccgcagcaatgtcgaagcgctggacaccatcctcgaggcgatcggcaaggccggttacaccgctggcgaagacatcctgctgggcctggacgtggcctcgtcggagttcttcgccagcggcaagtacaacctggtgggcgaaaacaagcgcctgaccagcgagcagttcgtcgacttcctggccgactgggtggcgcagtacccgatcatcagcatcgaagacggcctggcccgaagacgactgggccggctggaagctgctgaccgatcgcgtcggcaagaaggtgcagctggtgggcgacgatctgttcgtcaccaacccgaagatattcaaggaaggcatcgacagcggcaccgccaacgcgatcctgatcaaggtcaaccagatcggcacgctgactgagacgctggaagccattgccatggcgcatgcggccaactacgcctcgatcgtgtcgcaccgttcgggcgagaccgaagacaccaccatcgccgatatcgccgtggccaccaccgccacccagatcaagactggctcgctgtgccgcagcgaccgcgtcgccaagtacaaccagttgctgcgcatcgagcaggcactggggtccggcgcgcgttacgccggccgcgacgcgttcgtttcgctcaagcgataa

SEQ ID NO: 39025 - DNA, 1355 bp, Xanthomonas campestris
aggtccctgcagcaactcgatgctgcgcatcatctgcatccgttcaatgacaacgcggcactggcctccaagggcacgcgcatcctgacgcggggcgagggggtgtatgtgtgggatgcggatggcaacaagttgctggatgcgtttgccgggctgtggtgcgtcaacgtgggctatgggcgggccgagcttgcgcaggcggcggcgcggcagatggagcagttggcgtactacaacagcttctttcaatgcaccaccgagcccaccgtgcacctggctgccaagttggcggagctggcgccgggcgatttgaatcatgcgttctttgccaattccggctcggaggccaacgacaccatcctgcggctggtgcggcatttctgggcggtgcaggggcagccgcagaagcacatcttcatcggccgccacgatggctaccacggcaccaccatgggcggggccagtctgggcgggatgcgcgggatgcatcggcaaggcgggttgcccaattccggggatcgagcacatcgccgccacccaatcattttggcgagggtggcgagtatggacccggacgacatacggtctgctcgctgcgcgccgtctggaagagaagatcctgcagttggggcccgacaccgtggcggcctttatcggtgagccgatcatgggcgcgatcggggtctacatatccaccgcgcagctactggccggaaatcgaacgcatctgtcggcgctacgacgtactgctggtggccgacgaggtgatctgcgggttcggccgcaccggtgcctggttcggcgcggagtatttcggtttccagcccgatgtgatgaccctggccaagggcatcacatccggctacatcccgctggctgcggcgatgttcaacgaccgcgtggccggtgtgctcaagcgtcagggcggtgaactggcgcacggcggtacctatgccgggcatccggtctgcgctgcggtggcgctggaaaacctgcggctactgcaggacgagggcatcgtggacaccgcacgcacgcagattgcgccgtacctggcgcagcgctgggccgaactgggcgcgcaccgtctggtgggcgaggcgcgcatcgccgggctggtcggtgcgctggagctggtgcccgacaagcgccgccgtggtgtgtacttcccggagcgcgggcgcgtaggcgcgctgtgccgcgactttgccctgcggcgcgggctgatcctgcgggccacttacgacgccatgctgctgtcgccgccgttgatcatcacctgggaacaggtcgatgagctgttcgacaaaacctgggccgcgctggacgacaccgcgcaggcgctgggcaagtaa

SEQ ID NO: 39026 - DNA, 2035 bp, Xanthomonas campestris
atggcgcttttacttgccctgaaccccggcgcgctctagccttcgccggacttcaccgcaaggaccacccgtgaatcctcgtctgctgttgctggcgctcgccgttgccgccggtacgttgtcgctgtcgtcgtgccgccaggatgcggtgccgacgcccaagcccgccaccaccaaaaccgcacccagcgaaagcgccgaccagttcgtggcgcgcatcagtgccgaatacaaggcggcgtatccggaaatgactgccgcgcagtggctgtcgtcgacctacatcaacggcgactcgcagttgctggcggccaaggccaacgagcgcgcgctgagccagctggatcgctggatcgaccaatccaagcagtacgccggcaccccgatgtccgccgacagcgcgcgtgcgctgcaattactcaagctgatgagcgccctgcccgccccgcgcgacccgaccaagctggccgaactcacgcgtatcgccgcgaagatggaaggcgactacggcgcgggcagcgcctgcaccggtgaaggcgagcaacgccgttgccgccagctgggcgagctcgaacaagtgctggcacgcagccgcggctacgacgaacaactgcaagcctggcaaggctggcacgccaccgcgcaacccatgcgcaaggactaccagcgctttgtcgagctcgccaatgacggtgcacgcggcatgggctttgccgatgtcggtgcgatgtggcgcagcggctacgacatgccgccggcgcaattggccagcgaaaccgaccgcctttgggaacagctcaaaccgctgtacacccagctgcagtgctacgcgcgcggcaagctggacacgcagtacggcaaggacaagggcgaggtggccggcggcatgctgcccgcgcacctgatgggcaacatgtggcagcaggactggagcaacctgtgggatctgctgcagccctatcccggtgcgggcgacctggacatcacctcggcactggaaaaacagtaccagggcaacctgagcgccgcgctggcgcgcaataccggtggcgatggcggcgcagctgcacgcttcctcgccgagcgcgacgcgcaactgcgcactgcccagcagatgaccgaacgcgcgcaggatttctacacgtcgctgggcatgccgaagttgccggacacctattggcaacgctcgcagttcatcaagccactggaccgcgacgtggtctgccacgccagcgcgtgggacatgaacatgggtggcgagccgaacgcgggcatcggcccggacgtgcgcaccaagatgtgcatccgccccactgaagaagacttcaccaccatctaccatgagcttggccacatctattacgacatggcctacaacccgttgccgccgctgttccagaacggcgccaacgacggcttccacgaagccatcggcgacaccatcgtgctggcgatgacccccaagtacctgcagtcgatcggcatggttggcgagcagcagagcgggcgcgaggcattgatcaattcgcagatgcgcatggcgctgagcaaggtggcgtttctgccgttcgggctgatgatcgaccgctggcgctggggcgtattcgacggctcgattcccccggaacgctacaaccaggcctggtgggagttgaaggccacctaccagggcgtggcaccggtgagcccacgcggcgaggacttcttcgatgccggcgccaaataccacgtgcccggcaacacgccctacacccgttattttctcgcgcacatcctgcaattccagttctacaaaggcctgtgcgatgccgccggccaccaggggccgctgtacgaatgcagcttctacggcaacaaggaagccggccagaaattctggtcgatgttgcaacgcggctccagccagccctggcagaccacgctgaaggaagtgaccggcaaggacacgctcgatgccggcccgatgctggaatatttcgcaccgatgcaggaatggctcaaacagcagaaccagggccagatgtgcgggtggcag

SEQ ID NO: 39027 - DNA, 726 bp, Xanthomonas campestris
atgagcaccgctgccgattcgcccctgtccctcgcgcattactacctgccggtgtaccgcccgcgtcaggtggtgctggagcgtggccagggcagtcgcgtgtgggacgaccagggccgcgaatatctggatctgtcctccggcatcgcggtcagcgggctggggcacaacgatccggacctgatggccgcgctcaccgagcaggccggcaagctgtggcacaccagcaacgtgttcttcagcgcgcccccgctgaagctggccgaagagctggtcaccgcctcgcgctttgcgcagaaggtgttcctgtgcaactccggcaccgaggccaacgaggcggcgatcaagctggtgcgcaagtgggccagcagccagggccggccggccgacaagcgggtgatcgtcaccttccgcggcagtttccacggccgcacgctggcctcggtcaccgccaccgcacagcccaaataccaggaaggctacgagccgttgccgggcggattccgctacgtggatttcaacgatgtgccggcgctggaaagcgcgatggccagcggcgatgtggcggcggtgatgctggagccgatccagggcgagggcggggtgatgccggccgcaccgggctttttggcgcgcgtgcgcgcgctgtgcgaccagcacgacgcactgctggtgctggacgagatccagtgcggcatgggccgcaccgacagcctgttagcgcat

SEQ ID NO: 39028 - DNA, 819 bp, Xanthomonas campestris
aatcccatgacgttatccggcaaaaccctgttcatcaccggtgcttcgcgcgggattggcctggcgattgcgttgcgtgcggcgcgcgatggcgcgaacgtggccattgcggccaagtcggcggtggccaatcccaagttgccgggcaccatccacagcgcggcggcggcggtcaacgcggcgggcgggcaggggctggcgctcaagtgcgacatccgcgaagaagaccaggtgcgcgcggcggtggccgcaaccgtggatacctttggcggcatcgacatcctggtcaataacgccagcgcgatctggttacgcggcaccctggacacgccgatgaagcgcttcgacctgatgcaacaggtgaacgcgcgcggcagcttcgtctgcgcgcaggcgtgtctgccgcatctgttgcaggcgcccaatccgcacatcctcacgctggcgccgccgccatcgttgaatccggcatggtggggcgcgcataccggctacacgctggccaagatggggatgagcctggtcaccctggggctggccgccgagttcgggccgcagggtgtggccatcaacgcactatggccgcgcacggtgattgccaccgatgcgatcaacatgctcccgggcgtggacgcggccgcctgccgccggcccgagatcatggccgatgccgcgcatgcggtgctgacgcgcgatgcggccgggtttcatggccagttcctgatcgatgacgaagtgctggcacaggccggcatcaccgatctgtccggctacgccgtggacccgcagcgtgcgctgctaccggatctgtttctggag

SEQ ID NO: 39029 - DNA, 2382 bp, Xanthomonas campestris
ggagcatcgcgcttgaacgagaatatcctgtggttgcatgagctacgcctggtcgatctggcccgcgtaggcggtaaaaattcctcgctcggcgagatgatcggcaacctggccgggttgggtgtttcggttcccggtggatatgcgaccactgccgaagcattcaaggacttcatcgcgcacaacgatctgtccaaacgcattttcgacaagctggagacgctggacgttgaagacgtcaccgcgctcacggtcgccggcaaggagatccgcggctgggtgatcgacgccccgctgcagccggagctggaccgcgacatccgcagcgcctacgaaaaactctgcgccgagaacggcggcggcgaagtggccgtggcagtgcgttcgtcggcaaccgccgaagacctgcccgatgcctcgttcgccggccagcaggaaaccttcctcaatgtgaccggcgccgacgacgtggtgcacaaggtcaaggaagtgttagccagcctctacaacgaccgcgcgattgcctaccgcgtgcaccacggcttcaagcacgaagatgtgttcctgtcggccggtgtgcagttgatggtgcgctccggcgtgggttcgtccggtgtgttgttcaccctggacaccgagtccggcttccgcgacgtggtgttcgtgacctccagctttggcctgggcgaaatggtcgtgcaaggcgcggtcaatccggacgaattctacgtctacaagcccacgctcactgcgggcaagccggcaatcctgcgccgctcgctcggcagcaaggcgatccgcatggtgtattcggatgtgcccggtgaacgcgtgcgcatcgaagacacgccggtggagttgcgcaacactttctcgatcagcgacgaagatgtgcaggagctctccaagcaggcgctggtgatcgaaaagcattacggccgcccgatggatatcgagtgggccaaggacggcgtgagcggcaagctgttcatcgtgcaggcacgcccggaaacggtgaagtcgcgcagccatgccacccagatcgagcgtttctcgctggaagccaaggatgccaagatcctggtcgaaggccgtgcggtgggcgccaagatcggcagcggcgtggcacgtgtagtgcgctcgctggaagacatgaaccgcgtgcaggcgggcgacgtgctgattgccgacatgaccgaccccgattgggagccggtgatgaagcgtgcctcggccatcgtcaccaaccgcggtggccgcacctgccacgcggcgatcatcgcgcgcgaactgggcgtgccggcggtggtgggttcgggcaatgcgaccgacgtgatcagcgacggccaggaagtcaccgtgagctgcgccgagggcgacaccggcttcatctatgaaggcttgctgccgttcgagcgcaccaccaccgacttgggcaacatgccgcctgccccgctcaagatcatgatgaacgtggccaacccggagcgcgcattcgatttcggccagctgcccaacgccggtatcggcttggcgcgtctggagatgatcatcgccgcgcacatcggcatccatcccaacgcactgctggaatacgacaagcaggacgccgacgtccgcaagaagatcgacgccaagattgccggctacggcgacccggtgagcttctacatcaaccgtctggccgagggcatcgcgacactgaccgcgtcggtggcgccgaacacggtgatcgtgcggttgtcggacttcaagtccaacgagtacgccaacctgatcggtggctcgcgttatgagccgcatgaagagaacccgatgatcggcttccgcggcgccagccgttatgtcgatccgtccttcaccaaggcgttctcgctggagtgcaaggcggtgttgaaggtgcgcaacgagatgggcctggacaacctttgggtcatgattccgttcgtacgcacgctggaggaaggccgcaaggtgatcgaggtgctggagcagaacgggctcaagcaaggcgagaatgggctgaagatcatcatgatgtgcgagctgccgtccaacgcgctgctggccgatgagttcctggagatcttcgacggcttctcgattggctccaacgacctgacccagctcaccctgggtctggaccgcgattcctcgatcgtggcgcacctgttcgacgagcggaacccggcggtgaagaagctgctgtcgatggcgatcaagtcggcgcgcgccaagggcaagtacgtgggcatctgcggccaggggccgtcggatcacccggaactggccgagtggttgatgcaggaaggcatcgagtcggtgtcgctgaatcctgacaccgtggtcgatacctggctgcgcctggccaagctcaagagc

SEQ ID NO: 39030 - DNA, 753 bp, Xanthomonas campestris
cgcagcatcctgatcaccggtgccggcagcggcatcggcgccggcctggccaccgttcttgccgccgacggccaccacctgctggtgagcgacgccgacctggccgcggccgagcagaccacccagcaggtgcgcgcggccggcggatcggccgaggccttggcactggacgtcaccgacgagcacagcattgcccaggcactggcggccgcctcgcgcgcgcccgaggtgttggtcaacaacgccggcctgcagcaggttgcgccgctggaggagttcccgatgcagcgctgggcgctgctggtggacgtgatgctgaccggtgccgcacgtctcagccgcgcggtgctaccgggcatgcgggcgggcggctacgggcgcatcgtcaacatcggcagcatccattcgctggtggccagcccttacaaaagcgcctacgtggccgccaagcacgggctgatcgggctctccaaggtgctcgcgctggaaaccgccgactgcgacatcaccgccaacacgctgtgccccagctacgtgcgcacgccgctggtggagcggcagatcgccgaccaggcacgcacgcgcggcattgccgaagacgcggtgatccgcgaagtgatgctcaagccgatgcccaaaggcgccttcatcgagtacgacgaactggccggcaccgtggccttcctgatgtcgcacgcggcgcgcaatctcaccggccaggccattgccatcgacggtggctggaccgcgcaa

SEQ ID NO: 39031 - DNA, 603 bp, Xanthomonas campestris
cgccatttttcgatgctgcgcgactttcaactcgcagactggttcacgctggcaaacgccttttgcggcaccggggcggtgtttgcggccatgcggtttctgcaggaaggccaccgcggcgacctgttgctgggcatggcgctgattccgctggccttcgtcttcgatgcgctggacggccacgtggcgcgctggcgcaaggcgtcctcgacgctgggccgcgagctggattcgttggccgacgtgatttcgttcggcgtggcgccagccgcgctcggctatgcctgcggcatgcgcggcggctgggactggctggtgctcagttatttcgtctgctgcggcgtgagccggctggcgcgctacaacgtgaccgccgaagagatcgccggcgaggccgacaaggtgccgtatttcgaaggcacaccgatccccaccagcctggtgctggtgatcctgctggcggtggcggccagcaccgggcatatcggtcagacgttgtggtggggacagtggcagctcggcccgtggcagttccacccgctggtgctgctgttcgcggtgtccggctcgctgatgatcagcaagacgctgcgcatccccaag

SEQ ID NO: 39032 - DNA, 2562 bp, Xanthomonas campestris
gccacatccgccgcatcggccatcaccacccagctgccgcgtaccgccaggcccagccactacgcgatcgagatcaccccacatgccgagacgatgaccttcgacggtaaggtcagcatcgatgtcgaggtgctggcgcccaccgatgccatcgtgctgcaggccgcgcagctgaccttcggcaaggccacgctggccgcagcaggccgcaagccggtcgcagccaaggtcaccaccgacgcggatgcgcagaccgccagcattgccaccggcaagccactggcgccgggtaaatatgtgctgacgctggcctacagcggcaccatcaacacgcaggccaatggcttgtttgcgctcgattacaccactgcgcagggcgcgcgccgcgcactgttcacgcagtttgaaaactcggatgcgcgccgcttcgtaccctcgtgggacgagcccaacttcaaggccaccttcgatttggtcatcaatgcgcccgccgggcagatggcagtgagcaacatgccggtcgcctcgtccaagccgggtacaaacgggtgcacccgcgtggcgttccagacctcgcccaagatgtcgacctacctgctcttcgtgagcgtgggcgactttgagcgcgccaccgtcaaggccgataacggtaccgagatcggcgtcattgcgcagaagggcaaggtaggccaggcgcagtttgcgctggaatccggccgtgatgtgctgcacgaatacaacgactacttcggcatccaatacccgctgcccaagctggacaatatcgccgcaccagggcgcagccagttcttcagtgccatggaaaactggggcgcgatctttaccttcgagtacacgctgttgctcgatcctgcggtggccaacgtcagtaccaaacaaggcgtgttcactgttgcagcacatgagatcgcgcaccagtggttcggtaatctggtgaccatggcgtggtgggacgacctgtggctcaacgaaggctttgccaactggatggaagcacgcaccacggcaaaattgcatccggaatgggatatcgacaagaccggcccggcgcaaaaaagtcgcgcggccatgcgtcgcgatgcgtatgtcaccacccatccggtggtgcagcacgtggccaccgtggagcaggccagccaggccttcgacagtatcacctacgccaagggtgaggccgtgattgccatgctggaagactacgttggcgaggatgcctggcgcaccggcgtgcgcagctacatccggcagcatcagtacggcaatgcggtgaccgaccagttgtggcagcagatcgatacggtggcacccggcaagcaattcatccaggtggctcacgacttcaccctgcagccgggcgtgccgttgatcaaggccagcagccgttgcgtgggtggtcagaccacggtcacgctggagcagggcgagttcacgctggatcggcccgacaagcagccgctgcgctggcatgtgccagttgtgctgcgtggcggtgatggcaaacaggtgcgtgtgctggtggacggcactgcacaggtacagttgcctggctgcaaggtgccggtggtggtcaatgccgggcaaaagggctatttccgcacagcgtatgcaccgatgcagttcaaggcgctggccgcgggcttcagcgcattgccggtggtggaccagctgggcgtgttgaacgacaccaatgcactggccggcgcgggcgtacaaccggagacggacctgctgaatctcgcggcccaggtaaaggtcggcgcatcgccggatatctgggagatggtggccagcatctacgacagtgtggatggaagcttcgagcgtgaccaggctgcgcgcgctgcctggcgcgcgtacgccgtgccgcacctgtcggcggagttcgcaacattgggctgggacaatcgtgatgacgattcggcggagatccaacaactgcgcacacgcttgatcggcagcctcagcggcatgggcgatgcggccgtgattgccgaagcgcgccggcggtttgccgggttccaggccaaccccgcgtcgctgtcgcccgaactgcgcgacagcgtgctcggtgcggttgcgctcaatgccgatgccgctacctgggatgcgttacatgcgttggccaagcaggagacctcatcgatggtgcgcgacacctattacgactttctttccatggccgatgatcaggcgctggccaagcgcgcgttggaactggcgctgacagaggagccaggcgccaccaccggtgcgagcatgatcgaccgggtcgcctcccggcacccggagttggcgttcgactttgcggtggcgcatcgcgcacaagtagacatgttggtggattccacctcgcgtgcccgctactacccaagcctggggatggattcggccgacctcgccacagccaacaagatcaaggcctacgccgacacgtacatcgcgccaacctctcggcagaccgcagacaacgccatcaacacgattcagacgcgggtgaagctgcgggcggcgtcgctgccgcagatcaaagcgtggttggcc

SEQ ID NO: 39033 - DNA, 1296 bp, Xanthomonas campestris
cccgtcatgggtcagtcagttgtcgtgctcggtgcccagtggggcgatgaaggcaaaggcaagatcgtcgatctgcttaccgaggagatcggtgccgtcgtgcgtttccagggcggccacaatgccggccacaccttggtcatcaacgggaagaagaccgtcctgcacctgatcccgtccggcatcctgcgcgacgacgcgctgtgcctgatcggcaatggcgtggtgatctccccggccgcgttgatcaaggagatcggcgagctggaatcggccggcgtggaagtgcgttcgcgcctgaagatcagtccggccgcgccgctgatcatgccgtaccacatcgcgctggatcaggcccgcgagaaggctgctggcggcaaggccatcggcaccaccggccgcggcatcggcccggcatatgaagacaaggtggcgcgccgcggtatccgcatcgccgacctgcattacccggcgcagctggaagaactgctgcgcaccgcgctggattaccacaacttcgtgctgaccaagtacctgggcgtggaagcggtggatttccagaagaccttcgacgaagcactggcgttcggcgagtacgtgcagccgatgaagtccgacgtggccggcatcctgcacgacctgcgcaagcagggcaagcgcgtgctgttcgaaggcgcgcagggcgcactgctggacatcgaccacggcacctatccgtacgtcaccagctccaacaccactgtgggcggcgcactggccggcaccggcgtgggcgcggatgcaatcgactacgtgctgggcattgccaaggcctacgcaacgcgcgttggcggcggcccgttcccgaccgagctggatgacgaagtgggccagggcatccgcgaccgtggtgccgagtacggcgcctccaccggccgcccgcgtcgctgcggctggatggatatcgtcgcgctcaagcgtgcggtggccatcaacggcatctccggcctgtgcatcaccaagctcgacgtgctcgacggcatggaaaagctcaaggtctgtatcgcgtacgaataccgcggcaagcgcaccgaatacgccccgctggatgcgcagggctgggaagagtgcacaccggtgtacctggaattcccgggctggaccgagaacacccacggcatcaccgagtgggacaagctgcccgtcgccgcacgcgcctacctgcgcgcgctggaagaactggccggctgcccgatctcgatcgtctccaccggcccggatcgcgaccacaccatggtgctgcaggacccgttcgcc

SEQ ID NO: 39034 - DNA, 888 bp, Xanthomonas campestris
atggaattcaaggattactacgcgacgctgggcgtcgaaccgagcgctggcgaggcggaaatcaagaccgcctaccgccggcttgcgcgcaaatatcaccccgatgtcagcaaggaggctggcgcggaagacaagttcaaggcgatcaacgaagcctacgaggcactgcgcgacccgcaaaagcgcgccgcctacgaccaactcaaggcgcagggctaccgcccgggcgacgagttccagaccccgcccaacttcaacggcgggcagggcttcgactatgaggaagtgttcggcaacggcggcgccggcggcggcttcagcgatttcttcgaaagcctgtttgccggccagcgcggcggccgcccacgcggcccgggcgccggtgccggcccgggcgcacagacccgcggcgacacccgcgccaagttggcggtgccgctggaagcggtgtattccggcgacagcgtgcgcatcaccattaccggcaagcagctggacgtgcgcgtgcccaagggcatccagcccggccaggtgatccgcctgagcgggcagggcaacggcggcggcaacctgctgctggaaattgaacacgccgcgcacccgcagttcgaagtggatgggcgcaacatcctgtacacgctgcaggtgatgccgtggcaggccgcgctgggcaccaccatcagcgtgcctacgctgggcggtgcggtggagctgaaggtgccggccgattccgaggctgggcgcaagttgcgcctgcgcggccgcggcttgccgggcgccaccccgggcgaccagatcgtggagctggaaatcctggccccggcgcccaccgacgaggcgcagaagaaggcgtatcggacgctggccaaggccttcggcgaatcgatc

SEQ ID NO: 39035 - DNA, 2522 bp, Xanthomonas campestris
ttgtcctctccgtcgattgcccccgtcacccccgacctggtgcgcctgcgcgccactgcccgcgacaaggacgacgccattgcccaggccgcccagctgctggtggcagccggatgcgtggcgccgggctacgacgccagcatgcggcggcgcgaaggcctggcgaatactttcctgggccacggcctggcgattccgcacggcgtgggcgaagaccggcacctggtgcgccgcgacggcatcgcggtgctgcagctgcccgagggcgtggaatggaaccccggccagaccacccgcctggtggtgggcatcgccgcccagtccgacacccacatcaccctgctgcgccggctgacccgcctgatccaggatccggcccagctggaagcgctgttcaccaccgacgacccggccgtgatcgtggccgcgctgaccggcgaccgcgcacccgacaccagcgccgccccggccaccgacctggccgaacggttcgaatggaccatcgcctaccccagcggcctgcacgcgcgcccggccactcgctgggcggagaccgcgcgcggcttttcggcccgcgcccaggtccgcgccggtgaccaggccgccgatgccaagagcctggtcggcctgctgcaactgggcctgcgcgccggcgacagcattacggtctcagcgaaaggcagcgatgcccccgccctgctcaagcgcctgcgcgcggtgatggacagcctgaccgcgcaggaaaaggccgatgccgaacgtgccgcgcaacgccgcgccgcaccggtcatcggctggaccccgccgcaggcgcagccggccatcgtcggcatcggcgccagcccgggcgtggcaatcggcatcgtgcactgcctgcgtgccgcgcagaccgaggtggccgaccagccgatcggcctgggcgacggcggcgtgctgctgcatgacgccctcacccgcacccgccagcagctggccgccatccaggacgacacccagcgccgcctgggcgcctcggacgcggcgatcttcaaggcccaggccgagctgctcaacgacaccgacctgatcacccgcacctgccagctgatggtcgaaggccacggtgtggcgtggtcgtggcaccaggcggtggaacagatcgcctccggcctcgcggcgctgggcaacccggtgctggccggccgcgccgctgacctgcgcgacgtgggccgccgtgtgctggcccaactcgacccggcagcggccggcgccggcctcaccgacctgcccgagcagccctgcatcctgctcgccggcgacctgtcgccgtcggacaccgccaaccttgacgccgattgcgtgcttggcctggccacccgcccagggtgggccgaccctgcacaccgggatcctgtcgcgcacgcttggccttgcggcgcttgtccccgctggcggccaattgctggatatccaaaaacggcgtcaccgccatcatcgacggcagcagcgggcggctctacatcaacccgtcagaacaggatctggacgccgcccgcacgcatatcgccgagcagcaggccatccgcgagcgcgaagccgcccagcgcgccctgcccgccgaaaccaccgacggccaccacatcgacatcggcgccaacgtcaacctgcccgagcaggtggccatggccttgacccagggcgccgaaggcgtgggcctgatgcgcacagagttcctgttcctggagcgcggcagcacgcccaccgaggacgagcagtaccacacctacctggcaatggcacaggccctgaatggccgcccgctgatcgtgcgtgcgctggacatcggcggcgacaagcaggtggcgcacctggagctgccgcacgaagaaaacccgttcctgggcgtgcgtggcgcgcgcctgctgctgcgccgccccgacctgctcgagccacagctgcgggcgctgtatcgcgcggccaaggacggcgcacggctgtcgatcatgttcccgatgatcacctcggtgccggagctgatcagcctgcgcgagatctgcgcacgcatccgcgccgaactcgacgcaccggagctgccgatcggcatcatgatcgaagtgcccgccgccgccgcccaggccgatgtgctggcgcgccatgcggatttcttctcgatcggcaccaacgacctcacccaatacgtgctggcaatcgaccgccagaacccggaactggccgccgaagccgacagcctgcatccggcggtgctgcgcatgatccgcagcacgattgacggcgcgcgcaagcacgaccgctgggtcggggtgtgcggcggtctggccggcgacccgttcggcgccagcctgctggccgggctgggcgtgcaggaattgtcgatgacgcccaacgacattccggcggtcaaggcgcggctgcgtggcagggcgctgagcgccttgcagcagctggccgagcaggcgctgcactgcgagaccgcagagcaggtgcgtgcgcttgaagcacagcgcgagggccaggcatgagcc

SEQ ID NO: 39036 - DNA, 1404 bp, Xanthomonas campestris
atgacctgccgcacccgttttgcccccagccccaccggttacctgcacatcggcggcgcacgcaccgccctgtactgctggctggaggcacgtcaccgcggcgggcagttcgtgctgcgcatcgaagacaccgaccgtgagcgcagcacccaggtcgccatcgacgccatcctggaagccatggagtggctgggcctgggctacgacgaaggcccgatctaccagacccagcgcatcgcccgttaccaggaggtggccgagcagctgctggcgcagggcaaggcctattacgcctacgagacccgtgaggagctcgacgcgatgcgcgaggccgcgatggccaagcaggaaaagccgcgctacaacggcgccgcgcgcgagcagcagctgccgtatcgcgacgacccgaaccgggtgatccgcttcaagaacccgctcgcgggcacggtggtgttcgacgacctgatcaagggccgcatcgagatcgccaacagcgagctcgacgacatggtgatcttccgcccggatggctaccccacctacaacttcgcggtggtggtggacgactgggacatgggcatcaccgaggtgatccgcggcgacgaccacatcaacaacaccccgcgccagatcaacatctacgaaagcgctgggccgcaccggtacccaagttcggcgcacatgccgatgatcctggacgagcagggcgccaagctctccaagcgcactggcgcggccgatgtcatgcagtacaaggacgccggctacctgccgcatgcgctgatcaattacctggcccgcctaggttggtcgcatggcgaccaggagctgttcagccagcaggagttgctggacctgttcgacgtcaaggacgtcaattccaaggccgcgcgcctggacatggccaagctcggctgggtgaatcagcattacttgaagaccgacgacccggccagcatcgcgccgcagctggaataccagctccgcaagctgggcattgatgtggccgccggcccggccgctgccgatgtggtggtggcgctgcgcgagcgcgtgcagacgctcaaggaaatggccgaaaaagccgtggtctggtaccagccgctggaaacctacgacgaagccgcggtgatcaagcacctgaaactgggcgcggaagtgccgctgggcaaggcgcgcgagatgctcgctgcgctgaacgagtggagcgtggagaacgtatcggcggcgctgcatgccgctgccgcggcgctggaactgggcatgggcaaggtggcccagccgctgcgggtggccatcaccggcacccaggtcagcccggacatttcgcagacggtgtacctggccgggcgcgagggtgccttgaaacgcatcgatgcggcactcatcaagattggagcggcc

SEQ ID NO: 39037 - DNA, 771 bp, Xanthomonas campestris
acagcgcaccgctggcggctggatggacagaccgccctgatcaccggcgccagtgccggcattggcctggccatcgcacgcgaattgctcggcttcggcgccgacctgctgatggtggcgcgcgatgccgatgcgctggcgcaggcccgcgacgagctggccgaagagtttcccgagcgcgaactgcacggcctggccgcggatgtttccgacgacgaggagcgccgcgcgattctggattgggtcgaagatcacgccgatggcttacacctgctgatcaacaatgccggtggcaacatcacccgcgcggccatcgactacaccgaagacgaatggcgcggcatcttcgaaaccaacgtgttttccgcgttcgaactctcgcgctatgcgcacccattgctgacccggcacgccgcctcggcgatcgtcaacgtgggcagcgtgtcggggatcacgcatgtgcgcagcggcgcgccgtatggcatgaccaaggccgcgctgcagcagatgacgcgcaacctggcggtggaatgggccgaagacggcatccgcgtcaacgcggtggcgccgtggtacatccgcacccggcgcacctccggcccgttgtccgatccggactactatgagcaggtgatcgaacgcacgccgatgcgccgcatcggcgagccggaagaagtcgccgccgcagtgggtttcctgtgcctgccggcggccagctacatcaccggtgaatgcatcgcggtggatggcggcttcctgcgtcatgggttc

SEQ ID NO: 39038 - DNA, 1500 bp, Xanthomonas campestris
aacggattcgacgcgcttcacgcccacgcccagcgcctgcgcggcgttgccatccccacattgcttgccgcagagccccagcggcccacgcagtacgcccggcaagtcggtccgttgtatttcaacttcgcgcggcagaaatacgatcgcgccgcgctcgatgcgctgtttgcaatcgcacgcgagcgtgacctggcaggcgcattccagcggctgttccgtggcgagcaggtcaatgtcaccgaaaagcgcgccgccctgcacaccgcgctgcgtggtgatctcaccgatgcaccggtcgcatccgatgcatacgccaccgctgctgaggtccggcatcgcatgggcgcgctgatccagcagctggaaggcaccgacgtcaccgacattgtcagcgtcggcatcggtggttcggatctgggcccgcgtctggtggccgatgcattgcgtgcaccgtccggcgcgcgtttccgggtgcatttcgtttccaatgtcgatggcgcggccatgcagcgcaccctggcaacgctggacccggcacggaccgccggcatcctgatttccaagactttcggcacccaggaaaccctgctcaacggcagcatcctgcatgcgtggctgggtggcagtgagcgcctgtacgcagtgagtgccaatcccgaacgtgccgccaaggcgttcgacattgcacctggccgcgtgctgccgatgtgggactgggtgggcggccgctattcgctgtggtcggcggtcggtttcccgattgcactggcgatcgggttcgagcgcttcgagcaattgctcgacggtgccgcgcagttcgacgcgcatgcgctcaacacgccgctggaagaaaacgtggcggtgctgcacgggctgaccgcggtgtggaaccgcaacctgctcggtagcgccacgcatgcggtgatgacttacgaccagcgcctggccttgctgcccgcgtatctgcagcagctggtgatggagagcctgggcaagcgcgtcaagctggacggctcggccgtggacagcgacaccgtggcggtgtggtggggcggtgccggcaccgacgtgcagcacagcttcttccaggcgctgcatcagggcaccagcgtggtgccggccgatttcatcggcaccgtgcacaacgacgacccgtacgcagaaaaccatgtcgcgctgatggccaacgtgctggcccagaccgaggccctggccaatggccaggacagcagcgatccgcaccgcagttatcccggcggtcgcccgagcacagtgatcctgctcgatgcactcaccccgcaggcgctgggtgcgctgatttcgatgtacgagcacagcgtgtacgtgcagtcggtgatgtggggcatcaacgcgttcgaccaattcggtgtcgagttgggcaagcagttggccagccaattgctgccagccctgaagggcgaggccgccgatgtggccgacccggtcacgcgcgagctgttggccaagctgcgcggc

SEQ ID NO: 39039 - DNA, 2103 bp, Xanthomonas campestris
atggccaagtcccccagcaagcccgcacagattccttctgtcggcagttccgcaagcgcgcatgagttgcgcggcaccggcgacgaactgcaccagaaggctggcggctcgcatccgcaactgaccaccaaccagggcattcccgttggcgacaaccagaactcgctccgcgccacaccgcgcggcccgacgttgctggaagatttcatcctgcgcgaaaagatcacgcacttcgaccatgaacgcattcccgagcgcatcgtgcatgcgcgcggcagcgcggcgcacggctacttcgagctgaccaagtcgctgagccagtacaccacggccaagctgctcaccgaagtgggcgaaaaaaccccgctattcacgcgtttttccaccgtggccggcggcgccggttcggtcgatacgccgcgtgacgtacgcggcttcgcggtgaagttctataccaaggaaggcaactgggatctggtcggcaacaacatcccggtgttcttcatccaggatgcaatgaaatttccagacctcatccacgcggtgaagatggaaccggaccgcggctttccgcaggccgccagcgcgcacgacacgttctgggatttcatctcgctcacccccgagtcgatgcacatgatcatgtgggcgatgagcgatcgcaccattccgcgttcgctgcgcatgatcgaaggcttcggcatccacagcttccgcctgctcaacgaaaacggcgacagtacctttgtcaaattccattggcgccccaagctgggcctgcagtccaccatctgggacgaggcagtcaaacttgccggtgccgacccggacttccagcgtcgcgatctgttcgaggcgatccagaagggcgacttccccgagtgggaattgggcgtgcagctgtttaccgaagccgaggccgaagcattcccgttcgaccacctggattcgaccaaggtcattccggaagagctggtgcccttgcagatcgtcgggcgcatggtgctggaccgctggccggacaacttcttcgccgaaaccgagcaggtggcctactgcccggccaacatcgtgccggggatcgacttcagcaacgacccgctgctgcagggccggctgttctcctacctggacacgcagctgagccgcctgggcgggcccaacttccatcagattccgatcaacgcgccgaagtgcccgttcgccaacaatcagcgcgatggtcacatgcagatgggcgtgccgaagggccgcgtggcgtacgaacccagctcgttgcaggccgatgcgccacgcgaagcgctgcgcggtttccccagccatgccacaccggccgaggatggcgccaagggccgcgtgcgtgcggaaagttttgccgaccattacagccaggcacgcatgttcttccgcagccagaccgcgccggagcaagcgcatcttgcatctgcactggtgtttgaactctccaaggtggaaaccgcgcacgtgcgcgaggccatcgtgggacatctgcggcatatcgatgaagcgctggccaagcgcgtggccgatggcatgggcatgaccagcctgccgccggcaccgccggccgccgttgcaccgaccgacatgcagttgtcgcctgcgctgcagttgatcggcaagatgaaggacacgctgcagggccgcaccgtgggcatcctgatccacgacggctccgacgccgcggcaatcaaggctgtgcgcaaggcggccgaagcggccggtgcaacggtcaagatcgtggcccccaagctgggcggcgccaagctcagcgatggcaagcaactggcggccgatggccagctggccggcacgccgtcgatcgtgttcgacgcggtggcggtgttgctgtcttcggaagcggccaaggcgttgacgcgcgaatcggcggcgctggattttgtcagcaatgcctgggcgcatctgaaggcgattgctttcgacgacggcgcgcaactgctgctcaaggccggcaatgtcggcaaggaccccggcgtggtcgatgcggccgacaccaaggccttcattaccgccgccaagacccgccaatgggcacgtgagccgaaggtgcgcatgctggcg

SEQ ID NO: 39040 - DNA, 819 bp, Xanthomonas campestris
gtgaccttgcgcaacggacgcagcgtgcctgcgctgggcatgggctcctggaacctgggccagggacggcatgcgccgcagcaggagatcgaagcactgcagaccggccaggcgctggggatgcgcttgatcgataccgccgagatgtacggcaatggccgctcggaacagttgatcagccaggtgatcgcacgcgggcagccgccgtatctggtgtccaaggtgctgcccagcaacgccagcgcgcgcggcattgcgcgtgcctgcgaagccagtctgcaacgcctgggcgtgcgcacgctggatctgtatctgctgcattggcgcggaggcagcgatctggcggaggtggtcgctgcattcgaaacactgcgcgatgcgggcaagatccgtgactggggcgtgtccaatttcgatgtcgacgacatgcaggagctctggcagatcgatggcgggcagcactgcctggtgaatcaggtgctgtatcgcgccggcagccgcggcatcgagttcgatctgttgccgtggtgcgcgcaacatgcggtgacggtgatggcgtattcgccgctcggcagccgtgcgttgctcgatcacccggtgctgcatgccatcggtgcgcgacgcggcgtagcggctaccgcggtggcgctggcgtgggccatccgcagtggccaagtgatcgccattcccgaatccggtacgccagcgcatgtccgcgccaatgcagatgcatgcacgctgcaactcgatgcgcgggatctggcagacctggacaacgcattcccaccgcccacgcgcaagcagccactggatctgctg

SEQ ID NO: 39041 - DNA, 1101 bp, Xanthomonas campestris
ttctccgcgctgccgctctcgccagccttggcccccggcatcgatgccctgggctacaccaccctcacgccgatccaggcgcagagcctgccgccgatcctccaggggctggatgtgattgcccaagcgcccaccggcagcggcaagaccgccgcgttcgggctgggcctgctgcaaaagctcgacccggcactgacccgtgcgcaagcgctggtgctgtgccccacgcgcgaactggcagaccaggtcggcaagcaactgcgcaagctggccaccggcattcccaacatgaagttgctggtgctcaccggcggcatgccgcttggtccgcagctggcatcgctcgaagcgcacgacccgcaggtcgtggtcggcacgcccggccgcatccaggaactggcgcgcaaacgcgccctgcatctgggcggcgtgcgcacgctggtgctggacgaggccgaccgtatgctcgacatgggctttgaagaacccatccgcgagatcgccagccgctgcgacaaacactgccagagcctgctgttctcggcgaccttccccgacatcatccgcacgctggcgcgcgagctgttgaaggacccggtggaaatcaccgtggaaggtgcggacaacgcaccggagatcgaccagcagttcttcgaagtggaccccacttatcggcagaaggcggtggccgggctgctgctgcgcttcaatcccgaatccagcgtggtgttctgcaatacccgcaaggaagtggacgaagtcgccggctcgctgcaggagttcgggttctccgcgctggcattgcatggcgacatggagcaacgcgaccgcgacgaggtgctggtgcgcttcgtcaatcgcagctgcaacgtactggttgccagtgacgtggccgcgcgcggcctggatgtggaagacctcgcggcagtggtgaattacgagcttcccaccgacaccgaaacctatcgccaccgcatcggccggactgcgcgcgccggcaagcacggcttggcactcagcctggtggcgccgcgcgaaagcgctcgtgcgcaggcgctggaggccgagcacggccagccgctcaagtggtcacgcgcaccg

SEQ ID NO: 39042 - DNA, 450 bp, Xanthomonas campestris
atccgcgacatcgccgattttcccaagccgggcatcgtgttcaaggacatcacgccactgttgtccgatggcccggatttcgcttctgcgctagatgaaatggcgcaaccctggcgcaccaccccgctggatgcggtgctgggtatcgaggcgcggggcttcattctgggcgcggcgttggcgcgcgaactgcgcaccggcttcgtgccggtgcgtaaaccgggcaaattgcccgggcgcacgttgattcaggagtacgcgctggaatacggcaccgaccgcatcgagatgcatgaggatgcgctgccgcgtggcgcacgggtcttgattgtcgacgacgtgctcgccaccggcggcaccctgcgtgcggccttgggcctggccgcgcagctggagctggaaatcgtcggcgcggcagtgctggtcgagctgctggccctgcagggccgc

SEQ ID NO: 39043 - DNA, 846 bp, Xanthomonas campestris
taccgcggccgcttcgcgccctcgcccaccggccccctgcacttcggctcgctcctggctgcgttgggcagctggctgctcgcgcgccatgccggtggcgaatggcatgtgcgaatcgaagacatcgacccgccgcgtgccgagccaggcgcctcagagcgtcaattgcatacgctggctgcgttcgggctgcaccctgacgggccagtgctatatcagtccgaccgtgatgcgcattacgaggcggcactgtcgcggctgctgcgcaccggtgcggcgttcgaatgcagttgcagccgcgcagagctggccgtgatgggtggcatccaccacgtctgcgtggcgccactgggcatccgccgggccgtgcgcctgcgggtgccgccgaacacccaggcaagcttccaggacgcgctgcaggggcgcatcacccaggatgtgtacgccgaggtgggcgatgtcgtgctgcgccgtgccgacggctactgggcctaccagctggcggtggtggtcgacgatgcggcgcagggcatcaccgatgtggtgcgcggggcggacctgctcgactccaccccgcgccaattggtgctgcagcaggccctgggcgtggcaccgccgcgctatctgcatctgccgctgatcctgggcgccgacgggcgcaagctttccaagtcgcatgcggcgcaaccagtggatgacagcgacccgctgccagcgctgcgcgcggcctggcgggcgctgggccaggcaccggcggccctgcccgcgcgcgcatcggtggccggtgtgctgcagcatgctgtgcagcatttttcgccgcagcggctgccgcgcgttgccagcctg

SEQ ID NO: 39044 - DNA, 669 bp, Xanthomonas campestris
atgacatctcgcgtcgcgttggtcaccggcggcaccggcggtatcggtaccgccatctgcaagcgcctggccgaccagggtcaccgggtcgccagcaatttccgcaacgaagaaaaagcacgcgagtggcagcagcgcatgcaggtccaaggctacgaattcgccctgtttcgtggggatgtggcctcgtccgaccatgcgcgcgcgctggtggacgatgtggaagccgcgctcgggccgatcgaagtgctggtcaacaacgccggcattacccgcgacaccacgttccatcgcatgaccgccgagcagtggcacgacgtcatcaacaccaatctcaattcggtgtttaacgtgacccgcccggtgatcgaaggcatgcgcaagcgcggctggggccgggtgatccagatcagctccatcaacgggctcaaaggccagtacggccaagccaattacgccgccgccaaggccggcatgcatggtttcaccatctcgctggcgcgcgaaaatgcggccttcggcatcaccgtcaacacggtgtcgccgggctacgtggccaccgacatggtgatggctgtgccggaagaagtgcgcgccaagatcgtcgccgatatccccaccggccggcttgggcggccggaggaaattgcgtatgcagtggcgtttctg

SEQ ID NO: 39045 - DNA, 1530 bp, Xanthomonas campestris
tggtggcgcggggccgtcatttatcagatttatccgcgtagttttctggattccaatggcgatggcgtaggcgatctgccgggcatcattgccaagctcgactacatcgccgggctgggagtagatgcgatctggatttcgccttttttcaagtcgccgatggccgatttcggctatgacatcgcagactatcgcgcggtggacccgttgttcgggtcgttggtcgatttcgatcgcttgctcgaaaaggcacatggccttgggttgaaagtgatgatcgatcaggtactgagccattcctcgatcgcgcatgtgtggtttcaggagagccgacaggaccggagcaacccgaaggctgattggtacgtgtgggccgatccgcgcgaggatggaacgccgccgaacaactggctgtcgttgtttggtggggtcgcatggcagtgggagccgcggcgtgagcagtactacctgcacaactttctggtggaccagcccgatctcaatttccacaacgccgaggtgcagcaggcaacgctcgataacgtgcggttctggctcgatcgcggtgtggatgggttccgtctggatgcgatcaacttctgctttcacgacgcgcaactgcgcgataacccggccaagccggcagacaagcgggtggggcgcggcttcagcgcggacaatccttacgcctaccagtatcattacttcaacaacacgcagccggaaaatctagcgttcctcgagcgcctgcgcgggctgctggatctttatccgaatgcagtgagccttggcgagatctcgtcggaagattcgctggccaccaccgccgaatacaccgcccagggccgcttgcatatgggctacagcttcgagctgctggtgcaggattacagcgctgcctacatccgcgacaccgtaagccggctcgaggccaccatgttggagggctggccatgctgggccatttccaatcacgacgtagtgcgcgcggtaacgcgctggggtggggcgcatgcgacgccggcgttcgcgcggatggtggtggcgctgctgtgttcgctgcgtggatcgatctgcctatatcagggcgaagagctcgggctcagtgaggcagaggtggcgttcgaggacctgcaggatccgtatggaataactttctggccgaccttcaagggccgggatggctgccgtacgccgatgccatggaccgacgcgccatctgccggattcaccagcggcaagccttggctgccgttagctgcgtcgcatcgtgccgctgctgtgagcgtgcaacaggatgatgcgcattccgtgttgagtgcagtacgggattttctagcttggcgcaaagagatgccggcgctgcgtgagggatccatcgctttctacgacacggccgaaccggtgctgatgttccgccgcgaacacgccggccaggttgtgctgttggcattcaatctgtccgccgatcctgccgacctggctttgcctgcaggcgagtgggagcaggtcgatgtacctggtgtcgag

SEQ ID NO: 39046 - DNA, 1011 bp, Xanthomonas campestris
ctggccctgctcgccacgttgccgttggcgcatgccaaggaggcagacaacgcccgcggcggattgaagtacgtgggcgtcaacatctccggcgccgagttcaactcgcgcaagaagcccggcacgctctacaaggactacacctacccggcggcggcggatttcagctatttcgccagcaagggcatgaacaccattcgcttgccgttcctgtgggagcgcctgcagccaaccctcaatggcgagctggatgcggcgcaactggcgttgatcaaaaaatccgtggccgccgccaaggccaacaagcagttcctgatcctggacctgcacaactacgccaagtacaacggaaagcgcatcggcaccgacgaggtgccgcctgcagcactggccgatctgtggcgccgcctggcgctggagttcaaagacgacaagcaggtgatcttcgggctgatgaacgagcccaatggcatctcctccaccgactgggccgcggccgcacaagcggcgatcaacaccatccgcaagaccggcgcgaacaatttgattctggtgcctggcacggcctacaccggcgcgcacagctggcgcagcaccagctacggcgtctccaatgccaaggccctgcagattctcaaggaccccggcaacaatctggccttcgaagcgcatcaatacctggacggcgactacagcggcaccaagcccgaatgcaccagtgccacggtgggcgcagacaagttgcgcggctttaccgactggctgcgcgagaacaagcagaaaggcttcctgggcgagttcggcacggccaacaatgcggtctgcaacgacgcgctgaaaggcatgctgagctacatggaaaagaacagcgacgtgtggctgggctggacctggtgggcggccggcgcgtggtggaagccggactacccgttcaatgtgcagccgggcaaggacggcagcgagaagccgcagatgtcgatcctgagcgagcacgcgcgtcgcgccggcaag

SEQ ID NO: 39047 - DNA, 1035 bp, Xanthomonas campestris
cacgcctacgccgcccaaaccgccgaccagccgctggcgccgttcgtcttcgaacgtcgcgcgcccggtcccgacgatgtgcagatcgacatcgcctactgcggtgtgtgccactcggacctgcacaccgcacgcaacgaatggcacaacacggtgtatccctcggtgccgggccacgagatcgtgggccgcgtcactgccgtcggcagcgccgtgaccaacttcaaggtcggtgacctggccggtgtgggttgcatggtcgacagctgccgcagctgctcctcctgccaggaaggcgaggagcaatattgcgaacagggcttcaccggcacctacaacggcccgatgtttggcggcggcgagaacacctatggcgggtactccgaccatatcgtggtggaccagaagtacgtgctgcacatttcccacagcgacaacctggccgccgtggccccgttgttgtgcgcgggcatcaccacctattcgccactggcgcattggaaggttggccccgggcagaaggtgggcgtggtcggcctgggtggcctgggccacatggcggtgaagatcgccaaggccatgggcgccaccgtggtgctgttcaccacctccgaaagcaagcgcgccgatgcgctgcgcctgggcgccagtgaagtggtcatttccaaggacgaggcgcagatggccgcgcagtacaacaccctggatttcatcctcaacaccgtggccgcgccgcacaacctggacccgttcctcaatgcgctcaagcgcgacggcgcgatggtgctggtgggcgtgcccgaacattcgcatccgtcaccggcggtgttcaacctggtaatgaagcgccgcacgctggccggttcgttgatcggcggcatccgccagacccaggaaatgctcgatttctgcgccaagcacaacatcgtctccgacatcgaaaccatccgcgccgaccagatcaacgaggcctacgagcgcatgctcaagggcgacgtgaagtaccgcttcgtaattgatatggacacgctggcc

SEQ ID NO: 39048 - DNA, 1605 bp, Xanthomonas campestris
acgtttcaggccagcgcagcacgcccgcatgggctagacgttgccgataccgcgcacagcatctccaccagttggggtgtcgtgcagcagcccgcgctccccagccaggtctgcacaacgctcaaggctgcgctggtgccggttgccggctcgctggatgcgctcgaccaggatcccacccaatccaaacgcgacaccgcacgcctgcaggccgccatcgacgattgccctgccggcagcgcggtgcgtctggtggtcggcgatggcggagaatccggcctgttgagcggcccgctcaccatcaagagcggcgtgacgttgtggatcgatcgcggcgtgaccttgttcggctcgcgcaatccgcaggattacgacaatggcctgggcacctgcggcaccgccaccaccgacaaggccaagtcctgcaacccgttgatccacgtcgccgacactgccaagagcgccatcgtgggcgccggcaagatcgacggccgcggtggcagcacgctcaccgcgggaccgaatgccggcaaggccagctggtgggatctggcctatctcaacgtcaccaagggcctgagccagcacgtgccacggctgctgcagatcgatgacagcaccgacttcacgctgtacgacatcaccctggaaaactcgcccaatttccacgtcaccaccgacaacgtggtgggcctgaccgcctggggcatcaagatcctggcacctagcctggtgtattcgcgccccggctaccactgccctgccggcagcaccccggacgtcaatccgcacgccagctgctttaccccggaaaccgtcaagaacaccgacggcttcgaccctggccaatccaagaacgtgctgctggcgtactcgtatatcggtaccggcgatgacggcgtggcgatcaaggcgcatgccaaaaacaagcgcagcatcgcctcggaaaacatgctgttcgcctacaaccagttctactacacgcacggtttttcgctcggcagcgaaaccgattcggggatgcgccatatcgccgtgcgcggcttgagcatcgacggcttcaacgccaacgacgtgcagcgcgatccctactcggccaatggcctgcgtatcaagtccgatgcttcgcgcggcggccaggtctacgacatcagattcgagaacatctgcatgcgcggggttgcgcggccgctggtattcgacgccaactacgccaacccggccacacgcgaccagttgccgcggttcagcggcattgcactgaccaatgtgcactccctgggttccaaggccttcggtggcggcgaattgagcttctacggctatcgcgatgcgaccaccaccctgcccatcaccatgtcgctggacaacgtggtgctcgacggcggcccggtcgcctttgcgcagccgcattttggtggaccggccagcaacccgggcgcggtgcacttcaccttcaaaggcgggccggtgagcttctttgatcagctcaccgagtcggcggccaacgatgtgcagttgcagggccggcccgggccgggcgcgccgttgcaatgcgacgatgccttcattgcgtaccacagcgtgctgcccgactcaccgatc

SEQ ID NO: 39049 - DNA, 1136 bp, Xanthomonas campestris
agcctgatcagccttgatgctgctgccctcaccggcaccgccagccgcccgcagctcaccagcagcgaagcaagcacgtatacgatcagcaaggcgctcgccaaggccggcccgatcacagcgttggtgaccgacaactggaaccccaccgccggcgtggcgctgctgaccgccgactttgcagtggccgccgatggctccacccgttatcgcacggtgcaatcggcaatcgatgcggcggtggccgccggtggcagcacgcgccgctatatcagcgtcaaggccggcacttacaacgagctggtgtgcgtgccgagcggtgcaccgccactgaccctgttcgggcttggcagcgccacgaccgataccgtcatccgctacaacaacgccaaccccacgcccaagccaaccggcaccgcaagtcacccctgcgccagcaatgcgtcagccgccacagtgggcacttccaatagcgcgacggttaccgtgcgtgccagcggcttccaggcacggcatctgcgctttgacaataactatgtcgaaggcacttacgccgacaacaatcaatcggcagtggcactggccgtgcgcggcgaccaggccagcttcgaggacgtgctggtcaccggcaaccaggacaccttgctgatcagcgcgaccaacgccgccaacgtgatccgcgcctatttcaagagcagcacgatcgaaggcgatgtcgatttcatcttcgggtccggcatcggcgtgttcgacaacgcaatcattcgctcggccggcgcgcgcctgggcagcagccgtggtggctacatcttcgcgccaagcacgcgcccgggcagcggctacggctttctggcgatcaacagccgcttcgtagcgggctccggttcgccggacaatcaaacctacctcgggcgcgcatgggacgaaggcgttagtggcctgtccgcgtacgtcaacggcacctcgcccaatggccaggtgaccatccgcgattccacgctgggcagccacatccgcaagaccgcgccatggaatgcctccaccgccagccgcccgttctgcagcagcaactgcaccaactcggccaaccgctttttttcgaatacggcaacagcggtgctggcagtgccgactga

SEQ ID NO: 39050 - DNA, 747 bp, Xanthomonas campestris
gtgacccgcaaactcgtactgctgcgccatggccagagccaatggaacctggacaaccgtttcaccggctgggtggacgtggatctcaccgagcagggccgccaggaagccgccgcggccggcaagctgatgaaggacgaagggctgcagttcgatgtggcgtacacctcggtgctcaagcgcgccatccacacgctgcagggcgcgttgaaggagctcgaccaggattggttgccagtgcacaagagctggcgcctcaacgagcgtcactacggtggcctgcagggcctggacaaggcagaaaccgcggccaagcacggcgaggaacaggtcaagatctggcgccgttcctacgacatcccgccgccggccatggacgtcaccgatccgggccaccccgggcatgaccgccgctatgccacgctggaccgcaatgcattgccgggcaccgagtcgctggcaactacgctggtgcgcgtgctgccttactggcacgacgcgatcgcgccgcagttgaaggccggccagaccgtgctggtcaccgcgcacggcaactcgttgcgcgcgctgtacaagtacctcaacgacatctccaacgcgcagatcctggagctcaacatccccaccggcatcccgctgttgttcgagctggacgacaacctgcgggtgcagagctaccgctacctgggcgacccggaggcggccaagcgcgccgccgaagccgtggctaaccagggcaaggccaag

SEQ ID NO: 39051 - DNA, 2085 bp, Xanthomonas campestris
aagttcgccccgctgtccctggcggtggccatcgccgtgacgctgtccgcgtgcggcgcctccgacgacaccagcaagccggccgccgccgcacctgcagcgccgacgcgcgtggatgtgtccaagctggatgcgccgatcgtggccttcggcagcggcgatctggatccggccattgccgcatgccaggacctcaacgggttcgtcaacgccaagtggctcaaggccaacccggtgccgtccgaccgcaccagctggggcagtttcgaagtgctggccgagcgctcgttgaccatccagcacgcgctggtggaacaactggcgcgcggcaatctgtccgcaggttcggtggatgccaagatcgccgacctgtggcggaccggctcggacgaggcggcgatcgacaaggccggcatcaccccgctgcagccgcagctaaaggcgattgatgtgcttagcgatgcgccggcgattgccgcctggttgcgcgacagctatgccaagggccagggctttttgttctcgttcggcgccaatgccgactacaagaattccgagcagatgattgcgtatgcggggcagggcggtctgggcctgccggagaagggctattacaccgatccggcccaggccaagatccgcgaacagtacgtggcctatatcgcccgcgtgctggagctgtccggcattccggcagcgcaggcggccgaacaagccaaggcggtgatggcattcgagacgcagctggccaatgcctcgctctcgcgcatcgagctgcgtgacccagccaagcgctacaacccggtcgatgtggcgggcgccaatgccatcacgccgcacttcgattggcaggcgttcttcaatgcactgaaggtgccggccggcaccttctcgctgagccagccggagtatttccgcgcgctggacggcatgctcgtcaacacgccggcggatacgtggaaggcatatctgcgcttccacagcatcgatgaggcagcgccgtacctggccaagccgttcgagcaggccaacttcgatttctatgccaagacgttgcgcgggcagcaggacatgctgccgcgctggaagcgcaccttgaacgcggtcaacgaggccatgggcgaggcactgggccagctctacgtgcaatcggcattcccggccgagtcaaaagcgcagatgcagcagctggtgcagaacctctccaacgcgctgaaggcgcggctggagaagctggactggatgagcgcgcagaccaagcagcgtgcactggaaaagtgggccagcttcacgcccaagatcggctacccggaccagtggcgcgattggagcgggctggaaacgcgcggcgacgggttcctggccaatatgcaggccgcgcaggcgttcaattaccgctacatgctcgacaagatcggcaagccggtggacaagcgcgagtggcatatgacgccgcagaccgtcaacgcgtactacaacgccacccgcaacgagatcgtgttcccggcggcgattctgcagccgccgttcttcgatcccaaggccgacccggcgctcaattacggcggcatcggtgcggtgatcgggcacgagatgatgcatggctatgacgactccggcagccagttcgatgccaagggcaacttcgacacgtggtggaccgacgccgaccgcaagctgttcacccagcgcaccgatcagctggtggcgcagttcgatggctatgaggcgatccccggcgtgcacgtcaaaggcaagctgaccctgggcgaaaacatcggcgacctgggcggcctcaccgtggcctacgacgcgctgcagatggcgttgcaggaacagccggccgccaacaaggagatcgacggccatagccaggaccagcgcttcttcatgaactgggccacggtgtggcgccgcaacttcaccgacggcgagctgcgcgtgcgcctcaacaccgacccgcatgcgccggccaacttccgtgccaacggcgcgccgtccaacatgccggcgttcgcacaggccttccagtgcaagccgggcgatgcgatggtgcgcggcgacaaggaccgcgtagcgatctgg

SEQ ID NO: 39052 - DNA, 828 bp, Xanthomonas campestris
ggcgaaggcgtgctgtggtgcgagcagcgtgaagcgctgtattgggtggacatcagcgaaaaacgcctgtggcggcatcatccgggcagcgcgcagacgcgcttctggacactgcccgaccgcccgggctgcatcggcctgatggacgatggccgcctgctgatcgcgctggccaaggccatctgcatcgccgacccggacaatgccgacggcgacacgctgccgctcgaccatctggccgatgtcgaagccgacaacccgctcacgcgcagcaatgacggccgcgccgatcgccatggcaacttcgtgttcggcaccatggacgagcacgaagacaaggccgggcgcggggcgatgtaccagttctcgctgcgccacgggctgcgtcgtctgccgttgccgggcgtgtccattcccaactcgatctgcttcagcccggatggccgcacgctgtactactgcgattcggtgcgcccgcagatcctgcgctgcgattaccacccggacaccgggcaaaccaccaacacgcgcgtgtataccacgctggatcgcgacgacgcccagccggatggctccatcatcaacaacgccggccacctgtggaacgcgcactggccctcctggcgcgtgctgcggtatcacccggacagcagcgtgaagcgcatcgtgcacatgccagtgaagcaccccacctgcagtgccttcggcggtcccgcactggaccgtctgcacgtgatcagctcgcgcctggaccatagcgatgccgagctggcacagaccccgcaggccggcggcctgtacctctgcgacctgccggtgcgcggcctg

SEQ ID NO: 39053 - DNA, 1749 bp, Xanthomonas campestris
ctgtcgctgtggtccgaggccgggcagatgatcgactactacttcgtctcggccgactcctacgaccaggccgtggccggttaccgcgaactcactggcaagtcggtgatgctgccgaagtgggcgtatggcttctggcagagccgcgagcgctacaagagccaggacgaactggtgggcgcggtggccgaataccgcaagcgcaagctgtcgctggacaacatcgtgctcgactggtcgtactggccggaaaacgcctggggctcgcatgatttcgatccgcagcatttcccggacccggacggcatggtcaaggccgtgcacgacatgcacgcgcagatcatgatttcgatctggcccaagttctatcccaccaccgtcaactacaaggaactggacgcggcgggtttcatgttcaagcgcaacgttcaagtccccgagctggactggatcggcaagggctacaagatctcgttctagtacccgtactccgaaaaggcacagaccatctactggcgccagatcaacgaaaagctcaacagcaagggtttcgatgcctggtggatggacgccgacgagccggacgtgcattccaacctggatatcggtgagcgcaaggcacgcaccacgccgaccgcgttgggcccttcaaccgagttcttcaattcgtatccgttgccgcacacgcacggcgtgtacgtgggtgaccgtgcggccgacgacaagcgcgtgttcatcctctcgcgcaagggctatgccggcacgcagcgcaatgcggtggcggtatggagcggcgacatcgtctcgcgttgggacgacatgcacgaccagatttccgccggcgtgaacatggcgctgtcgggcctgccgaactggaccttcgacatcggcggctttgcggtggagaagcgttacgaaaaccaggacccggcgcatctgccggaatggcgcgaactcaacacgcgctggttccagttcggtgcgttcgtgccgatcttccgctcgcatggccagttcccgtaccgcgagatctggaacatcgccccggaaggcacgccgttctacgagagcatggcctactacaaccgcctgcgttacgccctgctgccgtacatctacagcctggccggcgatacctaccagcgtgacggcgtgatcatgcgcggcatgatgatggacttcccggatgacgcgaaggcacgcgacatcaacgaccagtacctgttcggcccggcattcctggtcgcaccggtgacccgcttcggcgcgacctcgcggcaggtgtatctgccggccggcagcagctggctggatttcgccactggtaagcgctacgagggtggccagaccatcgaggccgccgcgccgatcgaacgcatgccgctgttcgtgcgtgccggctccatcgtgcccaccggcccggtgcaggagtacgttgaccagaagccggatgcgccgctcaccgtggtggtctacacgggtgccaatggtcagttctcgttgtatgaggacgacggcaaaggctatggctacgagaagggcgagttcagccgcattccgctgagctgggaccaggctaagggcgagctgcgcatcggccagcgcgaaggcagctggaccggcatgcaggccaagcgcaccatcaatgtgcgttttgtcgacggcccgcgtgaggacgccggtgcgctggagcccaaggtggacaccagcatccagtacgacggcaagccggtcagcgtgttgcagcgc

SEQ ID NO: 39054 - DNA, 1344 bp, Xanthomonas campestris
atgtccgacccgtccgcgcccgatcatctgcaacgcagtctgtccaaccgccacctgcaactgatcgcgatcggcggtgcgatcggcaccggcctgttcatgggctccggcagaacgatcagcctggccgggccgtcgatcctgttcgtgtacctgatcatcggcgtgatgctgttcttcgtgatgcgcgccatgggcgagctgctgttgtccaacctggactacaagtcgttcatcgacttctccaccgatctgctcgggccctgggcggggttcttctgcggctggacgtactggttctgctggatcatcaccgccattgccgatgtcatcgcgattgcagcgtacgcccagttctggtttcccgaactggcgccatgggtgccggcggtgctgtgcgtgctgctactgctggcgttgaacctggtcacggtgaagttgttcggcgagatggaattctggtttgcgctgatcaagatcatcgccatctgcgcgttgatcatcaccggtgcgggcctggtgatgtggggcttccggtcgccctccggccacgtggcatcgctgagcaatctgtggaacgacggcggcatgttcccgatgggaatcggcgggttctttgcagggtttcagatcgcggtattcgccttcgttggcatcgagctggtgggcaccaccgctgcggaaaccgccgacccgcagcgtaatctgcccaaggcgatcaactcgatcccggtgcgcatcctcatcttctacgtgctggcgctgatcgcgatcatggcggtgacgccgtggcggcaggtggtggccgacaagagcccgttcgtggagttgttcgtgctggccggtgtgccggcggcagccagcctgatcaatttcgtggtgctcacctcggccacttcatcggccaatagcggcatcttttccaccagccgcatgctttacggcctggccgaagaacgcaacgcgcccaggggctttgccaagctgacgcgggcggcggtgccggcgcgcggcctgctgttctcgtgcatctgcctgctgctgggcgcgatgctggtgtatctgattcccgatctggtcaccgcattcacgctggtcaccaccttgtcggccgtgctcttcatgttcgtgtggtcgttgatcctgtgcgcgtacatcgcgtaccggcgcaaacgcccggagcagcatgcggcttcggcgttcaagatgcccggtggcgtgttgatgtgctacgtgtgcctggcgttcttcgccttcatcatcgtgttgctgaccttgcagcccgacacactgcacgcactgctggtgagcccgctgtggtttctggtgctggcgattgcctat

SEQ ID NO: 39055 - DNA, 1628 bp, Xanthomonas campestris
atgccatgagcgctgctgcgcccccgtgctgcacctcgttgcttggtctgtcgctgagcatgttcgttgcgccctgcgccctggcggccacgccgctggaaggtgcggtggtcagcgcgcccgcgcccacgccgcccacgcccgatctggcgtatccggagctgttccaggccgtgcagcgcggcgagctgttcgacgaccagaagcacttcgtcgactttctgccgctgcgcgacccggccctgatcaacgccgactatctggcgcagcacgagcatgccggctttgacctgcgcaagttcgtggatgccaacttcgaggaatcgccgccggtacagaccgatgcgatccgccaggacaccgcgctgcgcgagcacatcgacgcgctgtggcccaagctggtacgcagccagaccaacgtgcccgcacacagcagcctgctggcgttgccgcacccgtacgtggtgccgggcggacgcttccgcgaggtgtattactgggattcgtacttcaccatgctggggctggtgaaaagtggcgaaaccacgctgagccggcagatgctggacaacttcgcctacctgatcgacacctacgggcacatccccaacggcaaccgcacctactacctgagccgctcgcagccgccgttattctcctacatggtggaactgcaggccggcgtggaaggcgaggcggtgtaccagcgctacctgccgcagctgcagaaggaatacgcgtactggatgcagggcggcgacgatctgcaacccggccaggccgcacgccatgtggtgcgcctggccgatggcagcgtgctcaatcgctattgggacgagcgcgataccccgcgcccggaagcctggctgcacgacacccgcaccgctgccgaggcgcatgaccgcccggccgccgatgtctaccgcgacctgcgcgccggcgccgaaagtggctgggactacaccagccgctggctggccgacggcaagacgctgagcaccatccgcaccaccgcgattgtgccgatcgatctcaacagcctgctgtatcacctggaacgcaccctggcgcaggcctgcgcgcacaccggcaccgcctgcagccaggactacgctgcgctcgcacagcagcgcaagcaggccatcgacgcgcacctgtggaatgcagccggctactacgccgactacgactggcagacccgcacgctgagcaaccaggtcaccgcggcggcgctgtacccgctgttcgccggcctggcttcggatgaccacgccaagcgcactgccaccagcgtgcgcgcccgcctgctgcgtcccggcggcctggccaccaccgcgttgaagaccggccagcagtgggacgaacccaacggctgggcgccattgcaatgggtggccgtggacggcctgcgtcgctacggcgaagacggcctggcccgcaccatcggcgagcgcttcctcacccaggtgcaggcgctattcgcgcgcgagcacaagctggtcgaaaaatacggcctggacgccgatgcagccggcggcggcggtggcgaatatgcattgcaggacggctttggctggaccaatggcgtcacgttgatgctgttgaacctgtacccctcacagggcgcc

SEQ ID NO: 39056 - DNA, 912 bp, Xanthomonas campestris
ccaatgactccgatcgtttccatccagggactcagcaagacctacgccggaggtttccaggcgctcaaacgtgtggatctggacatccagcgcggtgagatctttgcattgctcggccccaacggcgccggcaagaccaccttgatcagcatcatctgcgggctggtcaatccaagcaccggcaccgtgctggccgatggccacgacatcgtgcgcgactaccgcgccgcgcgtgccagcatcgggctggtgccgcaggagctggccaccgatgcgttcgaaaccgtgtgggccacggtgcgcttcagccgcggcctgttcggcaagccggccaatccgcagtacctggaatcggtgctgcgccagctgtcgttgtgggacaagcgcaacagcaagatctccaccctgtccggtggcatgaagcggcgcgtgctgatcgccaaggcgctggcgcacgagccacgcatcctgttcctggacgagcccaccgccggcgtggacgtggagctgcgccacgacatgtggcagatggtgcggcggctgcgcgagcagggcaccacggtgatcctgaccacccattacatcgaagaagccgaagacatggccgaccgggtcggtgtcatcaaccgcggcgagctggtgctggtggaagacaagcacacgctgatgcgcaagctcggcaagaagcagctcagcttgagcctgcaggcgccgctgcaggtgattcccgcgccgctggccgacctgccgctggagctgtccgccgatggaaccagcctgatctacaccttcgacacccaggccgagcagaccggcatcggcgcgctgctgcgccggctcaacgagcagggcatcgacttcaaggacctgcattccagcgaaagttcgctggaagagatcttcgtcaacctg

SEQ ID NO: 39057 - DNA, 738 bp, Xanthomonas campestris
atgacgcttcgcatcgcatacgtcaccagtggcatgggcagtgtgggtactgcgatctgccagaaactggcgcgcaccgggcacacggtggtggccgggtgtggtcctaattcgccgcgcaaatcggcgtggctgcgtgagcaacgcgagctcgggttcgacttcgttgcctccgaaggcaacgccgccgattgggattccaccatggctgcgtttgccaaggtcaaggcggaggtcggcgagatcgatgtgctggtcaacaacgccggtggcagccgcgacacgctgttccgccagatgagccgcgacgactggaatgcggtgattgccagcaacctgcattcgctgttcaacatcaccaagcaggtggtggacggcatgacctcgcgcggctgggggcgcatcgtcaacattgggtcggtcagcgcgcacaagggccagatcgggcagatcaacttcgccaccgccaaggctgccatgcatgggttcagccgtgcgctggcgcaggaagtggcctcgcgcggtgtcaccgtcaacaccatttcgcccggctatatcgccagcgcttccatcagcaatttcccaccggatgtgctggaccgcctggccacctcggtgccggtgcgccggctcggcaagccggccgaagtggccggcctgtgcgcatggctggcctccgacgacgccgcgtatgtgaccggcgcggactatgcggtcaacggcggtttgtacatgggc

SEQ ID NO: 39058 - DNA, 906 bp, Xanthomonas campestris
atgaccacgctgcgcatcgccacccgtaagagcccgcttgccctctggcaaagcgaacacgtcgccaccgcgctgcgccagcaccaccccgggctggaggtcgtgctggtgccgatgagcacccgcggcgatgaagtgctggaccgctcgctggccgccatcggcggcaagggcctgttcctcaaggaactggagctggccatgctgcgcggcgaggccgattgcgccgtgcactcgctcaaggacgtgcccatggagctggacgcgccgttcgtgctgccggccatcctggaacgcggtgacccagccgatgcgctggtgtccaacctctacgccaccttgcaggccctgccgctgggcgcacgcgtgggcacctcgtcgttgcgccgccaggcgcagctgcgcgccgcgcgcccggacctggaattgattgacctgcgcggcaacgtcaacacccgcctggccaagctcgacaacggcggctacgacgccatcgtgctggcctgcgccggcctgcagcggctgggcctggaagcccgcatcaccgcgcggctggacgcaccggagtggctgcccgccccggcgcaaggcgcggtggcggtggaatgccgcggcgacgatgcccgcatccacgacctgctggcagtgctggatgctggccgcacgcgcgcctgcgtggaggccgagcgcgcgatgaatcgcgccctgcacggcagttgccacgtgccggtggccgccttcgcgcgctgggaaggcgaggacctgttcctgcagggcatggtgggcagtgccagcgacggccgcctgatccatgccgaggcacacggcagccccgatgccaccgaagacctcggccgccgcgtcgccgacggcctgttcgaaaagggcgccgcacagctgctggcg

SEQ ID NO: 39059 - DNA, 654 bp, Xanthomonas campestris
atgctggacgtgattgaacgcgagaccggaccgaacccgcagtgggcggtgatctggctgcatggcctgggtgcggacggcagcgacttcgcgccgatggtgccggaactggtgcgcgcgcagtggccggcgctgcgcttcgtgttcccgcatgcgccaatccgcccgatcaccatcaacaacggcgtgcgcatgcgcggctggtacgacatcgtcggcatggactttgcccagcgcgcggacaaggtcggcatcgccgagtcggtggcccaggtcgaggccttgattgccaacgaacaggcgcgcggcattgcgcccgagcgcatcctgctggccggcttctcgcaaggcggcgccgtcaccctggcggtgggcctgcagcgtcgcgtgccgttggccgggttgatcgccatgtccacctatctgcccgatccggccgccgccgccagccaactgcagccgggcgcgctggcgcaaccactgttcatggcgcatggcagcgccgacccggtggtgccttaccgcgccggcgagcagagtgcgcaggccctgcaggcactggggttcatgctggaatggcatagctacccgatgggccaccaggtctgcgtggaagagatcgacgccctgcgcgactggatgcaggcgcgcttc

SEQ ID NO: 39060 - DNA, 1558 bp, Xanthomonas campestris
atgtccatattcaggaccgcaagcacgctcgctttggccaccgccctcgcactggccgccgggccggccttcagctattccatcaacaacagcaggcagatcgtcgacgacagcggcaaggtcgtgcagctcaagggtgtgaacgtgttcggcttcgaaaccggcaaccacgtgatgcatggcctgtgggcacgcaactggaaggacatgatcgtgcagatgcagggcctgggcttcaacgccgtgcgcctgccgttctgcccggccacgctgcgtagcgacaccatgccggccagcatcgactacagccgcaacgccgacctgcagggcctgacctcgctgcagatcctcgacaaggtgatcgccgaattcaatgcgcgcggcatgtatgtgctgctggatcaccacacccccgattgcgccggcatttccgagctctggtacaccggctcctataccgaggcacagtggctggccgacctgcgctttgtggccaaccgctacaagaacgtgccgtatgtactcggcctggatctgaagaacgaaccgcacggcgccgccacctggggtaccggcaacgccgccaccgattggaacaaggctgccgagcgcggctcggccgcggtgttggcggtcgcgccgaaatggctgatcgcggtggaaggcatcaccgacaacccggtgtgctccaccaacggcggcatcttctggggcggcaacctgcagccgctggcctgcaccccgctcaacatcccggccaaccgcctgctgctggccccgcacgtgtacggcccggacgtgttcgtgcagtcgtacttcaacgacagcaacttccccaacaacatgcccgccatctgggaacgccatttcggtcagttcgccggcacgcatgcgctgttgctgggcgagttcgatggcaagtacggcgaaggcgacgcacgcgacaagacctggcaggacgcgctggtgaagtacctgcgcagcaagggcatcaaccagggcttctactggtcgtggaatcccaacagcggcgacaccggcggcatcctgcgcgatgactggaccagcgtgcgccaggacaagatgaccctgctgcgcacgctgtggggcaccgccggcaataccacgccgacgccgactcccacacctacgcccacaccgacaccgacgcctacccccacgccgacgcccaccccgggcaccagcaccttcagcaccaaggtgatcgtggacaacagctggaacggcggctattgcaaccgcgtgcaggtgaccaacaccggcaccgccagcggcacctggtcgatcgcggtgccggtcaccggtacggtcaacaacgcctggaatgcgacctggtcgcagagcggcagcacgctcagagccagcggcgtggacttcaaccgcaccctggcagccggcgccaccgccgagttcggcttctgcgccgcgagctgagtgcactgtggcgggtacggctcccgtgtccgctacctttgcaacatgcagtggcattgtggaggcgctgcgtagcaggttgatgatcacctgcggcgcctaa

SEQ ID NO: 39061 - DNA, 1146 bp, Xanthomonas campestris
gcgcaaaccgtcacggtcaacccgaaccagacgtaccagacggtgcgcggattcggcgggatgaatggtgcgggatggatcaacaatctgacccccgcgcaggtggatcttgcctatggcagcggcaacggacagatcggcctgtcgatcctgcgcatgcgcatcgacccctccagcagtggctggagcctgcaggttcccaccgccgcgcgcgtgcgcgcgctgggtggcatattgttcgccacgccgtggtcgccgccggcgtacatgaagtccaacaaaagcctggtcaagggcggcaagttgttgtccacctcgtacgccgcctacaccacgcatctgctggatttcgccaactacctctcggcgcgcaatgcgccgctgtacgcgatctcgctgcagaacgagccggattggcatccagactatgaatccgcagactggaatggcagcgacttcgtcaactatctcaacgcggaaggtgggaagttcggcgcattgaaggtgatcgtgggcgaatcggttggcttcaccttttccatcaccgacccggtgctcaacaacgccaaggccagccaggccacgtccatcgttgccgggcatctgtacggcgcgcagccaaaggactacgcactggcgcgcagcaagggcaagcaggtctggatgaccgagcactacaccgacaccagcgatggcaatgcgtggccgtcggcattgggcgttgcgagcgagctgcatcagagcatggtcgccaactacaacgcctacatctggtggtacatccgccgcagctacgggttgatcagcgaaggtggttcggtcagcaagcgcgggtatgtgatgtcgcagttcgcgcggttcgtgcggccagggtcggtccggatcggtgccaccgagcacccgtatgcggacgtgtccaccacggcgtaccgcacgccggacaacaagatcgtggtggtggcggtcaacaccggcaccgcccaccagcggctggatctgaccgtgccggccggcgcggccacgcagttcgtcaaatacaccacctcatccagcctcaacgccggctatgccggtgcgtacacggtgagcggcggcaagacctcgctgtatatcgacccgcagagcatcgccacgctggtggggcag

SEQ ID NO: 39062 - DNA, 933 bp, Xanthomonas campestris
atcaacggattcggtcgcatcggacgcaacgtgctgcgctctgcggtgcagaacttcgccaatgacatcgagatcgtggccatcaatgacctgctcgagcccgactacctggcgtacatgctgcagtacgactcggtgcacggccgcttcaaggccgaggtgtcggtcgacggcaacacgctgatcgtcaacggcaagaagatccgcctcacccaggaacgcgacccggccaacctgaagtgggatgcggtcggcgccgaggtggtgatcgagtccaccggcctgttcctgaccaaggaaaccgcgcagaagcacatcgatgcgggcgccaagaaggtgatcctgtcggccccgtccaaggacgacacgccgatgttcgtctacggtgtcaacgacaagacctacaagggcgaagcgatcgtctccaacgcctcgtgcaccaccaactgcctggcgccgttggccaaggtcatcaacgacaagtggggcatcaagcgtggcctgatgaccaccgtgcacgccgcgaccgcgacccagaagaccgtggacggcccatccaacaaggattggcgcggtggccgcggcatcctggagaacatcattccgtcctcgaccggtgcggccaaggcggttggcgtggtgatcccggaactcaacaagaagctcaccggcatgagcttccgcgtgccgacctcggacgtgtcggtggtcgacttgacggttgaactggaaaagccagccacctacgccgagatctgcgccgaagtgaaggcgcagagcgaaggcgcgctgaagggcatcctgggctataccgaagacaaggtggtggcgaccgacttccgcggcgagacctgcacctcggtgttcgacgccgacgccggcatcgcgctggattccactttcgtcaagctggtgtcctggtacgacaacgag

SEQ ID NO: 39063 - DNA, 1425 bp, Xanthomonas campestris
atgcacgccacctctcgcccctgtccacgcacgttctggcaacgcgctcaccagttgctgttgatcgcgctgaccttgttgctgaccaccgccagcgcacaggccgacgtcatcctgcatgcgttcaactggccctacgccacggtggaagcgcgcgccaagcagatcgccgatgccgggtatcgcaaggtactggtcgcaccggcgtatcgctccgaaggcagtgcctggtgggcgcgctaccagccgcaggatatccgcctgatcgacaatccactcggcgacaccaccgcgttcgcgcgcatggtgcaggcactggccaataacggcgtggaaacctatgccgacgtggtgttcaaccacatggccaacgaagcagcaacgcgctcggacctcaattaccccggcagcgcggtgctggcgcagtacgcggccaatcctgggcgctacgatgcactgcgcctgttcggcaccgtgcagtccaactttttgagcggcagtgatttcgggccggcgcaatgcatcagcaactacaacgatgccttccaggtgcgcaattaccgcatctgcggcggcggcagcgatccgggcctgccggatctgctcggcaacgattgggtggtgcagcagcagcgcgcctacctgcaggcgctcaagggcctgggcgtcaccggcttccgcgtggacgcggccaagcacatgaccttcgaccatctcaaccgcgtgttcgatgccggcatccgctccggtgtgtacgtgtttggtgaagtgatcaccggcggtggcagcggcaatggcgactacgaccagttcctggcgccgtatctgcaatccaccccgcatgccgcctacgatttcccgctgttcaacgcggtacgcacggccttcggtgtgggtgcgagcatgcaacagttggtggacccggcgtccgccgggcaggccttgccgggcaaccgtgcagtcacctttgccgtgacgcatgacatccccaataacgcgggcttccgctacgcgattctcgacccggtcgatgaaacgctggcctatgcgtacttgctgggccgcaacggcggcgtgccgatggtctacaccgacaacaacgaaagcggcgacaaccgctgggtcaatgcctatctgcgcgatgatctgcgccgcatgattggcttccacaacggcgtgcagggcagcgacatgcaggtgctgtcatccagtgcctgccacatcctgttccgccgcggcagcctcggcatcgtgggcatcaacaagtgcggcaacccggtcaacaccaccgtcgccatgaacggcagcgtgttgttctggaatgcggattacgtcgatgcactgggttccggcaccgtggtgcgcatctccagtggctcgtacaccttcaccctgccggcgcggcaggcgcgtatgtggcgacgt

SEQ ID NO: 39064 - DNA, 1338 bp, Xanthomonas campestris
atgccgggcctgatgtcgatccgccgcaagcatgcgcagaccaagccgctgaaagacgtccgcatcaccggctcgctgcacatgaccatccagaccgccgtgctgatcgaaacgctcaaggacatcggcgccaatgtgcgctgggcctcgtgcaacatcttctccacccaggaccacgcggccgccgcgattgccgccaccggcacgccggtgttcgcctggaagggcgagacgctggaagagtattgggactgcaccctggacgcgctgaccttcaccctgcccgacggcaccctgaccggcccggagctggtggtggacgacggcggcgacgtcaccttgctgatccacaagggctatgagctcgaaaacggcagcacctgggtcgacgagccggcctcctcgcacgaagaaggcgtcatcaaggcactgctcaagcgcgtggctgtcgagcgtccggggtactgggcgcgtgtggtcaaggactggaagggcgtctctgaagagaccaccaccggcgtgcaccgcctgtaccagattgccgaagccggcaaactgctgatcccggccatcaacgtcaacgactccgtcaccaagagcaagttcgacaacctctacggctgccgcgagtcgctggccgatggcctcaagcgcgcgatggacgtgatgctggccggcaaggtcgcggtggtctgcggttacggcgatgtcggcaagggcagcgccgcctcgctgcgtgcctacggtgcccgcgtcatcgtcaccgagatcgacccgatctgcgccctgcaggcgtcgatggaaggcttcgaggtcaacaccatcgaatccaccctgggccgcggcgacatctatgtcaccaccaccggcaacaaggacatcatcaccgtcgagcacctgcaggcgatgaaagaccaggccatcgtctgcaacatcggccacttcgacaacgagatccaggtcgatgcgctgaatgcacttaagggcgtggagaagatcaacatcaagccgcaggtcgacaagtatgtgttcggcaacggtaacgcgatcttcctgctggccgacggccgcctggtgaacctgggctgcgccaccggccacccgagcttcgtgatgtccaactcgttcgccaaccagaccctggcgcagatcgacctgtgggaaaagcgcgacagctacgagaagaaggtctacatcctgcccaagcacctggatgaagaagtggcccgcctgcacctggagaagatcggcgtcaagctgaccaccctcaccaaggaccaggccgactacctcggcgtggacgtggctggcccgtacaagccggatcattaccgctac

SEQ ID NO: 39065 - DNA, 518 bp, Xanthomonas campestris
atgggcgtttcgggcagcggcaagaccaccattgcgcaggccctggccacgcactacggcttccgttttctcgatgccgacgactatcacagcgtggccgcgcgcgcgcagatggcatccgggcaaccgcttaccgatgcgatgcggctgccctgggtggagctgctgtcggcgaccttgcgcgactgcgtgcagagcggtgaatcggtggtgctggcgttctccggattgcgcggcacgcaccgccaattgctgcgccgcagcggggttccgatgcgctttgtgttcctgcatgccgcgccgcacgtgatcgccgcacgcctgagcgcgcgtgcgggccatttcatgccgccgagcctgctcgacagccagctgcagacgctggaactgccgctggacgaagccgacgtggtatcggtggacgtggatgccaccgtgccggaggtggtgcaggacgcgatcgcgcagctggcattggagtaacgcaaacgcgttgcagcggtagtggcagtgacagt

SEQ ID NO: 39066 - DNA, 1515 bp, Xanthomonas campestris
ctgctcaaggcgctcgacctcgccccgtccaatgccggcacctatcttggcgaggggacctggtcgcaggccaccggtgccggggtgctgcagccgctcaatccgaccaccaatgcggtgatcgccgatgtgcaggccaccacgccggaggattacgagctgatcgtggcgcgcgcgcaggccgccttcaaggtctggcgcaccactccggcgccgcgtcgtggcgaggccgtgcgcttgtgcggcgaggcactgcgtgcgcacaaggacgcgctcggttcgctggtggcgctggaaatgggcaagagcaagcccgaaggcgatggcgaggtgcaggagatgatcgacatcgccgacttcgccgtgggccagagccgcatgctgtacggctacaccatgcattcggagcgcccgggtcaccgcatgtacgagcagtaccaaccgctgggcctggtcggcatcatcagtgcgttcaacttcccggtggcggtgtgggcgtggaatgcattcctggcggccatttgcggcgatatctgcatctggaagccgtccaacaagactccgctaaccgcgattgcaacgatgaagatctgcaatgccgcgctcaaggaggcaggcttcccggacatcttcttcctgatcaacgatgccggcacctccttgtcggaaaagctggtcgaagacggccgcgtgccgctgatcagcttcaccggttcgacccagatcggccgcgtggtggccgagaaggtcgcacgccgcctgggccgttgcctgctggagctgggcggcaacaacgccatcatcctggacgaaaccgccgacctgaagctggcggtgccgggcatcgtgttcggtgcggtcggcaccgccggccagcgctgcaccaccacgcgccggctgatcgtgcatgaatccatccacgacaacgtgctggccaccctggtcaaggcgtacaaacagctcgacagcaagatcggcgaccccaccgacccggccaacctgatgggcccgctcaacagccgcggtgcggtggaacagttcctggagtccatcgccaaggccaaggccgccggcggcaccgtggaagtgggcggcaccgcgatcgatcgcccaggcaacttcgtgttgccggcgatcgtgaccgggctgaagaacagcgacgcggtggtgcagcacgagaccttcgcgccgatcctgtacgtgatgaagtacagcacgctggatgaggcgatcgatctgcagaacggcgtgccgcagggcctgtcgtcgtcgatcttcacccagaacctgaaggcggccgagaagttcctgtcggcggccggcagcgattgcggcattgccaacgtcaacatcggcacctcgggtgcggagatcggcggcgccttcggcggcgagaaggaaaccggcggcggtcgcgaatccggctcggatgcgtggaaggtctacatgcgccgccagaccaacaccatcaactactccgattcgctgccgctggcgcagggcatcaagttcgac

SEQ ID NO: 39067 - DNA, 1038 bp, Xanthomonas campestris
atgtattcgctcgcccgccccttcctgttcgccttcgacgccgagcgcgcccacgcgctggccctgcgcgccatcgacaccgcctaccgcaccggcaccacggcgctggtggccacccggccggtgcccctgcccacgcctgccttcgggctgatgttccccaacccggtgggcctgggcgccgggctggacaagaacggcgagcacatcgatgcgctgctggcattgggcttcgggtttgtcgagatcggcacggtgacgccgaagccacaggagggcaatcccaagccgcgcatgttccggttgcccgaataccaggcggtgatcaaccgcatgggcttcaacaacctgggcgtggatgtgctggtgaagaacgtgcagcgtgcgcgccggcgcggtggcctgctcggcatcaacatcggcaagaacaaggacacgcccaacgaggaagcgaccagcgattaccgctattgcatggagcgcgtgtatccgctggccgactacatcaccgtcaacatttcctcgcccaataccgccggtttacgcgagctgcaggaagaacaggcgctgcgccggctgatcgccgatctgcgcgaaacccaggaagccctggccgcccaacacggcaagcgcgtgccgatgctggtgaaggtggcaccggacctcaacgaccgcgacatcgatgcggccgcacgcgtgttggctgacctggcggtggatggcgtgatcgccaccaacaccacggtgacgcgcaccctggtggccagccatccgatggccgagcaggccggcggcctgtcgggcgcaccgctgctggggcaatccacgctggtgctgcgtcgcctgcgtgcacgcctgcccgagtccattccgttgatcggcgtgggcggcatcacgtccggcgccgatgcggtggccaagatggccgccggtgccagcctggtgcagtgctacagcggcctggtctatcgcgggccgcgcttgatcggcgagtgcgtggatgcaatccggcgccgccgtgagtcgcccagtggcggc

SEQ ID NO: 39068 - DNA, 603 bp, Xanthomonas campestris
tcgcctttgccgcgcgctttttatgcagccgatgcgcgcaccgttgcgccgctgctactcaacaaggttctggtgagtgccgacggccgccgcggccgcatcaccgaagtcgaagcctattgcggcagcgaagacgccgctgcgcattcgtttcgcggcatgaccccacgcacgcaggtgatgttcggtgcgcccgggcatttgtatgtgtatttcatctacggcatgcactgggcaatcaacgcagtgtgtggcggcgcgcccgggcacgcggtgttgatccgtgcgctggaaccgctggccggctgtgatgcgatgcatgccgcacgcggggcagcgccgttcaaatcgctgaccaccggtccaggacgcctggcacaggcctttggcgtgagcgcggccgataacggactggacctgaccactggcgtggcgcgcttgtggatcgaggacgacggcactccgccaccagtggcaccgcttgccggcccgcgcatcggcattcgcaaggccgtggaattgccgtggcgctgggttgtgcctggcagcgcctatctgtcgcgtccgctgccacgtgtgagcggcgcacgcgcatccgtacct

SEQ ID NO: 39069 - DNA, 1254 bp, Xanthomonas campestris
gcattgccgggtgcggtggcgctgccgcgcgataccgatgacgtggtggcgatcgtgcaggcgtgccgcgcgcatggcgtgccgatcgtggcgcgcggcgcgggcaccggcaccactggcgcggcggtaccgttctcgggtggcgtggtggtatcgatggcgcgcatgaaccgcatcctggcgttgcgcccggccgaccgctgtgcggtggtgcaaccgggtgtgctcaatggcgatttgcagcaggccttgcagccgcacggcctgttctggccgccggatccatcgagcgcggagatctgcagcgtgggcggcaacctgtcgaccaatgccggcggcccgcgtgcggtgaaatacggcgccacccgcgacaacgtgctcggcttggtcgcggtgaccggcaccggcgatgtcattcactgcggtggcgcgtacaccaaaaattccactggctacgacctcacgcatttgctggtcggcagcgaaggcacgctggcgatcatcgtcgaagcgacgctgaagctgaccccgcgcgcagtcgcgcaagccggcgtgcgtgcgctgtaccgcgatgccgccagcgcggcggcggcggtgtcgcgcatcatggcgcaacccaccacgccgacgatgctggaattcatggatgccagcgcgattgcgctactgcgccgcaatggcagcgacgtgcccgatgccggcgcgatgctgttgatcgaagccgatggcgatcacgacaccctgccctacgcattgcaggccctgcatgacgcggccgatggcgatggcgtcctcagcctggacatcgccgccgatggcagcgcgcgcgacaaactatgggcggcacgccgtgcgttgtcgccggcattgcgcaccatcaagccgggcaagatcaacgaggacgtggtggtaccggtctcgcgcattcctgagcttgtcgctggtgtggaagcactggcggtggaattcgcggtgccaatcgttgccttcggtcatgccggcaatggcaacctgcacgtcaacatcatgtatgacccggacgacgccgatgaaacggcgcgcgcgcaggcggcactgccgcgcgtgtttgcgctggtactggcgctggaaggcacgctctccggcgaacacggcatcggcgtggccaagcgcgatttcatgacccaggccttcagcgcacccaccctcgcggccatgcgcgcgatcaaggccgcgctggatccggatggcattttgaatccgggcaaggtgctg

SEQ ID NO: 39070 - DNA, 1326 bp, Xanthomonas campestris
tgccgtcgcaattggatcattcgcatgagcaacagctcgcaacactggatcgcacagcgcggcaccgcgctgcagggcagcctgaccattcccggcgacaagtcggtttcgcaccgcgcggtgatgttcgccgcactggcggatggcacctcaaagatcgacggctttctggaaggcgaagacacgcgttccaccgcggcgatctttgcccagctgggcgtgcgcattgaaacgccgtcggcgtcgcagcgcatcgtgcatggcgtcggtgtggacggcctacagccgccgcaggggccgctggattgtggcaacgccggcaccggcatgcgcttgctggccggcgtgctcgcggcgcagcggttcgatagcgtactggtgggcgatgcgtcgttgtccaagcggcccatgcgccgcgtcaccggcccgctggcgcagatgggtgcacgcatcgaaaccgaatcggatggcacgccgccgctgcgtgtccacggcggccagccgctgcaaggcattacgtttgcctcgccggtggctagtgcgcaggtcaaatcggccgtgctgctggccgggttgtacgcagcgggtgagacctcggtgagtgagccgcatcctacgcgcgactacaccgaacgcatgctctccgcattcggcgtggacatcgcgttttctcctggccaggcgcgtctgcgtggcggccagcgtttgcgtgcgaccgatatcgcggtgccggcagatttttcatcggcggcgttcttcatcgtggccgccagcatcattcccggctcggacgtgactttgcgtgcggtaggtctgaatccgcggcgcaccggccttttggccgccctgcggctgatgggcgccgatatcgtggaagacaatcacgccgaacacggcggtgagccggtggcggacctgcgcgtgcgctacgcaccgctgcagggcgcgcagattcccgaagcgctggtgccggacatgatcgatgagttcccggcgctattcgtcgccgcagctgcggcgcgcggcgacacggtcgtcagtggtgcggcggaattgcgcgtcaaggaatccgatcgtctcgccgcgatggccaccggcctgcgggcgctcggcattgtggtggacgaaacgccggacggtgccaccattcacggcggcacgctgggcagcggcgtcatcgaaagccacggcgatcaccgcattgcaatggcgtttgccatcgcaggccagctgtcgaccgggacggtacaggtcaacgacgtggcgaacgtggccacctcgttcccaggcttcgacagcctggcgcagggcgccgggttcgggctc

SEQ ID NO: 39071 - DNA, 792 bp, Xanthomonas campestris
atgcgcatcatcagtttcaacgccaatggcctgcggtcggccgccagtaaggggttcttcgagtggttcgccacccaggacgcggatgtgctgtgcatccaggagaccaaggcgcaggaacatcagctggccgggccggaattcctgcccgccggctacaaggcctggtttcgcgatgccagcaccaagaagggctacagcggcgtggcgatctacgccaagcgtgaacccgacgaggtgcgcaccgcgctcggttggccggagttcgacgaagaaggccgctacatcgaggcccgcttcggcaacctcagcgtggtctctttctatatcccgtccggctcctcgggcgagttgcgccagggctacaaattccaggtcatggaatggctgcgcccgatcctgagcgaatggctggccagcggccggcagtacgtgctgtgcggcgactggaacatcgtgcgctcggcgctggacatcaagaactggaagtccaaccagaagaactccggctgcctgccgcccgagcgcgactggctcaacggcctgtgcgccgacctgctggacgaggccgatgccagcaacgggcgcggctgggtggacagctaccgcgtgctgcatccgcagggcgaggactacacctggtggagcaaccgcggcgctgcccgcgccaataacgtgggttggcgcatcgactaccaactggtcacccccgggctgcgcgataaggtgcaggcttgttcgatctaccgcgagcagcgtttctccgaccacgccccttacatcgtggattac

SEQ ID NO: 39072 - DNA, 1386 bp, Xanthomonas campestris
gtcgccgcagaaatgttccgcgcgtacgacatccgtggcgtggtgggcaaggatctcaaccccggcatcgccgcgctgatcggccaggccatcggcagcgtgatgcaggcgcaaggcctgcgcgacatcgtggttggccgcgatggccgtttgtctggcccggaattgaccaacggcctgatcgaaggcctgcgccgcgccggttgcaacgtcaccgacatcggcctggcgccgacgccggtggtgtacttcggcgcctacgaattgcgcgccggcagctgcgtggcggtgaccggcagccacaatccgcccgactacaacggcttcaagatcgtgatcggcggcgagacgctctccggtgcggcgatcaccgagctgcaccagcgcatcaccgaaggccgcctgcataccgcagccagccccggcgaactggagcagcgcgacatcagcgatgcctacatccagcgcattgccgacgacgtgcagctggaccgcccgatcaaggtggtggtggacgccggtaatggcgcggccggcgagatcgcgccgcgcttgttggaggccatcggtgcggaagtggtgccgctgtattgcgaaatcgacggcacttttcccaatcaccatccagacccgagcgagccgcacaatctcggcgatctggtgcagatggtgcagcgcttcgatgcggatatcggcgtggccttcgatggcgatgccgaccgcctgggcgtggtcaccaaggaaggcgccatcgtcttccccgaccgcctgctgatgctgtttgccgccgatgtgctgcaacgcaatcccggcgcgctggtgatctacgacgtgaagtgcaccggcaagctgtccgactacgtgttgcgcaatggcggcagcccgttgatgtggaagaccgggcattcgctgatcaaggcgaagatgcgcgaaaccgatgccgagctggccggtgaaatgagcgggcacttcttcttcaaggagcgctggtacggcttcgacgatggcatctatgccgccgcgcgcctgctggaaatcctcgcccagcgcgaagagaccccgtccgacgtgctcggcgagctgcccgaaagcgtgtccacgccggagatcaaggtaccgttggacggcgatgcgcatgcgctggtggcccggttcgtggagcgtgcccaggccggcgaggagtcgccgttcgaggccgcgcggttgtccaccatcgatgggctgcgcgcggatttcggcgacggctggggcctggtacgtgcgtccaacaccaccccgatcctggtgctgcgcttcgaagccgacaccgctgtggcgctggaacgcatccgcgcgctgttccgcagcgaactgcaggcgctgctgccggatcacccgctcgcattc

SEQ ID NO: 39073 - DNA, 1635 bp, Xanthomonas campestris
agtgacccgcttttccgctatcaatggcatttgctcaacgatgggcaagaggtcattgccgacactcggccacgcgccggaacggatctgaatgtgggcccgctgcatacgttggggctgcgtggacaaggcgtaaccgtcgccgtcgtggacgacgcactcgaactacgccacccggatcttgttgccaacgtggtgcccggcggttccaagaactttgtcgatggatcgaatgatccaacgccacgcaacggcgcttcccacggcacgatggttggcgggatcatggcggcagtgggctggaacgggcttggtggtcgcggcgttgcgcccgatgcgcgcctgaaaggtttcaacatcctttcctcagaagaaagcccgaccgacttcgataccaatctacgcgcctcctggggcgattcggtgcaatcccgggatgtggatgtattcaataacagctttggctcagatctgacgtactacccgacaatctctccagcagcagagcgctcgcttgaccgcttgatgcgtcgagcaagaaacggcaaggggggtctgtatgtccaggcagcagggaacacgttcgatagttttacggttctcgacgaccaggggaactgggtggagcgatgccctgtgctggcccgcaccttgggagtcacttgctccacgccggctaccgatccgttgagtaaccaacccctgatcatcgcgacgggcgcagtcaatgcacgcggcctgcgctcgtcctactcttcagccggcgcggcgctatgggtcaccggcttcggcggggagttcgggctgcaacgccgctactttggcgaccggccgcggcccgcgttgttcgatcccgccatcgtcaccaccgacctgactggctgcgccgtcggtgacaacagggacatcgccggccagccgccgatcaatgcattggcttcaagcagctcaccgatcgacgcctcttgcaactactccgcggcaatgaacggcacctccgcagcggcacccacggttgctggggtggttgcgctgatcgtgcaggccaatccgtcgctcaccgcgcgcgaccttaagtacatcctggcaacaagcgcgcgccagatcgatcctgcgcagcaggtgatccgctaccaaggcagcgtgatcgagccgggctggatcaccaatgcggccggccatgcatttagcaactggtacggtttcggcctggtggacgctgccgaagcggtctatcgcgcctatgggttccagccgcttccgccccagcgcgatctgggctggaaagcggcacgcgcaggcacatcgacgattggcggaccaaatgccgcggcaaccttgcggttgcggctcggggacacgctcaagatcgacaccgtgcagtggtcgatgcagaccacccacaagacaccgagcaatctccgggtagtgctgatctcgccgagtggcacccgcagctacgtgctcactcccttccaggccttggatacgatcacgcagggggccggctttgagataccgctttcgaccagcaatgccttcctagacgaaaacgttgccggcacctggacgctggaagtcaccgacatgaccggctcggacgttcccgcccaactgacgggcttcaaactgcgc

SEQ ID NO: 39074 - DNA, 1677 bp, Xanthomonas campestris
acaggcactacacgcgccagcgccgcaggcgacccgctctatcgctaccaatggcatctctccaaccaggggcagccggtgattggcgacagccgtcccgtggctggcgtcgacatggatgtagatctcctgcatgcactgggcattcgcggccgcggcgtgcgtgtggccgtggtggataacggcctggagatcggccacgaagatctcgcaggcaacatcatcccgaatgggtcgcacaatttcggcaatggctcgcacgatcccacgcccagtgacccgggctttggtcacggcacgtcggtggcgggcatcatcgctgcggttggctggaatggccgtggcggtcgcggcgttgcacccgaggccttgctggccggattcgatttcctcggcagcgattctgccggaagttatgccgaggtccgctattcctggggtgatgggccggaggcacgcaccctcgatgtcttcaataatagctggggctcggccccggacttctaccccgacgtttcattagaggagggtcagtcctgggaagcgctgatgcgctcgacacgcggcgggctgggcggcatctacatcaagtcggccggcaacagcttcaagcgtgttcgcgcccgcgacgccgaaggcaggatcgtcaatctctgcagcgacctgtcacgcacgttgaatgtcggttgcctgctcaccaacgtggacccactcagcaatatgcccgccaccgtcgtcgtcgccagcgtggacgccaccggcaagcgggcctcgtactcgtcatccggttcggcgttgtggatctccggcctgggcggtgagttcggctaccagcgcaagttctatcccaatgcggcccaggttttcgcgcctgaaaccgcgcccttcgcctacgatccggccatcgtcaccaccgatctcagcggttgcagcgcgggtgacaacgtggatggcaccacggtggaaaacgcactgaccggcagcacgtcaaggatcgacgcgtcgtgcaactacagcgcactgatgaacggcacatctgcggcggcgccaaccgtctccggtgttgcagcgctcatcctcggtgccaaccccagcctgactgcgcgcgatgtcaaatacatcctggccaagacggcgcgccagatcgatccctggcagcccgcatcggtctaccagggcagcgtgatcgaccctggctggatcaccaacgccgccgggcatcatttcagcaactggtatggcttcggcctggccgacggcgccgcagccgtctacgaagcgacctacttcaagccgctgccgccggtgcgtgatacgcaatgggttgcctccaccgcggctgcaagccagatcggtggaccggcgcgaccggccaagcaacgcatccgcatcacccaggcaatgaaagtggaagcagtgcaactgtcgttggccaccacccaccgcacgccggccaatctacgcgtggtgctggagtcgccgagcggcacgcgaagctacgtgatgacgccgttctcgctgctggatgccgatgcctacgcacagaccggcttctacatcgacctcacgtccagcaatgcgtttctggatgaaagagcgcaaggcgtgtggacgctggagatcaccgacatgagcgagccgaccagcacggcggcgttacagaacttcaaacttcgt

SEQ ID NO: 39075 - DNA, 2919 bp, Xanthomonas campestris
accgtggtctacgacggcaagacgctgcacggccaggcggatattccgctgatcgagtttctgagcgggcacggcatcgacctgtcccacatctgttatcaccccgcgttgggcgcaccgcagacctgcgatgtgtgttgggtcgaagtgggcggcgaattggtgcgcggctgcacgctgcgcagccacgatgggctggaagtgtccagtacggtggagcgcgcgcatgccgcgcgccacgaaggcatggaccgcgtgctggccaagcacgagctctactgcacgctatgcgagcacaacaccggcgattgcacgctgcacaacacgttcgccgacatgaagatgccgatccaacgttacgcgttccagcgcaagccgtacgaaaaggatcacagcaatccgttctacacctacgatccggaccaatgcatcctgtgcggccgctgcgtggaagcctgccagaaggtcgaggtcaacgagaccttgtccatcgatttttcgatggagcacccgcgggtgctgtgggacggcggcaagcccatcaacgagtccagctgcgtcagttgcggccactgcgtgacggtgtgcccgtgcaatgcgttgctggaaaagaccatgcagccggatgccggaccgctcaccgcattgccgcaagagttgaagcggccgatgatcgatatggtcaagacgctggaaaacaccatcggcgcgccgccgatcaccggtgtgtcggtgctggacatgcactggcggcagccggagatcaaacgcaccaagacggtatgcacctattgcggggtggggtgctcgttcgagatgtggacgcgcgaccgccacctgctcaaggtgcaaccggtggtagacgcacccgccaacggcatttccacctgcgtcaaaggcaagtttgcgtgggacttcgtcaacgaccccaagcggctcaccacgccgttgatccgcgagcacggccgcttccgcgaggcaagttgggacgaggccttggcactggtggcgcgccggctgctggagatccgcgacctccacggcgcgcagagcatcggcttcatcggctccagcaaggccagcaacgaagaggcctacctcacccagaaaatcgcgcgcctgatcatcggcaccaacagcgtcgacaactcctcgcgctattgccagaacccggccaccgagggcctgttccgcaccgtcggctacggcggcgacgccggcaccatcgccgatctgcagcaggcagaactggtggtgatcgtcggcagcaacctggccgagaaccacccggtgatcgcctccaagctcaaggcggcgcgcaagctgcacgggcagaagctcatcgtggtggatccgcgcaagcacgagatggccgagcgcgcggacctgttcctgcgccccgtgcccagtaccgatatcgtgtgggcgtcggcgctgtcgcgctacatgttcgataacggctacgccgatacgcagttccttgcacagcgcgtcaatcaggtggacgaataccgccagtcgctggagccgttcacgctggacgatgcggcgcacatcaccggcctgagccgcgagcagttggtggaggcgggcgagatgatcggccgcgcgggctcggtctgcatcgtctgggccatgggcatcacccagcacacgcacggcgccgataccagcaccgcgctctccaacctgttgttggttaccggcaattacggccgccccggcaccggtggctacccgatgcgcggccacaacaatgtgcaaggcgccagcgacttcggctgcctcaagaacatgtaccccggctacgaaagcgtctctgacccggccgtgcgcaacaagtgggcgcaggcctggcatgtaccggccgagcagttgtcgctggaggtgggctcggacaacttcatgatggtgcagcaggccgacaagggcgagatccgcgccatgtacgtgatcggcgaggaaaccgcgttttccgatgccgatgcgcgcaatgtgcaccgcggcttctccaagctggacttcatggtggtgcaggacctgttcttcagccgtaccgccgaatttgcggatgtggtgttgccggcgtgccccagcgtcgagaaggacggcaccttcgtcaacaccgaacgccgcatccagcgcttccaccaggtatttccaccgctcggccagagccggccggattggcagatcctcactgaactcgccgcacgcatgggccacgattggggctacacccatcccagccagatcatggacgaggtggcccgcatcgccacgctgttcaagggcgtgaactaccagcggctggaaggctggcgctctctgctctggcccatgcaggccgatggccgcgatacgccgctgctctacaccgagcgcttccacaccgacgacggcaaggcgcgcctgcatccgctgcaatggaagcgcccgggtgaggaggccgatgcgcagttcgatctgatgctggacaacggccgcatgctcgaacagttccagggcatgaatcagaccggccgcgggccgcggctgtggtcgctggcaccgaactggtttgtcgaagtcagcccgcagctggcggccgagcgcggcttgcaggaaggcgattgggtcaagctcagttcgcggcgtggctcgctggaggtaccggtggtgatcaccgatcgcgttgccggcaacacgctgttcctgcccatccaccagggcaagcccggcatcaatctgctcaccggcgagcatcacgaccccgacgtcaacacgccagcctacaaagagttggcagtacgcatggagccgcttggccgcaccggcaaaccgccgctgcctgcgcataactttcgccacgggcaacgcacgcccaacgatggcgtgcccgtacagcagaaatgggcacgcgaagactatgtcgcgccg

SEQ ID NO: 39076 - DNA, 2536 bp, Xanthomonas campestris
tggccccataacggggccatcggctttttttacgccccaattcctcgatcccgcggagcgccccatggcccagtcccaaccagaaattctcgatctgccagtgttgccgctgcgcgacgtggtggtgtttccgcacatggtgattccgctgttcgtcggccgtgacaagtcgatgcgcgcgctggaaaaagccatggaggcggacaagcgcatcctgttggttgcgcagaagtcggccgagaccgacgacccggcagcgggcgatctgtacacggtcggcacgctcgcccaggtgctgcaactgctcaagctgcccgatggcacgatcaaggtgctggtcgaagggttgtcgcgcgtcaccgtcgacaaggtggcggaacaggacggcgccttgcagggccgcggcaccgaagtggaagccagcgatgcacgcgagccgcgtgagctggaggcgattgcgcgttcgctgatgtcgctgttcgaacagtacgtcaagaccaaccgcaagctgccgccggaattgctgcagaccctggccggcatcgatgagcccggacgtctggccgacaccattgccgcgcacatcggcgtgcgtttggctgataagcaacgcctgctcgaaatcaccgagatcggcgaccggctggagctgctggttggtctggtcgatggcgagatcgacgtgcagcagctggaaaagcgcatccgcggccgcgtcaagtcgcagatggaaaagagccagcgcgagtactacctcaacgaacagatgaaggcgatccagaaggaactgggcgatctggacgacgcgcccggcgaactggaagaactcgcccgcaagatcgccgaggccggcatgcccaagccggtcgagaccaaggccaaggccgaactcaacaagctcaagcagatgtcgccgatgtctgccgaagctgcggtcgtgcgcaactatctggattggttgctcggcgtgccgtggaagaagcgcaccaaggtccgcaaggatctcaaggttgcgcaggatacgctggatgccgatcactacggtctggacaaggtcaaggaacgcatccttgagtacttggccgtgcagtcgcgcgtgaagcagatgaagggcccgatcctgtgcctggtcggcccgccgggtgtgggtaagacgtcgctgggtcagtcgatcgccaaggcgaccaaccgtaagttcgtgcggatgagcctgggcggcgtgcgcgacgaggccgagatccgtggtcatcgccggacctatgtcggttcgatgccgggccgcctggtgcagaacctcaataaggtcggcagcaagaacccgctgttcctgctggatgagatcgacaagatgtcgatggacttccgtggcgatccgtcatcggcgctgctggaagtgctcgacccggagcagaaccacaccttcaacgaccactatcttgaagtggatctggacctgtcggaggtgatgttcgttgctacctccaactcgctcaatatccccggcccgctgctggaccgcatggaagtgatccgcatccccggctataccgaggatgaaaagctcaacatcgccatgcgctacctggtgcccaagcagatcaaggccaacggcttgaagccggaagagatcgagatcggcagcgatgccatccaggacgtggtgcgttactacacgcgtgagtcgggcgtgcgtaaccttgagcgcgaagtggccaagatctgccgcaaggtggtcaaggaaatcgcattggctggcccgcagccggcggccaagaaggcggtcgcaaagaaggccaagcccaaggcgctggtgacggtgacctccaggaacctggacaagtatctgggcgtgcgtcgcttcgatttcggtcgtgcagaagaagagaacgagattggcttggtgacgggtctggcttggaccgaggtcggtggcgaactgctgcagatcgagtccacgctggtgccgggcaagggcaacctgatcctcaccggtcagctgggcaacgtgatgaaggagtcggcatcggcggccttgtcggtggtgcgctcgcgcgcagagcggctgggcatcgatgtggatttcctgcagaagcaggacgtgcacgtgcatgtgcccgacggtgccacgccgaaggatggccccagcgcaggtatcgcgatggtgacctcgctggtgtcgatcctgaccaaggtgccgatccgtgcggacgtggcgatgaccggcgaaatcaccttgcgcggccgcgtctctgcgatcggcggcttgaaggagaaattgctggcggcactgcgcggcggtatccgtaccgtgttgatccccgatgagaaccgcaaggacctggcggacatcccggccaacgtcacgcgcgatctgaagatcgtgccggtgaagtggatcgacgaagtgctggatctggccctggagcgcccattggcgccgaagaaagccggcaaggaaaaaacacgcaagaccgcctcgcgtgtagcggtgcgcggcaagtcgcgtaccacaccgggcacccgcgtcaagcattaa

SEQ ID NO: 39077 - DNA, 1038 bp, Xanthomonas campestris
gctccccccctttaagttcggaaacccaacgttatgacgcagacaatcacggtcatccgcggcgacggtattggcccggagatcatggatgccacgctgttcgtgctcgacgcgctgcaggctggcctgacctacgagtacgccgatgccggcctggtcgcgctggaaaagcacggcgatctgctgcctgagtccaccctggcctcgatcaccaagaacaaggtggcgctgaagagcccgctgaccacgccggtcggtgagggtttcagctcgatcaacgtcgccatgcgtcgcaagttcgacctgtacgccaacgtgcgtccggccaagtcgttccccaacaccaagtcgcgtttcgccgatggcgtggacctgatcacggtgcgtgagaacaccgaaggcgcctacctgagcgaaggccaggaagtctcggccgacggcgaagtggccgtttccggtgcccgcgtcacccgcaagggctccgagcgcatcgtgcgctacgccttcgacctggcgcgcgccaccggccgcaagaaggtcaccgcggtgcacaaggccaacatcatcaagtcgacctcgggcctgttcctgaaagtcgcccgcgatgtcgccacgcagtacccggaaatcgaattccaggaaatgatcgtcgacaacacctgcatgcagctggtgatgcgtccggaacagttcgacatcatcgtgaccaccaacctgttcggcgacatcatctccgacctgtgcgccggtctggtcggcggcctgggcctggcgccgggcgccaacatcggtgtggacgcggcgattttcgaggccgtgcacggctcggcgccggatatcgcagggcagggcaaggccaacccgtgcgcgctgctgctgggcgctgcgcagatgctggaccacattggccagccgcagaacgccgaacgcctgcgcgaagcgatcgtcgccacgctggaagccaaggactcgctgacccccgacctgggtggcaccggcaacaccatgggcttcgccaaggccatcgccagccgcctc

SEQ ID NO: 39078 - DNA, 2064 bp, Xanthomonas campestris
tccccctcgcgtcgcgactttctcaaacgtgtggcagcactgacggctgccggtgcgctacccgcctcgatcggacgcgcgctcgcactgccggcaaacgcacgcaccggtaccttgcgcgacatcgaacacgtggtgatcctgatgcaggaaaaccgctccttcgatcattacttcggcaccatgcgcggtgtgcgcggcttcggcgacccgcgtgcgctgcagttacgcgacggcaacccggtgtggagccaggcagccagcgacgggcgacgtgtgttgccgttcgccttcgatgcgcgcaacacctgcgcgccgctgatcaagagcctggatcactcctggaaagccggccatgggcaagacccgttgcgctggcaggaatacgacgcctgggtgccgtacaagggcgagctgacgatgggttatttccagcgcagcgatattccgtactaccacgcgctcgccgatgcgttcaccatttgcgatggttatttctgctcgctgcacgggcccaccaatcccaatcgcatgtatctgttcaccggtaccagcggcttgagcgtgggcaacaccggtgcgcagacggtcaccaatgccgacgacggcaactggaccgccgacatggcgcgcgacaaacccggttacgccgcgatgcaatggaccacctacgcgcagcggctgcaggcggccggtgtcgattggcgggtgtatcaggagtacgacaacttcggctgcaattcgttggcgtactttgcgcactatcgcgatctggatcgcaacgatgagcgctatcgacgcgcacgtgcgtgcgtcccggggtccactgccgacaatgccgccaccacgcaggccgatcatctggtcgcagccatcgccgccgatgtacaagccaaccgactgccgcaggtgtcgtgggtgatcccgcccaccgcctattgcgaacatcccgaagcgccgccggcatatggcgaatcgctggtggcgcggctgatcgatgcgctcaccgccaatcccgaggtgtggtccaagaccgcgctgatcatcaactacgacgagaacgacggcttcttcgaccacgtgcctgcgccgctgccggcactggatgcgcgcatgggccgcagtaacgtggacgcgcgcggcgaagtgcacgagggcgttccggttgggctgggcattcgcgtgccgatgctggtgatctcgccctggacgcgcggcggctgggtcaactcgcaggtgttcgaccacacctctgtgctgcgtttgctcgagcgccgtttcggtgtggccgaacccaacatcagcccgtggcgacgcgcggtgagtggcgatctcaccagcgtgttcgacttccgccagccggaccattccgcgctgagcgcgctgccagcgatcggcgactaccgcgcacgcacggccgcggtgcgcgacaaaccgctgccggtgccgccaaccactgcgcagatgccgcggcaggaaccagggcagcggcccgcgcgcgcgctgccgtatgcgttgcaggtgcatgcgcgtgtccacgatgacagcggcgtgcagttgcagttcatcaacaccggtgccgctgcagctgccttcaacgtgtacacgtccgccgcgacaggcggcccctggtattacaccgtcttgcccggcactcagctggacgacgtgccgatgggcgcggtgcacgacggcgcgtatgcattgcgcgtgcacggcccgaatggatttttgcgcgagttcgcagggaatttaggtgccgagcagccggcgttggctgcgccgtgggtgcaggcgcgtcaggatggcgagctgctggtgttggagatcggcaatgccgggcgccagccgtgcacgctgcaggtgcgcgcgctggattacgccgagccgaccacacagccgctgcagttggccgcagggcagcgccacactctgcgcctgacattggcggcaagcgatcactggtatgacattgtggtggagcagccgggcagcgcgttccgccgccggctggccgggcacctggaaaccggcaagcccagtcgcagcgacccggcgctcggt

SEQ ID NO: 39079 - DNA, 1020 bp, Xanthomonas campestris
atgaaggcgctggtcaagcgcgaagcgagcaagggcatctggctggaacaggtccccgtgcccaccccgggcccgaatgaggtcctgatcaagctggaaaagaccgccatctgcggcaccgacctgcatatctacctgtgggatgagtggagccaacgcaccattacgccgggcctgaccatcggccacgagttcgtcggccgcgtggccgagctcggttcggcggtgaccggctaccaggtcggccagcgcgtgtcggccgaaggccacatcgtctgcgggcattgccgcaactgccgtggcggccgcccgcacctgtgccccaacacggtgggcatcggcgtcaacgtcaacggcgcctttgccgaatacatggtgatgccggccagcaacctgtggccgatccccgaccagatcccctccgagctggccgccttcttcgacccctacggcaacgccgcgcattgcgcgctggaattcgatgtcatcggcgaagacgtgctgatcaccggcgccggcccgatcggcatcattgccgccggcatctgcaagcacatcggtgcgcgcaatgtggtggtcaccgacgtcaacgacttccgcctcaagctggccgccgacctgggcgccacgcgcgtggtcaacgtgtccaagacctcgctcaaggacgtcatggccgacctgcacatggaaggcttcgacgtgggcctggaaatgagcggcaacccgcgcgcgttcaacgacatgctcgattgcatgtaccacggcggcaagatcgcgatgctcggcatcatgccgcgcggcgccggttgcgattgggacaagatcatcttcaagggcctcaccgtgcagggcatctacggacgcaagatgtacgagacctggtacaagatgacccagctggtgctatcgggttttccgctgcagaaagtgctgacccaccagttgtcgatcgacgagttccagaaggggttcgacctgatggaagaaggcaaggccggcaaggttgtgttgagctggaac

SEQ ID NO: 39080 - DNA, 1185 bp, Xanthomonas campestris
gccgcgctgaccgcccattacgccgccgaactggaatcaatccagtcccaggggctgttcaagtccgagcgcatcatcaccggcccgcagtcggcacagatcacgctggccgacggccgccgcgtgctgaacttctgcgccaacaattatcttggcctggccgaccacccggacatcatccaggccgccaaggatgcactggacacgcacggcttcggcatggcctcggtgcgtttcatctgcggtacccaggacctgcacaagcagctcgaacgcaccatcgccgacttcttcggcaccgaagacaccatcctctacgccgcctgcttcgatgccaacggcggcctgttcgagccgttgctcggcgagcacgacgccatcatttccgatgcgctcaaccacgcctccatcatcgatggcgtgcgcctgtgcaaggccaagcgcttccgctacgccaactgcgacatggccgatctggaaacacagctgcaggccgccgacgccgccggctgcaagaccaagctgatcaccagtgacggcgtgttctcgatggacggcttcatcgccccgctggatgaaatcaccgcgctggcccgcaagtacaacgcgctggtgcacatcgacgaatgccacgccaccggctttttgggcgcgaccgggcgcggctcggccgaggtcaagggcgtgatggaccagatcgatatcttcaccggcacgctgggcaaggcaatgggcggcgcgttgggcggcttcaccaccgccaagcgcgaagtcatcgaactgctgcgccagcgctcgcggccgtacctgttctccaactcgctgccgccgcacgtggtggctgccggcatcaaggccttcgagatgctggacgcggccggcgagctgcgcacgcagctggtggaaaacacccgctacttccgcgagcgcatgaccgctgccggcttcgacgtgaagcccggcgtgcatccgatcagcccggtcatgctgtacgacgcaccgctggcgcagcgctttgccgagcgcctgctcgaagaaggcatctacgccatcggcttcttcttcccggtggtgcccaaggggcaggcgcgcatccgcacccagatcagcgccgcgcacacccgcgagcagttggatcaggcaatcgacgccttcacccggatcggtcacgagctcaaggtcatc

SEQ ID NO: 39081 - DNA, 735 bp, Xanthomonas campestris
atgacagacagttccaaggtggtcctgatcaccggtgccgcccgccgcatcggtgcgcagatcgccaccaccctgcacggcgccggctaccgcgtggccctgcacgcgcaccgctctggcgatgcattggctgcacgcgtggcggcgctatgcgcccagcgcgcgggcagcgcctgtgcactgcaggccgacctgcgcacgcccgaggcaccggcccagctggtggatgcctgtgtggctgcattcggccgcctggatgcggtggtcaacaatgccagcgcgttttatcccaccgtgctgggcgaggccacgccggcgcaatgggacgagttgttcgcggtgaacgcacgcgctccgttcttcattgcacaggccgctgcggcgcagttgcgcgcgcaccacggcgccatcgtcaacctcaccgatctgcatgccgaacaacccatgcgccagcacccgctgtatggcgcctccaagagcgcgctggaaatgctgacccgctcgctggcgctggagctggcgccgcaggtccgcgtcaatgccgtcgcaccgggcgcgatcctgtggccggaagacggcaaggccgacgccgccaagcaggcactgctcgcgcgcacgccgctggcgcgcatcggcacgcccgaagaagtggccgaggccgtgcgctggttgctggacgatgccagcttcatcaccggccataccttgcgcgtggacggcggccgccggctcagc

SEQ ID NO: 39082 - DNA, 900 bp, Xanthomonas campestris
atggaactgggtatggtgggactgggccgcatgggcgccaacatggccgagcggctggtgcgcggcggacatcgcgtgcatgggttcgatctgggcgctgccgcacgcaccagtgcgcaatccaaggggatccagacaaccgacgcgctggccacgctggtctccgcactgccgagtccgcgcgtggtgtggctgatggtgccggccggcaagatcgtcgacgacacgctggcgcagctgctgccgttgctgcaggccggcgacatcgtcatcgatggcggaaattcgtactacaaggattcgcagcgccgcgctgcgcagctgcagtccagcggcattgcatttgtcgattgcggcaccagcggtggcgtgtggggcctgcaggaaggctacagcctgatggtgggcggcgacgaagcggccgtgaccacgttgcatccggtgctggccacgttggcaccggcgccggacaagggctggggacgggtgggcccgagcggtgccggccacttcaccaagatggtccacaacggcatcgagtacggaatgatgcaggcctatgccgaaggcttcgcgctgctgcagcacaagaccgatttcgcactggacctgcaccaggttgccgagatctggcgcgatggcagcgtggtgcgttcgtggctgctggacctcaccgccgatgcgctggcgcacaacccgaccatgggcggcattgcgccgtatgtggccgattccggcgaaggccgttggacggtggcagaggccatcgacctggaagtctccgcgccggtgatcaccttgtcgctgatggagcggttgcggtcgcgcgacaaggattcgttcaccgataaattgctggcggcgatgcgcaatcagttcggtgggcatgcggtgctgacc

SEQ ID NO: 39083 - DNA, 909 bp, Xanthomonas campestris
cgcatccccggcctggacatcacccgtttcgacagcgaccgcgaggcctttgtcgccgagctcggtgccgcttatcggcaatggggctttgccggtatccgcaatcacggcattgcgcagtccgacatcgacgccgcctacgaggtgttcaaggcatttttcgcgctgcccgacgaggtcaagcgcagctaccacgtgcccggcagtggcggcgcgcgcggctataccgcgttcggtgtggaaaccgccaaggactccaagcatttcgatttgaaagagttctggcacatcggccgcgagatcccggacgattcgccgtaccgcgcggtgatggcgcccaatctgtggccgaccgaagtgccgggcttccgcgaacgtggctaccacctgtatcagcagttggatcagctgggctcgcgcgtgttgtcggcgctggcgctgcacatcggcctgccgcaggactacttcgccgacaagaccgatcacggcaattcgatcctgcgcccgatccattacccgccgatcaccagcgacgacatcccgaatgtacgcgccggtgcgcacggcgacatcaatttcatcaccttgctggtgggcgccagcgccgccggcctggaagtgcgttccaacgaaggcgagtgggtgccgttcactgcggacgccgacaccatcgtggtcaatatcggcgacatgctgcagcgcctgactaaccatgtgtacccgtccaccatccaccgcgtggtcaatccgccgggagaggaagcgcgcaagccgcgctattcggtgccgttcttcctgcacccgaacccggatttcctgatcgacgtgttgccgtcctgcatcagcgccgacaaccccagccgctatcccgagccgatcaccgcacacgggtttctggaagagcgcctg

SEQ ID NO: 39084 - DNA, 750 bp, Xanthomonas campestris
atgcgtcgaaagatcgttgctggaaattggaagctgcatggcacgcgtgccttcgccaccgaactggtggcgcaggtggccgcgcacatgcccctggcgggtgtcgatgtcgtcatcctgccgcccttgccgtatctcggtgatctgatcgaggacttcgaggcccaccacctggcattcggtgcacaggacgtcagtagcaacgagaagggcgcctacaccggtgaagtgtccgcctcgatgctggtggatgtcggtgccgaatacggcctggtcgggcattcggagcgccgtcagtatcaccaggaaagcagcgagctggtcgcgcgcaagtttgccgccgcgatgcatgccgggttgatcccggtgctgtgcgttggcgaatcgctggaacagcgcgaggccggtcacactgaggcaatcctacgtgcccagttggagccggtcctgagcttggtcggcagtgccggattcgcccgcgccgtggtggcctacgagccgatctgggccatcgggaccgggcgtaccgccacgccggaccaggcccaggccgtacacgccttcattcgtggcgaagtcgcgaaggcggatgctagaattgcggattcactgcccatcctgtacggggggagtgtcaagcccgacaacgccagcgagctgtttttccagcccgacgtcgacggtgggctggtcggcggcgcatcactggttgccgaagacttcctggccatcgcgcgtgcggcggccgct

SEQ ID NO: 39085 - DNA, 2160 bp, Xanthomonas campestris
gtcgagatcgacgggcagtcgctggtggtgccgaagggctcgatgatcatccaggccgccgacaaggccggcatcccgatcccgcgcttctgttaccacgagaagctgccgattgcggccaactgccgcatgtgcctggtcgatgttgaaaagtcgcccaagccgtcgcctgcctgcgccacgccggtgatggacggcatgaaggtcaccacgcgcagcgaaaaagcgctgaaatgacagcgaagcgtgatggaattcctgctgatcaaccacccgctggactgcccgatctgcgatcagggcggcgagtgcgaattgcaggacgtctcgcttggctacggccgttcggtgagccgcttcaatgagcgcaagcgcgtggtgccggacgaagacatcggcccgctggtggcgaccgagatgacccgctgcatccagtgcacgcgctgcgtgcgcttcaccgccgatatcgccggaacctacgagctgggcggtatgtatcgcggtgagaacctgcagatcggcacctacgacggcaagccgctgaccactgaaatttccggcaacgtcatcgacgtttgcccggtgggcgcgctgaccaacaaggtgttccagttccgtgcgcgtccgtgggaactgatggcacgtgaatcgctcggttatcacgatgcgatgggctccaacctgttcctgcacgtgcgtcgcggcgaagtgctgcgcaccgtgccgcgcgagaacgaagccgtcaacgagtgctggctgtccgatcgcgaccgttattcgcatcagggcctgtacgccgaagaccgtgcggtgaagccgctcaagaaggtcaacggtgaatggaccgaagtgagctgggccgaaggcctggccgctgcgacgcagatcctgcgcgataacgccggtgatcagctcggcgtgctggtgcacccggccacctcgaacgaagaaggcgccttgctggcgcgtctggccgagggcctgggcagcggcaacctggatcaccgcctgctcaaccgcgatttctccgacgccgctgttgccgaagcctttgccacgccgctggccgagatcgaacaggccgatgtcgtggtgctgttcggcaccaacgtgcgccatgagctgccgctgctgcatgcccgcctgcgcaaggcgagcatccagaaccgcacccagatccattcggtcaacccggtcgatttcgatttcgccttcacccaggccagccggacggtggtctcgccgactcagctggctggcgcgctggacgacgccacgctgcgtgatgcggtcaagggcgcaagccgcgccgtgatcgtggtcggcgcattggcagaaaatcatccgcaggcggcgacgctgcgtgcagcggcacgtgcctttgcagcggcaaccggtgcgtcgctgtgccggatcccgcagggcgccaacgcggtcggcctggtctcgcagggcgtgttgccgactgcgcggacagtcgccggcatgtttgccgagccgcgtcaggcgtatgtggtgtacggcatcgaacccggtctggattttgccgatgcggccgctgcgcgcagcgcgctggccggcgcgaaagtcgtggctttcagccagttcgcctgtgcatccacacgcgacgtggccgatgtgattttgccgatcggcgcactgccggaaatcgatgcgtcgctgaccaatctcgatggccgcgtgcagaccgcacgtgctgcgggtcggttgccggtcgaggcgcgtgagggctggcgcgtgctgcgcgcactgggtggtgagctgggtctggctgggttcgagttcatcgacctggtcggtctgcgcgccggcatgcagcagcgcagcgtgactgcagcgacgtcggcgcagccggctactgcgagcgaaggtctggaagttgcagcaaccgctgcgatctaccgcaccgatgcggtggtacgccgcgccgccgcactgcagtcgcacccgctcaacatcgccccgtgtgtggcgatgcacccggagcaggccgcgcagctgcaggtcgctgccgggcaagtcgtcaaggttggcaccgacgcgggcagggcgaccttgccggtggtgctggacaagcgcgtcgcaccgggcacggtgtggatcgaatccggccatggcgcaaccgcgccgttgggtgcc

SEQ ID NO: 39086 - DNA, 1122 bp, Xanthomonas campestris
aagccgaagaaatcggttgccctgtccggcaccgccgccggcaataccgcgctgtgcaccgtggggcgcagcggcaacgatctgcactaccgtggttacgacattctggacctggccaccagcagcgaattcgaagagatcgcgtatctgctggtgcacggcaagctccccaacagtggtgaactgcgtggttacaaggccaagctgcgctcgttgcgcggcgtgccggcggcggtgaaaactgcgctggaacagctgccgccctcggcgcacccgatggatgtgatgcgcaccggcgtttccgtgctcggctgcctgcagccggaaaaggacgaccacaaccatccaggtgcgcgcgatatcgccgacaagctgatggccagcctgggctcgatgctgctgtactggtatcactacagccacaacggcaagcgcattgaggtagagaccgacgacgattcgatcggtgggcatttcctgcacctgttgcatggatttgcgccgaaagaatcgtgggtgcgcgcgatgcacaccagcctgatcctgtatgccgagcatgagttcaacgcgtcgacattcgcgagccgcgttatcgccggcaccggcagcgacatgtacagcgccattgccggcggcatcggcgcgctgcgtggccccaagcacggtggcgccaacgaagtggcattcgaagtgcagaagcgctacgacacgccggatgaggccgaggccgacatcaaggcacgggtggagcgcaaggaagtggtgatcggcttcggccacccggtgtacacggtgtccgacccgcgcaacaaggtgatcaaggacgtggcccgcgaactgtcggacgagcagggcagccgcaagatgtacgacatcgccgagcgcctggaaacggtgatgtgggacatcaagaagatgttcccgaacctggattggttcagtgcggtgagctaccacatgatgggcgtgccgacggcgatgtttacaccgctgttcgtgctggcacgcacggccggttggagcgcgcacatcatcgagcagcgcgtggatggcaagatcatccgcccctcggccaactacaccgggccggaagaccaggcgtttgtgccgctggatcagcgc

SEQ ID NO: 39087 - DNA, 2592 bp, Xanthomonas campestris
gccatgaacaactcgtaccgcaagcccttgccgggcacctcgttggactatttcgatgcccgcgccgctgtggatgcgttgcagcccggtgcgtatgccacgctgccgtacaccgcgcgtgtgcatgccgaaaacctggtgcgccgcgccgatccgcaacacgtggacgcttatctgcggcagttgatcgagcgcaagcgcgacctggatttcccgtggttcccggcgcgcgtggtgtgtcacgacatccttgggcagaccgcattggtggatctagccggtttgcgtgatgccattgccgagcagggtggtgacccggcgcaggtcaatccggtggtgccggtgcagttgatcgtggatcactcgctggcggtggaatatgccggcttcgacaagcaggcctttgccaagaatcgtggcgtggaagaccgccgcaacgcagaccggtttcacttcatcgaatggaccaagcgggcattcgagaatgtggaagtgatcccgccgggcaacgggatcatgcatcagatcaatctggaaaaaatgtcgccggtgatctacgtgcaggacggcgtggcgtttccagatacctgcgtgggcaccgacagccacaccccgcacgtggatgcgttgggcgtgattgccgtaggcgttggtggcctggaagcggagaacgtgatgctcggccgcgcttcgtggatgcggctgccggacatcattggcgtggagttgctggggcggccggcgccgggtatcaccgccaccgatatcgtgctggcgctcaccgaattcctgcgccagcagcgcgtggtgggcgcgtacctggagttctacggtgcgggtgccagtgcgctgaccatcggcgaccgcgccaccatttccaacatgacgccggagttcggcgccaccgcggcgatgttctacatcgaccagcagacgctggactacctgcgcctgaccgggcgcgaagacacgcagattgcgctggtggaaacatatgcccgccagaccggcttgtgggccgacgatctggtcaccgcgcagtacgagcgcatgctgcagttcgatctgtccagcgtggtgcgcaacatggccggcccgtcgaacccgcacaagcgtgtggcgaccagcgagctggccagccgtggcattgccgctgcgtgggagcaggtgcccgggcagatgcccgatggtgcggtcatcatcgcggcgattacctcgtgcaccaatacctccaatccgcgcaacgtcatcgccgctggcttgctggcgcgcaatgcgaatgcgcgcggtcttacgcgcaaaccatgggtgaaaagttcgctggcacctggctccaaggcggtgcagctgtacctggaagaggccggcttgcttggcgagctggagcagctgggcttcggcatcgtggcgttcgcttgcaccacctgcaacggcatgagcggcgcgctggacccggtgatccagcaggaaatcatcgagcgcgacctgtatgccaccgcggtgttgtcgggcaaccgcaatttcgatggacggatccacccgtacgcgaagcaggcttttctcgcatcgccgccgttggtgattgcctatgccatcgccggcacggtgcgcttcgatatcgagaaggatgtcctgggcgtggatgccgagggtgtgccggtcacgctcaaggacctgtggcccagcgatgcggagatcgatgcggtggtcgcgcgcagcgtgaagccggagcatttccgcagcgtgtacgagccgatgttcaggcgcagtggcctgcagggtgcacgcgtcagcccgttgtacgactggcgcgcgcagagtacctacatccgccgcccgccgtattgggagggcgcgctggcaggtgcgcgcaccttgcagggcatgcgcccgctggcggtgttgggcgacaacatcaccaccgatcatctgtcgccgtccaatgcgattcttgccagcagtgcggccggtgaatacctcacccagatgggcgtgccggaagaagacttcaattcctacgccacccaccgcggcgaccatctcaccgcgcagcgggcgacctttgccaaccccaagctggtgaacgaaatggcagtggtcgatggccaggtcacggccggttcgctggcgcggctggagccggaagggcaggtgctgcgcatgtgggaggcgatcgaaacctacatgcagcgcaagcagccgctgatcatcattgccggtgccgattacgggcaaggctcgtcgcgcgattgggcggccaagggcgtgcggctggccggtgtggaggcgatcgtggccgaaggcttcgagcggattcaccgtaccaacctgatcggcatgggcgtgttgccgctggagttcaagccggggaccgaccgcaagatgctgggtatcgatggcagcgagacgttcgatgtggtcggcgaacgcaccccgggcgcaacgctgacgctgtcggtgcatcgacgcgacggcgagcagctgcaggtgccggtgacctgccgcctggataccgcagaagaagtgtcgatctacgaggcgggcggcgtgctgcagcggtttgcacaggattttctggaagcaaccaaggct

SEQ ID NO: 39088 - DNA, 879 bp, Xanthomonas campestris
atgaccgcttccgcgccagctgccctcgctccggcccgcctccttgatggtcgccgcattgccgaggaattgctcgacggtctgaagctgcgcgtggatgcgcgcttggcggcgggcaagacccggcccgggctggcggtggtgctggtgggcggcgatccggcctcgtcggtgtatgtgcgcaacaagcgccgtgcggccgaaaaagtgggcatcgaggccttcgactacgacctgccacaaggcaccaccgaagccgagctggccgcgttgatcgaccaactcaacaccgatcccaagatccacggcatcctgatccagttgccgctgccgggcattcccgatgccaaccggttgatccagcgcatcgacccgcgcaaggacgtggacgggttccatccgcagaacgtcgggcatctggcgctgcgcgaattcggtttgcggccgtgtaccccgcgcggcatcgtgaccttgctggcgcataccgaccagccggtgcgcgggcgcaacgccaccatcgtcggggtgagttaccatgtgggccgcccgatggggctggagctgctgattgccgggtgcacggtgaccagctgccacaagttcaccccgccggatgtgctggaagccagcgtgcgcaacgccgacatcctggtggtggcggtgggccggccggggctgattccgggcgaatgggtcaagcctggcgcggtggtcatcgacgtgggcatcaaccgcctggacgatggacgcctggtcggcgatgtggggttcgaggccgcagcgcagcgcgccggctggatcaccccggtgccgggcggggtggggccgatgacggtggccacgctgatgcagaacacgctcgaggcggccgatgcggct

SEQ ID NO: 39089 - DNA, 990 bp, Xanthomonas campestris
atgagcaagcgtattcgcaaggccgtattccccgtcgcaggtcttgggacccgctttcttccggcaaccaagacggtgccgaaggaaatgctgccgatcatcgataaaccgcttatccagtacgccgtggacgaagccatccaggccggttgcgatacgctgatcttcgtcaccaatcgctacaagcactcgatcgccgactacttcgacaaggcctatgagctggaacagaagctcgagcgcgcaggcaagctcgagcaattggagctggtgcgccatgcactgcccgaaggcgtacgcgccatttttgtgacgcaggccgaagcactcggcctgggccacgcggtgctgtgtgccaaggccgtggtcggtgacgaaccgttcgcggtgctgctgccggacgacctgatgtggaaccgcggcgatgctgcgctgacccagatggccgatgtggcagaagcctccggcggcagcgtgatcgccgtggaagatgtgccgcacgacaagacggccagttatggcatcgtgtccaccgatgcgttcgacggccgcaagggccgcatcaatgccatcgtcgaaaagcccaagccggaagtggcgccgagcaatctggcagtcgtcggtcgttacgtgctcagcccgaagatcttcgagtacctggagtccacgggcgccggtgcaggtggcgagatccagctcaccgatgcgatcgccgagctgctcaagcaggaacaggtcgacgcgttccgtttcgagggccgtcgcttcgactgcggcgcgcacatcggtttgatcgaggccacggtgcactttgcgctcgagcacgacaagcatggcgcaccggccaaggaaatcattcgcagcgccttggctgcggctgacgcacgcggctgagtgttcggctagcggtgttgcaacgaacggcgccattgggcgccgttcgtcgtttcgggtccgcgcgttagcgaataatggcgccgtgctagagat

SEQ ID NO: 39090 - DNA, 837 bp, Xanthomonas campestris
gtgagtcttgtcacttccctgacctacgtgctgccgcatcggctgctgtcctcgctggcacgcgccctggcgtattccaagacgccggcgaccaaacagtggttgatcgacacggtcacgcgcaagtttggcgtggatctgagcgaagcccaggagccggatccgcacgcctaccccaccttcaatgcatttttcacccgcgcgctgaagcccggcgcgcgcgtgcccgacgccgacccgcaggcgctgttgatgccggcggacgggcgcatcagccagctcgggccgatcgagaacgggcgcatcttccaggccaagggccaatcgttcacggctgcggaactgctcggcgatgagtccgccgccgtgcccttccacaatggcctgttcgccacggtgtatctgtcgcccaaggactatcaccgcgtgcacatgccgtggagcggcaccttgcgcgaaaccgtgcatgtgcctggccggcttttcagtgttggccccgatgcagtgcgcaacgtgccgcggctgttcgcccgcaacgaacgcctggtgtgccacttcgataccgacttcggcccgatggcctcggtgatggtgggcgcgctgctggtgtccggcgtggaaaccgtctggagcggtgtggagatcccgcgctacggcgaccgcatcacgcgcaaggattaccgcggcaaggggatcacgctggagcgctttgcggagatggcgcgcttcaattatggatcgacggtcatcgtcttgctgccgccgggcgttgccgcgcttgaaggcgggctggctgcggaatcgtcggtgcggctgggacaggcgctggcacgacgc

SEQ ID NO: 39091 - DNA, 1087 bp, Xanthomonas campestris
atgggcagtaacagttttggccgcttgttcacggtcaccactttcggcgaatcacatgggccggcgatcggctgcatcatcgacggttgccctcccggcctggagatcgcgccggaagagttcacccacgacctgcagcggcgtgccaccggcaagagccggcatacctccgcgcgccgcgaggccgacgagatcgagatcctctccggcgtctacgagggccgcaccaccggcacgccgatcgggctgctgatccgcaacaccgatcagcgcagcaaggactacaccaacatcgcccagcagttccgccccgggcatgccgattacacctattggcagaaatacggcatccgcgacccgcgcggtggcgggcgctcgtccgcgcgcgaaaccaccatgcgcgtggccgccggcgtgatcgccaagaagtggctcaagcagcgctacggcgtgctggtgcgcggtttcctgtcgcagctgggcgagatccgcccgaccgggttcgattgggatgcggtggaagacaacccgttcttctggccgcatgcggcgcaggtgccggagctggaaacctatatggatgcgctgcgcaagtccggtgactcggtcggtgcgcgcgtggacgtggtggccggtggcgtgccgccgggctggggcgagccgatctacggcaagctggattccgaactggccgccgcgctgatgagcatcaatgcggtcaagggcgtggagattggcgatggcttctgccagtgccgcgcagaagggcaccgaacaccgcgacctgatcacccccgaaggcttcctcagcaatcacgccggcggcattcttggcggcatctccaccgggcaggcggtcaccgcctcgatggtgctcaagccgacctccagcctgcggctgcccggtgccaccgtggatgccgacggtgccgtggtggatgtcatcaccaccgggcgccacgacccgtgcgtgggcatccgtgccacgccgatcgccgaggccatgatggcgctggtattgatggaccaggccttgcgccaccgcgcccaatgcggcgacgtgggcgaggtgtcgccgctgattccc

SEQ ID NO: 39092 - DNA, 1017 bp, Xanthomonas campestris
agcaacgaaacccgtcgtttcaacgtcgccgtcgtgggcgccaccggcgctgtcggtgaaaccatgttgagcatcctggccgaacgtcagttcccggtcgccaccttgtatgcactggcatcggcgcgctcggcgggcgggcaggtcgagttcaacggcggcaaggtcgacgtgctggacctggccgagttcgaccccaccggtgtggatatcgcgctgttttccgcaggcggcagtgtctccaaggaatacggccccaagttcgctgcggccggtgcggtggtgatcgataattcctcggcgttccgctacgacgacgatgtgccgctggtggtgtccgaggtcaaccccgaagcgctgaagcagcgcccgcgcgggatcattgccaaccccaattgctcgaccatgcagatgctggtggcgctgggcccgatccaccgcaagtacggcatcgagcgcatcaatgtggcgacctatcagtcggtgtccggcggcggccgttcggcgatggaggagctgggcaagcagaccagcgaattgctgagcttccagcagatcgacccgcagcgcttcccggtgcagatcgccttcaacctgattccgcacatcgacgatttccaggacaacggttacaccaaggaagagatgaagctggtctgggagacccgcaagatcctcggcgacgaaaacatccaggtgaatcccactgcggtgcgcgtaccggtgttctacgggcattcggaagcggtggccatcgagacccgcgaaaagatcaccgtggccgaagcccgcgccttgctggcagcctcgccgggcgtggaagtggtggacgagcacaaggccggcggctacccgaccccggtgacgcatgcctccggccaggatgcggtattcgttggccgcatccgcgaggatctctcgcacccgtgcggcctgaatctgtggatcgtctccgacaatatccgcaagggcgccgcactcaatgccgtgcagctggccgaattggtcgcacaggaa

SEQ ID NO: 39093 - DNA, 651 bp, Xanthomonas campestris
atgaatcgatcgctgtaccgcacccgcatcaagttctgtggcatgacccgcgccggcgacatccggctcgccggcgagctgggtgtggacgcggtgggtttcatcttcgcccatggcagcccgcgccgcgtggccccggccgaggcgcgcgccatgcgccaggccaccgcgccgatggtcgatgtggtggcgttgttccgcaacaactccaaggaagaagtgcgcgaagtggtgcgcaccgtgcgtcccaccttgctgcagttccatggcgaagaagacgacgccttctgccgcagcttcaatctgccgtatctcaaggcggtgccgatgggcgcttccggcgtgaatggcgaagacgccaacgcgcggaccctgcagctcgcctatcccaatacggccggcttcctgttcgacagccatgcgccgggcgagggcggcgggaccggcaagaccttcgactggtcgcgcctgcccaccggcctgcatcgcccgttcctgctggctggcggcatcaccgccgacaacgtcttcgacgcgatcgtggcgaccctgccgtggggcgtggacgtgtccagcggcgtggagcttgcgccgggcatcaaggacggccacaagatgcgcaagttcgtcgaagaagtgcgccgcgccgac

SEQ ID NO: 39094 - DNA, 1818 bp, Xanthomonas campestris
atgttccgctggttcgaatccctgatcgacacctttccgcccatcgagcgggagatgccgccacgcagcgtgtggcgcttttacctgcattatctgcggccgttgtggccaattctgttggcgaccttgatcgccggactactgctggcgctggtggaagtggcgatgttcgacttcctcggccgcatcgtcgacatgctggccgagcagccggggccggagttcttccgtcgccatgctggcgagctggtgtggatggcggcgatcacgctggtggcgcggccgtttttcaccgggctgcataacctgctggtcaatcaggccatcgtgccgggcctgagcaaccgttcgcgctggctgatgcacaactacgtggtgcgccagagtctggcgttcttccacaacgattttgccgggcgtatcgccaaccgcgtgatgcagaccggcacctcgctgcgcgaatcggcggtgcagatggtcgatgcactctggtacatcgtggtctataccggcagcgcactgtggttgttcgcgcaggccgacccgtggttgatggtgccgctgctgtgttggctggtggtgtatgtggggttgatggcgttcttcgtgccgcgcatgaaggcgcgtgcgtgggtggcatcggacgcgcgctccaaggccaccggccgcatcgtggacggctacaccaatatcgccacgctcaagctgttttcgcatgcgcgccgcgaagaggcctacgtgcgcgatgcgatcgacgagctggcggtcaagcatcgcctgcagacgcgcgtgaccaccgcaatggacaccgccatcgccatcgccaacggcttcctgatcgtgggcacctgtgggctggcgttgtggctgtggagccgcggccagatcagcgtgggcgccattacgctggccaccgggctggtgatccgcatccacaacatgtccggctggatcatgtggacggtgaacggcattttcgaagacatcggtagcgtgcaggacggcatgcagaccattgcccagcccctgacggtgcaggaccagcccaccgcgctgccgctgcaggtgacacgcggcgccgtgcatttcgaccagatccacttccattatggcaagcgcggcggtgtgatcgccgggctcgacctgcgggtgcgcgccggcgaaaagatcggtctggtggggccctccggcgcaggcaagtcgacgctggtcaacgtgctgctgcgcctgtacgacctggagcaggggcgcatcctgatcgatggccaggacatcgcccaggtcacgcaggaaagcctgcgcgggcagatcggcctggtcacgcaggacacctcgctgctgcaccgttccattcgcgacaacctgctgtacggccgcccgcaggccaccgaggcgcaactgctggacgcagtgcacaaggcgcgtgcggatggctttatcgacacgctggtggatggcgaaggccgccgcggtttcgatgcacatgtgggcgaacgcggggtcaagttgtcgggtggccagcgccagcgcatcgccatcgcacgcgtgctgctgaaagacgcgccgatcctgatcctggacgaagccacctcggcgctggattcggaagtggaagcggccatccaggacagcctggatgcgttgatgagtgacaagaccgtcattgcgatcgcgcatcggctctccaccatcgcgcgcatggatcgcctggtggtgatggatggtgggcgcatcgtcgagacaggcacgcatgcggaactgatcgcgcacggcggcctgtacgcccggctatgggcgcggcagaccggtgggtttgtt

SEQ ID NO: 39095 - DNA, 1059 bp, Xanthomonas campestris
cgagacaacgttatgccgccgctgaccgatgacctgcgtatccgcaagatcgaaccgttgaccccgccctcgcagctgctgtcgctgctgccctgcgatgagcgcgcctccgagaccgtcaccaacgcacgtgccgccttgcacgagattctgcacgggcgcgacgaccgcctggcggtggtgatcggcccctgttcgatccacgaacccgtggccgcgatggagtacgcgcagcgtctgcgccccttgcgtgagcagtttggggatgcgctggaaatcgtgatgcgcgtgtacttcgaaaagccgcgcaccaccatcggctggaagggcctgatcaacgacccggacctggatggcagtttccagatcaacaagggcctgcgcgtggcgcgtggcttgctgcgcgatatcaataacctcggcctgccggctggcgtggaatttctcgacatcatctcgccgcagtacatcgccgacctggtggcctggggcgcgatcggcgcgcggaccaccgaaagccaggtgcatcgcgaaatggcctccggcctgtcgtgcccagtggggttcaagaacggcaccggtggcgacgtcaagattgccgtggacgcggtgggtgcggcctcgcacccgcaccatttcctggcggtgaccaaggatggccacaccgcggtggcggccaccgcgggcaacccggattgccatgtgattttgcgcggcggcaagcagcccaacttcgacgcggctaatgtggaagcatccagccaggtgctcaacaaggccgggttgccggcgcggctgatgatcgacgccagccacgccaacagcggcaagaacccggacaaccagccgaaggtcatcgacgacattgccacgcagttggagggcggcgagacgcgcatcgttggcgtgatggtggaaagccacctggtcggcggccggcaggaactggtgccgggcggcacgctgacctacggccagagcatcaccgacggttgcctggattgggacacctcgcttcaggtgctggagcgcctggcgagtgcggtgcgtgcacgtcgt

SEQ ID NO: 39096 - DNA, 789 bp, Xanthomonas campestris
ctgtacgaccaggccacctggagcgaaggccccacctggtgggaggcccagcgcacgctggtgtggagcgacctggttggccgccgcgtgctggggtggcgcgaagacggcgccgtggatgtgttgctggatgccaccgccttcaccaatggcaacgcggtggatgcgcagcagcgcctggtgcactgcgaacacggccggcgcgccatcacccgcagcgatgccgatggccaggcccacctgctggtgggccgttatgccggcaagcggctcaactcgcccaatgacctgatcgtggcgcgcgatggcgcgatctggttcaccgacccgccgttcggcctgcgcaagcccagccagggctgcccggccgatccggagctcgcccaccacagcgtgtaccggctgccgccggacggcggcccgctgcagcgcatggccgacctggaccaccccaacgggctggcgttctcgcccgacgagcagaccttgtacgtctcgcagacgccggagcagggacacggcagcgtggaaatcaccgcgtttgcctggcgcgatggcgcgctgcacgaccgccgccacttcgccagcgtcccggacgggctgccggatggcttctgtgtggatcgcggcggctggctatggagcagctccggcaccggcgtgtgcgtattcgacagcgacgggcaactgctcgggcacatccccaccccgggcaccgcctccaactgcaccttcgaccaggcacagcagcggctgttcatcaccggcgggccgtgtctgtggatgctg

SEQ ID NO: 39097 - DNA, 1305 bp, Xanthomonas campestris
ctggccacccgtctgggcgggctgggactggacccggccgccggccgcaccctgatccgcgaaggcatcctgcgccgcgcggtgggcctgaccctggaagccaccggttgcgaagcgccgatgggcgccacctgcaaggtggaagtcgatggcggctgggtcgacgccgaagtggtcggtttttccggcgaacgcacctatctgatgcccagcgccgaactgcacggcctgctgcccaacgcccgtgtggtgccctcgcggcgccgcggcggcgtggaagtgggcgaaggcctgcttggccgcgtcatcgacagcgacggcaccccgctggatggcaagggcccgatccgcgccgaaggcagcgtgggcatggccggcgtgtcgatcaacccgctggcgcgcgaacccatcaccacctcgctggacgtgggcgtgcgcgccatcaacgcgatgctgccgatcggccgcggccagcgcgtgggtctgttcgccggctccggcgtcggtaaatcgacgctgctcggcatgatgacccgcttcacctccgccgacgtcatcgtggtggggctgatcggcgaacgtggccgcgaagtgcgcgacttcgtcgaaaccaccctgggcgaggaaggtctgcgccgtgccgtggtcgtggccgccccggccgaccgcccgccgctggcccgcctgcacggcgcctaccgcgccaccgcgattgccgaatggttccgcgaccagggcctgaacgtgctgctgctgatggattcgctgacccgttttgcgcaggcccagcgcgagatcggcctgtcggtcggcgagccgcccaccacccgcggctacccaccgtcggtgttcgccaaattgccggcgctggtggaacgtgccggcaacggcgccaagggccgcggctcgatcaccgccttctacaccgtactgaccgagggcgacgacccgcaggacccgatcgccgacgccgcgcgcgccattctcgacggccacatcctgctctcgcgccgggttgccgacagcggcctgtacccggccatcgacctggaatcctcggtcagccgcgtggtgcaggacattgccgacgacacctggcgcctgcgcatccgcaagctcaagcgcctgctgtcggcctacaccgccaaccgcgacctgatcgccatcggcgcctaccagcgcggcagcgacccggccaccgacgaagcgttggcgcgttggccggaaattgtcgacttccttggccaggacgtgcacaaggcgtccgatctgaccgacagcctgtccgcgctgcagcggctggtg

SEQ ID NO: 39098 - DNA, 3501 bp, Xanthomonas campestris
atgggtctttccacgatcaagctgtccggttccaagtcgtttggtcgaacccgaccacgttgcacctgccccaccaacatgaccggcatcgtcggccccaatggctgcggcaagtccaacatcatcgatccggtgcgctgggtgatggcccaaagctcggccagccgtctgcgcggcgactcgctgaccgacgtgatcttctccggctcctcggcgcgcaagccggtgtcgcaggcgacggtggagctgatcttcgataactccgatcacaccatctccggcgagttcgcctcgttcaacgagatctcggtcaagcgcctggtcagccgcgacggcaccagcgcctattacctcaacggcaccaagtgccggcgccgcgacatcaccgacctgttcctgggcactggtctggggccacgcagctactcgatcatcgagcagggcatgatcagccagatcatcgaggcgcgcccggaagatctgcgcgtctacttggaagaagccgccggcatttccaagtacaaggaacgccgcaaggaaaccgaaacgcgcatccgccatacgcgcgaaaacctcgatcgcctgggtgacctgcgcgaggaaatcaccaagcagctggcgcatctgcagcgccaggcgcggcaggccgagcagtaccaggcgttacaggaagaacgccgcatcaaggatgcggagtggaaggcgctggaataccgcggcctggatggccggctgcaaggcctgcgtgaaaagttgaatcaggaagaaacccgcctgcagcagttgatcgccgagcagcgcgatgccgaagcgcgcatcgaaaccggccgtgtgcgccgcgaagaggccgccgaagcggtggccaaggcgcaggccgatgtctaccaggtcggtggcgcactggcgcgtatcgagcagcagatccagcaccagcgcgaactctcgcatcgcctgcacaaggcgcgcgacgaagcgcagagccagctgcaggagctcacccagcacatcagcggcgactccgccaagctggcggtgttgcgcgaggcggtggccgatgccgaaccgcagctggagcaattgcgcgaagatcacgaattccgccaggacgcactgcgcgaggccgaagcccgcctggccgactggcagcagcgctgggaaacccataaccgcgacaccggcgaagcctcgcgcgccggcgaagtggagcgcacccgcgtcgattatctggaccggcaatcgctggaagccgaccgtcgccgcgaggcgctggtcaacgaacgcgccgggctggatctggatgcgttagccgaagcgttcgaacagatcgaactgcggcatgaaacgcaaaaggcctcgctggacgggctgaccgagcaggtcgaagcgcgcaagcacgcgctgggtggcttgcaggaacagcaacgcgccagccagggcgaactggccgaagtccgcaagcaggcgcaggccgcacgcggccggctgtcgtcattggaaacgctgcagcaggcagcgctgggtcaggagcagggcgccgccgtggcctggctcaaggcgcgcgggctggattcggccgtgcgtgtgggcgagcgcatcagcgtggaaagcggctgggaaaacgcggtggaaggcgcgttgggccagctgatcgaaggcgtgctggtggaggcgccggaacaactggtcgacgcgctgggtgagttgggcgacgggcgcatcgcgctggtgtcgtcggctaccgacaacgtgcagttcgcgccgacctcgcttgccgccaaggtgcaggggccgattgcgatccgccgcttgctggcgcgcctgcatgccgccgaagacctggatgccgcgcgcagcctgcagtgcaacctgccggacggcgattcggtgatcacccgcagcggcgagcggctgggcgagggctgggtgcgcgtgtcgcgctccggcgcggccaagcagggcgcgttgctgcgcgagcgcgagatccaggagctgcgctcgcagatcgacacgctgcaggagcgggagggcgacctggaagaacaactggccagcttccgcgagcaactgctggccgccgaacaacagcgcgaagacgcgcagcgccagctgtacatggcgcaccgcagcgtgtccgaactggccggccagctgcagagccagcagggcaaggtggacgcggcacgtgggcgcatcgagcggatcgaggccgaattagggcagttgctggaaaccctggacaccagccgcgagcaggcccgcgaagcgcgcgccaaactcgaggacgcggtggtgcgcatgggcgacctgcaaggcacccgcgaagcgctggaaagcgaacgccgccagcttaccgatgcacgcgaccaggcccgcgatgccgcgcgcggcgtacgcgatgcgatgcacgccttggcactcacgctggaatcccagcgcacccagatcacctcgctgagccagaccctggagcgcatggacagccagcgtggccagctcgacacgcgcctggaagatctggtggcgcagctgagcgaaggcgattctccggtcgaaacgcttgaacacgaacatcaggcagccttgagcgagcgcgtgcgcaccgagcgcgtgctcggcgaggcgcgcaccatgctggacagcatcgacggcgaactgcgcagcttcgaacagacccgccagcagcgcgacgagcaggctctggcgcagcgcgagcgcatctcccagcgcaagctcgaccagcaggcgctggtgctcaacgccgaacaactggccgccgcggtggtcaaggccggcttcgtgctcgaagacgtggtcaatgggttggaggaggccgccaacccggccgagtgggacgcggcggtggggcagatcgatgcccgcatgcgccggctggagccggtcaacctggccgcgatccaggaatacggcgaagccgctcagcgttccgagtatctggacgcgcagaacgtggacctgacgaccgcactggaaacgctcgaagaagcgatccgcaagatcgaccgcgaaacccgtggccgcttcaaggacactttcgaccgcgtcaactcgggtgtgcaggccttgtatccgcgcttgttcggcggtgggcacgcgtatctggagctcaccggcgaagatctgctcgacaccggcgtgaccatcatggcgcgcccgccgggcaagcgcgtgtcgagcatttcgctgctgtccggtggcgaaaaggcgatgaccgcggtggcgctggtatttgcgatcttccagctcaacccggcgccgttctgcctgctcgatgaggtggacgcaccgctggacgaggccaacgtcggccgcctggccaacatggtcaaggagatgagcgagaaggtgcagttcctgttcgtcagccacaacaaggcgaccatggaagcagcgcgtcagctctccggcgtgaccatgcgcgaacccggcgtcagtcgcctggtgagcgtggacctggaagaggccgcacgtttggcgggcgcg

SEQ ID NO: 39099 - DNA, 1110 bp, Xanthomonas campestris
gtctcgcgccgttccttcctcagccttgccacgtccggcctggcggtgtccgccctggggctgacgcctgcggcagaggcggcccgcaagcgcgctgccgcacctgcagcgccgagcgtggcgcttgcggccggcacggtgtacctcaacttcaacgagcatcccaccgggctgtcgccggctgcactggatgcggcaagccgctcgctggcgcgctcgggccgctatctgttcgaaatggaacaggacctgcgcaacctgatggccggcgaactgcagctgccgcacgaccaccttgcgttctttcccggctccagcgacccgctcaaccgcgccggcaccttgttcacgtcaccgcgcgccggcttggtcatggccgacccgaccttcgaagcactggccgacctggccgccgcgcaaggcgtgccggtccgcaaagtgccgctgcgtgccgacggcgcgcatgacgtcaaggccatggccaaggccgacccgagcgccgggctgatctatctgtgcaaccccaacaacccgaccggctcgattaccccgcgcgcggagatcgaatggctgctcgccaacaaacccgccagcgccgtgctggtggtggacgaagcctacatccactacagcaccgagccatcggtggccgatctggtgcgccagcgccaggacctgatcgtgttgcgcacgttttccaagctctacggcatggccggcatgcggctgggtgccgcactcgcccccccgggtctgctgaccaagctggccagcctgggtggcaacccgctgcccgtcccggcgatggccgcgggcattgccagcctgcgcgatccgatgctggtgcccagccgccgcgccgacaacgcccgtgtccgcgacgacaccatcgcctggctgaaatccaagggctacacctgcctgccatcgcaggccaattgcttcatggtcgacgtcaagcgcgacggcaaggtgttcgccgactcgatgcagaagcagggcgtcatcgtcggccgcagctggccgatctggcccaagcgggtgcgtgtcaccgtgggcagcgaggcagaaatgctgcgcttccgcgaggcgtttgctaaagcgaagcgt

SEQ ID NO: 39100 - DNA, 2394 bp, Xanthomonas campestris
ctgctggggctggtgctgctggcaggtggtgcgtggctcgccacgctgggcggatcctggtattacgcaccggcaggcctggcgatgctgatcgctggcgtgttgctgttccgcggccgcaatgccggcgcgtggtggtttgccgccgtcgtggccgccacgctgctgtggacgtggtgggaatcgggcagtgattactggcgctgggtgccgcggctcgggttgatcgtgggcctggcgtttgtgctggcgctgctgttgcccaagctcgagcgcccggtgtcgcgcgccgtctcgcgcagcgtggctggcggactggcagtggtgtttgtggtggcctttgcgttggccttcgtgccgttcggaatcaccgaggccgagggtgcattgacgcaggtggcaggcatcgccgcaggtgtggtcaatcgccccgccgatggcgcacagccggcacagcccgccaatgcgccggtcgatgacgactgggccgcatatggacgcagccaggctgggcagcgctattcgccactcacccaaatcaatcgcgacaatgtcagccagctgcagcaggcgtgggtgttccataccggcgatgtgccgaccaagcgctggggcgccgaaaccacaccgttgaaggtcggcgacagcctgtatctgtgtagcgcgcgcaatcaggtgatcgcgctggacgcctccaccggcaagcagcgctggcgctacgaccccaaggtcaaggacgaggccattccatacaccgcggcctgccgcggggtgtcgtattacgaagtgccgacggcggcgccggccgcaaatgacgcagccgcttcgcaggcggcgacggcgcctgcgctgtgccgtacgcgcgtgatcgaaggcacgctggatgggcgcctgattgcattggatgcgcgcaccgggacaccatgcgcggacttcggcactcacggtcaggtcgacatcaccgtcggcatgggcgagacgccaccgggctacatctcgatcaactcgccgccggccatcgtgcgcggcgtggtggtcatcgggcatcaggtccttgacgggcaaaagcgttatgagccctcgggcgtgatccagggctttgacgcggtcaccggccagttgcgctgggcctgggacatgacccatcccgaatggaatggtgcaccgccgcctggccagacctggacgcgcggcacccccaacatgtggaccaccgcagcggccgacgagcagctgggttacgtgtatctgccgatgggcaattccaccgcggactactggagcagctcgcgcacgccgccggaaaaccgctatgccacctcgctggtggcgttggatgtgaccaccggcaagccggtgtggaatttccagaccacgcatatcgacgcatgggattacgacctcggctcgcagcccagcctgatcgatttccccaaggatggcgtcaacgtgccggccgtgttgctgccgagcaagcagggcgagttgtacgtgctggaccgtcgcaccggcgagccgctggttggcgtggaagagcgcgccgtgcccggcggtggtgtggagccgcagatgcgctacaagacccagccgttctcgctgtatcacacgctgcgcaagccggatctgaccgagcgcgacatgtggggcatgaccccgatcgatcagctggtgtgccgtatccagttccgcaaggcgagctacaagggcatctacacgccgcccgaagccgaccggcattccatcgaataccccggctataacggcggctcggactggggcagcgtggcggtggatccgcaccgtggcgtgatcgtggccaactacaacgacatgcccaactacaacatcctggtgccgcgcgccaaggcggacaaactgggctgggctccgcgcgatcaggtgcgtggcgatgccggtggtgccgaaggcgccggcgacccgcaggccggcacgccctacgcggtaaacgtcaacgccggctggcgtttgccgttcaccaagctgctgtgcaagcagccaccctatggcggcattcgcgccatcgatctgaagagcggcaagaccctgtgggaccgtccctttggcagtgcgcgcggcaacgggccgttcgggattcgctccggcctgccgatcgaaatcggcacgccgaacaacggtggctcggtggtcactgcgggtggtctgatcttcattgccgccgcaaccgatgacctgatccgtgcgatcgacctggccaccggcaaggagctgtggcacgccaagctgccggccggtggccaggccaatccgatggtctacgcgtacggcggccgcgagtatctggtgatcatggcggccggtcaccacttcatggaaacaccggcaggcgatgccctggtggcctacgcgttgccg

SEQ ID NO: 39101 - DNA, 1521 bp, Xanthomonas campestris
tctgttgtgttgcagcccggccaggtcaccctggcgcagtggcgtgcgctgtatcgcggtgccgaagtcaccctggaccctgcctgcgcgcaggcggtgttgcgtagcgcgcagacggtggaggcgatcgtggcgcggggcgagccggtgtacggggtcaacaccggcttcggcaagctggccagcgtgcggatcgaacgcgacgatctgcagaccctgcaacgcaatatcgtgctctcgcacgcggccggtgtcggcgaccccacgccggtgccggtggtgcggctgatgatggcgctcaagctcaccagcctggcgcagggcgcctcgggaattcagcccgataccctggcgctgctggaggcgatgctgcgtcagggcatcacgccagtggtgccgtgccagggctcggtgggtgcgtcgggcgacctggcgcccctgtcacacctggccgcggtgatgatcggcgtgggcgaggccttcgtcggcgatcagcgcctgccggcggcggatgcgctggcccgggcgcagctgcagccacgcgtgctcggtgccaaagagggcctggcgctgctcaacggcacccagttctccaccgcctgcgcgctggccggcttgttcgagatcgaaaccgtgctgcaggccgcgctggtcaccggcgcgctgtcggtggaagcggccaagggctcggacacgcccttcgatgcgcgcatccatgccttgcgcgggcaacccgggcagatcgcaaccgcggccgccttgcgtgcgctgatggcggaatcggccatccgcgaatcgcatcggctgggcgatgtgcgtgtgcaggatccgtactgcctgcgctgccagccacaggtgatgggcgcggcactggatgtgatgcgccaggccgcgcgcacattggaaattgaagccaatggcgtgtccgacaacccgctggtcttcagcgataccggcgaggcattgtccggtggcaacttccacgccgagccggtggcattcgcggccgacatgctggcgctggcggtgtgcgaaatcggctcgatcagcgagcgccgcaccgcgatgctggtcgaccctgcgctctcgggcctgccggcgtttctcaccccgcgccccggcttgaattcgggcttcatgattccacaggtgaccgccgccgcgctggtctcggaaaacaagcaatgcgcctacccagccagcgtcgattcgattccgacctccgccaaccaggaagatcacgtgtcgatggcagcgcatggcgcacgccgcctgctggcgatggccgacaacgccgcgcacgtcatcggcatcgaactgctggccgccgtgcagggctgcgatttccacgcgccgctgcgctccagcgccgcgctggaagccgcgcgtgcactgctgcgtgcgcaggtgcccacgctgcaggacgaccgttacttccatccggacatgctggccgccagcgcgctggtgcgctcgggcgccctcgccactgcggtgggcatcgtactgcctggcgtggag

SEQ ID NO: 39102 - DNA, 1077 bp, Xanthomonas campestris
cgcgcgttcaatttcagtgccggccctgcgacattgccggaatcggtcctgcggcaagcgcaggaagagatggtcgagtggaacggcgtgggtgcctcgatcgtggaaataagccaccgcagcgccgacttcatggcggtggccgccgccgccgaggcggacttgcgcacgctgttgtcaattcccgacgactacgcggtgctgttcacctccggtggtgcgaccaccatccaggcgctgttgccgctgaatttcgccgcgcctggccaggcagtcgattacgtagtcagtggccattggggcaagaccgcgatcaagcaggccacgccgtatgtggacgtgcgcgtggccgccgatggccagcccggcggttatgtcgacatcccgccggtcgcgagctggacgctgtcgccgcacgccgcgtacgtgcacatcactgccaacgaaaccattcacggggtcgagttccgcgacacgccggacgtgggcaccttgccgctgttcgccgacttcagttcgtcgatcgcctccgagccgctggacatcaggcgctatggcctgatctatgccggggcgcagaagaatctgggcccggtgggtatttcggtggtgatcgtgcgccgcgaattgctcgagcgtgccggccaaccgcgtgcagacatcttcaattacgcctcgcacgtggcgcgcgattcgatgctcaacacgccgcccacctggaactggtatctgctcgggctcaccgtcaaatggatgctcgagcagggtggggtggccgcattcgcgcagcgcaatgccgaaaaggccgcgttggtgtatggcgcaatcgatggctccggtggcttctatcgcaaccaggtgatgccgacggtgcgttcgcgcatgaatatcccgtttttcctgggcgatgagcagctcgatgcgttgttcgtcagcgagtccaaagcggccggcttgctcgcgctgaaggggcacaaggccgtgggcggtatccgcgcttcgctgtacaacgccatgccggtggccggtgcacaggcactggtggccttcatgcacgatttccagcagcgccacggc

SEQ ID NO: 39103 - DNA, 357 bp, Xanthomonas campestris
aacgccatggatatcttcaaagtatttacgctcgaggccgcccaccggctgcccaacgttccgccgggccataagtgcgcacggctgcatgggcattcgttccgggtcgagctgcatgtcagcggcgaaccgggtgccgagaccggctggatcatggacttcggcgacatcaaggctgccttccagccgatctacgaccggctcgatcaccactacctcaatgacatcgaggggcttgaaaaccccaccagcgaacgcctggccatctggatctggcagcagctcaagccggccttgccgcagttgagcgaaatcgtggtgcacgagacctgcacttccggctgccgctatcgcggt

SEQ ID NO: 39104 - DNA, 1206 bp, Xanthomonas campestris
atgcgccgtgttgtcgtcaccggaatgggcatcaattcgtgcctgggcaatgacctggacacggtctccagcgcgctgcgcgaaagccgctcgggcatcaccgcattacccgaccatgccgaagcgggtctgcgcagccaggtgggcggcgcggtggacatcgacctggacggattgatcgaccgcaagctcaagcgcttcatgggcgatgcctcggcctacgcctacctggcgatgcgcgatgccattgccgatgccggcctgtcgcccgagcaggtcagcgacctgcgcaccggcgtgattgccggctccggcggcggctccagccagtggcaggtggaaacggccgatctgctgcgcgcacgcggcgtgcgcaaggtaggcccgtacatggtgccgcgcacgatgtgttcggcagtctcggcctcgctggccactgccttcaagatccgcggcctgagctattcgttgtcggccgcctgcgcgacctcggcgcattgcattggcgcggctgcggatctgatccggcatggtgcgcaggatgtgatgtttgccggcggcggcgaagaactgcactggaccatgagcgtgatgttcgatgcgatgggcgcgttgtccaccggcttcaacgatcgcccggcggtggcctcgcgtccctacgatgcgcaacgcgatgggttcgtcatcggcagcggcggtggcatgttggtgctggaagactacgaccacgccatcgcgcgcggcgcccgcatccatgccgaactgctgggctacggcgtgacctccgatggcgcggacatggtcgcgcccagtggcgagggcgcggtgcgctgcatgcacatggcgatgcaagggctggatcgcccgatcgactatctcaacacgcacggcacctccaccccgctgggcgatgccaccgagctgggcgcggtgcgcgaggtgttcggcgacaacgtgccaccgctgtcctcgaccaaggcgttgtccggtcattcgctgggtgcggcaagcgtgcacgaggcgatctacagcatgctgatgctgcgcgatggcttcatggccggctcggcgcatatcgacgaactcgacccgcgcgcggaaggcttcccgatcctgcgcgctacacgcgaggcgacgttgaacacggtgatgtccaacagcttcggcttcggcggcaccaacggcgtgctggtgttcggccgggtg

SEQ ID NO: 39105 - DNA, 2016 bp, Xanthomonas campestris
atgaccaacccgctgctcgatttttccggactgccgtccttcgatacgatccgccccgaccatgtgggcccggcgatcgatcagctgctggccgatgccgaggcagcggtgaaggcggccgaacaggtcagcccggtcagctgggacagtttcgtggtgccgctggatgatgccaccgagcgcctgtggcgcgcctggggccaggtcggccacctgcaggcggtgatgaatactcccgagctgcgcgaggcctacaatagcaatctgcccaaggtcagccgcttcggcagtgcactggcgcagaacctggccctgtacgcgcaatacaaggcgctggccgcctcgccggaagctgcgcactacgacgaagcccggcgcaaggtgctcgacaacgcgctgcgcgatttccgcctgggcggcgccgaactggacgacgcctccaaggcgcgctttgcacagatccaggaagagttgtccggcctggccgccaagttttcgcagaacgtgctcgacgccaccgacgcgtgggcacacgtgacgcaggacgagacccagttgtcgggcttgccgtccgaagtggttgccgccgcacgcgcggcagcggaaaaggatggggctgccggctggaaattcaccttgcagatgccgtgctacctgccggtgcagagcgatgccgacagccgcgaactgcgcgcgcggttgtaccgcgccaatgccgagcgcgcctccgaattcggcgatgtcgcgctggacaacagcgccaccatccagcgcatcctggcgctgcgcgccgagctggcacagctgctgggctttgccagctacgcggactattccatcgccaccaagatggcgcaaagcccggatgaagtgatgggctttctgcgtgatctggccgtgcgtgccaagccgtatgcacaacaggatcgtgccgaactggaagcctttgcgcgcgacgaactcggcctggagcagctggaagcctgggacctggcgtatgccggcgaaaagctcaagcaggcgcgctacagcttctccgagcaggaagtgaagcagtacttcaccgagcccaaggtgctggctggcctgttcgatgtgatccatagcctgtacggcctgactgtcaaacccgatagcgcgccggtctggcacccggacgtgcgcttctatcggctggaagatgcgcagggcgcactggtggggcagttctatctggatctgtacgcgcgcgagggcaagcgcggtggtgcatggatggacgactgccgcaatcgccgcgagaccagtcagggtgtgcagacgccgctggtgtatctggtgtgcaatttcggccgtggcagcggcgatgcgccggccacattccggcacggcgaagtcaccacgctgttccatgaaatgggccacggcctgcatcagttgctcacccgtatcggcgagctcggggtggccggcatcaacggcgtggaatgggatgcagtggagctgcccagccagttcatggagaacttctgctgggaatgggagcgcgtgcaggcgatgaccgcgcacgtgcaaaccggcgagccgctgccgcgcaatctgttcgaccggctgctggccgcgcgcaatttccagagcggcatgttcaccgtgcgtcagctggaattcgcgttgttcgacatgcaattgcacagcagtttcgatccggcccaggacagcgtgctggagttgatcgagcgcgtgcgcgacgaagtggcggtgaatcgcccgccgacgtggaatcgcttcccgcatcagttcagccacatttttgcgggcggctacgcggccgggtattacagctacaagtgggccgaggtcctcagcgccgatgcctacgcggcgttcgaagaagcgcccgagcaggtggccgacaccggcgcgcggttccggcatgaagtgctggcgcgtggtggcagccgcagcgcagcggacaacttccgcgccttccgtggacgcgcgcccaagatcgacgcgctgctgcggcacaacggcatg

SEQ ID NO: 39106 - DNA, 1872 bp, Xanthomonas campestris
tggtccctcgaccaagcccgcaagacctactcgatcccgcattgggccgatgggtatttcgatgtgaacgacgccggccatgtggtggtcaaaccgaccgccgacggccctgcggtgtcgctgcccgaagtggtggatgccgcgcgtgcggccggcgccaagctgccgctgctggtgcgcttcccggacatcctgggccagcgcctgggcaagctgcaggcggcgttcgcccaggcccaggccgattgggattacgccggtggttacaccgcggtgtacccgatcaaggtcaaccagcaccgtggcgtggccggcacgctggccagccaccacggcgagggcttcggcctggaagcgggcagcaagcccgagctgatggcggtgctggcactgtcgcgtccgggtgggctgatcgtctgcaacggctacaaggatcgcgagtacatccgcctggcgctgatcgggcgcaagctcggcctgcagaccttcatcgtcatcgaaaagccctccgagctgaacctggtgctggaagaggcgcgcgcgctggacgtcaagccgggcctgggcgtgcgcatgcggctggcgtcgctgggcgcgggcaagtggcagaacagcggtggcgacaaggccaagttcgggctgtcgccgcgccaggtgctggacctgtggaagtcgctgcgcgacaccgaatacgccgatagcctgaacctgctgcatttccatatgggctcgcagatttccaacgtgcgcgacatcgccaacggcatgcgcgaggccacccggtatttcgtggaactctcgcgcctgggcgcgaagatcagccatgtggatgtcggcggcggcttgggcatcgactacgaaggcacgcgttcgcgcagctattgctcgatcaattacggcctgcattcgtacgccagcaacatcgtgcagccgctggccagtgcctgcgaagagcacggcctgccgccgccgcgcatcgtcaccgaatgcggccgcgcgatgactgcgcaccacgcggtgctgatcgccaacgtctcggaagtggagcaggcgccggaaggccgtgtgccggatgcgcacgacgacgagccggcggcgatccgtcacctgcgcgagatccacgacgagctcgatgtgcgcccggcggtggaactgttccaggaagcgcagcacttccatgccgaagggctgagcgcctacgcgctgggccagatcgacctgacccaccgtgcgcgcatcgacgacctgttctacgccatcgcccacggcgtgcgtgcgcgcctgagcttcgacgaaaagagccatcgcccggtgctggacgagctcaacgagcggctggtggacaaatacttcgtcaacttcagcgtgttcgaatcgattccggatgtgtgggcgatcgatcaggtcttcccgatcgtgccgatcgagcgcctgaacgaggccccgcagcggcgcggcatcatcgccgacatgacctgcgattccgacggcatggtcaagacctacgtcgagaacgaaagcctggacagctcgctgccattgcatggcttgaaccccggcgagagctatcgcattggcttcttcctggtgggtgcctaccaggaaatcctgggcgacatccataacctgttcggcgacaccgatgcggtggaagttgcggtggatggcaccggctaccgcatcgcgcagcagcgtcgcggcgataccaccgacgtgatgctcgactacgtgggctatcagctggacactctgcgtgccacctatgccgaacgtatcgccgcggcacagctgccgcccgagcgcgcgcaggaagtgcacgacgcgctggaagccggcctgaccggctacacctatctgtccgacgaaccgttg

SEQ ID NO: 39107 - DNA, 1827 bp, Xanthomonas campestris
gtgattgaaatcaaggactacgcacatgggatagaacaacgatgtcccagtcatcgaagcgatcgcctgcgttttcgacccactgctcaaggaccatggactggagacgctcaactctgacaatgccaacctcgaagcacatgactcgtgcgctggcgtgcggaaggaactcaacgttaaaattggttacaccctggcctaacgacctaacgacctactcctggaaacgcaaggcgatgtcagtacacaacacgccgcgccgaaacttatacagggacgtcagactgggatccgcggcgtacacctgggacgaaatgcccagcgactccgtcacaccgcgccgcgcacgaatcgggcgggcacaatctctcgctggccagcccatatggatgcgctatccaatgcaagatcagtgagactacgggcctgcacctgggacgatacacaccaccaatgacgcgctgcgagctttgcctgaacaccgtattgatcaagcgctacgcgcggctgatggggatctgactgaacgtggggtgcatcccgtccaaagcgctgctgcacgccgctgcggtcatcgatgaagtggctcacgccggcgacttcggcgtggacttcggccagcccaagatcaccctggacaagctgcgcgagtacaaggaaaaagtggtcggcaagctcaccggcggcctggccagcatggccaagcagcgcaaggtgcgcaccgtcaccggcgtggccagctttgtctcgccgaacgagttggagatcgtcggcgacgacggcaagacccaactgctgcgctttgagcactgcgtcatcgccgccggttcgcaggcggtgaagctgccgaacttcccgtgggacgacaagcgcgtgatggactccaccgacgcgctggaactgcacgacatccccaagaccctgctggtagtcggcggcggcatcatcggcctggaaatggccacggtgtacagcgcgctgggcagcaaggtcaccgtggtggagttcatggaccagctgatgccgggcgccgacaaggacctggtcaagccgctggccgatcgcctgaagaagcagggcgtcgaggtccatctcaagaccaaggccaccgacgtcagcgccgatgccaagggcatcacggtgtcgttcgaagcggcctccgaaggcgaaaagcctggcctgcaggccaccgccttcgatcgtgtgctggtcgcggtgggtcgctcgcccaacggcaagaagatcggcgctgaaaaggctggcgtcactgtcaccgaacgcggctttatcccggtggaccggcagatgcgcaccaacgtgccgcacatcttcgccatcggcgacatcgtcggtaacccgatgctggcgcacaaggccacccacgagggcaagctggccgccgaagtggctgcaggcgagaagaaggaatgggtggcgcgggtgattccgtcggttgcctataccaatccggaaatcgcctgggtgggcgtcaccgaaaccgaggccaaggccaagggcttgaaggtgggcgtggccaagttcccgtgggccgccagcggccgtgcgatcggcatcggccgcaccgagggcttcaccaagctgatcttcgacgaagacacccaccgcatcattggtggtgcgatcgtcggcgtgcatgccggtgatctgctggccgaaatcggcctggccatcgagatgggcgccgaagccgaagacattggccacaccatccatgcgcacccgaccctgagcgagtcggtcggcatggcggccgaggtgtacgacggcaccatcaccgatctgtacattcccaagaagaagtaaacc

SEQ ID NO: 39108 - DNA, 1533 bp, Xanthomonas campestris
ctcaacccctccgaaatcagcgacctgatcaagacccgcatcgaggcggtcaagctgtccgccgagtcgcgcaacgaaggctccgtgaccagcgtgtccgacggcatcgtgcgcatcttcggcctggccgacgtgatgcagggcgaaatgatcgaactgccgaacaacaccttcgccctggcgttgaacctggagcgcgattcggtcggcgcggtggtgctgggcgattacgaaaacctgcgcgaaggcgacgtggccaagaccaccggccgtatcctggaagtgccggtcggtcctgagctgcttggccgcgtggtcaacgcactgggcgagccgatcgacggcaagggcccgctgggcgccacccagaccgcaccggtggagcgtgtggccccgggcgtgatctggcgcaagtcggtcgaccagccggtgcagaccggttacaagtcggtcgatgcgatgatcccgatcggccgtggccagcgcgagctggtgatcggcgaccgccagaccggcaagaccgcgctggcgatcgatgcggtgatcaaccagaagggcaccggcatcaagtgcgtgtacgtggcgatcggccagaaggcctcgaccgttgccaacatcgtgcgcaagctcgaagaaaacggcgcgctggcgcacaccgtggtggtggcggcgaccgcgtccgaatcggccgcgatgcagtacatcagcccctacgctggctgcaccatgggcgaatacttcatggaccgcggcgaagacgcgctgatcgtgtacgacgatctgtccaagcaggccgtggcctaccgccagatctcgctgctgctcaagcgcccgccgggccgcgaagcttacccgggcgacgtgttctatctgcattcgcgtctgctcgagcgcgctgcgcgcgtgtccgaggagtacgtggagaagttcaccaacggtgcggtgaccggcaagaccggttcgttgacggcgctgccgatcatcgaaacgcaggctggcgacgtctccgcgttcgtgccgaccaacgtgatctcgatcaccgacggccagatcttcctggaaaccgacctgttcaacgccggcatccgtccggccgtgaacgccggtatctcggtatcgcgcgtcggtggcgcggcccagaccaagatcatcaagaagctgtccggcggcatccgtatctcgctggcgcagtaccgtgagctggcggcgttcgcgcagttcgcctcggatctggacgaagccacccgcaagcagctcgagcgcggtcagcgcgtcaccgagctgatgaagcagaagcagtacgcgccgatgtccatcgccaaccaggcgctgtcgatctatgccgtcaacgagggttacctcgatgaagtgccggtcaacaagctgctggcgttcgaagaaggcctgcacgcgcacttcgccaacacccagggtgagctggtctccaagatcaacaccaccggcggttgggacaacgacatcgaagccgcgttcaagaagggcatcgaagagttcaagaccacgggcagctgg

SEQ ID NO: 39109 - DNA, 861 bp, Xanthomonas campestris
atggcaggcggacgcgaaatcaaaaccaagatcaagagcgtgcagaacacccgcaaggtgacgcgcgcgctcgaaatggtctcggcctccaagatccgcaaggcgcaggaacgcatgaagacctcgcgtccctacgcgcaggccatgaagcaggtgatcgggcatctggcgcaggccagcaccgactaccagcatccgttcctggtggagcgtgagcaggtcaagcgggtcggctacatcgtgatctcttccgaccgcggcctggccggcggtctgaacaacaacctgttccgcaagatgctgggcgaagtgcgcccgtggcaggacaagggtgccgagatcgacgtggtcaccatcggtcagaaggcctcggcgttcttccgccggatcaaggtcaacatggtcggcagcgtcacgcatcttggcgacagcccgcacatcgagcagttggtgggcgtgatcaaggtgatgctggatgccttcaccgagggcaaggtggaccgcgtgtatctggtctacaaccgcttcgtgaacaccatgacgcagaaggccagcttcgagcagttgctgccgcttccggccgccgagcacaaggtggcgcaccacgactgggactacctgtacgaacccgatgccgccaccgtgctggagcacgtgatgacgcgctacatcgagtcgctggtgtaccaggccgtgctggaaaacgtggcctccgagcacgccgcgcgcatggtggccatgaaggccgccagcgacaacgccaacaagatgatcggcaccttgcaactggtctacaacaaggcgcgccaggcggcgatcacccaggaaatttcggaaatcgtcagcggcgcggcagccgta

SEQ ID NO: 39110 - DNA, 1392 bp, Xanthomonas campestris
atgagtcagggcaagatcgttcagatcatcggcgcggtcgtcgacgtcgaattccagcgcaatgaagtgccgaaggtctatcacgcgctgaaggtcgaaggcaccgccatcaccctggaagtgcagcagcagctcggcgacggcgtcgtgcgcacgattgcgctcggctccaccgacggattgaagcgcaacctgctggccaccaacaccgagcgtgcgatttcggtgccggttggcgccgggacgctgggccgcatcatggatgtgctgggtcgcccgatcgacgaagccggcgacgtgcaggcctcggatcattgggaaatccaccgcgctgcgccgtcgtacgaagaccagtcgtccagcaccgaattgctggaaaccggcatcaaggtgatcgacctgatgtgcccgttcgccaagggcggcaaggtcggcctgttcggcggcgccggcgtcggcaagaccgtcaacatgatggaactgatcaacaacatcgccaaggcgcactcgggcctgtccgtgttcgccggcgtgggtgagcgtacccgtgagggcaacgacttctaccacgagatgaaggactccaacgtcctggacaaggtcgcgatggtgtacggccagatgaacgagccgccgggcaaccgtctgcgcgttgcgctgaccggcctgaccatggccgagtacttccgcgacgagaaggacgagaacggcaagggcaaggacgtgctgctgttcgtggacaacatctaccgctacacgctggccggtaccgaagtgtccgcgctgcttggccgcatgccgtcggcggtgggttaccagccgaccctggccgaggaaatgggcgtgttgcaggagcgcatcacctcgaccaagagcggttcgatcacctcgatccaggccgtgtacgtgcccgcggacgacctgaccgacccgtcgccggcgaccaccttcgcccacttggactcgacggtgacgctgagccgtaacatcgcctcgctgggtatctacccggccgtggatccgctggactccacgagccgccagatggacccgctggtgatcggccacgagcattacgacaccgcccagcgcgtgcagcagaccttgcagaagtacaaggaactgaaggacatcatcgcgatcctgggcatggacgagctgagcgaagaagacaagcagtcggtgtcgcgcgcccgcaagatcgagcgcttcttcagccagccgttccacgtggccgaagtgttcaccggctcgccgggcaagtacgtctcgctgaaggacacgatccgcggcttcaaggcgatctgcgacggtgaatacgaccacctgccggagcaggcgttctacatggtcggcagcatcgaagaagcggtcgagaaggccaacaagatg

SEQ ID NO: 39111 - DNA, 1827 bp, Xanthomonas campestris
atgtgcggcattgtcggcgccatcgccgggcgcgacgtggttccggtcctcatcgaagggctcaagcgtctggagtaccggggctatgattcctccggcatcgcggtgctggacggcacgcaggtacgccgcgtgcgccgcactggtcgggtggcggaaatggcccaggcggcgcaggccgagcagttcggcgcgaccctgggcatcggccatacccggtgggccacccatggcggcgtcaccgaagccaatgcgcatccgcacatcagtgccggcgtggcgctggtgcacaacggcatcatcgaaaaccacgaggagcagcgcgaaaagctgcgcgcgctcggctacaccttcgagtcgcagaccgataccgaagtcatcgcgcatctgatccatcaccatcttgccgatgcgggcgatctgctcagcgcgctgcagcgcacggtgaaggaactcaccggcgcctacgcgctggcggtgatgagccaggccgagccggagcgcttcgtctgcgcgcgcatgggctgcccattgctgatcggcgtgggcgagggcgaaaacttcgtcgcctccgatgtctcggcaatcgtgcaggccacccggcaagtgatctttctggaagagggcgacaccgccgaattgcgccgcgatggcgtgcgcgtgttcgacgcgagcgacgcggcggtggagcgcccgctgcacctgtccgatgtctcattggcctcgctggagctgggcccgttccgccacttcatgcagaaggaaatccacgagcagccgcgtgcgctggccgacaccattgaggcggcgatcgatgccaagggcttccccgcatcgttgttcgggcccactgccgatgcggtgctgcgcgacatcgaaggcgtgcagatcctggcctgcggcaccagttactacgccggcctgacggcgcgctactggatcgaagcgatcgccggcttgccgtgcagcgtggagattgccagcgaataccgctaccgcactgcctatgccaacccgaagcatctgatcgtcaccatctcgcagtccggcgaaacgttggacacgatggaagcgctcaaatacgccaagtcgctcgggcatctgcacaccttgtcgatctgcaacgtgccggagagcgccatcccgcgcgccagcgagctggtctgctacacgcgcgccggtgccgagatcggcgtcgcttcgaccaaggcgttcaccacccagctggcggtgttgttccagctgaccatggtgctgggcaagctgcagggccgcatcagcgacagcgaagaagccgattacctggagcagctgcgcttcctgcccggtagcgtgcagcacgccttgaacctggagccgcagatcatggcctgggccgagcgtttttccccgaaagagaatgcgctgttcctcggccgcggcctgcattacccgatcgcgctggaaggtgcgctcaagctcaaggaaatctcctatatccacgccgaagcctacccggctggcgagttgaagcacggcccgctggcgttggtggatgccaccatgccggtggtggtgattgcaccgaatgaccggctgctggaaaaggtcaaatccaacatgcaggaagtgcgcgcgcggggtggcgaactgttcgtgttcgccgatcaggacagccatttcagcgagtccgacggcgtgcatgtgatccgcacaccgcgccacgccggcgtgttgtcgccggtgatccacaccatcccggtgcagttgctggcttatcacaccgccctggcacgcggcaccgacgtggacaagccacggaatctggccaaatcggtgacggtggag

SEQ ID NO: 39112 - DNA, 1179 bp, Xanthomonas campestris
gtcgccatcaccgccttcaccgccaccaccgcgctcggcgccggattggacgcccaggccagcgcgctgcgcgagcgccgcagcggcatgcgccgcaacgacttcggcccacagccgctggaatgctggatcggccgggttgccggcgtagaagacgtggtgctaccagacgcgctgcaaggctgggactgccgcaacaaccagctggcctggctggccctacaacaggacggcatggccgccgccgtgcaggccgccgcgcagcgctatggcgccgagcgcgtggcggtggtgatgggcacgtccacctccagcgtgggcgccagcgaagaggcctacacgcgcctggtcgaagacgcccacggcctgcgcttcccggacgacctgcagcgcccgatcgtgcataccccgcattcgctgggcgatttcgtgcagcacgccaccggcctgcgcgggccggcgatcaccgtggccacggcgtgttcgtccagcgccaaggtgttcgcccaggccgcgcggttgatggcggccggcgtggtcgacgcggccgtggtcggcggcgtggataccttgtgcggcagcgtgttgttcggcttcaactcgttgcaagtggtggcaccgcagctgtgccagccgttcgacgcacgccgggtcggcctgagcctgggcgaggccggcggctttgccctgctcgaacgccccgccgccgcgccggacgccgcgcagtggctgtacggctatggcgaatccagcgatgcccaccacatgtccgccccgcacccgcagggcctgggcgcgcagttggcgatgcgtggcgcgctggacaccgccgggctggatgccgcggcggtgggctatctcaacctgcacggcaccgccacgccggccaacgacagcgtcgaggcggccgcggtggcggcgatcttccccgacaccttgcatgccagttcgaccaaggcctggatgggccacacgctgggtgcggccggcattgtggagtcggtgattgcgctgctcgcgctgcgcgacggcctgctgccgggcacgctcaacagtgcggtgcccgaccccgcctgcggcccgcagatccgcttcgataacgcccattcccggattcagtacgcaatgaacaactcctttggcttcggcggcaacaactgctcgctgctgttcgggcag

SEQ ID NO: 39113 - DNA, 732 bp, Xanthomonas campestris
atgagcacatctgttccacagcgccgtgcgctggtcaccggcggtagcggcgatcttggcggtgcgatctgccgtcagctggccgcgcagggccggcacgtcattgtgcatgccaatcgcaatctcgcccgggccgaagaggtggtggcgtccatcgtggccgcgggcggcagtgccgaagcggtcgccttcgatgtggccgatgcgcaggccagtgcggatgcattggcggcgttgctggaggccgggccgatccacatcgtggtcaacaacgccggcatccacgacgatgcgccgatggccggcatgaacgcgcaacagtggcatcgggtcatcgatgtgtcgctgcacggcttcttcaatgtcacccaaccgctgctgctgccgatggcgcgcgcgcgctggggccgcatcgtcagcgtgtcgtcggtggcggcggtgctgggcaatcgcggccagaccaattacgccgctgccaaggccgcgctgcacggcgccagtaaatcgctcgcgcgcgagatggccagccgcggcatcgccgtcaacgtggtcgcaccgggcgtgatcgaaagcgagatggtcggcgacagcttcgcgccggaactgatcaagcagatggtgccggctggccgcgttggcacacccgacgaagttgccgcgctggtggcgttcctgtgctcggatgttgctggttacatcaacggccaggtgattggcatcaacggcggcatg

SEQ ID NO: 39114 - DNA, 2667 bp, Xanthomonas campestris
cccttgcgcgacgatgtccgtcggctcggtgccctggtcggtgacctgctcgccgagcaggtgtctgcggactttcttgaagaaatcgaacgcatccgcaccaccgcgatcgcacgccgcgaaagcgatacgccgcccgccggcttgctgtcgctgctggaaggccgcgaaccgcgcgccgccgaggccttggtgcgtgccttcagtacctatttccaggtggtcaacatcgccgagcgcgtgcaccgcatccggcgccggcgcgactaccagcgcagcggtaccgacaccccgcagccggaaggcctgcacgatgcgctgcgccggctcaaggcgcagggcgtgacgttggacgagttgagcgaatggctgccgcgcatcgacgtggagccggtgttcaccgcgcatcccaccgaggcggtgcgccgcgccttgctcgaaaaagaacagctgatggtcgccagcctggtcgacaacctggatggcatgcgcacgcccaatgagcgcgccaccgatgcggcgcggttccgcatggcgttgaccgcgtcctggcagaccgccgattcctcgccggtgcgccccaccgtggaagacgagcgcgagcacgtgggcttctatctcacccaggtgctctaccgcgtcatcccggtgatgtacgaaaccctggaacacgccatcgaagaaacctacggcagcacgctggcgttgccgcgcctgctgcgcttcggcacctgggtcggtggcgacatggacggcaatcccaacgtggatgcgcacaccattgccggcaccctggacgcgcaacggcgcgcggtgctggaccgttatctcaacgagttgtggcagctggcgagcctgctcagccaatccaccacgctggtggcggtgagcccggcgctgagcgcgcagctggaacgctaccaggcgctgctgcccgacgccgccgcacgctcgcggccgcgccacggcgacatgccgtaccgcctgctcaacgacctgatgcgcgcgcgcctgcaggccaccctggacgatgccgacggcgcctacgccgcgcctgccgagctggaacacgacctgcaactgatcctggacagcctggaggtcaacaagggcttgcacgcgggctggttcgcagtgcgccgcctgctgtggcgcgtgcgcagcttcggtttccatctggcgcggctggatgtgcgccaggaatccagcgtgcatgcgcgcgcggtggccgatgcattggggcaagccgattgggacagccaggacgccacccaccgtgccggtctgctcggcccatatgcctcgggtgagcaggcgttgccgcaggtggacgacgaaggcaacgcgcggctggatgcggtgttcgccgcgctcgccgatgcacgcacgcggcatggtgccgatgcgctgggcagctacatcatttcgatggcgcacaatcgcgccgacgtgctcaccgtgctagcgctggcgcggcgtggtggcctggtcgatgacgccggtgcggtgccgctggacatcgtgccgctgttcgaaaccgtggacgatctgcgcggcggcaccggcaccgtgcaggacctgctggccgacccggtgtatcgccagcacctgcgcgcgcgcggcgacacccagatggtgatgctggggtattcggacagtggcaaggacggcggcattgcggcctcgcgctggggcctgcaacgcgcccaggtggagctgctggaggccgccgccgaactcggcgtgcgcctgaccttcttccacggccgcggtggttcgatcgtgcggggcggtgacaagaccacccgcgcgctggatgcagcgccgcgcggcagcgtggatggacgcctgcgcgtgaccgagcagggcgaggtgatccatcgcaagtacggcatccgcgcgctggcgttacgctcgctggagcagatgaccggcgcggtgttgttgtccagcctgcgcccgcgcgcgccggagccgcgcgaagacgcctggcggccagtgatggatctggtggccgagcgcagcacggtggcgtatcgcggttttgtcggcgcgccggatttcatgcagtacttccgcctggccacgccgatcgatgtgatcgaacgcatgacgctgggctcgcgcccctcgcgccggctgggccaggacgcggcgttgtcgaacctgcgcgcgattccctgggtgtttgcctggagccaggcgcgtgcggtgatccccggctggtacggcgtgggcagtggcctgcaggccgcggtggaggccgggcacgaagacagcctgcgcgagatggcgcaggactggccgttcttccgcaccttcctggacgacatcgccatggtgctatccaagggcgatctcaatatcgccgagctgttctcgcgcctggctggcccgctgcacgcgcgtttcttcccgcgcattcgcgacgaactcgcgctgaccaagcactgggtcaagaccttgctcgggcagcgctcgttgctgcagcacgacccgcgcctggcgttgtcgatccggctgcgcaacccgtacatcgacccgatcagcgtgttgcaggtggatctgctgcagcgctggcgtgccaccgatggcgaagacgaagaactgctgcgtgcgctggtggcatgcgtcaacggagtggcgcagggcgtgcagaacaccggc

SEQ ID NO: 39115 - DNA, 1206 bp, Xanthomonas campestris
atgtccagctacctgttcacctccgaatcggtctccgaaggccatccggacaagatcgccgaccagatctccgacgcagtgctggatgccatcctggcccaggacaagcgtgcccgcgtggcgtgcgagacgatggtcaagaccggtgtggcgatcgttgccggcgaagtgaccaccagtgcctggatcgacctggaagcgctgacccgcaaggtgatcctggatatcggctacaacagctccgatgtcggcttcgacggcgagacctgcggtgtgctgaacctgatcggcaagcagtccccggacatcaaccagggcgtggaccgaaagaacccagaacagcagggtgccggcgaccagggcctgatgttcggctatgccaccaacgagaccgacagctacatgccggcggcgatccacctgtcgcaccgcctggtcgagcagcaggccaagatccgcaagaagaagaactcggcgctgtcctggctgcgtccggatgccaagtcgcaggtcaccctgcgctatgaagacggcgttgcgaccgcgatcgatgcggtggtgctgtcgacccagcacgatccgggcgtcaagcagaaggacctgatcgaagcggtgcgcgaggaaatcctcaagccggtgctgccggccaagtggctgcacaagggcaccaagttccacatcaacccgaccggcaagttcgtgatcggcggcccggtgggcgattgtggcctgaccggtcgcaagatcatcgtggacacctacggcggctgggcccgtcacggcggcggcgcgttctcgggcaaggatccgtccaaggtcgaccgttcggcagcctatgcggcgcgctatgtggccaagaacgtcgtggcggccggcctggccgaccgttgcgaagtgcaggtttcctacgccatcggcgtggccgagcccacctcgatttcggtcaccacctttggcaccggcaagatcgccgacgagctgatcgagaagctgatccgcaagcacttcgacctgcgtccgttcggcatcatccagatgctcgacctgattcacccgatgtaccagcagaccgcctcctacggtcacttcggccgcaagccgaaggacttcacctacaccgacggcaccggcgcgcagcacagcgcaacgtcgttctcgtgggaaaagaccgaccgtgcagaagcgctgcgcgctgctgcaaagctg

SEQ ID NO: 39116 - DNA, 2184 bp, Xanthomonas campestris
gtggatgtctctcatttgctcgatcatttaaaccccgcccagcgcgaggccgtttccgcgccgccggggcattaccttgtgctggccggcgccggctccggcaagacgcgcgtgctgatccatcgcatcgcctggctcaacgaagtccagggcgtgccaaaccacggcatcttcgcggtgaccttcaccaacaaggccgccggcgaaatgcgccaccgcaccgacctgcagctgcgcaacggcagccgcgggatgtggatcggcaccttccatgggcttgcccatcgcctgctgcgcctgcactggcaggacgcgcggctgccggaaggcttccaggtcatggacagcgacgaccagttgcggctggtcaagcgcgtggtgcagtcgctggagctggacgagagcaagtatccgcccaagcagatgagctggtggatcaacgagcagaaggacgaaggccgccgcccgcaacacatccagcccgagcccaacgacgactggaccgaggtgcgccggcaggtgtacgccgcctaccaggaacgctgcgaccgctccggcctgctggatttcgccgagctgctgctgcgcgcacacgaattgctgcgcgacaccccggccttgctggcgcactaccgcgcgcgctttcgcgaaattctggtggacgagttccaggacaccaacgccatccagtacgccttcgtgcgcgtgctggctggcgagagcggccacgtgttcgtggtcggcgacgacgaccaggccatctatggctggcgcggtgccaaggtcgagaacgtgcagcgcttcctcaaggactttcccggtgcgcagaccgtgcggctggagcagaactaccgctccagcgccaatattctgggcgcggccaatgcggtgatcgcgcataacccggaccgcatcggcaaacagttgtggaccgattccggcgatggcgacccgatcgatctgtacgcggcctataacgaagtcgacgaggcccgctatgtagtcgagcgtgcgcgccaatgggtgcgcgatggcggcagttatggcgaagtggcggtgctctatcgcagcaatgcgcaatcgcgcgcgctggaagaagcgctgattgccgaacaactgccctaccgcgtgtacggcggcatgcgctttttcgaacgcgccgaaatcaaggacgcgctggcatacctgcgcatgctcaccaaccgcagcgacgatgcggcgttcgagcgcgcggtcaacacgcccacgcgtggcattggcgaccgcaccctggatgaagtgcgccggctggcacgcgccaatgcgctgtcgctatgggaagcggcgatgctgtgcacgcaggaaaatactcttgcggcgcgtgcacgcaatgcgctggctacgttcctgagcctggtcggccagctgcaggccgaaaccggcgagatggacctggccgagcgcatcgaccatgtgctgatgcgctcgggcctgcgcgagcattgggccaaggaaagccgcggcggactggattcggaatcgcgcaccgagaacctggacgaactggtctcggtggcctcgcgcttcacccgcccggacgatgaagacagccagggcatgaccgaactggtggccttccttgcctacgcctcgctggaagccggcgaaggccaggcgcaggccggcgaagaaggcgtgcagctgatgacgctgcactcggccaaaggcctggaatttccgatcgtgttcctggtcgggctggaagatggcctgttccccagcgcacgctcgctggaagaaagcggccggctcgaagaggaacgccgcctggcctacgtaggtatcacccgcgcgcgccagaagctggtgctgtgctacgccgaatcgcggcgcatccacggccaggacaactacaacgtgccgtcgcgctttctgcgcgagatcccgcgcgacctgctgcatgaagtgcggcccaaggtgcaggtctcgcgcactgcctcgctgggcgccgcacgcggcggcccggtgcacgccgtggtggacgccgcgccgatcaagctcggcgccaatgtcgaacacccgaaattcggtggcggcgtggtcgtcgactacgaaggcgccggcgcgcatgcacgcgtgcaggtgcaattcgatgaagtgggcgccaagtggctggtgatggcgtacgcgaatctgacggtggtg

SEQ ID NO: 39117 - DNA, 894 bp, Xanthomonas campestris
atgaacgaattcgaccgtgtacgtgactatctgaccgatctgcaggaccgcatctgcgccgccgtggaagccatcgatggcaaggcgcggtttgctgaggacctgtggcagcgcgcggaaggcggcggtgggcgcacccgcatcctgcgcgacggtgcggtgttcgaacaggccggcatcggcttctccgacgtgtccggcgcgcggctgccgccctcggccagcgcgcatcggcccgagctggccggcgccacctggcgtgcctgcggggtgtcgctggtgttccacccacacaatccgcacattccgaccacacacgccaacgtgcgctatttccgcgccgagcgcgatggcgagatggtggcggcctggttcggcggcggcttcgacctgaccccgttctacccggtcgacgaagacgtcatgcactggcaccgcaccgcacaggcgctatgcgcgccgtttggcgaggagcgttacgccgcgcacaagcgttggtgcgacgagtacttcttcctgcgccaccgcaacgagacccgcggcgtgggcgggctgttcttcgacgacctgggccaggacttcgaacgcgacttcgcctaccagcgcgcggtcggggacggcttcctggacgcctacctgccgatcgtcgaacgccgcaaggacacgccctacggcgaggctgagcgcgccttccagctgtaccggcgtggccgctacgtggagttcaacctggtctacgaccgcggcaccctgttcggactgcagagcggtggccgcgccgagagcatcctgatgagcctgccgccgcaggtgcgctgggaatatggattccagccgcaaccgggaagcgccgaggcacgcttggccgattatttgattccgcgtgattggctc

SEQ ID NO: 39118 - DNA, 1896 bp, Xanthomonas campestris
ttgaccaagaatctgctgctatgggtggtcgtcgcggttgtgttgatggtcgtcttccagagcttttcgccgcgcatggccggcggagtgggccctgactcgatcacctacacccagttcctgaaggaagtggattcgggccgggtgaagtcggtggattacaccgatgagaccaacttggccgtcaacgcgatccgcttcaagcgcaccgacggcagcgaagccaccgtctacggtccgcgcgacgacaagctggtcgacgtgctgtacagcaagaacatcgaaatgacccgccagaagccgtccaccgggccgggcttctggtcgctggtgctcaacttcctgccggtcatcctgatcatcggcttctggctgttcatcatgcgccagatgcagggcggtggcggcggcgccaagggggcgatgagcttcggcaagtcgcgcgccaagctgcagggcgaagaccaggtcaaggtcaccttcgctgacgtcgcaggctgcgatgaagccaaggaagaagtgggcgagctggtcgacttcctgcgcgatcccaccaagttcaccaagctgggtggcaagattccgcgcggcgttttgatggtgggcccgccgggtacgggcaagacgttgcttgccaaggcgatcgccggcgaagccaaggtgccgttcttcagcatctccggttcggacttcgtcgaaatgttcgtgggcgtcggcgccagccgcgtgcgcgacatgttcgagcaggccaagaagcatgccccgtgcatcatcttcatcgacgaaatcgatgcggtgggccgtcatcgcggtgccggtctgggcggcggtcatgacgagcgcgagcagaccctcaaccagttgctggtcgagatggatggctttgagggcggcgaaggcgtgatcgtgattgctgcgaccaaccgtcctgacgtgctggatccggcgttgctgcgtccgggtcgcttcgaccgtcaggtcgtggtcggcctgccggacgtcaagggccgcgagcagatcctgcgcgtgcacatgcgcaagctgccgctggccgacgacgtcgtgccgctggtgattgcacgtggtaccccgggcttctccggtgccgatctggccaatctggccaatgaggctgcgttgtttgccgcacgtggcaacgagaaggaagtccgcatggaccacttcgaccgtgcacgcgacaagatcctgatgggtgccgagcgccgctcgatggccatgagcgaggacgagaagaccctgactgcgtatcacgaggctggccacgccatcgttggtcgcctggtgcccgagcatgacccggtctacaaggtcacgatcattccgcgtggtcgcgccctgggcgtgacgatgtacctgccggaaggtgaccgctactcgatgaatcgcgtggcgatcgaatcgcagctgtgctcgctgtatggtggccgcgttgccgaagagctgatcttcggtggcgacaaggtcaccaccggtgcgtccaacgacatcgagcgcgccaccaagatggcccgcaacatggtcaccaagtggggcctgtccgacgaactcggcccggtggcctacggcgaagaagaggacgaggtgttcctgggccgttctgtcacgcagcacaagaacgtctcggatgagaccgcacgcaagatcgatgaagtggtgcggtcgatcctggacaaggcgtacagcaagaccaagaccatcctcacggagaatctggacaagctgcatgcgatgtcgcagctgctgctgcagtacgagaccatcgacgtgccgcagatcgacgccatcatggaaggccgcgacccgccgccgccggctggctggggcaagtccgacaaggacggtggcaacaacaacgacaagggtagcccgcgtccg

SEQ ID NO: 39119 - DNA, 1503 bp, Xanthomonas campestris
tccgcggccacgcgtgtccgtcgcgccttggaagagctcggtccaaccttcgtcaagcttgggcaggtgttggccacgcgcgtggatctgttgccgccagactggatcgaggaactcagcgagctgcagaacgccgtgccggcgctgccgttcgcacacatccgcccgcaactggtggccgcgctgggaatggaaccggagcaggtcttcgcgcggctggatgaagagccactggcggccgcatcgctggcgcagacgcatcgcgcctggctggccgacggcaccgcggtggtgctcaagatccggcgccccggcatcggcgacaccatcgatgccgacctgcgtctgctcgcacggctggccgaaatcgtcgaaacccgcgcgccggatctgaagcgctatcgccccgccgaagtggtgcagcagttcacgctgtcgctgcgccgcgagctcgatttcgccgccgagtgccgcaatgccgagcgcatcgccgccaacttcgccaacgatccacagatcctcattcccgccgtgcattgggaatggacctgcgagtcgctcaacgtgcaggacttcgtcgacggcattcccgggcgcgatcttgttgctgtggatgccgccggcctggaccgcaaggcgctggcacgcaccggcgccggcatcgtgttgaagatggtgctgcaggacggctgttttcatgccgatccgcatcccggcaatattttctatctgcgcgacgggcgcatcgcggtcatcgacttcggcatggtcgggcgcatttccgaacagcgccgcttccaggtcgcgcaactgttgcacggcatggtgagctacgacgccgagtcggtgatcgacgtgttgctggaatgggcaggcaccagcctggacatcgacgagccgcgcctgcaacaggacatcggcgccttcgtcgatgcttatcgtggcgtaccgctcaaggagctgcgtatcggcgcgatgctgggcgatgtcactgccatcctgcgcgatcacgggctgacgttgccatcggacctggcgctgatgatcaaggccttcctcaccctggaaggcatggggcgccagctcgacccggatttcgacatggctagcgaagcgcgcccctatctcgaacgcgtggtgctgcagcggtatgcgcccagtgcgatgctgcggcgtggccggcgtacggtgaccggggcgattgatctgatcggcgatctgccgcgcgatctcaagcggctgatccaggccgcgcgacgcggcaagctgcagctgcatgtggaaacgcgagccttgcgcgaattcggcgagcaggtcgaccgcgccgccaaccgcctcaccatgggaatcgtcaccgccgcattggtgattggctcgtcgatcgtgatgaacagcgttggcggcattgccagccgctggctgctggcgctgggcgtcagcgggttcatcggcgcggccttgtgcggggtctggatcctgttctcgatctggcgcagccgccgc

SEQ ID NO: 39120 - DNA, 933 bp, Xanthomonas campestris
ttcctgtcacgtaagagcagcagaatcttgtccctttccggcatcatcaccgcgctggcgacccctttcgggccggacggcgcactcgacctggatgcctggcggcggctgctggagcagcagttgcacggcggtgtccagggaatcgtggttgccggctcgaccggcgaagcggcggcactgagcgacgacgagtacgacacgctagtgcgtgcggccgtggcacaggtggccggtcgtgtgccggtactggctggcaccgggctctccggtaccgcaaaaaccatcgcgcagacccgccgtgccgccacgctgggcgcgcagtacgcgctggtggtgacgccgccttacgtgcggcccacccaggccggcctgctggcgcacttccaggcggttgccgacaacggcggcctgccggtgttgctgtacaacgtgccgggccgtaccggctgcgacctgctgccggaaacggtcgccgcgctggtgagccacccgaacatcgtcggcatcaaggaagcgcgcagcgaaccggagcgggttgccgcgctggtggccatgcgcagcgacagcttcgtggtgctcagcggtgacgacggcagcgccgcccagtcaatgctggccggcgccgacggcctggtgtcggtggcgtccaacgcgctgccgtcggcctaccgccggctctgcgatctggcccgcactggtcagcacgaggccgccaacgcctgggacacgcgtctgagcgagtaccacagcttctgcggcatcgaatccaatcccatccccgtcaaggcgctgctgcagcgcgccgggatcggccacggcctgcgcttgccgttgctgccactttccgcggcccatcagccggccgccgaccgccttgccgccaacgcaattgcgttggaagcgctttccagccgcgaaatgctcgcggcc

SEQ ID NO: 39121 - DNA, 1783 bp, Xanthomonas campestris
atgttgcgtaccacgcttgccccgcttgtcctggccctgtccatcgcactgcccatcaccgccacggccgccagcgatgaccagtggcccaccttcgccacccagggcacgcagttcgtgcgcgacggcaagccgtaccaagtgctttccggtgccatccatttccagcgcattccgcgtacctactggaaagaccgcctgcaaaaagcgcgtgcgctgggcttgaacacggtggaaacctacgtgttctggaacctggtcgaaccgcagcaggggcaattcgatttcaacgccaataacgacgtggccgcgttcgtgcgcgaggccgccgcgcaaggtctcaacgtgatcctgcggccgggcccgtacgcctgtgcggaatgggaagccggtgggtatccggcctggctcttcggcaaggacaacatccgcatacgcagccgcgacccgcgctttctcgccgccagccagtcctacctggatgcagtggcgcagcaggtgcgcccactgctcaaccacaacggcggcccgatcatcgccgtgcaggtagagaacgaatacggctcctacgacgacgaccatgcctacatggccgacaaccgcgccatgttcgtcaaggccggcttcgacaaggcgctgctgtttacctccgacggcgcagacatgctcgccaacggcaccctgccgggcacgttggccgtggtcaatttcgccccgggcgaggccaagagtgcgttcgacaaactgatcaagtttcagccagaccaaccgcgcatggtcggcgaatactgggccggctggttcgaccattggggcacgccgcacgccagcaccaacgccaagcagcaaaccgaagaactggaatggatcctgcgccagggccattccgccaacctctacatgttcatcggcggcaccagtttcggcttcatgaatggtgccaattttcagggcaatcccagcgaccattacgcaccgcagaccaccagctacgactacgacgccatcctggacgaagccggccgccccacgcccaagttcgcgctgatgcgcgatgtcatcacgcgcgtcaccggcgtgcagccgccggccttgccggcaccgatcgccatggccgcgctgaaagacgcaccgctgcgcgagtcggcctcgctgtgggacaacctgcccgcgcccatcgccatcgacacgccgcagccgatggaacatttcggccaggactatggctacatcctgtatcgcaccaccgtcaccggcccgcgcaaggagtcgctgtatctgggcgaggtacgcgacgtagcacgcgtctatgtggatcagaagcctgttggtagcgtcgaacgccggctgcaacaggtcgccaccgaggtggacattccggctggccaacacaccctggatgttctggtcgaaaacagcggccgcatcaactacggcccgcgcatggccgacggccgcgccggcctggtcgacccggtactgctggacaaccagcaactcaccaactggcaggccttcccgctccccatgcgctcgccggacagcatccgcggctggacgcgtaacacagtggaaggccccgcctttcatcgcggcaacctgcgcatcggcacgcccgccgacacctacctggacatgcgcgcattcggcaaaggcatcgcctgggccaacggcgtcaacctcggcaggcactggaacatcggcccgcaacgtgcgctgtacttcccggcaccgttccagcgcaagggcgacaacaccgtggtggtgttcgatctggacagca

SEQ ID NO: 39122 - DNA, 2315 bp, Xanthomonas campestris
caccggccgttgctagtgccggcgcccccgcggcagctgccgccaacacaccgctgcccctgattccggcaccggcgcaggtcacacgcggcagtggcagtttccacatcggtgccggcacggtgatttcgatcgtcggtggcgatgccgatgcacgccgcagcgccgaatatctcgccgagctgctcaagcgcacgcgcggcctctcgctggaagtgcgcaacgaaaccagcgcatcgccgggcagcatccgcctggaacgcagcgcgcaggcaccggtagcgcagaaggaaggctatagcctggatagcgacgcgaagggcctccgcatccaggcgcgtgatggcgccgggttgttctacggcaccgtgagcgcgtggcagttgatgaccccggatgcgcgcaagggcgatgtcgaggtaccagcggtggccatccgcgactggccgcgtttcagctggcgcggccagcatctggatgtggcgcgccacttccacgacgtggcaacggtcaagcacgtgctcgacacgatggccgtgcacaagctcaacgtgctgcactggcatctcaccgatgaccagggctggcggatcgagatcaagcgctaccccaagctcaccgaggtgggtgcatggcgcacgccgccgggcgcgggccagcacggcacaccggagcgctatggcggcttctacacgcaggaacagatcagcgaagtggtggcctacgcggcgcgcctgcacatcaccgtgctgcccgagctggatatgcccgggcatgcgcaggcggccgttgccgcctaccccgaagaggtgggcgtccccggtgtgcgcacccaggtgggtgtggactggggcgtcaacccgtacctgttcaacaccagcgaacgcagcctgaccttcatcaccaatgtgctggatgaagtgctcacgctgttcccgtcgacctacatccacatcggcggcgatgaggcagtcaaggaccaatgggaagcctcgccggccgttcgcgcacagatgcgcaagctcggcgtcaaggacgcacacgcgatgcaaggctggttcaacgaacagctggcccagtacctcacccagcatggccggcgcatgatcggctgggacgaaatcctcgaaggcggcgtgccggccagcgcggccgtgatgtcctggcgtggcatcgaaggcgcggtgaccgccgccaagcaaggccacgacgtggtgctggcaccgggcgattcgctgtatctggacaacctgcagaccacgcgcagcgatgaacccaacggccgcctgaccacgctgccgctctcgaaggtctacgcgttcaacccggtgccggccgcgctcaatgccgagcaggccaggcatgtgctcggcgcgcagggcgcgttgtgggccgaatacattccctcgcgctggcacgtcgaccacgcgctgttcccgcgcctggcagcggtagccgaagtgacgtggtcgccgatggccgcgcgcgactggaagaatttcctggcgcggatgccggcgcagctgcagcgttatcaggcgctgggcatcgattacagcgatggcgcgtttgccgccgacatcgatctggacggcgacgtcaacgcggtactggccggtggcccggccaaggtatcgcttggcaaccagagcggcgccggcagcctgcactacaccgtggatggcagcgaccccacgccggatgcaccgcgctacacggcgccgttcgcgattcagctgcccaccaccgtcaaggccacagccttcaccgacgatggcattgcactggccgccccacgcagccgcacctttgaccgtgccgcgctgctgagccgcgacacccagggtctgcgccactgtgtcgagcaaggggcgctgggcctgcgcctgccgctgctgccggacctgccgggcgccgacacgccggtctacaacgtggacctgttccatgcctgccgcctgtatccgcaggcgcggctggatggtgtgggcgcgatcaaggtggacgccgcacgcctggcgcgcaacttcggcctggcgcacgagcagtccaaggtgcagaagtacccggccaagacacccggcggcgaactcgaagtgcgcctgggttgcgaaggcgagctgctcgcgcgcatcccgctgcccaagggcaacgcgctcggcgaacaattcacactggaaagcgcgctgcctgcacgcaccggcacgcacgatctgtgcctgcgcttcaccgcccccatcaccggcccgttgtatgccatcggcgccgtccatctgattgaaaccaccgcgcaggcgccccccgccgccacgcgc

SEQ ID NO: 39123 - DNA, 804 bp, Xanthomonas campestris
gttgcctttgtcggtggcggcaacatggcgcgcagcctgatcgccgggctgctgcgccagggcgcgccggccagcgccatccgcgtcgccgagccggtcgccgaactgcgtcaggcgctgtccgctgacttcggcgtgcaagtgttcgacgacgcgcgcagcgccgtggagggcgccgcactctgggtactggcggtcaagccgcaggtcatgtccaccgtgtgcacgcagctggccgatctcgcgcagcaacagcatccgctgctgctgtcgatcgccgcgggcatcaccgcaacgcaactggagcgctggtgcggcggcacggccgccgtggtgcgcgccatgcccaacacgccggccctgctcggcgccggcgtgaccggcctgtacgccaatgcacgcgtcagcgcggcgcagcgcacacaggcaacccggctgctggaaagcgctggcgtcaccgtctggctcgacgacgaggcacagatggatgcggtcaccgcggtgtccggcagcggcccggcctatgtctttctgctggccgaagcgatggaggccgcggcgcgcgcgcaaggcctgcccgccgagaccgcccgcacgctggtgctgcataccctgctcggcgctgcacgcatgctgaccgaatccggcgaagcaccggaggtattgcgccggcgcgtgacctcccccaacggcaccacgcaggccgcgatcgaggaattccaggccggcggtttcgaagcgttgaccgccaccgcgattgccgcggcgaccgaacgcggccgcagtttgtcggcagcgaacgac

SEQ ID NO: 39124 - DNA, 948 bp, Xanthomonas campestris
gcgatgaccaccatgcaactcgattcggacggacgcctgcgccacctgctcaccctggaaggactgccgcgcgccaccttgctgcagctgctcgatcgcgccggccagatccgcgatgcggcggtggggcgcgtgggcaagcgcagcgtgctcgcgggcaccgcggtgtgcacgctgttcttcgaaccctccacgcgcacccgcagttcgttccacctggccgcgcagcggctgggcgcagacgtgctcaatttcgacgcgtccacctcgtccacccgcaagggcgaaaccgcacgcgataccttgaagaatctcgaggcgatgggcgtgcgcggcttcgtggtgcgtcatcccgaagacggcgcggtggagcgactggccgaagctgccggcgagggtaccgcgctgatcaatgccggcgatgggcgcagtgcgcatcccactcagggcctgctggacatgctcaccctgcgtcaggccaagggcacggatttctccaagctcaaggtggtgatcgtcggtgacgtgaagcactcgcgcgtggcccgctcggacctgcacgccttgcgtacgctgggtgccggcgagatccgcgtgtgcggcccggccagcctgctgcccgacgacgacatgctggacggctgcgtggtcggcgaggacttcgatgcgatgctggaaggcgccgatgcgctgatgatgctgcgcctgcagcgcgagcgcatggaagaaggcctggtgccatcgctggagcagtaccacgccgactacggcctgacccgcgagcgcctggcacgcgcgggacgcgacgcggcagtgctgcatccgggcccgatcaatcgcggcgtggagatcaccgacgaggtggccgatggcgcgcagtcctgcgtgctgcgccaggtggccaacggcgtggccgtgcgcatggcggtcctggaaaccctgctgggc

SEQ ID NO: 39125 - DNA, 900 bp, Xanthomonas campestris
atgattagtcagcatgttcgaaagaaaacgcgggaatatcccaaccgatttttcgattccagcgtatggaatgatctggcgctacgccggggcgatatcgtaatcgccagttacgccaaagcaggcacgacctggctgcagcagattgtggcccaactgatcttcggcggtgaaccgaacattgatgtctctgccatctccccttgggtagacggggtctatccggacaaggcgaccaagctcgcgctgctgaaggcgcagagccaccggcgcttcatgaagacacacctaccggccgatgcgctggtcactagtccgctcgccagatacctttacatcggccgcgacggccgcgacatggcgctgagcctgtacgaccatcaatgcgcggtgagccaggatgcgcaggcacgcctgcacgctaatgggggcaaatccggcaagttgcgtgtggtgtcgccgccgggcctgccgcgtgatgcctacgtggcgcattggctcgaatacgatggagcgccgttctggccattatgggaaaacgtgcggtcatggtgggaacgacgcgaggacgcgaatgtgctgctactgcactacgccgatctgctagatgacctgcccggccagatccgtctcattgccgcttttctcggcattacggtcgctcaagacaggtgggatgcgattgtggcgcactgccgcttcgactatatgcggcagcatgcggcgcgctacgtgccgcagggtaccggtttgtggcgcgaagacggaaaggcgtttttcaaccagggccgaatcggccgctggcgtgaggtcttgccggctgagctaaataccgcttactcccggcgcgcagaggcggagctaggccgggacgcagcgcagtggctggcccacggccag

SEQ ID NO: 39126 - DNA, 2598 bp, Xanthomonas campestris
atgtcagcttccctttctaccgatcgttggatcgtcctcaagttcggcggcacctcggtgtcgcgtcgtcatcgctgggacacgattggaaaactggcgagcaaacgggcgaacgaaaccggcggccgcgtgctggtggtggtgtctgcgttgtcgggcgtcaccaacgagctcactgccatcgccgatggtgctgccgacagcgcgcagcgcgtggcggcactggaactgcggcatcgcgaattccttgccgagcttgagctcgatgccgacgcagtgctgggcgcgcggcttgccgcgttgcacgcgttggtgggcgatgcacgcgctgccagccgcacgctcgactggcaggccgaggtgctggggcaaggcgaattgctgtcttccaccatcggtgcggcctatctgcatgccaatggcctggacatgggctggctggatgcgcgggagtggttgtcggcgttgccgccgcagcccaaccagagcgagtggtccaagcgcttgtcggtgtcgtgccagtggcaatccgatgccgcatggcgggcgcgtttcgatgcgcagcccacgcggctgctgatcacgcagggctttatctcgcggcacgccgatggcggcaccgcgatcctgggccgtggcggctcggacacctcggcggcgtatttcggtgcattgctcggcgccagccgggtggaaatctggaccgacgtgcccggcatgttcagcgccaacccgaaggaagtgccggatgcgcgtctgctgacccgcctggactattacgaagcgcaggaaatcgccaccaccggcgccaaggtgctgcatccgcgctcgatcaagccctgccgcgattccggcgtgccgatggcgatcctggataccgaacgcccggatctgccaggcaccagcatcgatggcagcgccgaaccagtactcggcgtcaaggcgatcagccgccgcaacggcatcgtgctggtgtcgatggaaggcatcggcatgtggcagcaggtcggcttcctggccgatgtgttcacgctgttcaagaagcatggcttgtcggtggatctgatcggctcggccgaaaccaacgtcaccgtctcgctggacccgtccgaaaacctggtcaacaccgatgtgctggcggcgttgtcggcagacctgtcgcagatctgcaaggtcaagatcatcgtgccgtgcgcggcgatcacgctggtcgggcgcggcatgcgctcgctgctgcacaagctgtccgacgtgtgggccacgttcggtcaggagcgcgtgcacatgatttcgcagtcgtccaacgacttgaacctgaccttcgtcatcgacgaatccgatgccgacggcctgttgccgattttgcatgcggaattgatcgatagcggcgccatgccggtcagcgaaggtgaggtgtttggcccacgctggcgtgacatcatcggttcggtgcggccgcggcccacgccgtggtggcatgccgagcgcgcgcatctgctgacgctgtccaaggccggcacgccgcgttacgtgtaccacctgcccacggtgcgcgcgcgcgcgcaagcgctggcgcagattgccgcagtggatcagcgctattacgcgatcaaggccaactcgcatccggccatcctgatggcgctggaacaggctggattcggcctggaatgcgtctcgcacggcgaattgcgccgcgtgttcgacacgttgcctgagctgtcgccacgccgcgtgttgttcacgccgagcttcgcgccgcgtagcgaatacgaggccgcgtttgcgctgggcgtaaccgtcaccgtggacaacgtcgaagcgctcaagcgctggccggagttgttccgcggccgcaacgtgtggctgcgcatcgacctgggccacggcgatggccaccacgagaaggtcaacaccggtggcaaggcgtccaagttcgggctgtcgtccacgcgcgtggatgagttcgtcgagttggcacgcacgctggaagtcaccatcaccggcgtgcatgcgcatctgggcagcggcgtggagaccggcgaacactggcggatgatgtacgacgaactggccggcttcgcgcgccgcatcggcaccgtggagaccatcgacatcggcggtgggctgccgattccctacagcgccgaagacgagccgttcgacctggagctgtgggccaagggcctggccgaggtcaaggccgtgcatccgggcttccgcctggcgatcgagcctggccgttatctggtggccgaggccggcgtgttgctggcccaggcgacccaggtgatcgaaaaggacggcgtccatcgcgttggcctggatgccggcatgaatagcctgatccgcccggcgctgtacgacgcctggcacgacatcgaaaacctcagccagctcggtgcgcctgccgatggcagcttcgatgtggtggggccgatctgcgaatcctccgatgtgttcggcaagcgccgccgcctgcccgcggcgaccgcaccgggcaatgtgatgctgatcgctgatgccggcgcgtatgggtattccatggccagcacctacaaccagcgggagttgccgcgcgaagaggtgatcgatgcg

SEQ ID NO: 39127 - DNA, 996 bp, Xanthomonas campestris
atgaccatcgcccaagacctccccaccgtactgggcctgccccagatccagtccctcgccgcgcccgacatggcggcggtcgatgccttgatccgccgccgtctggcgtcggacgtcgtgctgatcaaccagattgccgatcacatcatctccgccggcggcaaacgcctgcgcccgatgctggtgatgctggccggccacgccgcgggcggctccgggccggagcaccaccagctcgcggcgatcatcgagttcatccatacctccacgctgctgcatgacgacgtggtggacgaatcagacctgcgccgcggccgcagcaccgccaatgcgctatggggcaacgcgcccagcgtgctggtgggcgatttcctgtattcgcgcagcttccaactgatggtcgaactggaccgcatggaagtaatgcagatcctggccgacaccaccaaccgcatcgccgaaggcgaagtgctgcagctcttgcatgtacacaaccccgacaccgatgaagccgcgtacctgcgcgtgatcgagcgcaagaccgcggtgctgtttgccgccggcacgcgcctgggcgcactggcctcgggcgcggatgcgcaggtgcagcagtgcctgtacgactacggcatgcagctgggctttgcgttccagatcgccgacgacgtgctcgactacgccgcagatgccaccgacctgggcaagaacctgggcgacgacctggccgagggcaaggccaccctgccgctgatccacgccattgcgcattccgatgccgccacccagcagcgcctgcggcagatcgtcgaacagggcgatgccgaggcgatgccggaggtgttgacggccatccgcgcaaccggcgggctcgattacagccgccagcgcgccgccgaatacgccgccgccgccgaacaggccctggacggcttgccgccgagcccggcagtggccgcattacgcggtctggcgcgttatgcggtggaacggacgcac

SEQ ID NO: 39128 - DNA, 804 bp, Xanthomonas campestris
tcctccaccgccgcatccactccgttcgcagagtcgatgcgcggacagcaaccgcaaccgcaggaccggcaatttccggagctgctgcaagatctctatgccactgccaatcaacgccgtgaaggcggcgccgaaacctttgcgccgctggccaacggctggtcgcgtatggacgacagtgcgctgcagcaggccggcatcgatccggcactgctgcacgacgccaaaagcggcttcgatgccgcgttctatcgcaacgatcaaggccaggtggtgttcggtttttgcgggaccgacgaaggcaaggactggaagcacaacattggccagggcctgggcttcgacgatgcgcagtacgcatcggcaatccagctcggcagccaggccaaacaggccttcggcgaccaggtggtgatctccggccattcgttgggcggtggtctggcatcggcatcggccatggtcaacgacattcccgcggtgacgtacaacgcggccggcgtcaacgaccgtaccctcgaacgcgagggcctggatgcatcggcagccaagcagtacgccagcgaggagttgattcgcggctaccacgtcaagaacgaaatcctcacccatctgcaggaagacagcattccgctgaagtggacgatgcccaatgcggctggccaccagatcgaattgccggagccggacccgctgtcgttcgggcagcggctggtacccggcatgatgctcaagcaccgcctggacctgcacgggatggactcggtgatcaaggcgcaggacatgcaatcgcccgaccaggca

SEQ ID NO: 39129 - DNA, 651 bp, Xanthomonas campestris
ctgatcagtgactgcgatggggttcttgtcgacagcgaaatcctggccgaccgtgtgatgcgtgagacgctggcagcgttcgtgccggccgagccgttggaacatctgctggaaaccacgttcgggcagaccacgcgcgaggtattgcggcgggtggaagaacactttgcgctgcagttgccggaaaccctgctggcgcagatccaggcgcgcagcgaggccttgattgccgccgaggtgcagccgattgcgggcgtgcgacaggcgctggagcagatcccgctgccgctggcggtggcctccaatagccgccgccacaacgtgattgcatcggtggagcgggccgggctcacggagcgtgcggcagggcggatcttcagcgccgacatggtggagcggcccaagccggcgccagatgtgtacctgctggctgcacgcacggccggtgtagtgccggagcgttgcctggtgatcgaagacagccccaccggtgcgaccgccgcgctggcggccggcatgcaggtgctgggctttaccggtgccagccatatcccgcaagggcacggcgacaccctgcgacggatcggcgtgctggaggtgttcgacgatatgcgcgatttgcccgcgttgttcgagcggctcgcgtaaacg

SEQ ID NO: 39130 - DNA, 1293 bp, Xanthomonas campestris
atggaggcgttctggatgccgttcacggccaaccggcagttcaaggcgcgcccgcgcctgctggcctcggccgcaggcatgtattaccgcgacgtggagggccggcagatcctggatggcaccgcggggctgtggtgctgcaacgccggccatgcgcgcgagcgcatcgtggcggcgatccgcgcgcaggccggcacgctggatttcgcgcccaccttccagatgggctcaccgctgccgttcgccctggccgaacggttggccgcgttggccccgccaggcctgggccatgtgttcttcaccaactccggctcggaggcggtggatagcgcgatgaagatcgtgttggcctatcaccgcctgcgcggcgagggccagcgcacccgcttcatcggccgcgagaaggcctaccacggggtgggcttcggcgggatgtcgatcggcgggctgcccaataaccgcaaatggttcggcccgctgctggccggcaccgatcatctacggcacacgctggatctgcagcgcaatgcgtattcgcgcggcctgcccgctttcggagtggagctcgccgacgacctggaacggctgatcaccctgcacgacgcctccaccattgccgcggtgttcgtcgaaccggtgtccggctcggccggggtgatcctgccgccggagggctatctgcagcggctgcgcgccatctgcgaccgccacggcatcgtgctggtgttcgacgaggtgatcaccggcttcgggcgcgtgggcgaggcgttcgccgcgcagcgcttcggggtgaccccggacctgatcaccgccgccaagggcctgaccagcggcacggtgccaatgggcgcggtgctggtggccgatgcgatccacgatgccttcatgcatgggccgcaggcggcgatcgagctgttccatggctacacctattccggacatccgctggcctgtgccgcagccctggccacgctggacacctacgccgaagaacagctgttcacgcgggcaattacgctggggccgcagtgggaggaggcgttgtacagcctgcgcggactgccgcacgtcatcgacatccgcaacatcggcttgatcggtgcgatcgaactggcgccgcgcgagggtgccccgggggcgcgcggttacgaggtgttcgaacgctgcttccacgagggcggcctgctggtgcgtgtcaccggcgatgtcattgcgttgtcgccgccgttgatcgtcacccctgaccagatcggacaaatgttggagacactggccgcgatcctgcgcaaggtg

SEQ ID NO: 39131 - DNA, 765 bp, Xanthomonas campestris
atcggtatgacagtctccattcccacgacgcccaacacccgcctgcagggcaagcgttgcctgatcaccgccgccggcgccggcatcggccgcgaaagcgcgctggcctgcgcacgcgtcggtgcgcacgtgatcgccaccgacatcgacgccgccgcgctgcaggcgctggccgccgaatccgacgccatcactacccagttgctggatgtcaccgacgcggcggcgatcactgcgctggtcgcggcgcacggcccgttcgatgtgctgttcaactgcgccggctacgtgcaccagggcagcattctggactgcgacgagccggcctggcgccgctcgttctcgatcaatgtcgatgcgatgtactacacctgcaaggcggtgctgccgggcatgctcgagcgcggccgcggcagcatcatcaacatgtcctcggtggcttccagcatcaagggcgtgccgaaccgcttcgtgtacggcgtgaccaaggccgcggtgatcggcctgagcaaggccatcgccgccgactacgtggcccagggcgtgcgctgcaatgcgatctgccctggcaccatcaagacgccgtcgctgggccagcgcgtgcaagcgctcggcggcgacgagcaggcggtgtggaagagcttcaccgaccgccagccgatgggccgcctgggcgacccgcgcgagatcgcgcagctggtggtgtatctggcctcggacgagtcctcgttcactaccggccagacccacatcatcgacggcggc

SEQ ID NO: 39132 - DNA, 2064 bp, Xanthomonas campestris
ctcgccgttgccaccgtgatggcgctgagcgcctgcaagcgcgatccggccacagcgccaggcgcaaccgcaacaccggcagccgcaccgcaacacgctccacagcgcgcagcgtttgacccgcaggaactgcagcccaccatcagcgcctgccaggacctcaacggcttcgtcaattccaagtggcttgccaagacaaccattcctcccgacgaaacggaagtcggcagctacccaacgctgcaggacgaaagcgatgctgcccagcgcgagatcgtggaggcgctgggccgatcgaaacctgtggagggttccgttgagcaactggtgggcacgttctacgcgtccggtatggacgaagccacgatccagcgcctgggcgatgcacccattcgcccgcggctcgcgcagattgaagcgctgaaaacgccgcaggacgttgccaatttcattgctgcacgcaatacccaaggtgccgggctggtcttcaagttcggcgcctacccggatttccaggatgcgtcgaaggtgatcgcttatgccgaagagaacggcatgacgctgccatcgaaggcgtattacaccgacccgcgctatgccgacattcgcaaagcgtatctggattacatcacccagtccttcgtcctggccggcgcgacgcccgaggctgcaacagtgcaggccaagcaggtcttgcaggttgaaacggcgctcgcagcggcatcgctgagtccggtcgaagcgcgcgacccaaagacccaataccatctggtcagcgttgcacaggccgacgcagtgacgccgcatttctcgtggaaggcgtatctggccgcgcaggggttgagcacagatcagcgtttctccctctcgcagccgcgcttctttgcaggcttcgatcacttgttgaagaccttgcccgtctcgcaatggcaggcctatttacgcttccgtgcgattgacgatgcggcgttcgccctgagcaagccgtttgtcgataaccgcttcgcgttccgctacaagaccatggacgggcagcaggcgcagcggccgcgctggaagcgcgtgctgtttgcgaccgatgaagccatcggcgagggtcttggccagctgtatgtggcaaagatgttcacccccgaagccaagcagcgcgcaacagagctgatcgagaacatccgccaggcactcaagctgcggatccagcaggcagactggatgacagcggagaccaagtccgctgcattgaagaagtgggcaggattcgtcgtcaaggttggctacccggatcattggcgtagctggtcgggcctgcacttcgagcgcgacgcctatttacgcaatgtggaaacagccgcggcgttcaactatcgctatgagcttgccaaggtcggcaagccagcggaccggaccgcgtggttcaccacgccgcaaaccgtcaacgcgttctatttttcgctggacaacagcatcaatttcccggcggcggtgttgcgtcctcccttctttgatgtgaccgcggacgacgcgctaaattacggcgccattggtgccgtgatggggcacgaggcgacccacgggttcgacgatcaaggcagcaagttcaatgcggttggcaccaacgtcaactggtgggcccccgccgatctggccgctttcactgcgcgcgccagcaagctggtcacccagttcaacgcctacaccccgctgccgaacaagccggacgtgcacgtcaacggcgaactgacgctgggagagaacattgccgacctgggtggcatcaatatcgcgttcgatgcgttgcaggccaatctgcagcggcatcccgagcgtggtgcggatatcgatggatttacgccgcaacagcgcttcttcctcggctgggcaagactgtggcgcggcaccatgcgcgaggagaagcagctcagcttgctcagctcggatggtcatgcgccctacgcggtccgcacgaatgcatcgccgtcgaatatgccgcagttcgccaccgcgtttggatgcaagccgggcgacgcgatggtccgatcggaacaggaccgcgttgtgatctgg

SEQ ID NO: 39133 - DNA, 1407 bp, Xanthomonas campestris
atgtcgtcttggctcaggcgcaaatccatcgatcaggtcaccgtgcacgaggccgggcggcagctggtgcgcagcctgagctggccacacctgatcgcgctgggcatcggcgcgatcgtcggcaccggcatctacacgctgatcggcgtgggcgcggacaaggccggcccggcggtgctgctctcgtttgtggccgccggtatcgtgtgcgcctgcgcggcgctggcgtatgcggagatggccacgatgatgccggccgccggcagcgcctacacctacagctacaccgcactaggcgagagcatcgcctgggtggtgggctggagcctggtgctggaatattcgctggtggtgagcacggtggcggtgggctggtcgggctatttcgtcgggttcctgcagtggttgggagtcaatctgccgcatgcattgattgccgggccgcacgccggcggcatcgtgaacctgccggcggtggtgatcaccttcctggtggccggcatgctgatggccggcaccaaggaaagcgccacgctcaatgcggtgttggtggtgctgaagatcattgcgctgggcgtgttcgtggcgatcgcactgccggcgttcaacagcgccaacctgcagcccttcatgccctatggcttctccaaggcgatgggcccggatggcgtggagcgcggcgtgatggcggcggcggcgatcatcttcttcgcgttctacgggttcgatgcgatctccactgcggccgaagagaccaagaacccggggcgcgatctgtcgatcggcatcgtcggttcgatgatcggttgcacgctgatctatgtgctggtggcgttgtcggcggtgggtgcgatgagcttcaccgtgttcggcaagagccccgagccgttggcgttgatcctgcgcgagctcggccatggcaaggcggcgctggtgatcggcgcggtggcgatcatcgcgctgccgacggtgctgctggcgttcctgtacgggcagagcaggatcttctttgtgatgtcgcgcgacggtctgttgccgcgtggcttgtccaaggtcaatgcacgcaccggcacgccggtggcgatcaccttgttcaccgcggtgctggtggccgcgttggcgggcgtggcgcggctggacgagattgccgcgctggccaatgccggtacgttggcggcgtttacggcggtggctgcgtgtctgctggtgttgcgcgtgcgcgaacccacccgtgcgcgggcgttccgcacgccgctggcctgggtggtggggccggtggcgatcctgggctgcctgtatctgttctggagcctgccgagcaccacgcagggctggttcctggtgtggaacgcgctgggcgtggtggtctacctggcctacgggcggcggaatagtcgcttggggaag

SEQ ID NO: 39134 - DNA, 1128 bp, Xanthomonas campestris
ctggcccgcgccagcgcactgcaaaagcgactggtcacgctggattcgcacctggacacgccggccaatctggagcgcggcgatttcgatgtgatgcagggccatgccggcaatcggctgtcgcaggtggactacccgcgcatgctcgaaggcgcgctcgatggcggcttctgggcggtctataccgggcaaggcaatcgcagcgcagccgcgcatctcgatgaccgcgacgccggcctgcagcggctgatgaagatccacaacctgctggccgcgcagccgcaacgcttcgcgctggccaccacgcccgccgatgccgcccgcatcaaggccgccggcaaacgcgtggtgtacatcagcatggaaaacgccagcccgctggtggccgacccgtcgctgttgcgcttttattacgcgcagggcctgcggctgatgagcacggtgcattttctcaacaacgagttcgccgattcggccaccgacccgaaaggggccgagtggaaaggcctgagcccggccggcaagcagctggtgcagcaggcactgggcatcgtgatcgatcaatcgcatgcctccgatgcggtgttcgaccagttgatcgcgctgtcgccggtgccgatcgtgctctcgcacagcggcgcgcgggcggtctacaaccacccgcgcaacatcgacgacgcacgcctgaaggtgctggccgcgcacggcggggtgatccaggtgaattcgtatggcggctatctcatcgacagcggcgccagccccgagcgcaaggccgccgagaaggcgctggccgaccaatacggcggctgggagcatctgaagatgtccgacggcaccgccctgagtgaagcgctcaaggcgctggatgcgcgctacccggtcaagcgcgcgaccgaagaggatttcttcgcgcatctggagcacgtgctcgccgtcgccgggcccgcgcatgtgggaatcggcatggactgggatggcggcggtggcgtggtcgggctggaagacgtctccgacctgccgcgcatcaccgcctggctgctgcgcaagggctatagcgagccgcagatcgccggcatctggggtgggaatctgctgcgggtgatggagcaggcgcaggcctatgcg

SEQ ID NO: 39135 - DNA, 1353 bp, Xanthomonas campestris
atcgccgcgcgcatcgaccgcctgcccgccagcgccacgctgtggcggctggtcgggctgctggcgctgggcggtttcttcgagttgtacgaccttttccagaccgcctatatcagcccggggctcattcgcgacggcatctttgccagcggcaatgacggcgccttcggcatgtccgatcaagccgcgtttgccgcggcgacctttcttggtctgttcgtcggggccgccctgctcagcccctttgccgatcgcttcggccgccgcctggtgttcaccgtggcgttggtctggtacaccgccgccacggtggccatgggcctgcagagcactgccacggcagtgatcgtgctgcgctttgtggtggggatcgggctgggcatcgaactggtgaccatcgatacctacctgtccgaactggtaccgcgtcacatgcgcggggccgcatttgcgttcgcgtttttcctgcagttcctggcggtgcccagcgtggcgctgagcgcctggctgctggtgccgcacgcgccgctgggtgtcagcggctggcgctgggtggtgttgctgagcggtgtgtttgcgctggcgatctggtggctgcgcagccggctgccggagtccgcacgctggctggcggcgcaagggcggcatgccgaggccgaagcggtgatggcccagctcgaagctgcctgcagccgcgatcttggccgggcgttgccgccgccggaaccggtgcaacgggtcgccgcacccgacagccgtctatccgcattgtggcggcagccctaccgcgggcgtatcggcatgctggtggtgttccagatcttccaggccatcggcttcttcggttttggcaactggctgcctgcgctcatcaacgcgcaaggcgccggggtgaccaagagcctggcgtatgcgtttgcgatttcgctcgcttacccattggcgccgctgttgctgctgcgtgttgcgcatcgctgggaaaacaaatggcagatcagtgcatcggctctgggtgcagtggtatttggcgtgctcttcgcgctacagcacgcgccgctgggcatgattgcctgcggggcgatgattgccttttgcaatgcgtggatgagctttgcctaccacggctaccaggccgaactgttccccacggcactgcgcgcacgtgcggtgggtttttgctattccttcagccggttgtctacggccggcagcagcgtgttgatcggttggctgctggcgcagaccggcagccacggcgtgctggccttcatcgtgatcagcatgactatcgtggccagcgtgattgctgcgttcggcccacgcacgcgcaatcgtgctttggaagacatcgcg

SEQ ID NO: 39136 - DNA, 873 bp, Xanthomonas campestris
gtgagcgcggcgttgtttgagcgctgggttgctcgcaccgaacggcagctggacgcctgccttcccagccccgccctcgccccgcagcgtctgcacgcggccatgcgccacgccgtgctcggtggcggcaagcgcatgcgtccgctgttggtctatgcaagcggtgccttgttcggcgccgaagaaggcagcctggatgcgccggcggtggcggtggaactgatccacgcgtattcgctggtgcacgatgacctacccgcgatggacgatgacgcgctgcgtcgcggccaccctacggtgcacatcgccttcgacgaagccactgcgatcctggccggcgatgccttgcaggcacgcgcattcgaactgctggccgaggcaccggcagatgcggcactgcgggtgggctggttgcagagcctggcatctgccgccggtgcggccggcatgtgtggcgggcaggcgctggatatcgacgccaccgggcaggtgcaggcgctggaggcactgcagcgcatgcatgcactcaagaccggtgcgctgatccgcgccgcggtgcgcatgggcgtgctgacaggcggcgcgggtattgccgaccagcagcgcctggatgcgtttgccgacgcgctggggctcgcgttccaggtgcgtgacgacatcctggatgtggaatcaagctccgcccagctcggcaagactgccggcaaggatgcggcgcagtccaagtccacctaccccgccttgctgggcatggacggcgccaaaaccaagctggcggaactggccagccatatgcatgcgctgttgctgccctacggcgaatccggcgccaccttggccagcctcggccgcttcgcggtcgaccgcgcccac

SEQ ID NO: 39137 - DNA, 1302 bp, Xanthomonas campestris
atgacattggtctcggcctggttgcgcattccgttctggcaacgcgtggtggccggcttcgtgctgggcgcgatcgcgggcgcagccatgggcccggccgccgaggtgtggtttgggccgctgggcgatctgtacgtcaccctgatcaagatgatcgcggtgccgctggtgttctttgcggtgatcaacgcgatctcgtccttgcacgggcaaaaatccgttgcggccttgggcgggcgcaccttcctgtggttcgtcatcaccgccgcactggcagtgggcgtgggcctggcggtgggcacgatcatgcagcccggcgccggccatttcagcctgagcgtggactcggcgtggaagccgcgcgatgtgcccagcccgatcaaggtgctgctggatgtggtgccctccaacccgttctacgcgctgaccgggatcggcaccaagaccaatgccgccggcgaaaccgtgctggccgccgggcgtggctcgatcctgccggtgatcttctttgccgcgctgctcggctttgcgatggtcaagctgggtgaccgcgtggccgaggcacgcaagctcaccgggcagatgagcgacatcatgattcaggtcacccgcttcgtgctggagatgaccccgctgggcaccttcggcctgattgccggtttggtgggcagctacggctttgcgaagctgctgccgttcggcaatttcgtgctggcgctgtatgtggcctgcgcgcttcacatcgtggtggtctacagcagcctgttgctgctgcacgggctgaacccgtggaagttcttccgcggtgcggcgcctggcatgcaagtggcgttcgtgagctcgtcaagcttcgccgcgatgccagtggcgatgcgctcgatcacccacaacctcggcgtgaacaaggactacgccgccttcgccgtgccgctgggcgcgagcatcaagatggacggctgtggcgcgatcttcccggcgttgtgcgccgtgttcatcgcgcaatacaccggcgtgccgttgaccgccaaccagtatttcgtggtgctgatcgcctcggtgctgggcagcttcggtaccgctggcgtgccgggcaccgcggtggtgatggccacggtggtgcttagcgccgccaacctgccgctggaagtgatcggctatctgtacgccatcgaccggatcctcgacatgatgcgcaccatgaccaacgtcaccgggcagatgctggtgccggtgctggtggccaaggagaccggtctgctggacaagacgatctacgagtctgcgtccaccaatgtggggctt

SEQ ID NO: 39138 - DNA, 1881 bp, Xanthomonas campestris
tgcaccgatttctacgattacgccaatgccggttggctcaagagcaacccggtgccgcaggctggcgcggtcaccgcgctgggccagctgtccgaccgcgccctgcagcagcagcgcgagctgctggatgcggcgatgaacagcccgcagggcaatgtgcagaagctgctcggcgatttctgggccagcggcctggatgaggccgccgtggaaaaggatggctccaatcccatcgccccgttgctgtcgcgcatcgatgcgatcaagaaggccaaggatgtgcccgcttcgatcgctgcgctgcaccaggtcggtatcccggtcggcttcaacttcggcccggacgtggacctgaaggcgctcgaccgccacatcggttacttcatgcagggcggcatgggcatgccggatccggcgttctacacccgcaccgacgccgacacccaggcgctgatgggccgctaccgcgcctacgtcaagcagatcctggcgctgaccggcaccccggccgacaagctcgacgccgatgcggcctcggtgttgcagatcgaaaccgcactggcacgcagcgcgcagtccgtgcagggcatcaacaacccgttcaacaactacgcgccgatcgccaccaaggagctgaccaagcagtacaagaacctgcgcctgggcgacttcctcgaggcccagggcgtcaaggacgacctggtgtcgatggccgacccggcgatgttcaagcagctcgacagcatgatcgtcagcatcaagcccgagcagtggaaggcctacctgcgctggcgtgtgggcgatgccatggcgccgtatctttccaagagcttccatgacgccgaataccagttccgcggacgcttgctgcgtggcgacgcgttgccgccgcagcgctggcagcaggtgctcgatgccatcaacgtggccgccggcccgatgctcggccgcgagtacgtgagccgttacctcagcagcgacacccgccgccaggccgaagccatcgccgaccagatccgcgatgcgcagctggccgcgctggagcgcaccggctggggcaatggcgaggtcatcgccgaagccaaggccaagctgagcgccatgaagatcgaagtgggcgcaccgcgccgcgacctcgactacaccgtgcagccgatgggccgtggcagcttcggcggcaacatgctgatcgcctccacctggcgtcaccgcgaagaaatgaagcgcatcggcaagggcaacgccgaccgccgttgggatgtgctgccgcagcagccggccctggcctacgacatcgcacagaaccgcctgatcatcaccgctgcggtgctgcagccgccggtcttgagcaccggcgccacgccagctgcacaatacggtgcctacggcgcgctggtggcgcatgaaatgacgcgtgccatcgatgccaagggtgcgctggtcgatgccaagggcgaactgcgcagctggtggacgcccgccgaaaagagcagctggacgctgctgactggcaaggtagccaaccagtacggtgcctacgcctacccgggcgtgcccaatgccaaggtcaatggcgcacagaccgccgaagaaaacctggccgatctggccggcgtggagttggcgtggcaggccttcagcaaggcgcagccggcggcaacccaggccgacaagcaggccttcttcaccgcctgggccggcctgtgggcgcagcagctgtcaccgaacgaagcggtgcagcgtgccagtgctgacatccgtgcacctggccagtggcgcaccaacggcccgctgtccaacctgccggagttcggtgccaccttcagctgcaagccgggccagccgatgcagcgtgtggatgcagaccagttgaagatctgg

SEQ ID NO: 39139 - DNA, 2079 bp, Xanthomonas campestris
cttgccctggccctgctggtggccctgcccggctgcaagcgcacctccgatgcagagagcgcccctgcatcagccgccattgcggcgcctgccgcgccgcccaccacggcagcaaacacacccgcattcgatatcagcgagctgggccctgcagccagcgcgtgccaaaacctggacgagttcgtcaatggcgcctgggccaaggccaatccgattccggccgaccacaccagctggggcatcgacgaactcctgactgaaaaaagcctgctgatccaacgcgagctgcttgaagccgcggcgaaacaggccggtacacaggccccatcgctggaacaaaagatcggcgcgctgtatgcgtccggcatggacgaggccgcaatcgaagccgccggtgccaagccgatccagccgcagctggataagatcgccgcattgcactccggcaaagatgtcgctgcctacatcatcagccggcatggcgaaggcgacgcacaggtctttgcgttcggtgccggtgcagatttccacaatgccgaccagcagattgcgtttacacaggaaggtggccttggcctgccaaccaaggactactacaccggtgcggagcacgcgccaatccgcgcagcctaccttgcctacatcgccaaatcgttcgaactcaccggcacccctgccgcgctggccaagacacaggcaaacgacgtgcttgcgctcgaaacgcgcctggctgccgcatcgctggcccccgtggacgcgcgtgaaccaaagaaccaataccgcctggtcaccctcgccgaggcggacaagctcactccgcactttccgtgggaggattttttcgccacccaaggcgtaccggtcggcagcggcttctcgctcgcgcagccacggttttttgccgcgttcgatcaggcattggctagcgcgcccattgcgcagtggcaggcctacctacgcttccatgcgatcgatgacgcatccacgcgcttgagcaaggcatttgccgataatcgctttgcgttctatggcaagacgctgtccgggcagccagagcagctgccgcgctggaagcgcgtgctgcgttcggtcaacggcgcaatgggcgaaggcgttgggcagctctatgtggccaaggtgttcacgccagatgccaagcaacgcgccagcgaactggtcgacaacgttcgcgcggcgctcaagacacgtatcgaacaggtcgactggatgagtgccgagaccaaggccaaagccttggccaagtggcagaccttcctgcccaagatcggctatccggacacctggcgtgactggtcggggttgcagatcacacccggcgactattacggcaacctgcaggcggctgacacgttcaattatcgctacgacattgcgcagatcggcaaacccaccgatcgcggccgttggtcgatgacgccgcagacggtcaacgcgtattacgacccgatgaccaattcgatcaactttcctgcggcgatcctgcagcctccgtatttcgatgccactgccgacgatgcgttgaactacggcggtatcggcgcggtgatcggtcacgaggccacccatgggttcgacgatcagggcagccaattcgatggtgcaggcaacaacgtcaactggtggacggcagaggatcggcgcaagttcgaccaacgtagcaaccagttggtcaaacagttcgatgcgtatgcgcccctgcccagccatccgaccctgcacgtcaacggcaaactcacccttggcgagaacatcgccgacctgggcggcaccaacgttgcctatgacgcgttgcagaccgccttgcagcagcatccggaacgggccaaggccatcgacggctacagccccgaccagcgctttttccttgccttcgcccgcagctggcgtcaacgcgtccgtgatcaacaacagatggtctatctggcgtcggacccgcacgcgccagccaagctacgcgccatcgcatctccctcaaacatgccgcagttcgccaccgccttcgcctgcaagccgggcgatgcaatggtgcgcccggagaaagaccgcgtggtgatctgg

SEQ ID NO: 39140 - DNA, 2097 bp, Xanthomonas campestris
ttgacgctgtccctggccgtcgccgccgcgctgagcggctgcaagaagcccgaagacgccgcaccggccaccgcgcctgatgccgctgccagcgcggccgccgcacccaagacgctgaccctggaccagagcaagctgccggcggtgaatcagttcactgctgccgatctggatcccaacggcaatgcctgtaccgatctgaacgcctacgccaatgccaagttcctggccgccaacccggtgccgggcgaccgcaccagctggggcgcgttcgaaatgctcgacgagcgctccaacgcgatccagcagcagctggccgaacaggccgctgcagacaccggtgctaccggcgtcgaaaagatcgtcggcgacctgtggtccaccggcatggacgaagccaagatcaatgcccagggcatcgagccgctgaagccggaactggccgccatcgacgccatcagcgaccaggccaagctggtcgactatctgcgcagcagcgcggccaagggcaacaacgagctcttcagcttcggcgcggaagcggacttcaagaagtccagccagaacattgcctatgcgatgcagggcggcctgggtctgcccgacccggagtactacaccagcgccggtaacaaggccaagctggacgcctaccaggcgcacgtcgccaaggtgctggaactgtctggcgttgccgccgccgatgccaccgcgcaggccaagcaggtcgtcgcgttcgaaacccgcctggccaaggtttccaagaccagcacgcagatgtcgcgcgatgcctcgctggcctataacccgatctcgcccgccgatgccgacaagctgacccccaactggtcgtggaccgagttcttcaagtcgcagggcgtagccacgccggagatgttctcgctggcaatcccggcctttcatcaggaagtgagcaagatgatcgccgacaccgacccggccatctggcgcgcctacctgcgcttccacaccgtcgacggtgcctcgccgtacctgagccagccgttcgtggatgagagcttcgcgttctacaacaagaccatgcgcggccagaaggaaatcaagccgcgctggaagcgcgtgctggccaccatcaacagccaggccggcgaaacgttgggccagatgtacgtcaaggtcgccttcccgggcgattccaaggccaagatggaaaccctggtgaccaacctgcgcaccgcactgaaggcgcgcatcgaaaagctcgactggatgagcccggagaccaaggccaaggcgatcgccaagtgggaaagcttcacgcccaagatcggctacccggaaaagtggcgtgaatggaacggcctgagcaccagccgtgacagctacctgggcaacgtgatggcggcatccgagttcaactacaagtggaatctgtccaagatcggcaagccggtggacaagaccgaatggggcatgagcccgcagaccgtcaacgcgtactacaacccgctgcagaacgagatcgtgttcccggccgctatcctgcagccgccgttcttcgacccgaatgcgccggaggaaatgaactacggcggcatcggtgcggtgatcgggcatgagatgacccacggctacgacgaccagggcagccgcttcggtgccgatggcaacttcatcgccgatccgggttggtggacgcagaaggatctggacgcgttcaaggcacgcaccggcaagctggtggcacagttcgacagctaccgcacgccggcaggcgacaaggtcaagggcgacctgaccctgggcgagaacatcgccgacctgggcggcctcaacaccgcctatgacgcgatgaagaccgccaccgccggcaaggacgaccccaagagcgacggcatcacccgcgaccagcgcttcttcctcaactgggcgacggtgtggcgtcgcaacttcaccccggaagaattggtggtgcgcctgaagaccgacccgcacgcgccggccaacttccgcgccatcggcgcgccgtcgaacatgccggcatttgccgccgcattctcgtgcaaggcgggcgatgcgatggtgcgtcaaggcgatcagcaggtggtgatctgg

SEQ ID NO: 39141 - DNA, 873 bp, Xanthomonas campestris
atgtccgttttgattaacaagaacaccaaggtgatcgtgcagggcttcaccggccagcagggcaccttccacgccactcagatgatcgagtacggcacccaggtcgttggcggcgtgacgccgggcaagggcagcaccacgcacatcgatctgccggtgttcaacaccgtggccgacgccgtgcagagcaccggcgccgacgcgtcggtcatctacgtgccgccgccgtatgcggccgatgcgatcctggaagcggctgcggccggcatcaaggtcatcgtctgcatcaccgaaggcatcccggtgctggacatgctgcgcgtcaagaacgtgctgacccgttcgcatccggacaccgtgctgatcgggccgaactgccccggcgtgatcaccccgggcgagtgcaagatcggcatcatgccgggccacatccacaagccgggcaagatcggcatcgtgtcgcgttcgggcaccctgacctatgaagcggtcaagcagaccaccgaagtgggcctgggccagagcacctgcatcggcatcggtggcgatccgatcaacggcctgaacttcgtcgactgcctcaagctgttcaacgaagacccgcagaccgaaggcatcatcatggtcggcgagatcggcggcgacgccgaggaagccggtgccgagtacatcaagcagttcgtgaagaagccggtcgtcggcttcatcgccggtgcctcggcgccggccggcaagcgcatgggccacgccggtgcgatcgcatcgggcggcaagggcacggccgaaggcaagttcgcggcgatggaagcggccggcgtcaagaccgtccgttcgccgggcgatctgggtgcggcgatcgctgcgctggtgaag

SEQ ID NO: 39142 - DNA, 1128 bp, Xanthomonas campestris
cagctgcttgccgagtacggcatccccgtcccggccggtaaggtcgcgtccacgccggacgaagcggttgaagtcgccaactccttgggcaagggcccctggatggtcaaggcgcagatccacgcgggcggccgcggcaaggctggcggcgtcaagttctgcaagaccaccgacgacgtgaaggccgcagcagacaagatgctcggcaccaagatgtccacctaccagaccgcaggcgtcgagttgccggtcaacctggtgctggtgaccaccgccggcgagatcgtcaaggagctgtacctgtcgatcctggtcgaccgcggcaccaagaccatcacctatatcgcttcttcggaaggcggcgtggaaatcgagcaggttgctgccgaaaccccgtaactgatccactcgctcaacgtcgatttcgtcgaaggcgtgcagggctaccacggccgcgatttcggcttcaagctcggcctcaatgccaagcaggccggccagttcgccagcatcatggtgaacctgtatcgcctattcaacgacaaggacctggcgctggttgaaatcaacccgctggcgatcctggacgacggcaacctgtacgcgctggacggcaagttcgacagcgacgacaacgccgccttccgtcagaaggcgctggtcgccatgcgcgacaagacccaggaagacgagaccgaagtgaccgcttcggagctggacatcaactacgtcaccatggacggcaacatcggttgcatggtcaacggcgccggtctggccatggccaccatggacgtcatcaagctcaacggcggcgagccggcgaacttcctggacgtgggcggcggtgccaacaagcagcgcgtcatcgaagcgttcaagctgatcctgtcctcggacaaggtcgaaggcatcttcgtcaacatcttcggcggcatcgtccgctgcgacatgatcgccgaaggcatcattgccgcggtcaaggaagtgggcgtcaaggtgccggtcgtggtgcgcctggaaggcaccaatgtggaagaaggcaagcagctgctgcgtgacagcggcatggccatcatcccggccgacaacatcaacgacggcgccaagaaggtcgttgaagctgtc

SEQ ID NO: 39143 - DNA, 2082 bp, Xanthomonas campestris
ccctcccgcatccgccaaggccgcccgttcccacgcggcgccatcttcgatggcaagggcaccaactttgcgctgttttccgcgcacgccacgcgtgtggagctgtgcctgttcgacgaacagggcaacgagagccgtgtcgacctgcccgagtacaccaacgagatctggcatggctatctgcccgacgtaaagcccggccagcgctacggctaccgcgtgcacggtccctatgcacccaccgagggacaccggttcaaccacaacaagctgttgctggatccgtatgcgcgcgaactcgatggcgacctggtgtgggccgatgaattgtatggctacacggtcgggcatcctgatggcgacctgagcttcgacgagcgcgacagcgcgccgttcatgcccaagtgcgtggtggttgaagacacctacgactgggaagacgacgcgcgcctgctcaagccgtggaacgagactgtgatctacgagacccacgtacgtggctacaccatgcgcaacgcgcaggtgccggaagccgtgcgcggcaccttcgccggcctggcgcagccatcggtgctgcagtacatcaaggacctgggcattacggcggtggaactgctgccggtgcatgcgtatctggatgatcagcacctgctggacaagggcctgcgcaactactggggctacaacaccatcagcttcttcgcgctgaagtcgcgccacctttccagcggccatcgcgacgagttccgcgacatggtcaaggcgatgcacaagcaaggcctggaagtgattctggacgtggtctacaaccacactgccgaaggcagcgaactggggccgacgctctcgttcaagggcatcgacaacgccagctattaccgtctcgccgaagacaagcgctactacatcaacgacaccggcaccggcaatacgctcaacctgagcaactcgcgggtgatccagttcgtcaacgattcgctgcgctactgggccggcgaaatgcacgtggacgggttccgcttcgacttggccacgatcctgggccgcgagccgagcgggttcgatcaacgcggtggcttcctggatgcctgcaaccaggatccgctgctgtcggaagtcaagctcattgccgaaccatgggattgcggcccgggcggctatcaggtggggcatttcccgccaggttggtcggaatggaacgacaaattccgcgacaacgcgcgcgagttctggaagggcgaggacggcaagctggcagagtttgctactcgcttcaccggctctgcggacctgttcgaccgccgcggtcgccgcccctgggcatcggtgaacttcatcaccgcgcacgacggttttacgctgcgcgatctggtgagctacaacgagaagcacaacatcgacaacggcgaggacaaccgcgacggttcctccaacgatggctcgtgcaactacggcgaagaaggcgaaaccgacaacgccgacatcctgcaacttcgcgagcggcagatgaagaacctgctcgccacgctactgctctcgcaaggcacgccgatgatgctggccggcgacgagcgggcgcagtcgcagggcggcaacaacaacacctattgccaggacaacgagatcacctggctcgactgggagaacgaccccaccgacggccgcctgaccgacttcgtcaaatcactgaccgcgctacgtaaacgttacccgatcctgtcgcgtggccgcttcctcaacgggcagtacaacgaagaagctggcctgcgtgatctgacctggctcaatccgggcggcaccgagatggacgacgcgcactggaccgatgccggcgcgcgctcggtgggactgctgctggaaggcaaggcgcagacctccggcgtcaaggaacgcggcaacgacgctaccttgctgatcgtgatcaatgcctaccacgagggcgtgaccttcaccctgccctcttccgacgaaccggtgcactggaagcttgcgctctccaccgacgaagcgctggaagtggacagcatgccggccggcgccagcgagttcctggcaccgccgcgcagcatcacggtgttcgag

SEQ ID NO: 39144 - DNA, 2112 bp, Xanthomonas campestris
atccgtcagacggagtcgagcgagtgcggcctggcctgcattgcgatgctgctctcctactacggccatgaaacgagccttggggagcttcgcaaccgctttacggtgtcaaccagtggggcaacgctcgcctcgctgattgaaatcgctgacgccaacggactcacgacgcgtccgcttcgcttggagctttacgaactgcccaagctgtcgttgccttgcatggtccacctacaccacgggcactttgtcgtgctgacggctgtgaggggagggcatgttcacatcagcgatcccgcaacgggcgtcaaaaaaatcaagctcgatgagttcgatgagctttttagcggcattgcgttggaggcgcatccgggtccggccttcaagaagatcaagagcgtgccatcggtgtcgcttcgcgatctggcaggctcgcttcggtccctggtgcccgcgttctggggtgtgggcatcttggcgctcttcttggaaggctgtgcgctgattgcgccgcaatatctgagactgaccatggatcaggtgctcagcgtcaaggacgatggtctggtcaccacattggctatcggcttttcgatcgtgctcctggtccagctcgtcttgaccgttgccaggaagtggaccttgctgtggatctcttcgaccactggcttacggtggagcagcaacttgttccgtcacctcgtgtcgctaccccagtcgtatttcgtaaagcggcacaccggggatatttcaagccgcttccagtcgatctactccatccagcagtcactcacgacgaagatgatggaagcggtcatcgatggggtgatgtcttttctcatgttgttgctcttgatgagctacgacgcgccgcttgccttcgccttgttggctttcaccattgcctatgtgggttcgcgctacgcctactacgccaaactgaaagaagccaaccttgatcagatcaacattgatgcacgccggcaaagcttgctctacgaaacggtccgaagcatccagcccatcaagctgttcaacaagtcagcgctctgggcgtcgcgcttcacgaactacagcgcgaaagccaccaatgcaaccatcggggccgagcgtatccgcattgggttcgattctgtccagcttctcatccaaggcctgtgccgcattttcgtgatctgggagggcacacggctggtgctcagtggcgatatgacgatcggggtgctgacggtctttttgatctacgcgacccagttcagccaacgcagcatcaatttggccgactacttgatgcagctccggctgcttcgcttgcacaccgagcgcatttcagacatcacgcacagcgagcctgagtcgtttctgcatggcaacggcgcgctggaggatgctgcgccagctattgccattgccaacggctacttccgctactcgtctacggacaagtggatcatgagcgctttgcagctcagggccccggcaggccaagtgattgcaattgtcgggaactcaggcgtgggtaagaccacactcatccgcgttctggcggggcttgaagatcttcaagttggggacttcttagtcaatggagaggatctgcgcaaagtcggtaagtcgagctaccggagcaaggtcagcatcgtcatgcagggagacaatctgttgtccgggacgttgtcggaaaacatctccatgttcgatgagcacattgatcaagagcgtcttgtgcaggctgcgaaattggcatgcatccacgacgatattcagcgcatgccaatgggcttcaacaccagagtcggcgacttgggaaacacgctgtcaggcggtcaaaaacaacggatcttcttggcgagagccttttacaggcgcaccaagttgttgctgatggatgagccaacgactggggttgatgagcagatgggcatccagttgatgaagaacatcaagagcatcggcgcgaccacggtcgtcgtgacgcacgacaagaatatctctcggatgtgcgatatgcactacctcttcgttaacgggaacctgaggcccctgatcaaagagcagccaagcagctttgaacaggacaatgcagtggaaacagctggaaaatccagccaa

SEQ ID NO: 39145 - DNA, 759 bp, Xanthomonas campestris
atgacggcgtccgaatcccctgtcgtgcaattgtccggtgtccgcatcgatcgcggcggacgcgcgatcctgcgcgacgtgtcgctggatgtcccgcgcggcagcatcacggccgtgctcggtccctccggcagcggcaagtccaccttgctggcggcactgacgggcgaattgcgcccggtggccggccgcgtgaccttgttcggccaggaaattccgcgcggtagccgggcgctgctggagatgcgccgcaatgttggcgtgctgctgcagggcaatggcttgttgaccgacctgagcgtggccgacaacgtcgcgctgccgctgcgcacgcatacccgcctgccggcgccggtgctgcagcgcctggtgcagatgaagctgcatgcggtgggcctgctggccgcggccgatgcctggccgcgcgagttgtccggcggcatggcgcggcgtgtggcactggcgcgcgcgctggcgctggacccgccgctgatgatctacgacgagccgctgaccgggctggacccgatcgcctcgggcgtgatcatgagcctgatccagcgcctcaacgacagcctggacctgaccagcatcatcgtcagccaccacgtgcacgagacgctgccgatctgcgaccaggcggtggtgatcgccaatggcggcatcgtgttcgccggcacccccgagcagctgcaggacagcaccgacccgctcgtgcagcagttcctgcacggccagccggacggcccgatcccgttc

SEQ ID NO: 39146 - DNA, 1485 bp, Xanthomonas campestris
caatccatcttcaaaccacgctacgacaacttcatcggcggggcgtgggtggcgccgcagggtggtcagtatttcgacaacaccacgccgatcactggcaaggtgttcacttcgatcgcgcgctctaccgcgccagatatcgaagccgcattggacgccgcgcacgcggccaaggaggcgtggggcaagacctccaccaccgatcgctccaacgtgctgctcaagatcgccgaccgtatcgagcagaacctggaattgctggcctacgccgagacctgggacaacggcaaaccggtacgcgaaacgctcaatgcggacgtgccgctatgcgtggaccacttccgctatttcgccggtgccatccgcgcgcaggaaggcggcatctccgagatcgacagcgacaccattgcctatcatttccacgagccgctcggcgtggtggggcagatcatcccgtggaatttcccgctgctgatggcctgctggaaactcgcgcccgccctggccgccggcaactgcgtggtgatgaagccggccgagcagaccccggcctcgatcctggtgctgatggaggtgatcggcgatctcctgccgcccggcgtgctcaacgtagtgaacggcttcgggcttgaggcaggcaagccgctggccagcaatccgcgcatcgccaagatcgccttcactggcgaaaccaccaccggccggctgatcatgcagtacgccagccagaacctgatcccggtgacgctggagctgggtggcaaatcgcccaacatcttctttgccgatgtcatggccgaagacgatgactttctcgacaaggcagtggaaggtttcgtgctgtttgccttcaaccagggcgaggtctgtacctgcccgtcgcgcgcgctgatccaggaatcgatctacgacacattcatggaaaaggcgctcaagcgcgtggcggcgatcaagcagggcaacccgctcgatcccaacaccatggtcggcgcgcaggcttccagcgagcagctggagaagattctgtcctacatcgacataggcaagcaggagggcgccgaaatcctgatcggtggcgagcgcaacatgctcgacggggagctatcggacggtttctatgtcaagcccacggtgttcaagggccacaacaagatgcgcgtgtttcaggaagaaatcttcggcccggtggtgtcggtgaccaccttcaaggacgaggccgacgcgttggcgatcgccaacgacaccttgtacggattgggcgccggcgtgtggagccgcgatgcctcgcgcctgtaccgcatgggccgcgcgatccaggccggccgcgtgtggaccaactgctaccacgcctatcccgcgcacgccgccttcggtggctacaagcagtcgggcatcggccgcgaaaaccacaagatgatgctcgaccattaccagcagaccaagaacctgctggtgagctattcgccgaaggcgctggggttcttc

SEQ ID NO: 39147 - DNA, 1194 bp, Xanthomonas campestris
ttctttgcaaatgtagaacaggttccaggcgaccccatcctgggcctgaccgaggcctacaacgccgacagccgccccaacaaggtcaatctgggtgttggcatctattacgacgaaaacgggcgcatcccgctgttgcgtgccgtgcagaagatcgagcagcagctcgcgctggatgccaaaccgcgcggctacctgcccatcgacggcctggccgcctacgacaaggccacccaggagctgctgttcggcgccgagtcggcgctggtggcctccggccgcgtggcgacctcgcagaccgttggcggcagcggtgcgctgcgcgtgggcgcggacctgctcaagaagctgctgcccacctccaccatcgccatcagcaaccccagctgggaaaaccaccgcgcggtgttcggcgcggccggcttcgaggtggtggattacacctatttcgatgccgccagccacgggctgaacttcgacggcatgctggccgacctggccaagctggagccgggcacggtggtgctgctgcatgcctgttgccacaaccccaccggtgccgacctcagccgcgagcagtggaagcagctggccggcctgttgaaagaacgcaacctgttcccgttcgtggacatcgcctaccagggcttcgacaagggcattgaagccgacgcctacgcagtgcgcctgctggcggccgaaggcatcgacacctacgtggtggcgagctcgtactccaagtcgttctcgctgtatggcgagcgcgtgggcgcgctgtcggtggtctcggccacggccgccgaagccaaggcggtgcagtcgcaggtcaagcgcatcatccgcacgatctactccagcccatccacgcacggcgccgccctggtggccggcgtgctgaccagcccggagctgcgcgatgtgtgggagcaggaactcaccgaaatgcgcgagcgcatccacgcgttgcgtgccggcctggtcgccaagctggccgcgctgggcgcaccggagttcgagttcatccagcgccaggccggcatgttctcgtactcgggcctgaccaagtcgcaggtggaccgcctgcgggacgagttcgcaatctatgcggtcggcaccggccgtatctgcgtggccgcgctgagccagcgcaatctggactacgtggcccaggccgtggccacggtcagccgcggc

SEQ ID NO: 39148 - DNA, 996 bp, Xanthomonas campestris
atgtcgcgtccctcgctgacccgcttcctgatcgaagagcaacacgccggccgtatcgacccggaattgcgccagctgatcaccatcgtctcgcgcgcctgcaagcgcatctccatcgccgtcagcaagggcgccctgggcggcgtgctgggcgatgccggcaccggcaacgtgcagggcgaggcgcagaagaagctcgacgtgctgagcaacgacatcctgctcgaagccaatgcctggggcggccacctcgccgcctgcgcatcggaagagatggaccacagccagccagtgcccgaccaataccccagcggcgatttcctgctgttgttcgacccgctcgatggcagctccaacatcgacgtcaacgtctcggtcggcaccatcttctcggtgctgcgcgcgcccaagggcaccgaaaagcccggcgacgaacacttcctgcagccgggcacgcaacaggtggccgccggctattgcatctacggccccagcaccatgctggtactcacgctgggccacggcacccacgcgttcaccctggagcgtgaggaaggcagcttcctgctgacccaggccgacatgcgcgtgcccgaagacactgccgaattcgccatcaacatgtccaaccagcgccactgggaaccggccatgcaggcctatgtgggcgacctgctggccggcaaggacggcgcgcgcggcaaggatttcaacatgcgctggatcgccagcatggtggccgacgtgcaccgcatcctgacccgcggcggcatcttcatctacccctgggacaagaaggacgcggccaagcccggcaagctgcgcctgatgtacgaagccaacccgatgggcatgctggtggaacaggctggcggcgccgcgaccacggggcgcgagcgcatcctggatattcaaccgacgcaactgcatcagcgcgtgccggtgtttttgggctcgaagaatgaggtggccgaggcgacgcggtatcacgtggag

SEQ ID NO: 39149 - DNA, 1290 bp, Xanthomonas campestris
ctcaaaccccggcaattgatgatgatgggcctgggcacggcgatcggcgcaggcctgtttctcggctcgggggtcggcatccacgcggccggcccggccgtgctcgtgtcctatctgatcgccggcgcgctggtgatcatcgtgatgaacgcgctcggtgaaatggccgcggccaagccggccagcggcgcgttttcggtctacgcggccgatgccatggggccgaccgccggcgcaaccgtcggctggttatggtggctgcagatcgtggtggtgatcgccgccgaagcagtgggcgcggcaagtctgctggccacggtgtggccggccttgccggtgccgatgctggcgtcggtgttcatggccaccttcaccgtgatcaacctgctgggcgtgcgcaatttcggtgagttcgaattctggttcgccatcctcaaggtggtggcgatcctgatcttcctgatgattggcggtgcgctgctggccgggttgctgccgggcgtggcgtcgccggggctctccaatttcacccagcacggcgggttcgcgcccaagggcctggccggcatcggcaccgcactgctggtggtggtgttcgccttcggcggtaccgagatcgtggcggtggcggcagcggaaaccgccgaccccgggcgcagcctggcgcgcaccatccgcacggtggcctggcgcattctggtgttctatatcggctcgatcagcgtcatcgtcgcggtggtgccctggaccagtgatgcactgagttcgccgtttgccgctgtgctggaagtcgcgcgcattcctggtgcggcaaccggcatcacgctggtggcggtggtggcgctgttgtcggcgctcaatgccaatctctatggtgcctcgcgcatgatcttctcgctggcccagcgcggtgaagcgccccgttggctgggcaacaccagccgccagcaggtgccgctggtggcggtgatcgccagcgtgttgttcggctttgccgccgcggtgctggagttgctgtatcccggcaaggtgctgccgatgctgctgaatatcgtcggtgccacctgtttgctggtgtggacgatctcgttgctgtcgcagttgatcctgcgtgcacgcgccgaccgcgccggcatcgccttgccgttccgcatgcgtggctacccggtactgacgctactggcgttggcgatcctggcggtgatcttcgtgctgctggcattgtcggccgacacccgcgcgcagttcctgtcgatggtggggctcaccgccggcatcgcgctggtgagc

SEQ ID NO: 39150 - DNA, 1677 bp, Xanthomonas campestris
atgagtctgcgcttgcgcggacatgccgcctcgcgcggtaacgcattggggcgcgcccgcgtccgccagagccacacgccggaggtggccgagcaacgcgtgccggccaaccaggtcgaaacgcagctgcagcgtctgcacgcggccattgccgccgcacgcaccgagatgcagcaactgcgcgaccgcctgcatggcgcgctggcccgcgaagtgggcgaattcctcgaactgcatgccctgttgctagacgacccggaactgctgcaggggctagacgatttgatccgcacgcaccgctacagcgccgactacgcgctgcgtgtgcaacgcgatcgcctggcggcggtgttcgacggcatggaagatgcctacctgcgcagccgcatggacgatctggaccatgtgatcgggcgcatccatgcgtttttgcacaagcgcgcgcccgatctcaagggcgtggccggcgagatcctggtgtgcgacaacgtggcaccgtcggaactggcgcagctgcaggcgcaaggcgtggtcggcatcgtcaccaccgccggcagtgcgctctcgcatagcgcgatcctggcgcgcagcctgcacctgcccttggtggtcggcgtggccgacgcggtgcagcgggtcaacgatggcgacgtgctgatcgtcgatgccggctccggccaggtcatcgtcgaccctacgcccgagcatctacgcgactaccgcgagcgcctgcgcacgctggccaaggaacaacgcgaactgggacggttgcgctccaagccgacccgcacgcgcgacaacgtcgacatcaccctgctggccaatgccgagtcgctggaagacgtggccaaggcgcatgcgctgggcgcgagcggactggggctgtaccgcaccgaattcctgttcctgcagcgcaacgagctgccggacgaagacgagcagttccacacttaccgcgacaccgtgctgggcatgagcggccggccggtgacgatccgcacgctggatctgggcgcggacaaggctgaccgcaccgggctcaccctgagcgacgaggacaacccggcgctgggcctgcgtggggtgcgcctgtcgcttgcccggccggcggtggcccaggcacagctgcgcgcgatcctgcgtgcgtccggctacggcccggtgcgcatcctggtgccgatggtcagcgggcgcgaggaaatcctgttggtgcgcaaacagctgaaaaagctcaccgcgcagctgcgcgacgaaggccacgagatcgccgagcacattccgctcggcgcgatgatcgaggtgccggcggcggcattggcgctggactgcttcatcgacgacatcgactttttgtcgatcggcaccaacgacctggtgcaatacctgctggcggtggaccgcaacaacgaagcgctaggcgagctgtattcgccgttgcatccggcggtgctgcgattgattgcgcaggtcatcgccaccgggcgggcgcacaacaagccggtggccgtgtgtggcgaaatcgccggcgacccgcgcttcgtggcgatgctgctggcgttgggcctcaccgagttcagcctgcatccggccaccttgctggaagtacgccgcgcggtgcgcgacctgcatctgggccagttgcgcgtgcacggcgaaaaactgctgcgcgcgcgcgac

SEQ ID NO: 39151 - DNA, 1269 bp, Xanthomonas campestris
atggcaaaaatcgtagtgaccggcggccaagcgctgcacggtgaggtccatatttccggcgccaagaacgcggtgctgccgatcctgtgcgcgaccctgctggccgatgcgccggtggagatcagcaacgtgccgcacctgcacgatgtgatcaccacggtgaagctgctcagcgagctgggcgccgaggtcaccatcgatgaaggcacgctggccaaggggcgctcgatcctggtcgacccgcgttcggtcacccaccagatcgcgccgtacgagctggtcaagaccatgcgcgcctcgatcctggtgctgggcccgctgctggcgcgctatggcacggccgaagtgtcgctgcccggcggttgcgcaatcggctcgcggccggtggaccagcacatcaagggcctgcaggcgctgggtgccgacatcagcgtggaaaacggctacatcaaggccaccagcaacgggcggctcaagggcgggcgttacgtgttcgacatggtcagcgtcaccggcaccgagaacgtgctgatggccgccgtgctggccgaaggcaccaccgtgctggaaaacgcggcaatggagccggaagtcaccgacctggccgactgcctgatcgcgctgggcgcacagatcgaaggcgcgggcacgccgcgcatcacggtgcagggcgtcgagcgcctgggcggcggccaccatgcggtgctgccggaccgcatcgagaccggtacctttttggtggccgcagcgatgaccggcggcagcgtcaccgtgcgtcgcgcgcgcccggacaccctggacgcggtgctggacaagctcaccgaggccggcgcgacgatcaccaccactgccgacagcgtcaccctggacatgcacggcaagcgcccgcgcgcggtcaacctgaccactgcgccgtacccggcgtttcccaccgacatgcaggcgcaattcatggcgcttaactgcgtggccgacggcgtgggcgtgatcaacgagacgatcttcgaaaaccgcttcatgcacgtcaacgagctgctgcgcctgggtgcggatatccaggtggaagggcataccgcgatcgtgcgcggcgccgaacgcctcagcggcgcgccggtgatggccaccgacctgcgtgcgtcagcctcgctgatcctggccggcctggtcgccgacggcgacaccaccatcgatcgcatctaccacctggaccgtggctacgaaaacatcgaggagaagctgggggcgctgggcgcgaccatccggcgcatc

SEQ ID NO: 39152 - DNA, 825 bp, Xanthomonas campestris
agcgccaccctggcagcagcgctgcagcacccgcagttgcgtctgctggatgcgcgggcggcaccgccaaccgcgccggacccgggcgccgcacagcgcgactacgcacaaggacatctgccgggtgcgcatttcgccaatctgcacgacgcgctggcggatgtgtcgcgccctgggcaagggcgtcatccgctgccgcacagtgatgtcttcgcggcccagctcggccgctgggggatcacgcccgacagccaggtggtggtctatgacgcggccgacggcagcatggcggccgcacgtgcatggtggatgctgcggctgatgggccatcgccgcgtggcggtactggatggcggcctggccgcctggcgtgcggccgggttgcccgagaccacggcagtgccttcgccggccgacagcggcgcgtacccgggcagtttcgatgcggatgcggtggtggacgccgaggcgatcctggcgcgcctggacgcggcgccgggctggctgctcgacgcacgtgccggtgagcgctttcgtggcgaggtggagcccatcgacccggtggccgggcacgtgccgggcgcggtgagtcgcccgctcggcatgagcctgcgcgatgggcggttcaagccggcggcggagttgcgcgccgagctgggcgcgctgctgtgcgactacgcgccggagcaggccgtggtgatgtgtggctcgggtgtgaccgcctgccatctgctgctcgcgctggaggtggcagggctctccggtgcgcgcgtgtatgccggatcgtggagcggctggttgcaggatcgcagccgcccggtcgcg

SEQ ID NO: 39153 - DNA, 1356 bp, Xanthomonas campestris
atgctcgataaagtcgtcattgccaaccgaggtgaaatcgcgctgcgcatcctgcgcgcgtgccacacgctcggcatccgcacggtcgcggtgcactccacggtcgaccgtaacctcaagcacgtggccatggccgacgagtcggtgtgtatcggcccggccgcgtccagcgacagttacctcaacatcccggcgctgatcgccgcggccgaggtcaccgacgcgcaggccatccaccccggctacgggtttctctcggaaaacgccgattttgccgagcgggtggaagaatccggcttcatcttcatcggccccaaggccgacaccatccgcctgatgggcgacaaggtcgaggcgatccgcgcgatgaaggccgccggcgtaccgtgcgtgcccggctcgggcggcccgctgggcgatgacatcgtggccaacaccaagatcgcgcgcgaaatcggctacccggtgatcatcaaggccgccggtggcggcggtggacgcggcatgcgcgtggtgcattcggaggccgcgctgaaggcggcgatcgaaaccaccaagtccgaagcaaaggccgctttcagcaacgatcaggtctacatggagaagttcctggagaacccacgccatgtggaaatccaggtgcttgccgatggccagggcaacgccatccatctgggcgagcgcgattgctcgatgcagcgccgtcaccagaaagtggtggaagaagcgccggcaccgggcatcagcgaagaactgcgcgctgagatcggcaaggtctgcgtggatgcgtgcatccgcatcggttaccgcggcgcgggcaccttcgaattcctgttcgaaggcggccggttctacttcatcgaaatgaacacgcgtatccaggtggaacacccggtgaccgagcgcatcaccggcatcgacctggtgtgcgagcagctgcgcatcgccgccggccacaagctgagcatcaagcagagcgacatcgtgctgcgcgggcatgcgatcgagtgccgcatcaacgccgaagacccggaaaccttcatgcccaacccgggcctgatcaccgccttccatccgccgggtggcccgggcgtgcgcgtggatacgcacatctatgccggctacaaggtgccgccgaactacgactcgatgatcggcaagctgatcgtgcacggcccggaccgcgagaccgcgatcgcgcgcatgcgcgtggcgctgagcgagatggtggtggacggcatcaagaccaacatcccgctgcagcagcgcatcatgcgcgacaagggcttccaggccggtgggcagaacatccactacctggaaaagcgactggccgaacgcaagaacaagtcgatc

SEQ ID NO: 39154 - DNA, 441 bp, Xanthomonas campestris
atggcccacctgctgctgttgcacggccccaacctcaacctgctcggcacccgcgagccggaggtctacgggcgcaccacgctggcgcagatcgatgcggcgctggtggaccgtgcgcaggcggccgggcacacgctggactgcctgcagtccaatgccgagcacgtgctggtggagcgcatccacgccgcgcgcgaagacggcaccgccttcatcctgatcaacccggccgccttcacccacacctcggtgtcgctgcgcgatgcgctgctgggtgttggcctgccgttcgtggaaatccatctgtccaacccgcacacccgtgagccgttccggcaccacagctatctgagcgacaaggccgccggcgtgatctgcggcttcggcgccgacagctaccggctggcgctggaagcggtgatcgcgcgcctggagcgcgac

SEQ ID NO: 39155 - DNA, 1632 bp, Xanthomonas campestris
atggctgctaaagacattcgtttcggtgaagatgcgcgtacccgtatggtgcgtggcgtcaacgttctcgccaatgccgtgaaggcaaccctgggcccgaagggccgcaacgtcgtgctcgagaagagcttcggcgcgccgaccatcaccaaggacggcgtctctgtcgccaaggaaatcgaactggctgacaagttcgagaacatgggcgcgcagatggtcaaggaagttgcttccaggaccaacgacaacgctggcgacggcaccaccaccgccaccgtgctggcccaggccctgatccgcgaaggcgccaaggctgtggccgccggcatgaacccgatggatctgaagcgcggtatcgaccaggccgtcaaggccgccgtcatcgagctgaagaacatctccaagcccaccaccgacgacaaggcgattgcccaggtcggcaccatctcggccaactcggacgaatcgatcggcaacatcattgccgaagcgatgcagaaggtcggcaaggaaggcgtgatcaccgttgaagaaggctcgggcctggaaaacgagctggacgtggtcgagggcatgcagttcgatcgcggctacctctccccgtacttcatcaacaaccagcagagccagtcggccgatctggacgacccgttcatcctgctgcacgacaagaagatctccaacgtgcgtgacctgctgcccgtgctggaaggcgtggccaaggccggcaagccgctgctgatcgtcgctgaagaagtcgaaggcgaagccctggcgacgctggtggtcaacaccatccgcggcatcgtcaaggtcgtggccgtcaaggcaccgggcttcggcgaccgtcgcaaggcgatgctggaagacatggccgtgctgaccggcggcaccgtgatctccgaggaagtgggtctggccctggaaaaggccacgatcaaggatctcggccgcgcgaagaaggtgcaggtctccaaggagaacaccaccatcatcgacggcgccggcgattcggccacgatcgaagcccgcgtgggccagatcaagacccagatcgaagacacctcgtccgattacgaccgtgagaagctgcaggaacgcgtggccaagctggccggtggcgttgcagtgatcaaggtcggcgcgtcgaccgaaatcgaaatgaaggaaaagaaggcccgcgtcgaagacgccctgcacgccacccgtgcagccgtcgaagaaggcgtggtcccgggcggcggtgtggccctggtgcgtgcgctggtggccgtcggtaacctgaccggtgccaacgaagaccagacccacggcatccagatcgccctgcgcgccatggaagccccgctgcgcgaaatcgtggccaatgccggcgaagagccgtccgtgatcctgaacaaggtcaaggaaggcaccggcaactacggctacaacgcggccaacggcgagttcggcgacatggtcgagttcggcatcctggacccgaccaaggtcacccgttcggcgctgcagaacgcagcctcgatcgccggcctgatgatcaccaccgaagccatggtggccgatgcaccgaagaaggacgagccggcgatgccggccggcggtggcatgggcggcatgggcggcatg

SEQ ID NO: 39156 - DNA, 1755 bp, Xanthomonas campestris
atggccgaaatcaaggaagcacttgtccccgatatcggtgactacagcgatgtcccggtgatcgaagtgctggtgtcggtcggcgatacggtcagcaaggaccagagcctggtcacgctggaatcggacaaggccacgatggaagtcccctcgtcggtggccggcgtggtcaaggagatcaaggtcaaggtcggtgacagcctgtcgcagggcgcgctggtcgcgctgatcgaagtagccgatgccgatgccggtgccgagacggctgcggcgccagcgcctgccgctgcgcccgccaaggccgcacctgctgccgctcctgcgccggctgccaaggccgcgcctgccgcagcgtccgacggcggtcaggtcgaggcccgtgtgccggacatcggcgactacagcggcgtgccggtgatcgaagtgctggtggcggtgggcgacaccgtcgccaaggaccagagcctggtcacgctggaatcggacaaggccacgatggaagtgccctcgtctgtggccggcgtgatcaaggagctcaaggtcaaggtcggcgacagcctgtcgcagggcgatctggtggcgatcatcgctgccagcgatggcggcgccggtgcggcgcagtccccggccaagcccaccaccgacaccgctgaaaccgccggcaaggtcgagccggtggccgtcccggccgagccggacaagctggcccagcgcgagatcgcgcaggtgcagtcggcacggtccaccgcggcatcgcagccggcccaggcagcgcccggcaccccgagcagcccgccggtgaccttcgatgccgacagcgtgctgccgtccaaggtgccgtatgccagcccggtggtgcgcgtgttcgcgcgcgagctcggcgtggatctgaaccagatcaagggcagcgagaagggcggccggatcacccgtgaagacgtgcagcgcttcgtcaaggccgcactcagcggcggcgcgccggccgcagccggtgccgcaccggccggtggtggcaacggcctgaacctgctggcctggccgaaggtggacttcagcaagttcggcgaaaccgaaacccagccgctgtcgcgcatcaagaagatttccggtgcgaacctggcgcgcaactgggccatgatcccgcacgtcacccagttcgaatcggccgacatcaccgacctggaagccctgcgcgtggcgctgaacaaggaaaacgagaaggccggcatcaagctgaccatgctcgctttcctcatcaaggccagtgccgcggcgctgaagaagttccccgagttcaacgcctcgctcgatgcggccggcgaaaacctcacgctgaagaagtacatcaacatcggctttgccgctgacaccccgaacggcctggtcgtgccggtgatccgcgacgtcgacaagaagggcgtgctgcagatcgcgcaggaaagtggcgagctggccaagaaggcacgcgacggcaagctgggcccggccgacatgagcggcggctgcttctcgatcagctcgctcggtggcattggcggcaccgcgttcacgccgatcatcaatgcaccggaagtggcgatcctgggcgtgtccaagtcggcgatgcagccggtctggaacggcaaggacttcgcaccgaagctgatgctgccattgtcgttgagctacgaccaccgcgtcatcgacggcgcgctggccgcgcgcttcaccacctatctcagccaggtgctcgccgacatgcgacgcgtcctgctg

SEQ ID NO: 39157 - DNA, 762 bp, Xanthomonas campestris
ttgcaggaccgcgtggtgatcatcaccggtggtgcgcaagggattggccgcggcattgcgcaggctgtgctcggtgccggcggcagcgtggtgattggcgatctggatgccgatgcgggcaaggcctgcctgcaggactgggcactgccgcgccgcagcgccttcgtgcgtgccgacgctgcgcgcgaaccacatgccgcgcgcctggtcgccaccgcgctcaaacgtttcgggcggctcgacggcctggtcaataacgccggcgttccggacccgcatatcgctgcgctggcacaactggaatggcaggaatggcagcgccggctctcgagcctgcatggcgcgttcctgtgcagcaagcatgccctgcccgcgctcgcaaaggccgccgatggcggcgccatcgtcaacatcgcctccacgcgcgcctggcaatccgaaccccatagtgaagcgtatgccgccgccaaaggtggcctggtggcgatgacgcatgcattggcgctgagcgaaggcccgcaggtgcgcgtcaacagcatcagccctggctggatcagtaccgatgcctggcgtgcaccggcgcgccgacgcgcacccaagctctcgcggcgcgatcatgcacagcatccggttggccgcgtcggcacgccggaggacatcgcgcaattggctgtgtatctgctggcgccgcagctgtcgggctttgtgaccgggcaggacttcattgtcgacggcggcatgtcgcgcaagatgcagtacgtc

SEQ ID NO: 39158 - DNA, 666 bp, Xanthomonas campestris
atgaccgccgccacgccgctgccgttctggccgcaggcggtgatcttcgacatggatggcctgatgctcgacagcgagcgcgccatcaccgcctgcctgtcacaggccgccgacgagcatgggctgcagatcgagcccgcattctggttgcgcatggtcggcaccggtgatgccgcgtgccggcgcctgcttggcgagcgcatcggcaccacggccatggagcacgtgctggcgcgctgccaaggcttgtacgacgccgcggtcagcgcgggtattgcgcatcggcccggcatcatcgcgttgctcgagttcctcattgcgcacggcatgccgcgtgcggtggccacctccacccagcgcccgctcgcgttgcgcaagctggctgcctccgatctgttgtggcgtttcgatgcggtgtgcaccgccagcgatgtcgcgcacccaaagccggcgccggatatctacctgctggccgcgcgcacgctgggcgtggaccctgcgcagtgcctggtgctggaagattcacccaccggggtgcgtgctgcactcgctgcgggcatgaccccgatccaggtgccggacctgctcgcacccgatgccgaggtgcgtgcgctcggccatcgcatcgttgcctcgttgatggacgcgcaaaccttgctggaagcg

SEQ ID NO: 39159 - DNA, 1363 bp, Xanthomonas campestris
ttgcaacaggccgtccccgcgctgcggttgaagaccggaccggccgacctggagcactacggccgtgactggacgcgccgctggacgcccaatccgctggccatcgcgctgccggggtcggtggaagaagtgcaggcggtggtgcgctgggccaacacgcatgcggtggcggtggtgccctcgggcgggcgtaccggtttgtctggtggcgcggtcgcggccaatggcgagctggtgctgagcctggagcggttgaacaagccgctggccttcgatgcggtggatcgcacgctcaccgtgcaggccggcatgccgctggaagcggtgcacaacgccgcgcgcgagcacggcctggtgtacccggtggatttcgcagcgcgtggttcgtgctcgatcggcggcaacatcgccaccaatgccggcggcatccgcgtgatccgctacggcaacaccccgcgaatgggtggccgggctcagcgtggtcaccggcaccggcgagctgctgcatctcaacaatgcgttggtgaaaaattccagcggctacgacttccggcatctgatgatcggctcggaaggcacgctgggtatcgtggtcgaagcaaccctgcggctgaccgacctgccgccgccgagcaacgtgatgctgctggcgctgccgtcgttcgatgtgttgatgcaggtgttcgcggcgtttcgcgcacagctgcggctggaagcgttcgaattcttcaccgaccgcgcgctggagcacgtgctggcgcacggcgcgcaggcgccgtttgcgcaggtgcacccgtactacgtggtgaccgaattcgctgccggcgatgaggcgcaggaagcggcggcgatggcggcgttcgaggcctgcatggagcagggctgggtgagcgacggggtgatcagccagagcgatgcgcaggcggcgcagctgtggcgcctgcgcgaaggcatcaccgaggcgctggcgcgttacaccccttacaagaacgatgtgtcggtgcggatctcggcgatgccggcgttcctggccgagacgcaggcactgctgcacgatgcttacccgcatttcgatgtggtgtggtttggccatatcggcgacggcaacctgcatatcaacgtgctcaagcccgatgccaccagccaggcagatttcatcactgcctgcgagcaggtcaccaagttgctggcgcagagcctgcagcgtttcgacggcagcatctcggccgagcacggcattggcctggtcaagaaaccgtacctgtggagtacgcgctcggcggcagaaatcgcgctgatgcgcggcatcaaacaggtgctcgacccccatcttttgctgaatccaggcaagctgttcgacatg

SEQ ID NO: 39160 - DNA, 705 bp, Xanthomonas campestris
tctcccgtgaaagttctgatccacggtgcctccgggcgcatgggcaaggcattgctgcgattggccgccgaagacgacgccttgcacgtcgtcggtgcggtggtggggcggtcgccctcccagcgcgtggtggacggcgtgccgtacttcgccgccaacgaactgggcggtgcgccggcgttcgatgtggcgatcgacttcagcctgccgcagggctttgcgccgatcctggcgttgtgcgtgcagcgcggcaaaccgctggtctcgggcaccaccgggctggacgaggcgcagcgggccggcttgctgcaggcagcgggccagattccgctggtgtgggcgtccaatttcagcctgggcgtggcggtgctcaccgaactggtggagcgcgccgccggcagcctgccgggctgggactgcgacatcatcgaagcccatcacgtgcacaagcaggacgccccctcgggcaccgcgctgacgctgggtgaggctgccactggcagcggggcacagccgcggtttgccagcgtgcgtgccggtgacatcgtcggcgagcacagcgtgcagttcaccgggctgggtgaacgcgtcgagctgatccaccgcgccaccaaccgcgacatcttcgcgcgcggtgcgttgcatgcggccaagcgcctgctcggcaagccgccgggcagctaccgggtgcgcgatctggtgctg

SEQ ID NO: 39161 - DNA, 1150 bp, Xanthomonas campestris
atcggagtcccaggcagccagagcgagaccccacgtgacccaacccgcaatccttgtcctcgaagacggcaccgtgttcgagggcgaatccgtaggcgccaacgggctatccgtcggcgaagtggtgttcaacaccgccatgaccggttaccaggaagtcctgaccgatccgtcctacgcccgccagatggtcacgctgacctatccgcatatcggcaacaccggtttcaacgatcaggacgacgaggccaagcaggtgtgggccgccggcctgatcgtgcgcgatgtgccgcgccgccccagcagctggcgcaaccaggtggcgctgccggattggttgcagacccgcggtgtggtggccatctccggcatcgacacccgcaagctgacccgtctgctgcgtgagaaaggtgcgcagaacggtgcactgatggccggcgagatcgatgtcgaaaaggcattggaagccgcgcgcaagttccccggcctgaagggcatggacctggccaaggtggtctccaccgaaaccacctatcagtggcaggaaggtcagctggacctaaacgcgaacgccttcttgcaggccgagctgaagttcaaggtcgtggcctacgactacggcgtcaagatcaacatcctgcgcatgctggccgagcgcggttgcgaggtcaccgtggtaccggcgcagacgccggtggccgaggtgctggcgctgcagcccgatggcgtgttcctgtccaatggccccggcgacccggagccgtgcgattacgcgatcaccgcgatccaggaattgatcgccaagaaggtgcccaccttcggcatctgcctgggccaccagttgctggcgctcgccgccggcgccaagacggtcaagatggccaccggccaccacggcgcgaatcaccccgtgcaggatctggagggtggccgggtgatgatcacctcgcagaaccatggctttgcggtggacgaaaccacgctaccggccaacgtgcgggtgacccatcgctcgctgttcgatggcaccaaccagggcatcgccctgaccgacgcgccggcgttctcgttccagggccacccggaagcctcgccgggcccgcgcgatgtcgggccgttgttcgatcggtttgtcgcatcgatggccgag

SEQ ID NO: 39162 - DNA, 3237 bp, Xanthomonas campestris
atgccaaagcgcaccgaccttaaaaccatcctgatcatcggcgctggcccgatcgtcatcggccaggcctgcgagttcgactactccggcgcgcaggcgtgcaaggcgctgcgcgacgagggttatcgcgtggtgctggtcaacagcaacccggccacgatcatgaccgacccgaacatggccgacgccgtgtacatcgagccgatcaactggcagacggtcgagaagatcatcgccaaggaaaagcccgatgccctgctgccgacaatgggcggccagaccgcgctgaactgcgcgctggacctggccgaccacggcgtgctggagaagtacaacgtcgagctgatcggtgccaagcgcgaagcgatccgcatggccgaagaccgcgagctgttccgcgtggcgatgggcgagatcggcctggattgcccccgggccgaagtggcgcacacgctggaagaagcgctggatatccagacccgcgtcggctacccgaccatcatccgccccagcttcacgctgggtggcagcggcggcggcattgcgtacaaccgcgaagagctgatcgacatcgtcggccgcggcctggaactgtcgccgaccaccgaggtgctggtggaagaatcggtgctgggctggaaggaattcgagatggaagttgtgcgcgatactgcggacaactgcatcatcgtctgcgcaatcgaaaacctcgacccgatgggcgtgcacaccggcgactcgatcaccgtggcgccggcgcagacgctcaccgacaaggaatatcagcgcctgcgcgatgcctcgatcgcggtgctgcgcaagatcggcgtggataccggcggctccaacgtgcagttcggcatcagcccgaccaccggccgggtggtggtgatcgaaatgaacccgcgcgtgtcgcgttcgtcggcgctggcgtccaaggccaccggcttcccgatcgccaaggtcgccgccaagctggcggtgggctacacgctggacgaattgaagaacgagatcaccggtggcctgaccccggcctcgttcgaaccgtcgatcgactacgtggtcaccaagattccgcgctttgcctttgaaaaattcccgcaggccgatgcacgcctgaccacgcagatgaagtcggtcggcgaagtcatggcgatgggccgcaccttccaggaatcgctgcagaaagcgctgcgtggcctggaaaccggcaagatcggcctggacccgaccggcctggatctgggcagcgaagacgacatggccgcgctcaagcgcgagctcaaggctccgggcccggagcgtctgttctacgtgggcgatgcgttccgcgccggcatgagcgtggccgacgtgtatgcgctgtcgttcatcgacccctggttcctggaccagatcgaagagttgatcagcctcgagcagcagctggccgacgatggcatggcggcactggatgccccacgcctgcgcctgctcaagcgcgccggtttctccgacgcacgcctgggcgagctcatcggcaccaacgaagaagccgtgcgcacgctgcgccgcgcgctcaaggtgcgcccggtgtacaagcgcgttgactcgtgcgcggctgaattcgccaccagcactgcgtacctgtattcgacctacgaggacgagtgcgaagcgctgccgagcaaccgcgacaagatcatgatcctgggcggtggccccaaccgcatcgggcagggcatcgagttcgactactgctgcgtgcacgcggcactggcgctgcgcgatgacggcttcgagaccatcatggtcaactgcaacccggaaaccgtctccaccgactacgacacctccgaccgcctgtacttcgagccgctgacgctggaagacgtgctggagatcgtcgagctggagcagcccaagggcgtgatcgtgcagtacggcggccagaccccgctgaagctggcgcgtgcgctggaagccaacggcgtgccggtgatcggcacctcgccggactcgatcgatctggccgaagaccgcgagcgcttccagcagctggtcgacaagctgggcctgaagcagccgccgaaccgcattgcccgcaatgccgacgaggccttggtgctggcgcgcgaaatcggctacccgttggtggtgcgcccgagctatgtgctgggcggccgcgcgatggaaattgtgtacggcgaatccgacctggcgcgctatgtgcgcgatgcggtgaaggtctccaacgattcgcccgtgttgctggaccgcttcctcgacaacgcggtggaagtggacgtggacatcattgccgacaaggacggcaacgtgctgattggcggggtgatggagcatatcgaagaagccggcgtgcattcgggcgattcgtcctgctcgctgccgccgtattcgctgtcggccgaaacccaggccgagctgcgtcgccaggtggtgatgctggccgaaggcttgaatgtggtcggcctgatgaacacccagttcgcggtgcaggtcaacgacgccggcgatgacatcgtgtacctgctggaagtgaacccgcgtgcctcgcgcaccgtgccgttcgtgtccaaggccaccggcatgccgctggccaagatcgctgcacgctgcatggccggcaagacgctggccgagcagggcgccaccaaggaaatcgtgccggactactactcggtgaaggaggcgatcttcccgttcgccaagttccagggcgtggacccgatcctcgggccggagatgcgctccaccggtgaggtgatgggcgtgggccgcagcttcggcgccgcgtttgcgcgcgcgcaggaagccggcggcatcaaggcgccgccgctgggcaaggccttcgtgtcggtgcgcgatccggacaagcagcgcgtgttgccggtggcccaggccctggtggagcgcggcttcaccctggtggccacgcgtggcaccggtgcgtggttgcagcagcacggcctgagctgcgagatcgtcaacaaggtggccgaagggcggccgcatatcgtcgactcgatcaagaacggcgagatcgtctacatcgtcaacaccaccgaagggcgcgcggcgatctccgattcgttctcgatccgccgtgaagcgctgcagcatcgcgtgacctattcgaccaccgtcgccggcgccaaggcgctggtgcattcactggaattccgcggcaccggccccgtctggtcgctgcaggaactgcacaaggagctggaa

SEQ ID NO: 39163 - DNA, 2031 bp, Xanthomonas campestris
atggccacctggttgatcttggtcggcgagctgctggtgtcgttgggtttgatggtggcaatcctgctgcgaccgcaggtgtcgcatacgcgccggctgatcgggatgctgctcgactacacctgcaccggcgcgatcatggccatccagggcgagccagcctcgccgctgtatgcggtgtgcatgtgggtgaccatcggcaacggtctgcgctatggcagcaactatctgcgtgcggcgaccgcaatgggcagcctgtgttttctcggcgccattctgatttctccttattggaaagccaatccctatctgagttgggggttgttgctgggcctgattgcggtgccgctgtacttcgactcgctgttacgtgcgatgacccgtgcagtgcgcgaagcccggcacgccaaccaggccaagagccgcttcctggccaatatgagccatgagttccgcacgccgctcaacgggctgtcgggcatgaccgaagtgctggcgaccacgcgcttggacgccgagcagaaggagtgcctcaacaccatccaggcatcggcgcgcagcctgctgtcgctggtggaagaggtgctggatatttcggcgatcgaggccggcaagatccgtatcgatcgccgcgacttctcgctgcgcgagatgatcggctcggtcaacttgatcctgcagccgcaggccagggggcgccggctggagtacggcacgcaggtggccgacgacgtgcccgacctgctcaagggcgacaccgctcatctgcgtcaggtactgctcaatctggtcggcaatgcggtcaagttcaccgagcacgggcatgtgttgctccgggtcacgcgcgtgtccgggagtgccgaggacgccgtccggttgcgcttcgatgtggaagacaccggcatcggcgtgccgatggacatgcgcccgcggctgttcgaggcctttgagcaggccgatgtcgggttgtcgcgccgttacgagggcaccggcctgggcaccaccatcgccaagggccttgtagaggcaatgggaggcagtatcgggttcaaggaaaatcagccaagcggcagcgtgttctggttcgagctgccgatggcgatcggcgagccgctgaaatcttcgaccgtacgggtgccgaccggggcgttggtggatgcgcccgaggagttggaatcttccaacatcatcgctttttccaacccattcctgcgtcatcgcgcacgtgtgcgcagtatgcgcatgctcgtggccgacgaccacgaagccaaccgcatggtgctgcagcggttgctagagaaggctgggcataaggtgctgtgcgtcaacggcgccgagcaggtgctcgatgcgatggccgaagaggattacgacgcggtgattgtggatctgcacatgccgggcatgaacggcctggacatgctcaagcaattgcgggtgatgcaggccagtggcatgcgctacacgccagtggtggtgctcagcgccgacgtgacgcccgaagcgattcgcgcctgcgaacaggccggcgcgcgtgcgtttctggccaagcctgtcgtggcggccaagttgctcgacaccctggccgatctggcagtgagcacccggcagttggcgacgccggcaaccacggtgcaggtggcgacaagtttcgaaggcgtgctcgattccagcgtgctggacgagctggccgcgctgggcatgggcgaggaattcgaacgccagttcgtgcgccagtgtctggacgatgcgcagaactgcgtgggcgatatcgaacgcgatggcacgtgctcggactgggaacaactgcgcgagagtgcgcatgccttacgcggcgtggccagcaaccttggtctggcgcaggttgccagcagcggtggcgagctgatgcgcatggccgattggcagctgcaggcagaatggcggctgcggctgtccacactgcgcgagcagttgaaggcgggaaaggatgcactcgacgcacgcgtgcagggcgtcaaggacggcgagtgctccccccgtagcaacgaa

SEQ ID NO: 39164 - DNA, 1668 bp, Xanthomonas campestris
cgtccttggttgcaaagttatccggccggagtggccgcggagatcgatctggagcagttccgcaccgtggcggaggttttcgccacatcggtggcgcgcttcgctgatcgccccgcgtatcacagcttcggcaagaccattacctaccgcgaagcagatcagctggtcgaccagttcgcggcctatctgctcggcgagttgcagctgaaaaaaggcgaccgcgtcgccttgatgatgcccaactgcctgcaatacccgattgccaccttcggcatcctgcgcgccggtctgaccgtggtgaacgtcaacccgctctacaccccgcgcgagctcaagcaccagttgatcgactcgggcgccagcgtgctggtggtcatcgacaacttcggcaccaccgtgcagcaggtgatcgccgacacgcaggtcaagcaggtcatcaccaccggcctgggcgacatgctcgggttcccgaaggctgcactggtcaactttgtcgtcaagtacgtcaagaagctggtgccggagtaccgcatcaacggcgcgatccgcttccgcgacgcgctggcactgggccgcaagcaccgcgtcccgaccctgcagatcgagccggacgacatcgcctttttgcagtacaccggcggcaccaccggcgtagccaagggcgcgatgctgacccaccgcaacctggtcgccaacatgcagcaggcgcaccagtggctggccggtaccggcaagctggaagaaggccacgaggtggtgatcaccgcgttgccgctgtatcacatcttcgcgttgacggcgaacggcctggtcttcatgaagatcggcggctgcaatcacctgatcagcaacccgcgcgacatgccgggcttcatcaaggaactcaagaagacccgcttcaccgcgtttaccggcgtcaatacgctgttcaatggcttgctcaatacgcccggcttcgatcagatcgacttttcgtcgttgaagatgaccctcggcggcggcatggcagtccagcgctcggtcgccgaacgctggaagcaggtgaccggcctgactctggtcgaggcttacggcctgaccgagacctcgcccgccgcctgcatcaacccgatggatctggtcgactacaacggctcgatcggcctgccgattccgtccaccgatgcctgcatcaaggacgacgatggcaaggtgctggcgctgggcgagatcggcgagctgtgcatcaagggcccgcaggtgatgaagggctattggaagaaggccgacgagaccgccaaggtcatggacgccgaaggctggctgcacaccggcgacatcgcacgtatggacgaacgtggcttcgtctatatcgtcgaccgcaagaaggacatgatcctggtgtccggcttcaacgtgtaccccaacgagatcgaagacgtcatcgcgacgatgccgggcgtgctcgaagtggccgcagtcggcgtgccggatgaaaagtccggcgaaatcgtcaaggtggtgatcgtcaagaaagaccaggccctgaccgccgaggatgtaaaggcgcactgccgcaccaacctgaccggctacaagcagccgcgcgtgatcgagttccgcaaggaattgccgaaaaccaacgtcggcaagatcctgcgtcgcgaattgcgggatgcggccaaggca

SEQ ID NO: 39165 - DNA, 2742 bp, Xanthomonas campestris
gattccttttccacccgcacctcgctagaggtcaacggccagcgctacgattactacagcctgcccaaactgggcgagcgcttcgatgtcgcccgcctgccctactcgatgaagatcctgctggagaacctgctccggcatgaagacggtggcgtcaccgtcggcaaggaccacatcgaagcggtcgccaagtgggacccggccgccgaacccgatatcgaaatcgccttcatgccggcgcgcgtggtgctgcaggacttcaccggcgtgccctgcgtggtcgacctggccgcgatgcgcgatgcggtggtcaagctcggtggcaatgccgaccagatcaatccgcagattccctccgaactggtcatcgaccactcggtgcaggtggacgtgttcggcaagcctgaagcgctggacctcaacggcaagatcgaattccagcgtaaccaggagcgctacggcttcctgcgctggggccagaaggccttcgacaacttcaaggtggtgccgcccaacactggcatcgtccaccaggtgaacctggaaaacctggcacgcgtggtgatgagcgcggacaaggacggcacccagatcgcctatccggacaccgtgttcggcaccgacagccataccaccatgatcaacggtatcggcgtgctgggctggggcgtgggcggcatcgaagcggaagcggcgatgctcggccagccctcttccatgctgattccgcaggtagtgggcttcaagctcaccggcaagctgcccgaaggcgccaccgccaccgacctggtactcaccgtcacccagatgctgcgcaagcacggggtggtgggcaagttcgtggagttctacggtgaaggcctgcagcacctgccgctggccgaccgcgctaccatcggcaacatggcgccggaatacggtgccacctgcggcatcttcccggtcgacaatgaatcgctgacctacctgcgcctgtccggccgcagcgaggaacagattgcactggtagagacctacgccaaggcacagggcctgtggcatgacgccgacaccccgcatgcgcagtacagcgccacgctggagctggacatgggcgacgtcaaaccgtcgctggccggccccaagcgcccgcaggaccgcgtgctgctggaagacatgcagtccaactaccgcgaaagcctcaagccgttcgccgaggcgcgcagcaagcgtctggccgataccaagcaggaagaccggctcaagaacgaaggcggcggcggtaccgcagtgggcgccaaggcctcgcaggccgaaagcgctggcgacagcggtgcgggctggcagctgcgcgatggctcggtggtgatcgctgcgattacctcgtgcaccaacacctccaacccggcagtgatgctgggcgccggtctgctcgcccgcaatgccgcagccaagggcttgaaggcgcagccctggatcaagacctcgcttgggccgggctcgcgcgtggtcaccgactatctgaccaaggccggcgtgctggccgacctggaaaaactcggcttctacgtggtgggctacggctgcacgacctgcatcggcaactccggcccgctgccggaagacgtctcggcggcaatagccaaggatgacctggtggtgacttcggtgttgtcgggcaaccgcaacttcgaaggccgcgtgcatcccgaggtcaagatgaactatctcgcctcgccgccgctggtggtggcgtatgcgatcgccggcaccaccgacatcgacctcacccgcgacccgctcggcaccggcagcgacggtcagcctgtgtacttgcgcgacatctggccgagcaacaaggaaatcggcgacaccatcgccgccaccgtcggcccggaaatgttcaagcagaactacgccgatgtgttcaagggcgatacgcgctggaacaccatcgcctcgccggatggcgcgctgtacgagtgggatgccgcatccacctacatcaagaacccgccctatttcgaaggcatgacgatgcaggtgggccacgtcgacgacgtgcatggcgcgcgcatcatgggattgttcggcgactcgatcaccaccgaccacatctccccggcgggcaacatcaagaaggattcgcccgcgggccggttcctgcaggagcgcggcgtacagccggccgacttcaacagttacggcagccggcgcggcaacgatgatgtgatggtgcgcggcaccttcgccaatatccgcatcaagaacctgatgttcggtggcgaggaaggcggcaacacgctgtacttcggaaaggacggcgccgcgcccgagaagctggccatctacgacgcggcaatgaagtacaaggccgatggcgtgccgctggtggtgctggccggcaaggaatacggcaccggctcctcgcgtgactgggccgcaaagggcaccaacctgctgggcgtcaaggccgtggtcgccgaaagcttcgagcgcatccaccgctccaacctggtcggcatgggcgtgctgccactgcagttcctggaaggcgaaaatgcgcagacactgggcctggatggctcggaagtgctggacatcaccggcttgcaggacggtgccagccgtcgcgccaccatcgatgcgaaaaaatccgatggcagcgtcaagcagttccaggtcaaggtgctgctgctgacgccgaaggaagtggagtacttcaagcacggcggcctgctgcagtacgtgctgcgccaactg

SEQ ID NO: 39166 - DNA, 2137 bp, Xanthomonas campestris
gcaaagaccctgtacgacaagttgtgggagatgcacgaggtcacgcgccgtgacgatggctcgtcgctgatctacatcgaccgccacatcctgcacgaagtgacctcgccgcaagccttcgaaggcctgcgtcttgccgggcgcaagccgtggcgcatcgatgccaacatcgccacgcccgaccacaacgtgcccaccacccgtgccgagcgccagggcgggctggagtccatctccgatgaagtctcgcgtctgcaggtgcagacattggacgagaactgcgacgacttcggcatccttgagttcaagatgaacgacacgcgccagggcatcgtgcacgtggtcggccccgagcagggcgccacgctgccgggcatgacggtggtctgcggcgattcccacacctccacgcatggcgccttcggtgcgttggcgcatggcatcggtacttccgaggtcgagcatgtgctggccacgcagtgcctgatcgccaagaagatgaagaacatgcaggtgcgcgtggaaggcacgctgccgttcggggtcaccgccaaggacatcgtgctggcagtgatcggcaagatcggcacggccggtggtaacgggcatgcgctggaatttgccggcagtgcgatccgcgcgctgtcgatggaaggccgcatgaccatctgcaacatgtccatcgaagccggtgcgcgcgtgggcatggtggcggtggacgaaaagaccatcgcctacgtcaagggtcgcccgttcgcgccgaagggcgcggattgggacgcggccgtggcgctgtggcgcacgctggtgtccgacgccgatgcgtccttcgacaccgtggtggaactgcgtgccgaagacatcaagccgcaggtcagctggggtacctcaccggagatggtggtggcaatcgaccagcaggtgcccgacccggcggccgagcaggacccgaccaaacgcgattcgatccagcgcgcactcaaatacatgggcttgcgggcaaaccagccgatcaccgagatccatctggaccgcgtgttcatcggctcatgcaccaactcgcgcatcgaagacctgcgcgctgccgcggcggttgccaaaggccgcaaggtggcctccaccatcaagcaggccctggtggtgccgggctcgggactggttaaggcacaggccgaggccgaagggctggacaagatttttctggatgccggtttcgagtggcgcgagcccgggtgctcgatgtgtctggcgatgaacccggacaagttgggcagcggtgaacattgcgcgtccacgtccaatcgcaactttgaagggcgccagggcgccggtgggcgcacgcatctggtcagcccggcgatggccgcggctgcggcggtgagcgggcactttgtcgatgtgcgtgagttgcagggaatcgagactcgggaatagggaatcgccacctcccgcctccaccctgccacaccattctctactcccaattcccggtattcccatgaccccttttacccaacacaccggactggtcgcgccgctggatcgtgccaacgtcgataccgaccagatcattcccaagcaattcctcaagtcgatcaagcgcaccggtttcggcccaaatctgtttgatgagtggcgctatttggacatcggcgagccgggccgcgacaacagcacgcgccccctcaaccaggagttcgtgctcaattttccgcgttaccagggcgccagcgtgctgctggcacgcgagaacttcggctgcggttcttcgcgcgaacatgcgccgtgggcactggacgaatacggcttccgcgcagtgattgcgccgagttttgcagacatcttctacaacaacagtttcaagaacggcctgctgccgatcgtgctggcagaggcggaaatggatgccttgttcgagcagtgcctggggaacgaaggctaccaactcaccgtcgatctggccgcgcagcgcgtgcgccggcccgatggtgtggagtacgcgttcgagatcgatgcattccgcaagcactgcctgctcaatgggctcgacgatatcggcctgaccttgcaggacgccgacgcgattggccgcttcgagcaagggcatcgcgcgcaacagccgtggttgttcggcgcg

SEQ ID NO: 39167 - DNA, 1421 bp, Xanthomonas campestris
cgcaacgcccagcgcgtagtaccaatgggttatcggcccgggctgtgacgtgcggccagaatgcctgcaccgggtgcctggctcaggcgccctccaagttccctcggagtggtgtcatgcacatcagcaagcctgccggccccctgccggcgcctgtccccttctaccgccagttgtatttccaggtggtggtggcgatcgttcttggcgccctgctgggccatttcgagccggccttcgccgaaagcctcaagccactcggcgatgccttcatcaagctggtgaagatgatcatcgcgccggtgatcttcctgaccatcgtcaccggcatcgccggcatgacccacctcaagacggtgggccgggtcttcgccaagtcgatgacctacttcctgttcttctccacgctggcgttgatcgtcggcatggtggtggcgcacgcggtgcagccgggcgccggcatgaacatcaacccggccgagctggaccagagcgcggtcaacacctacgtgcagaagtcgcacgagctgagcctggtcggctttttgatggacatcatcccggccacgctgatcagcgcgttcgtcgatggcaacatcctgcaggtgctgttcgtggcggtgctgttcggcatcgcgctggccctggtgggcgagcgtggccgcccggtgctgagcttcctggaagcgctcaccgccccggtgttccgcctggtgcacatgctgatgaaggccgcgccgatcggtgcattcggtgcaatcgctttcaccatcggcaagtacggtgtggaatcgctggtcaatctggcctggctggtgggctcgttttacctgacctcgctgttcttcgtgctggtgatcctgggcatcgtgtgccggttgtgcggcttttcggtgctcaagctgatccgctacctcaaggccgagctgctgctggtgctgggcacctcctcgtcggaatcggcattgccgtcgctgatggagaagatggaaaaggccggctgtgagaagtcggtggtgggcctggtcgtgccgaccggctactcgttcaacctggacggcaccaacatctacatgaccctggcggcgctgttcatcgcccaggccaccaatgtggacctgaccctgggccagcagatcaccttgctggcggtggcgatgctcagctccaagggcgcggccggcgtgaccggcgccggcttcattacgcttgcggccacgctgtcggtggtgccggatgtgccggtggccggcatggcgctgatcctgggtgtggaccgcttcatgagcgagtgccgctcgctgaccaacttcatcggcaatgcagtggccacggtggtggtgtcgcgttgggaaaatgcgctggaccgcgaccagttgagcctggcattggacggccgtgcgccgccgctgcaggcaccg

SEQ ID NO: 39168 - DNA, 972 bp, Xanthomonas campestris
aagaaccaggtggtgtgtttcggcgaagcgctgatcgacatgctggcgctgccgccggccggcccggacgaggcccgcaccttcgcccaatatgcgggtggcgctccggccaacgtggctgttgcggtggcacgcctgggcggcgcggcgcattttgtaggcatgctcgggcgcgacatgtttggcgattttctgctggagagcctgcagcaggccggtgtcgtgaccgatggcatcgtgcgcaccgatgaggccaagacggcgctggcattcgtcgcgctggatgcggccggcgaacgcagtttcagcttctatcgcccgccggcggccgacctgttgttccgtgccgaacatttcgccgccgatggctttgcgcaggcggccgtgttgcacgtgtgctccaacagcatgaccgagccggccatcgcgcggtgcacgctcgacggcatgcgccgcgcgcgtgccgatggcgccatcgtcagcctggatctcaatctgcgcccgatgctgtggccgcaggatgtcgacccggcaccgctgttgtgggaagcgctcgcgcttgccgacgtggtgaaactgtcgcgcgaagagctcgactatctcgccggcacgctcgacagcgatgccagcgcggtgacgcagaagctgtggcaaggccacgcccgttggttgcttgtcaccgatggcggcgggccggtgcattggcagacgcgtgtggattccgggcaggtgcccgcgttccatgtgcaggtgcgcgacagcacggcggccggcgatgccttcgtgggcggcctgttgttccagctggcggcgcgcgcgagcccgcttgagcagctgtgtgccgacccggcggccattgccgaggtgattcgcttcgccgccgccgttggtgcgctggcagtgacacgcaagggcgcgtttgccgcgatgcccagcgttgacgaggtccattctttgatccaggaacaatca

SEQ ID NO: 39169 - DNA, 1362 bp, Xanthomonas campestris
atgcgagttgcgatctttggtaccggctatgttggtcttgtcaccggtacctgtctggcggaagtaggtcatcacgttatctgcgtggatatcgaccaggcgaaagttgatggtctcaatcgtggggtgattcccatctatgaacctggcctggagccgatggtgaaagccaaccacgcctctggccggttgcgcttcactaccgacgcggccgaggcgattgcgcacggcgaaatcaccttcatcgccgtgggcacgccgccggacgaggacggcagcgccgacctgcagtacgtgctggcggttgcgcgcaccgtgggtcgtcatatcgacgggccgtcggtgatcgtcaataagtccacggtgccggtcggtaccgccgacaaggtgcgcgcggccatccaggaagaactggatgcacgcggcgtggaccatgagttcgacgtggtttccaaccctgagttcctcaaggaaggtgacgcggtggccgactgcatgcgcccggaccggatcgtgatcggtgccaagaagccggcagcgattgcacgcatgcgccgtctgtatgcaccgttcaaccgcaaccgcgatcgcatcgtggaaatggatgtgcgttcggccgagctgaccaagtacgcggccaacgcgatgctggcgaccaagattagtttcatgaatgaaatcgccaacattgccgagcgtgtcggtgcggacgtcgagcacgtgcgtaacggtatcggttcggatccgcgcattggctggcacttcatctatcccggcgccggttacggcggctcgtgcttcccgaaggatgtgcaggcgctggccaagaccgcgcagcagtacggcatgcagccgaccctgctcaatgcggtggaaagcgtcaacaacgcgcagaagggtcatttgttcgaactggtgcagcgtcactatgccgatggcaacggcagcatcgccggcaagacctttgcggtgtggggcatggcgttcaagcccaataccgatgacatgcgtgcagcctccagccgtcgcctgatggcgcagttgtgggaagccggtgccaaggtgcgcgcgtacgaccccgaagccacgcacgaagccaagcgcatcttcggcgagcgcgacgacctggcgttctgcgacgacgccttcgccgcactggaaggcgccgacgcgctggtcgtggtcaccgagtggaagcagttccgcagcccggatttcggcaagatcaagcaggctctgaaggacgacgtcgtgttcgacggccgcaacctgtacgacccgcaggagatcgaagccgcaggtctggcgtactacgccatcggacgaggccgttcgctgcatgcatgagcaactctcgccgcg

SEQ ID NO: 39170 - DNA, 1356 bp, Xanthomonas campestris
atgagcgagagtttcaggatcgaacacgacagcatgggcgaattgcaggtgcctgccgatgcgttgtggggtgcgcagacccagcgcgccgtgcagaacttcccgatttccggccagccgatgccgcgcggtttcattcgcgcgctggggttgatcaaggccgcggccgcaggcgtcaacgccgatctcgggctgctgtccaaatcggtggccaaggtggtgcaggaagccgccttgcaggtggcgcagggcacgcacgatgcacatttcccgatcgatgtgtatcagaccggctctggtacgtcgtcgaacatgaatgccaacgaggtgattgccacgttggccacccgcgccggaaaggatgcggtgcaccccaatgaccacgttaatctcgggcagagttccaacgatgtggtgcccaccgcgattcgcgtctcggcattgctggcggtgcaggagcagctgcagccggcgctcaagcacctacgcaagaccatcgacaagcgcgccaagggtctggacaagatcgtcaagaccggccgcacgcatctgatggatgcgatgccgctgacctttggtcaggagttcggcgcgtggtctgcgcagctcagttcagcgcaggagcgcatcgacgacagcctgaagcggctgcgccggttgccgctgggcggcactgcgattggtaccggcatcaacgccgatgcgcgcttcggcggcaaggtggccaaggccttgtccacgttgagcggcgtcaagttcgaaagtgccgagaacaagttcgaaggcctggcggcgcaggatgatgcggtggaattgtcgggccagctcaatgcgctggcggtggccttgatcaagatcgccaatgacctgcgctggatgaatgccgggccgctggcagggctgggcgagatcgaattgccggcgctgcagccaggcagttcgatcatgccgggcaaggtgaatccggtgattcccgaagcgaccgtgatggtgtgcgcgcaggtcatcgggcaccacaccgcgatcacggtggccgggcagaccggtaattttcagttgaatgtggcgttgccgctgatcgccgcgaacctgctggattcgatcaacctgctcagcaacgtctcgcgcctgctcgccgataccgccattgccggattgaaggtgcgccaggagcgcgtgcgcgaggccctggaccgtaacccgatcctggtgaccgcgctcaacccgatcatcggctacgaaaaggccgccgcgattgccaagcgcgcctacaaggagcagcgcccggtgctggatgtggccaaggaagacagcggtctgagcgaggcagagctgcgccgtttgctggatccggcg

SEQ ID NO: 39171 - DNA, 2859 bp, Xanthomonas campestris
caatcatccccacagcagacccgacttaccatcgtggataatctcctaaagcagttcgcgcagtcatcgcagctcgccggcggcaatgccgcctatatcgaggatctgtacgagcagtacctcgtcgcccccgacagtgtcgatccgaagtggaaggcgtatttcgacggcttcaacggtcgcgatgccggtgatgtgccgcactcggcggcaattgcccacattctcagcgcctccaaacaggctgccaatgccggtaccggcgtgggcgccagcgacgagcgcgagcgcaatgtcggtcgtctgatcaccgcctaccgttcgcgtggtcatctcggcgcgcagctcgatccgctgggcctgaccccgccggtcaacccgcccgacctggacctgccgttccacagcctctcgcaggctgatctggacagcgagttcagcaccggtggtgtcggcgggcagccgcggatgaagctgaaggatctgctggcgcgcctgaaggcgacctacgccagcacgatcggcgccgaattcatgcatatccccgaattcgaccagcgccagtggatctacaagcgcctggaagatgccggcggcaagatcgctgccgacgcggccagccgcaagcgcacgctggagcggctcaccgccgccgaaggcctggagcgctacctgcacaccaagtacgtcggccagaagcgcttctcgctggaaggcggcgacgcattgatcccgatgatggacaccatcattcgccagtccggcaatgaccaggtcaaggacatcgtgatcggcatggcccaccgcggccgcctcaacgtgctggtcaatacgctgggcaagaacccgcgcaagctgttcgacgagttcgaaggcaagttcgagcacgcccacgacgaccgcgcgcacaccggcgatgtcaagtatcacatgggcttctcggcggacatcgcggtcggcgacgacaagcaggtccacctggcgctggcgttcaacccctcgcacctggaaatcgtcgacccggtcgtggtcggcagcgtgcggtcgcgtcaggagcgtttcggtgatgcggaccgcaagaccgtgctgccgatcctgatccatggcgacgccgcattcgccggccagggcgtggtgatggagctgttccagatgtcgcaggcgcgcggtttcgcggtcggcggcaccgtgcatatcgtggtgaacaaccagatcggcttcaccaccagcgcacgcgacgatgcccgctccaccctgtactgcaccgacgtggccaagatgatcggcgcgccggtcttccacgtgaacggcgacgacccggacgcggtgatgttcgtgtccaagctggcctatgagttccgccagcagttcaagaaggacgtggtcatcgacctggtctgctaccgccgttggggccataacgaggccgacgagccggccgccacccagccggtgatgtaccagaccatccgcaagcacaagaccacccgcgagctctacgccaccaagctggaaagcgatggcgtgctgagcgccgacgaggccaaggcgctggtggatggctaccgcaacaagctggattcgggcgaatacaccaccgaattggccaagcgcaagccggacgaattcgccatcgactggtccaagtatctggtcggcactgcggccgatccggtcgatacgcgcgtcaagcggaatgagctggaccgtctggccaagctgatcaccaccatcccggccggtgtggaactgcacgcccgcgtggcgaagatctacgaagaccgcgtcaagatggccgccggcaatcaggacggtgactggggctttgccgagaatctggcctacgccaccttgctggccgaaggccacaagctgcgcctggtcggccaggatgcgggccgcggtacgttcttccaccgtcacgcgatcctgcatgaccagaagaccgacagctattacctgccgctgcgccagctggtggaaaacccggaagacgccaccatcatcgattcgctgctgagcgaagaagcagtgatgggtttcgagtacggctactccaccaccgacccgaacgcgctgtgcgtctgggaagcgcagttcggcgacttcgccaatggcgcgcaggtggtgatcgaccagttcatcgctgccggcgaggccaagtggggccgcatcgcgggcctgtcgctgttcctgccgcatggctacgaaggccagggcccggagcacagctccgcacgtcttgagcgtttcctgcagctgtgcgcgctggagaacatgctggtctgcgtgccgacgaccccggcgcagtgcttccacatgatccgtcgccagatgcgcatgaccacccgcaagccgctggtggtgatgaccccgaagtcgttgctgcgccacaagcttgcggtgtcgacgctggaagaactggccgatgggcagttccagcatctgatccccgacgccaaggccgacgcgagcaaggttaagcgcgtggtgctgtgctcgggcaaggtctattacgacctgctcgaagaccagaccaagcgtggccaggacgacgttgccatcctgcgtgtggagcagctgtacccgttcccgcgtgcgcagctggccgcagaactcaagcgcttcggcaatgccgccgacgtggtgtggtgtcaggaagagccgcagaaccagggtgcgtggtatcagattcgccatcacctgaatttctgcctggccagcggtcagagcctgcattacgccggccgtgcccgttcgccctcgcctgctgccggccacatggccgaccacatcgccgaacagcagaagctggtcgccgatgcgctgctcaatccgttcaacgaccaagtcgctgaa

SEQ ID NO: 39172 - DNA, 1212 bp, Xanthomonas campestris
atggccaccgaagtcaaagttccggtactgcccgaatccgtttccgacgccaccatcgccagctggcacaagaaggccggtgaagcggtcaagcgcgacgagaatctggtcgatctggaaaccgacaaggtcgtgttggaagttccttcgccggtcgacggcgtactgaaggaaatcaagttcgaagccggcagcacggtcaccagcaaccagatcctggcgatcatcgaagaaggcgccgtggccgcagctgcaccggccgaagagaagaaggccgatgccacggcggccgccgctgcgcctgctgctgcgccggcaccggctgccgctgccgctgccgcgccggttgcatcgaagtcgtctgctgacagcctgccgccgggtgcgcgtttttccgccatcacccagggcgtggatccgtcgcaggtcgacggccccggccgtcgtggcgcggtgaccaaggaagatatcgtcaacttcgccaaggccggcggcgtgggcaaggcgtctggcgcccgtcctgaagagcgcgtggcgatgacccgcgtgcgcaagacgatcgccaagcgcctgatggagtccaagaactccaccgcgatgctgaccaccttcaacgaggtcaacctcgccaaggtgtcggccgcgcgcaaggaactgcaggacgaattccagaaggcgcacggcatcaagctcggtttcatgagcttcttcgtcaaggccgcggccaacgcactgcagcgcttcccactggtcaacgcctcgatcgacggcgacgacatcatctatcacggctacagcgacatctcgatcgccgtctccaccgagaagggcctggtgacgccggtgctgcgtaacgtcgagcgccagtcatttgccgaagtcgaacagggcatcgccgactacgccgccaaggcgcgcgccggcaagctgggcctggacgacctgcagggtggcaccttcaccatcaccaatggcggcaccttcggctcgctgttgtcgaccccgatcatcaacccgccgcagagcgccatcctgggcatgcacgcgatcaaggaacgtccgatcgccgagaacggccaggtcgtgatcgcgccgatgatgtacctggcgctgtcctacgaccaccgcatcatcgacggcaaggattcggtgcagttcctggtcgacatcaagaatcagctggaaaacccgggccggatgctgtttggcctc

SEQ ID NO: 39173 - DNA, 1438 bp, Xanthomonas campestris
atgagcgaacaattcgacgtcgtcgtcatcggtgccggcccggccggttatcacgctgcgattcgtgcagcgcagctcggcatgaaggtcgcctgcatcgacgcagccatcggcaaggacggcaagcccgccctgggcggcacctgcctgcgcgtgggctgcatcccgtccaaggcgctgctggattcctcgcgccagttctggaacatgggccacctgttcggcgaccacggcatcagcttcaacgacgccaagatggacgtgcccaccatgatcggccgcaaggacaagatcgtgaagcagttcaccggcggcatcgcgatgctgttcaaggccaacaagatcaccccgtactacggcttcggccagttgcagccgggcaacatcgtcaaggtgactcagcacgaaggtggcgagatcgagctgaagggcaccaacgtgatcctggcggccggttcggaatcgatcgaactgccgttcgccaagttcgacggcgacaccatcgtcgataacgtcggcggcctggacttcaccgcggtacccaagcgcatggcagtgatcggtgccggcgtcatcggcctggagctggccagcgtgtggaagcgtctggccgccaaggacactatactcgaagcgctgccagatttcctggccctggccgaagccgaagtggccaagaccgcgctcaaggaattcacaaaccaggctctgtacatcaagctcggcccctaggtcaccaagaccgagatcaccggcagcgtcgaccccaaacaggtggtgctcagatacaccgacgcccgccggcgagcagaccctgaccgtggacaagttgctggtcgccgtgggccggaaggccgcgaccaagaatctgctggccgatggcaccggcgtcaagctgaccgagcgtggccagatcgaggtcgatggccattgccacaccggcgtcgacggcgtgtgggcgatcggcgactgcgtgcgcggcccgatgctggcgcacaagggcttcgaggaaggcattgcggtggccgagctgatcgctggcctgcccgggcacgtcaactttgacaccattccgtgggtcatctacaccgagccggaaattgcctgggtcggcaagaccgagcagcagctcaaggccgaaggcgttgcctacaaggccggcagcttcccgtttgcggcgatcggccgtgcggtggccatgggcgagccggccggcttcgtcaaggtgattgccgatgccgaaaccgaccgcgtgctggggatgcacctggtgggcgtgggtgtctcggagctggtgcacgaaggtgtgctgacaatggagttcagcggctcggcggacgatctggcgcgcatctgccatgcgcacccgaccctctccgaagcaatccacgacgccgccatggcggtgagcaagcgcgccattcacaaggcgaattaa

SEQ ID NO: 39174 - DNA, 1128 bp, Xanthomonas campestris
atgagcaaacgcgattactacgaagttctgggcgtggcccgtggcgccagcgacgaggagctgaagaaggcttatcggcgttgtgccatgaagtaccacccggaccgcaatcctggcgacgctgctgcagaggcaacgttcaaggaatgcaaggaagcctatgaagtgctgtcggacggcaacaagcgccgtgcctacgacgcgcacggccatgcggcgttcgagcacggcatgggcggcggcggtggcgggcctggtggtccggacatgggagatatctttggcgatatcttcggcaatatttttggcggtggcgccgccggtccgcgcgctgcgcgacgtggtgccgacgtcggctacgtgttggaactggatctggaagaagccgtcgccggcatcgagcggcgcatcgagatccccacgctgatcgagtgcgaaccctgccacggcagcggctcggaagacggcaaggtggaagtctgcgcaacctgccatgggcgcggccaggtccgcatccagcgcggcatcttcgccatgcagcagagctgcccgcattgcgacggccgcggcacgctgatccagaacccgtgcaagacctgccatggcgcaggtcgcgtggaagaggacaaggtactgtcgatcaaggtgccggcaggcgtggacaccggcgaccgcatccgtttggcaggcgagggcgaagctggcccggccggtacgccgccgggcgatctgtatgtggaagtgcgcgtgcgcgagcatgcgatcttccagcgcgatggcgacgacctgcattgcgaggtgccgatccgcatttcgcaggccgcgctcggcgacaccgtgcgggtggccacgctgggcggcgaagcggaaatccgcatcccggccgaaacgcagaccggcaagctgttccggctgcgtggcaagggcgtgcgctcggtgcgcagccgcagcgagggcgatctgtactgccgcgtggtggtggaaacgccggtcaacctcacggccgatcagcgcgaattgctcaagcagtttgaggccacgttcaccggtgaggacgcgcgcaagcattcgcccaagtcggcgaccttcatcgatggagtgaagggtttctgggatcggatgacctcc

SEQ ID NO: 39175 - DNA, 1923 bp, Xanthomonas campestris
atgggcaagatcattggtattgacctcggcaccacgaactcgtgcgtggcgatcatggacggcggcaaggcccgcgtcatcgaaaattccgagggcgatcgcaccacgccctcgatcgtcgcctacaccaaggacggcgaagtgctggtcggtgcctcggccaagcgccaggcggtgaccaacccgaagaacaccttctacgcggtgaagcgcctgatcggccgcaagttcactgacggcgaagtgcagaaggacatctcccacgtgccgtacggcattctggcgcacgacaacggcgatgcctgggtgcagaccagcgattccaagcgcatggcgccgcaggaaatttccgcacgcgtgctggaaaagatgaagaagaccgccgaggacttcctgggcgaaaaggtcaccgaagcggtgatcacggtgccggcgtacttcaacgacagccagcgccaggccaccaaggacgctggccgcatcgccggtctggacgtcaagcgcatcatcaacgagccgacggctgctgccctggcctatggcctggacaagaacggcggtgaccgcaagattgccgtgtacgacctgggcggcggcaccttcgacgtgtcgatcatcgaaattgccgaggtcgatggcgagaagcagttcgaagtgctggccaccaatggcgacaccttcctgggcggcgaagacttcgacaaccgcgtcatcgagtatctggtcgacgaattcaacaaggatcagggcatcgatctgcgcaaggatccgttggcgctgcagcgcctcaaggacgccgcagagcgcgccaagatcgagctgtcgacctcgcagcagaccgaagtgaacctgccgtacgtcaccgccgatgcctcgggcccgaagcacctcaacatcaagttgacccgtgccaagctcgaagcgctggtggaagacctggtcaagaagtcgatcgagccgtgccgcaccgcgttgaacgacgccggcctgcgcgccagcgacatcaacgaagtgatcctggtcggcggtcagacccgtatgccgaaggtgcagcaggccgttgccgatttcttcggcaaggaaccgcgcaaggacgtcaacccggacgaagccgtggccgtgggcgccgcgatccagggcggcgtgctggctggcgacgtcaaggacgtgctgctgctggacgtgaccccgctgtcgctgggtatcgaaaccatgggcggcgtgttcaccaagatcatcgaaaagaacaccaccatcccgaccaaggcctcgcagaccttctccactgccgaagacaaccagtcggccgtgaccgtgcacgtgctgcagggtgagcgcgagcaggcccgcttcaacaagtcgctggccaagttcgacctctccggcatcgagccggcgccgcgtggcatgccgcaggtggaagtgtccttcgacatcgacgccaacggcatcctgcacgtgtcggccaaggacaagaagaccaacaaggaacagaaggtcgagatcaaggccggttcgggcctgtcggatgaagagatccagcgcatggtcgccgacgcggaagccaaccgcgaagaagacaagaagttccaggagctggtgcagacccgcaaccaggccgatggcttgatccacgccacccgcaccgcgatcaccgagcatggcagcaaggtgggtggcgatgtgatcggcaaggtggaagcggccctggccgacctggaaaccgccatgaagggcgacgacaaggcgcagatcgaagcgcgcagcaagaccctggaagaagccggccagtcgctgtacgccgcggccgccgcggcagagcagggcggcaacgccgatgcggccagcggcaatgcgcaggcctccaaggccgccgatgacgtggtggacgccgagttcaccgaggtcaaggacgataagaag

SEQ ID NO: 39176 - DNA, 1284 bp, Xanthomonas campestris
atgtcttttgaatccttgggcctggcgcccttcctgctgcgcgcattggccgagcagggctatgaaacccccaccgccatccagcagcaggcgatcccgctcgtgctggccggccatgacctgctggctggcgcacagaccggtaccggcaagaccgccgcgttcggcctgccgctgctgcagcacctgggcaccaccccgcagccggtcaacggcccgcgcaagccgcgcgcgctgatcctgacccccacccgcgagctggccacccaggtgcacgacagcctgcgcggctacagcaagtacctgcgcattccgagcgcggtgatctacggcggcgtgggcatgggcaaccagctcgatgcgctgcgtcgtggcgtggacctgctgatcgcctgcccgggccggctgatcgaccatatcgagcgccgcagcgtggacctgtccggcatcgaagtactgatcctggacgaagccgaccgcatgctcgacatgggcttcttgccgtcgatcaagcgcatcctgaccaagctgccgcgccaggaccgccagaccctgctgttctcggccacgttcgaagagaacatcaagcagctggcgctggagttcatgcgcaacccgatgcagatccaggtcaccccgagcaacaccgtggccgagagcatcacccaccgcgtgcacccggtcgatggcgcgcgcaagcgcgacctgctgctgcacctgctggcgcaggacagccgcgagcagaccctggtcttcgcacgcaccaagcacggcagcgacaagctggcgctgttcctggagaagtccggcatcaagaccgcggcgatccacggcaacaagagccagggccagcgtatgcgtgcactgagcgacttcaaggccggccgcgtgaccgtgctggtggccaccgacatcgccgcgcgtggtatcgatatcgaccagttgccgaaggtcatcaactatgacctgccgatggtggccgaggactacgtgcaccgcatcggccggactggccgtaacggttcgaccggcgaggcgatctcgttggtggcacaggacgaagccaagctgctgcgtcagatcgtgcgcatgctgggccgcgacgtggaaatccgcgacgtgccgggctacgagccgcagaccccgatccgctggggcaacagcgccccgggccgtgccgagcagccgggtggcgatcgcgccctgcgcaagagccacgcccgtcgcccgcatggcgatgcaccgcgtcaggcgcacgcccatgccggccccgaagaagccggg

SEQ ID NO: 39177 - DNA, 642 bp, Xanthomonas campestris
ctggagctgttttcgtactggcgctccagcgccgcctatcgcgtacgcatcgggctgcagctgaaggcgctggcctatgtcgcgcacccggtgcatctggtgcgcgatggcggcgagcaacacgccgccgcttacgcgcaactcaacccgcaggagctggtgccgacgctgcggcacgggcaggtggtgatcccgcagtccctggccatcctcgaatacctggacgaggcatttgcggacagcgcgccgctgttgccgaccggccccgccgcgcgtgcgcgggtgcgggcgctggcacaggtgatcgcttgcgatgtgcacccgctcaacaacctgcgcgttacccaattcctggagcacacctgggacgtctcgccagcgcagcgccatcactggactgcgcactggatgcagcaagggttggcagcgctggaaacccatttggctggcgacgcacaaaccgggcagttctgccacggcgacacgccgggcctggccgattgcgagctggtgccgcagctctacaacgcgcgccggttcgccgtggagttggcgccgtatccgacgctgcagcggatcgaacaggcctgcctggcactgccggcgttcgatgcggcacggccggaaacgcagcctgacgcg

SEQ ID NO: 39178 - DNA, 1164 bp, Xanthomonas campestris
gcaaacagccacgatggcgagcgcgcactgtcgctcgcaacgctggcgatccatggtggacagtcgccggaccccagcaccggggcggtgatgccgccgatctacgcgacgtccacctatgcgcagtccagccccggcgagcatcagggttttgagtactcgcggacccacaaccccacgcgttttgcctacgagcgctgtgttgccgtgctggaaggcggcacccgcgggtttgccttcgcctccggcatggccgcgacctccacggtgatggaattgctggacgccggcagccacgtggtggcgaccgatgacctgtacggcggctcgttccgcctgttcgagcgtgtgcgtcgccgcaccgccggcctggacttcagtttcgtcgacctcaccgacccggccgcgttcgaggccgcgatccgcccgaccaccaagatggtctggatcgaaaccccgaccaacccgatgctcaagctggtcgacatcgccgccattgcggcgatcgcgcgcaagcacggcctgctggtggtggtggacaacaccttcgcctcgccgatgctgcagcgcccgctggagctgggcgccgacctggtggtgcattcggccaccaagtacctcaacggccactcggacatggtgggcggcatcgccgtggtcggcgaaaacgccgaactcgccgaacagatggccttcctgcagaactcgatcggcggcgtacaaggcccgttcgacagcttcctggccctgcgcgggctcaagaccctgccgctgcgcatgcgcgcgcactgcgaaaacgccctggcgctggcgcagtggctggagacccaccaggcgatcgaaaaagtgatctaccccggcttggcctcgcacccgcagcacgcactcgccaagcagcagatgtccggcttcggcggcatcgtctcgatcgtcctcaagggcggcttcgaggcagccaagcgtttctgcgaaaagaccgaactgttcacccttgccgaatcgttgggtggtgtggaaagtttggtgaaccatcccgccgtcatgacccatgcctcgatccctgtggcccgccgcgaaaagcttggcatcagcgatgcgctggtgcggctgagtgtgggggttgaggatgtgggggatttgcggggggatttggagcgtgcgctt

SEQ ID NO: 39179 - DNA, 1041 bp, Xanthomonas campestris
atgtgtgaaatgaaaactgcgttgattaccggaatctccggccaggatggcgcctacctcgcccagttgttgttggacaaaggttaccgcgtgttcggcacgtatcgccgtacgagttcggtcaatttctggcggatcgaagagcttggaatcgcagctcacccgaatcttaatttgatcgaatacgatctgaccgatcttggctcgagcatccgtatgcttgagagcaccggcgcgacagaggtctacaatctggcagctcagagttttgtcggtgtgtcttttgatcagccgaccacaacggcacaaatcactggtataggtccggtccacctgctggaggcaattcgccaggtcaaccgagatatccgcttttaccaggcttcgacgtctgagatgttcggcaaggtgcaggcggtccctcagatcgaaagcacgccgttctatccacgcagcccctacggggttgctaagctttacgcgcactggatgacggtgaactaccgtgagagttacgacatcttcggatgcagcggaattctgttcaatcacgaaagtccattgcgtgggcgtgaattcgtgacgcgcaagatcaccgactcggtggccaagatcaagctaggccagctggactgcatggaattgggcaacctggacgccaagcgtgactggggcttcgctcgcgaatatgtcgaaggaatgtggcgcatgttgcaggccgacgagcctgacaccttcgttcttgccaccaaccgtaccgagactgtgcgtgatttcgtgagcatggcattcaagggtgcgggcatcgacgtcgagttccgtgggaaggacgctgaagaaactgcggtggacactgccaccggcaaggtggtcatgcgtatcaacccgaagttccaccgccctgcagaagtggagctgttgatcggcgatcccgagaaggcggcacgtatcctcggctggaagcctgaaaccacactggagcagctatgccagatgatggtcgaggccgatctcaagaggaacgagcgtggcttctcattc

SEQ ID NO: 39180 - DNA, 1044 bp, Xanthomonas campestris
acttggctagtaaccggcggggccggcttcatcggcggaaattttgttctggaggcggtctctcgcgggatccgcgtggtcaatctggacgcgctcacttatgcgggcaatctgaatacgctggcgtcgctggaaggcaatgccgaccatatcttcgtcaagggcgacatcggtgatggagcgcttgtgactcgcttgctgcaggaacatcagccggacgcggtgctgaactttgcagccgaaagccatgtcgatcgctcgatcgaaggccctggcgccttcatccagaccaatgtggtcggcactttggccctgctcgaggcagtgcgcgactattggaaagcactgccggacacgcgccgtgatgccttccgcttcctgcatgtgtccaccgacgaggtctatggcacgctcggcgagaccggcaagttcaccgaaaccacgccgtatgcgcccaattcgccgtactcggcgtccaaggcggcatcggatcatctggtgcgcgcgtttcaccacacctacgggctgccggtgctgaccaccaactgctcgaacaactacggtccgtatcacttccccgaaaaactcattccgttggtcattgccaaggcgctggctggcgagccgctgccggtctatggcgatggcaagcaggtgcgcgactggttgttcgtcagcgaccactgcgaggcgatccgcaccgtgctggccaagggccgggtcggcgagacttacaacgtgggcggcaattcggagcggcagaacatcgaggtcgtgcaggcgatctgcgcgctgctggatcagcatcgcccgcgcgaagatggcaagccgcgtgagagccagatcgcctacgtcaccgaccgccccgggcacgatcgtcggtatgcgatcgatgcctccaagttgaaggacgagctgggctgggagccggcgtacaccttcgagcagggcatcgcattgacggtggactggtatctgaccaaccaaacctgggtccaaggcgtgctggatggtagctatcgactggaacgcatcggcgcaacg

SEQ ID NO: 39181 - DNA, 876 bp, Xanthomonas campestris
atgacacaacgtaaaggcatcatcctggcgggcggctccggcacccgcctgtaccccatcaccaagggcgtcagcaaacagctgctgccggtgtacgacaagccgatgatctactacccgctgagcgtgctgatgctcgcgggtatccgggacatcttgatcatcaacacgccgcacgagcaggcgctgttccagtcgctgttgggcgatggcgcgcagtggggcgtcaatatccagtacgccgtgcaacccagcccggacgggttggcgcaggcctatctgatcggacgcgacttcgtaggcggcaagccgagttgcctggtattgggcgacaatattttccatggccacggtttgaccgataccttgcgccgcgccgacgcgcgcgagcagggtgcgacggtgttcggctactgggtcaacgatccggagcgctacggtgttgccgaattcgatcagcacggcaaggtcatcgacattgccgaaaagccggaaaagccacgctccaactatgcggtcaccggtttgtatttctatgatggcaaggccagcgattatgcggctgccttgaagccgtcgccgcgcggcgagctggaaatcaccgatctcaatcgttgctatctcgatgctggcgacttgcatctggagccgctgggtcgcgggtatgcgtggctggataccggcacgcatcagtctttgcacgaagcggcgaatttcatcgagaccatccagatgcgacagggcttgcaggtgtgctgtccggaggagattgcattcggtcaaggctggatcgatgccgagcagctggagcgtctggcggcgccgttgttgaagaatgactatggcaagtatttgactgcattagccaagcgtggg

SEQ ID NO: 39182 - DNA, 1335 bp, Xanthomonas campestris
ctacccgccttcaaggcctacgatattcgcggccgcgtgccggatgaactcaacgaggacttggcccgccgcatcggcgtggcactggcggcgcagctggatcaagggcccgtggtcctgggccacgatgtgcggctggcgagcccggcactgcaggaagccctgtctgccggcctgcgtgccagcggccgcgaggtgatcgacgttggcctgtgtggcaccgaggaggtctatttccagaccgatcacctcaaggccgccggcggcgtgatggtcaccgccagccacaacccgatggactacaatggcatgaagctggtgcgtgaacaggcgcggccgatcagctccgataccggcctgttcgccatccgcgacacggtcgcggccgacactgccgctgcaggcgagcccaccgctgccgagcacagccgcaccgacaagaccgcgtatctggagcacctgctcagctacgtggaccgcagcacactcaagccgctcaagctggtggtcaacgccggcaacggcggcgccggcctgatcgtcgacctgctggcagcgcatctgccattcgaattcgtgcgcgtcttccacgagcccgatggcaacttccccaacggcatccccaacccgctgctgccggaaaaccgcgacgccaccgccaaggcggtcaaggaacacggcgccgacttcgggattgcctgggatggcgacttcgatcgttgcttcttcttcgatcacactggccgcttcatcgagggttattacctggtcggcctgctggcgcaagccatcctggccaagcagcccggcggcaaggtcgtgcacgacccgcgcctgacctggaacacggtggagatggtggaagacgccggcggcattccggtgctgtgcaagagtggccacgccttcattaaggaaaagatgcgcagcgagaacgccgtctatggtggcgaaatgagcgcgcaccattacttccgcgaattcgcctacgccgactcgggcatgattccatggctgctgatcgccgagctggtctcgcaatcgggccgttcgctggcggacctggtcgaagcgcgcatgcagaagttcccatgcagcggcgagatcaacttcaaggtcgacgacgccaaggctgcggtcgcacgcgtcatggcgcattacggtgatcagtcaccggagctggattacaccgacggcatcagcgccgacttcgggcaatggcgcttcaacctgcgcagctcgaacaccgagccgctgctgcgtctgaacgtggaaacgcgcggcgatgctgcactgctggagacgcgtacgcaggaaatttccaacctgttacgc

SEQ ID NO: 39183 - DNA, 1704 bp, Xanthomonas campestris
cgttttctgtggcactacatctgccaacgtccgtggcacttcggtgggctgctggtgttgatcatcggcgccgccggctgcgcggtcgcggtgcagtacggcatgaagctgctggtggatgcgatgtccaccgatcagcgcatccaggccgatgtgtggacgccgctgggcctgttcatcgggttgattgcggtggaaaacctgttctggcggttgggcggctggctgggttgccgcaccgtggtggccagcgtggtggatatccgggtggacctattccgccatctcaccggccacccgatgcgctatttcaccgagcattttgccggtgcgctgggcaaccgcatcaccgcattgggcaccgccgccgggcagatctatggcggcctggcgtggaagatcctgccgcccatcgtcgacttcatcggcgccatcgtggtgctgttcaccgtggactggcgcatggccgccaccttgattgggtttgtggcggtggtggccgcgatcatcaccggcttcggcatccgcggccgtgccaagcaccagagctttgccgcgcaggccgcacgcgtgggcggcgagctggtggatgcggtgtccaacgtgtggacgatcaaggcctttgctgcacgcgaccgcgagagcgcacgcctggcgcaggaaatcggccacgaggcggtcgcgcaccggcgcagctggatgtatgtggaaaaggcccgcgtcatccacgacatctgcctgtcgatcatggcgggcggcatgctgatctgggcgatcagcgcctggcgcggcggcgcggtgagtgccggcgatgtggtgctggtcagcgccttgacgttccgcatcctgcacggctcgcgcgacctggcattgaccctggtcgacaccacgcagcagctgggcgccatcgccgataccttgcagatcatcctgcagccgcacgccctgcccgatgccgatgcaccactggcgctggccgaaggcgacgtgcgttttgaaggcgtgcgctttgcctacccggaccgccctgcggtgatcgaggcactggacctgcacattcctgccgggcagaaggtgggcatcgttggcccatccggcgccggcaagtccacgctgatcgccttgatccagcggctggacgatgtggaatcgggccgcgtgttgatcgacggccaggacatccgcagcgtgagccaggacagtctgcgcgaccgcattgccgtggtgccgcaggaaaccgcgctattcaaccgcagcatcgccgacaacatccgctacggccgcccggaagccagcgatgccgaggtccacaccgcggcacggcacgccttctgcgatggcttcatccgcgacctgccgcagggctacaacacgctggttggcgagcgcggcgtgatgctgtcgggcggccagcggcaacgcctgggcattgcgcgtgcgttcctcaaggatgcgccgatcctgatcctggacgaagccacctccgcgctggacaccgaatccgaggcagagatccagtccgcactggaccacctgatgcgcggccgcacggtgctggcggtggcccaccgcttgtccacggtgatcggcttcgaccgcatcgtggtgctgcaggacgggcgcatcgtcgaagacggcagcccggccgaactacgcggacgcggcggcgtgttcgacagcctatggcaacgccaggcggcgggc

SEQ ID NO: 39184 - DNA, 849 bp, Xanthomonas campestris
cccgtgcccaactacccgcgcccgccattcaagccgcagcaacagggcttccccggcaagactgacaagatggacccgcgcccggatcacggcgaagacagctacgtgggccacgggcaactgaaaggcaagcgcgcgttgatcaccggtggcgacagcggcattggcgctgccgtggccatcgcttacgcacgcgaaggcgcggatgtggccatcgccttcctgccggatgagcaggaagacgcatcacgcatcggtgcgttgatcgaaaaagccggcgtgcgcgcactgctggtgggctgcgacatcagcgaccccaaccaggctgcgtccttgatcgacaaggtcaacagcgagttcggcgggctggacatcctggtcaacaacgccggctaccagaagtacttcgaaaacttcgaagaaatcaccctggacgagtggcgcaagaccttcgataccaatgtgcacgcagtgttcaacctggtgcgcttgtcggtgccgttgatgaaggacggcggttccatcatcaacaccgcttcggtgcaatctaaaaagcccacgccgaacatccttccctatggcgcaaccaagggtgcgctggccaatctcaccatcgggttggccggcgtgttggccgaaaagcagatccgcgtcaatgcggtgctgccgggcccgatctggacaccgttcattcccgccggcatggacgaagactcggtggaaagcttcggctcgcaaacgccgatgggccgccccggccaaccggtggagcttgcatcggcctacgtgatgctggcctccgataccgccagctacacctccggcaccttgctcaccatctccggtggc

SEQ ID NO: 39185 - DNA, 1554 bp, Xanthomonas campestris
cactcgttgcgccgcgatgtcggcccctttgccctcatgctcaccgggctcggctcgatcatcggctccggctggttgttcggcgcctggcgcgctgccggcctggccggccccggcgcgatctgggcctggatcctgggcgcggcgatcatcaccaccatcgcgctgtcgtatgccgaactcggcgccatgttccccgagtccggcggtatggtgcgctacagccactactcgcacggctcgctggtgggcttcatcgccggctgggcgaactggatcgccatcgtgtcggtgatcccggtcgaggccgaggcctcggtgcagtacatggcctcctggccgtggccctgggcacaaagcctgtacgtgcaggcgcccggcggggcgggcgagttgtcggtgccggggttgctgatttcggcggtgctggtgctggtgtatttcctgctcaacttctggagcgtgaagctgttcgcgcgctccaacaccttgatcaccgtgttcaagctggtggtgccggcagcgaccggcgtggcgctgatcgccagtgggttccatagcgaaaacttcagcgtgggcatccacggcgatgcgcatgtaatcgacctggccgccgtgctcaccgccgtggctaccgccggcatcgtgttcagcttcaacggcttccagagcccggtgaatctggccggcgaagcgcgcaacccggggcgcagcattccgttcgcggtgctgggctcgatcgcgctggccacggtggtgtacctgatcctgcaggtggcctacatcggcgcggtgccgccggagttgctggccaaggccggctggcacggcatcgatttccgttcgccgttcgccgagctggccatcatcgtcaacctgcactggctggcgatgctgctgtacatcgatgcgttcgtgagccccagcggcaccggcatcacctacaccgccaccaccgcgcgcatggtctacggcatggaaaagaacggcaccttgccggccgcgctgggcaagctgcacccggtgtggggcgtgccgcgcatggcgatgttctttaacctggcggtgtcctacctgttcctgttcttcttccgcggctggggcacgctggcggcggtgatttcggtggcgacgatcatttcctacctcaccgggccgatcagcgcgatggcgctgcgccgccacgcaccggacatgcaccgcccgctgcgcatcgccttcctgccgatcctggccggcgtggcgttcgtgatggccaccgagctgctgtactgggcgcgctggccgctgaccggcgagatcatcctgctgatggtggtggcgctgccggtgtactgctactaccaggccaagcagggctggccggacctgcgccgcaacctcaagggcgcggcgtggatggtgtgttacctgccgatcgtggcgctgctgtcctgggccggcagcaccgatttcggcggccatggttacctcagctacggcaccgacctggcggtggtcgcggcggtcgggctggtgttctacatctggggcgtgcgcagcggatggcgcacc

SEQ ID NO: 39186 - DNA, 1959 bp, Xanthomonas campestris
ggtttcgatgtggccggcatggaccgcagcgtggcgccgggcgacgacttcttcggctacgccaacggcacctgggtcaagaccacgcagattccggaagaccgctccagcttcaacagcttcaccagcatcaccgtgaagaccgagcagcacagccgcgacatcatcgaaggcgacgccgccaacgaccgcgtcaccggcgaagacaagcagattggcgactactacgccgcctacatggacgaggccggcatcgaggccaagggcgtgagcccggtgcaaccggccttggatgccatcgcgcaactcgaggacaagcaagccttggcgcgcacccttggcggtcaattgcgcgccgatgtggacctgctcaattccaccgatttctacaccgaccgcctgttcggcctctgggtgtcgcaagacctgcatcatccgcagcggtatgtgccgtacctggtgcaaggcggcctgggcatgcccgagcgcagcttctatctggatggcgggcgcatggcgcagatgcgcgaggcgtaccgcgcctacatcgtcaacgtgctcgaacttgccggcattgccgatgccgcgcccaaggccgagcgcatcctggcgctggaaaccgccatcgcacgcgtgcatgccagcgccgagcaaaccaacaacgtgcaggacggcgccaatgcctgggcccaggccgacttcgcgcgcaaggcacccggcctggactggggcgcatttttcgaagccgccgggttgaaggcgcagcgcgacttcatcgtctggcagccgcaggcggtgaccggactgtcggcgctggtgcagtcgcagccgctgcagacctggaaggactacctgagcttccgcgcgctcgaccgcgccgcgccgtacctgtccaagccgtttgccgacgcgcgcttcggcttctatggcaccaccctggaaggcaccccacagcagcgccaacgctggaagcgtggcatcgacgccaccaacgccgcgttgggcgaagcggtgggcaagcgctacgtgcagaaatacgtcagtgcgcaaaccaagacgcgcgccgaagcgatggccaagaacatcatcgccgccttcggcaagcgcatcgacgcgctggcgtggatgagcccgcagaccaagcagcacgccaaggccaagatcgccgggctcaccgtggccgtgggctacccggacacctggcgcgactacagcgcgctcgaggtacggcgcgacgatgcggtgggcaatgtcgaacgtgccgagctgttcgagtaccgccgcaacctggccaagctgggcaagccggtggaccacggcgagtggtacatgctgccgcaggaggtcaacgcgctgaatgtgccgctggaaaaccgcctgatcttcccggccgcgatcctgcagccgccgttcttcgacccggccgccgacgatgcggtgaattacggcgcgatcggcgcggtgatcggccacgaaatcagccacagcttcgacaacatgggcgcgctgttcgacgaacatggcgagctgcacaactggtggacgccgcaggacctgaagaagttcgagaccgccagcgacgcgctggccgcacagttcggcagctacaaaccgttcgaggatctgtcggtcaacggcaagctcaccctgggcgagaacatcgccgacgtggccggcctggccaccgcctacgacgcgtatcagctgtcgttgcagggcaagcaaccgcagacactggacgggttcacaccagaccagcgcttcttcctgggctttgcacaggcctggcgcggaaagtaccgcgacgaggcgttgcgcaacgcagtcctcaccgatgtgcacgcacccgggcgcttccgcgcgcagaccgtgcgcaatctcgacgcctggtacccggccttcgaagtgacccagggccagcagctgtatctggcgccggagcagcgcgtcaaaatctgg

SEQ ID NO: 39187 - DNA, 1062 bp, Xanthomonas campestris
atgctcaagaacgaccgtctgttgcgtgccctgcgccgccagcccgtggaccgcacccccgtctggctgatgcgccaggcaggccgctatttgccggaataccgcgccacccgcgcgcgcgccggcagtttcctgggcatggccaagaacccggacatcgcctgcgaagtcaccctgcaaccgctggaacgctttccgctggatgcggcgatcctgttctccgacatcctgaccatccccgatgcgatggggctggagctgtatttcgtcgaaggcgaaggccccaagttccgccacccggtgcgcgacgccgacgccatccatcgcctcggcgtgccggacatggaaaccgagctgcgctacgtgatggacgcggtgcgcttgatccgccgcgagctggatggcgcggtaccgctgatcggcttctccggcagcccgtggacgctggcctgctacatgatcgaaggcggcggcagcaaggaatatgcgcgcatcaaggccatggccttcaacgcgccgcagctgctgcaccacctgctcagcaccgtcaccgatgcggtgatcgcctacctgtccgcacagcgcgcggccggtgcgcaggcgctgcaggtgttcgatacctggggcggcgtgttgtcgccggcgatgtaccgcgaattctcgttgccctacctcacccgcatcgcccaggaactggagcgcggcagcggcgaagagcgcaccccgctggtgctgttcggcaagggcaatggcgcctatgtgtccgagctggccgccagcggtgccgaagcggtgggcgtggactggacgatctcgctggccgacgccgctgaacgcgccggcggccgtgtcgccctgcaaggcaacctggacccggccacgctgtacggctcgcccgacgcaatccgcagcgaagtcggcaagaccctggacagctacgcgtacggcaacggcggctcgcgcgaaggccacgtcttcaacctcggccacggcatgtcgccggacatgaatccggatcacgttggcgtgctggtggaagcggtgcagacgctgagcaagcgg

SEQ ID NO: 39188 - DNA, 1035 bp, Xanthomonas campestris
ctcgccctgttgggcaccggcacggtgggacgtgccttcgtgacgcgctataccgccttgcagcaacgtcagttgcgcctgccgcgctttgactggctggccaactcgcgcatcgcccacgactgtggtgccggcgcggagcaggcactgcagctggtcaatgcggcgccgcgtggccgtgcggagctgcagccgtgggcagaaaccactgcgctgcgcgccggcgatgtgctggtggatgccaccgccagcgacgtggtggcggattggcatgttgagtggctaacccgcggcgtgcatgtagtgaccgccaacaagctgggccagggcacggcactgtcgcgtgcgcaggacctgtatgccgcgcgtcacgccagcggcgcgtattacggcgacagtgccaccgtgggtgctggcttgcccttgctcagcagcgtgcgtgcactggtggccggcggcgaccagattcattcgatcgaaggggtgttgtcggggtcgttggcatggctgtttcatcgctatgacggcagtgcgccgttctcggcgtgcgtccgcgaggcgatggcggccggctacaccgagcccgatccgcgcatcgatctctccggtgaggacgtgcggcgcaaattgctgatcctggcgcgtgcggccgggcaaccgctggaagccgagcaggtgcatgtggaatcgctggtgcctgccgcgctggcgtccgtggcgccggaagcggtggatgcgcacctggaaacactcgacgcgctggtgcggacacgttggcagcaggcccgcgccgccggccgctgcttgcggttcgtgggccgcgtggacgagcatggcgcaagcgtgggcttgcgcgaattggccctggaccacccgctggcgggcggcgcgggcaccgacaaccgtgtcgccatcagcagcgatcgctaccgcgaccagccgctgttgattcaagggcccggcgcgggggcggaagtgaccgcggcggcgttgctggacgatgtgttgcggatcgttgctggctgaggttgcggt

SEQ ID NO: 39189 - DNA, 1212 bp, Xanthomonas campestris
atgagctttcgtgaccctgccgacgcgccctgtagcgctgccaccgccgccgtccgtgccggaatcgaccgggacaccgcctacggcgcggtgacgccgccgatcgtgctgtcgtcgaacttctccttcgacggcttcggcaacaagcgccagtacgactacacccgcagcggcaaccccacccgcgacctgctcggcgaagctttggccgaactggaaggcggcgccggcggcgtgatcacctccaccggcatgggcgcgatcaacctggtgctcaacgccttgctgcagcccggcgacaccctggtggtgccgcacgatgcctacggcggcagctggcggttgttcaacgcgctggccaagaagggccatttcgccctgatcaccgccgacctcaccgacccgcgctcgctggccgatgcactggcgcagtcgcccaagctggtgctgatcgaaaccccgtccaacccgttgctgcgcatcactgatctgcgctttgtcatcgaggccgcgcacaaggtgggcgcgctgaccgtggtggacaacacgttcctgtcgccggcgctgcaaaagccgctggaatttggcgccgatgtggtgctgcattccaccaccaagtacgtcaacggccacagcgatgtggtgggcggcgcagtgatcgcgcgcgatgcggagctgcaccagcagttggtgtggtgggccaacgccctgggcctgaccggttcgccgttcgatgcgtttttgaccttgcgcgggctgcgcacgctcgatgcccgcctgcgcgtgcaccaggaaaacgccgatgcgatcgcggtgctgctggacgaacacgcggcagtgaaccaggtgtatttccccgggctggcatcgcatcctggccatgcgttggcggcacgccagcagaagggcttcggcgcgatgatcagcttcgagctcaatggcggtgaggcggcggtgcgtgcgttcgtcgacgggctgcgttatttcaccctggccgaatcgctgggcggcgtggagagcctgatcgcgcatccggcctcgatgacgcacgcggcgatgaccgccgaagcgcgcgctgcggccggtatttccgatggcttgttgcgtctgtcggtgggcattgaatccgctgaggatctgctgatcgatctgcgcgccggcctggcgcgtgcggaagccgcgttgagcgcggtcgcgcgcaaacaggtagac

SEQ ID NO: 39190 - DNA, 420 bp, Xanthomonas campestris
aaccctacgttttcccggagcacacccatgagcgagatccctggcgacctcaagttcctcaaatcccacgagtgggcccgcgtcgaaggcaatggccgcgtcaccgtcggtatctccgaccacgcgcaaggcttgctgggtgacctggtctacgtcgaactgccagccgttggcgacaccgtccaggctggcaacggcgctgcggtggtggagtcggtcaaggccgcctccgacgtctacagcccggtcaccggcacggtcgtcgaggtcaatgcctcgctgagcgacaagccggaaaccatcaatgaagacgcgtacggcgaaggctggatcttcgtggtggagatcgacgacaaggaacagctcaacgaactgctggccccggacgattacgccgagctgctggaagacgacgcgcac

SEQ ID NO: 39191 - DNA, 1569 bp, Xanthomonas campestris
atgacacgccggcagctgctggcacggatcggcatgaccgcgggcggcgcgatgatgtatcaggcgatgagcagcctgggcatggcggccgaatccacctttaccgggccgctgcaactcgatggcgacgccaagggtgcatcggtgctgattctcggtgccggcctggcgggcatgacggcggcgttcgaattgcgcaaggcggggtaccgcgtacaggtgctggaatacaacgaccgcccgggtggtcggaactggacactgcgcggcggcgaccgttacaccgaacttggtggcgcggcgcagcactgccagttcgatgagggccattacctcaatcccggtccgtggcgcatcccgcatcaccaccgcgcggtgctgagttactgcaagcagttcggcgtggcgctggaggcattcaatcaggtcaactacaacgccttgctgcacagccagcacggcttcgatggcaagccgcagcgcttccgcgccatcgatgcggactacaagggccatgtctccgaactgctggccaagtgcacccagcaacacgcactggacagcctggtgagcaccgaggatcagcagatcctgctcgaatcgctgcgcacctggggcgcgctcgacaaacgctttggctacgtcaagggcaaggacagcagcgagcgccgcggctttgcgcgctacccgggtggcggtttgtccggcaagccggagttttccgatcccttcagcgtgcaggacgtgctgcgttcacggctgtggaccacgctggcggctggtaacaactacgaaatgcagaccaccatgttccagccggtgggcggcatggaccagatcggcaaggcgtttgcccgccagctcggcaatgccatcacctataacgccaaggtcaccaggattgatcaggacggcagcggcgtgcgcgtgtcctggcaggatgccgcgcgtggtggcgccgaacaggtggccagtgccgactggtgcatctgcacgattcccctctcggtcttgagccgcatcccggtcaccgccagcgatgcgatgaccacggcgatcggcaaggtgccgtatgcggcgtcggtgaaggtggggctgcagttcaagcgccgcttctgggaagaggacgaggcgatctacggcggcatcagctacaccgatctgccgatcacgctgatcagctatcccagtaccggctatcacagccccggcaagggtgtgttgctgggcgcctacgtctggggtctggacgcctaccagttcacctcgatgtccccggagcagcgtgtgcgcaaggcggtcgaatacggcacgcaattgcatccgcaatatccgcgcgaattcgaaaccggcattgcagtgggctggcatcgtgtgccgtttacgcatgggtgctttggcatgtggagcgaggccgcacgcgccgagcactacgcgccgctgtgccagatcgatggccgcctggcgctggccggcgagcacgtgtcttacatcccggcctggcaggagggcgccatcttgtccgcgcacgatgtcatcggccgcctgcatcgcaaggtgcttgcccaa

SEQ ID NO: 39192 - DNA, 1108 bp, Xanthomonas campestris
gctctgtcgcgccgcaggttcctgcgtgattccgcactgttcgctggtgccgccgggagcgccctgccgctgctggccagcgccgccgaacgctcggccgccatcgcgcctgccacagcgggcgcaatggcgccggtgatgatcggctccaacgagtttcctgatggcccgtgtgccgcggcgatcaaggcaatcacgcagattgcgccgcagggtgggcggtatctgcgtgagctgcagatggaactgatgaccaccctggccgctgagctcaagctgccggtgaaccacctgatggcctatgccggttctaccgagccgctcgactacacgatgctggccttcacctcgcccagtgccgcgctggtcaccgccgaccccacctacgaatccggctggcgcgctgcgtcccgcaacggcgccaagctggtcaaggtgccgttgcgcaaggacttctcgcacgacgtgcaggcgatgtgcgcagccgataccaacgccggcgtgatctacatctgcaatcccaataatcccaccggctcggtgaccgcacgcaaggatctggactacccgctggcgcacaagcccaagggcagcattttggtggtggacgaggcctacatacatttcgcgcagagcacccgcagcgtggtggacatgagtgtccgcggtagaagacgtggtggcactgttcaccttttccaagctctacggcatggccggcatccgcctgggctatgcggcagcacgcccggacctgctggccaagctgatgttctacagcgtcaacagcctgccggtgaccgcggccgcggcgggcctggccagcctgcgcgatgccacgctggtgccgcaacggcgcgcacgcactgcggccacccgcgccgatgtcatcgacttcctcaccaagcagggctatgcctgcaccgcttcggaaagcaactgcttcatggtcgatgtaaaacagcccgcggccggcttcaaggacgccatggccaccttcggtgtattcatcggccgcagctggccggtgtggcccacctggtcgcggatcacggtgggcacgcccgaggagatggcgcgcttcaagcaggccttcgtgcaggtcatg

SEQ ID NO: 39193 - DNA, 1287 bp, Xanthomonas campestris
atgaaccactcccgctcccacgccctgttttcccaggcgcagaacctgatgcccggcggcgtcaactcgccggtgcgtgcgttcaagtcggtgggcggcgagccgttcttcgtcgcgcgtgccgacggcgcgtacctgttcgacgtggatggcaaccgctatatcgactacgtgggttcgtgggggccgatgattgccggccacaaccacccggccgtgcgcgaagcggtggaacgcgccatccgcgatggcctgtcgttcggcgcgccctgcgaggccgaggtgaccatggccgaaaccatcacccggctggtgccatcctgcgaaatggtgcggatggtcaattccggcaccgaagccacgctgtcggcgatccgcctggcacgcggcgccaccgggcgcaaccgcatcgtcaagttcgagggctgctaccacggccacggcgactcgttcctggtcaaggccggcagcggcatgctgaccctgggtgtgcccacctcgccaggcgtgccggcaggcctgagcgagctcaccgccacgctcagcttcaatgatttcgaaggcgccaccgcgttgttcgacgagatcggcgccgaagtggcggcggtgatcatcgagccggtggtcggcaatgccaactgcattccgccgcaggccggctacctgcagcacctgcgcacgctgtgcacccgccacggcgcgctgctgatcttcgacgaagtgatgaccggcttccgcgtggcgctgggcggcgcgcaggcgcactacggcgtgaccccggacctgaccaccttcggcaagatcatcggcggcggcatgccggtgggcgcctacggcggcggccgcgacctgatggaacagatctccccggccggcccgatctaccaggccggcactttgtctggcaacccggtggcaatggccgcgggcctggcgatgctgcaactggtgcaggaaccgggcttccacgcccgcctcagcgagaccaccagcctgctgtgcgaaggcctggaagacgccgcccgcgccgccggggtagcggtgaccaccaaccaggtgggcggcatgttcgggctgttcttcaccgaccagatcgtggagaactacgcccaggccaccgcctgcgacgtaaccaccttcaaccgcttcttccacgcgatgctgcagcagggcgtgtacctggcgccatcggcctacgaggcgggcttcgtatccagcgcccacgacgaggccgtcatcgaggccaccctggccgccgcacgcgaagcctttgccgacgtcatgcgc

SEQ ID NO: 39194 - DNA, 1317 bp, Xanthomonas campestris
atgaagaagctcaccggcattggcgcggccgagtacgcgcgccgacgcaagcagctcatgcagatggccggcgagcaggccatcctgatcctgccggcggcaccggagcgggtgcgcagccacgacacccattacccgtaccggcaggattcggatttctggtacctgagcgggtttccggaaccggaggcggtgctggtgctggtgccagggcgcaagcacggtgaggcaatcctgttctgccgcgagcgcgatgccgagcgcgaagcctgggacggcccgcgcgcgggccaggaaggcgcggtggcgcagtacggcatggacgatgcgtaccccatcgacgatgtcgacgagatcctgcccggcctgctggaaggacgcagccgcgtctactaccacttcggccgcgatgtggatttcgatctcaagctgatcggctggctcaagcgggtgcgcgagcaggtgcgccatggcgcgcaaccgccgcatgagttcctggagttgggccatctgctgcacgagcagcgcctgttcaagtcgcgcgacgagatcgcattgatgcagcaggccgccgacatcagcgtgcgtgcgcatcgcgcggcgatgcagttggcacgcccgggcgtgcacgagtatcaactgcaggccgagatcgaacgcgaattccgcgccgccgatgcgtggccggcgtacggcagcatcgtcggcaccggcagcaatgcctgcgtgctgcattaccgcgccaacaacgcgcgcagccgcgatggcgagctggtgctggtggacgccggcgccgaataccgcggctatgcggccgacatcacccgcacatttccggtcaacggccgcttcagcgcggcgcaacgtgccctgcacgatctggtcggcgccgcgcaggcggccgccctggcgcaggcacaacctggcattgcctacgaggccggtcacctggcggcggtgcagacactgaccgaagggttgctgcgcctggggctgctcaaaggcacgctggagcgcaacctcgccgaagggcactacaagcggttttatcggcacaagaccggccactggcttggcctggatgtgcatgacgttggcgagtatcgcctcgcgggcgagtcacgccttctggagcccggcatggtgttcaccatcgagcctgggttgtatgtctcggccgacgatacgagcgtggacgccaagtggcgcggcatcggtatccgcaccgaagacaacgtgctgatcaccgccgacggccaccgcgtgctgaccgatgccttggcgcgcagcgccgacgaaatccagggggcgatggct

SEQ ID NO: 39195 - DNA, 1309 bp, Xanthomonas campestris
ctgagcgtcctgtattccgaccacctgcgcacgctcaacgagcgcgccgaccaggcgctgcagcggggcggcttcgattcatctgggtcatttcccagcggcaccacgcattaccagctgttcgacgcccgcgactacccgtttgcgggtcaatccgcagttcaaggcctgggtgccgcttacccgcatgccgcacagctggctggtctacacgcccggcaagcggccgacggtgattttctatcagccgttcgactactggcacgtggtgcccgatgcgcccagcggctggtgggtggagcactgcgacatccacatcatccgcacgccggaggccgcattgccgctgctgcccgcccgcaccgagcgctgcgccatcctgggcgaggccgccagtgcgctgggcgcgtgcgtgcccaacaacccggccgcggtgctcgacttcctggactatcaacgcgccttcaagacaccgtacgaactggcggtgatgcggctggcgcagcagttggcggtgcgtggccaccgcgccgccgaggctgcgttccgcgcgggccagagcgagttcggcatccacatggcgtattgcagcgcagtcggccaggacgccaacgaattgccgtacggcaacatcatcgcgctcaacgagcacggtgcggtgctgcactacaccgaactcggcaggcaggcgccgcagccactgcgcagctttctgatcgatgccggcgcctcggcacatggctatgccagcgacatcacccgcacctacgccgccgatgccggcagcgagttccaggcgctgatcgatgcggtggatgccgcgcagctgcgcatgggcaatgcggtgtgtgccggcatggattacaagcaactgcatgtggacgcgcacctgtcgctgatgggcatcctgcacgacttcggcatcattacggtttcgcctgaagccgcgctggccaccggcgtcagcgccgcattcttcccgcatggcctcggccacttgatcggcctgcaggtgcatgacgtggccgggtttgcagccagcgatcgcggcgggcgcatcgagcgcccggacggccacccgtatctgcgcctgacccgcgtgctcgaaccaggcatggtggtcaccatcgagcccggcgtgtacttcatcgacatgctgctggacgaggtcaagaaaaacggccatgccgccagcgtgaactgggaccgcgtggcgcagttcgcgccgtacggcggcatccgcatcgaagacgaagtggtctgcaccgacggcgatccggaaaacctgacccgcccggtgtttgcggcg

SEQ ID NO: 39196 - DNA, 897 bp, Xanthomonas campestris
agcagatacacaccttcggaaatggcccaagcgcttggtgccgggctcctgtcattcccggtgacgcacttcgatgcggacatggctttcgacgagcccgcctaccgcagcaatctggactggctgtcctcgcacccggccgccgggttgtttgctgccggcggcaccggcgagctgttttcgctgaccctggacgaagtggaccgcgcagtgcgcgcggccgtgacccagaccgccgggcgcatgccggtgattgcgccggccggctacggcaccgcgattgccgtggccatggcgcaggcggcagagcgtaacgacgccgatggcatcttgctgtttccgccgtatctcaccgaatgcgatgccgacggcgtggccgagcatgtcgagcgcgtctgcaaggcgacctcgctgggcgtgattgtctacggccgcgccaatgcccggctcgatgacgtggcgctggcgcgggtggccgagcgctgccccaacctggtgggctacaaggacggcatcggcgatgtggagcgcatgacgcgtatctacgcgcggctgggcgatcgcctgctctacgtcggcggcctgccgacggccgaaacctttgcgctgccgtacctggaaatgggggtgaccacgtattcgtcggccatcttcaatttcctgccggaatgggcgctgtcgttctatgcggcagtgcgcgcgcgcgatcacgcaaccatctaccgcgagctcaacgacttcgtgctgccgtacaccgtgctgcgcaatcgccgcgccggctatgcggtgtcgatcgtcaaggccggcatgcgtgccgtgggtcgcccggccggcccggtacgtacgccgctggccgatctgaccgaagacgaattcgcccagctcacgcagctcatc

SEQ ID NO: 39197 - DNA, 1296 bp, Xanthomonas campestris
cgttatctgatcttgctgatgttgttcgtggtgaccacgatcaactacgcggaccgcgccaccttgtccattgccggctccgccgtgcaggactcgctgggcatcgatgcactgcagatgggtttcattttctcggcattcggctgggcctacgtggccgggcagattccgggaggctggttgctcgaccgcttcggctcacggcgcgtgtatggcctgtccctgctgacctggtcgctgttcaccgtgctgcagggattcatcggctgggtgccggtggcttgggcggtcaccaccttgttcgtgctgcgctttttggtgggcatcgccgaagcgccctcgttcccgggtaacagccgcatcgtggcggcgtggtttcccacagccgaacgcggcttggccgcctcgatcttcaactccgcacagtacttcgccaccgtggccttcgcgccgctgatgggctggctggtgcatgcctggggctgggagcacgtgttcctggtgatgggtgcggccggcgtgctgctggccgcgctgtggagaaagaccatctatgcaccgcgcgagcatccgcgcttgtcggcgcaggaactggagtacatccagcgcaacggtgcactggtggacatggagcagcgcaacacgccaagccagcacgtcaagggagcgcaatggcattacgccaagcaactgctgggcaatcgcatgttgctaggcgtgtacatcggccagtactgcatcactacgctgacgtatttctttttgacctggttcccggtgtatctggtcaaggagcgtggcatgtcgatcctggaagcaggcttcgttgcctcgctgccggcggtgtgcggcttcatcggcggcgtgctgggcggttacgtgtccgatcgcatggtgcggcgcggctattcgctcaccgtggcgcgcaagacgccgatcgtggttggcatgttgatgtcggtgacgatgatcgggtgtaactacgtgcaggccgaatggatggtggtcggcttgatggcgctggcgttcttcggcaaaggcatcggcgcgctcggctgggcggtggtggccgatacctcgcccaaggaaatcgcagggctctcgggcggcctgttcaacaccttcggcaacatggccggcatcaccacgccgatcgtgatcggctacatcgtctccaccaccggcaccttcgagtgggccctggtgttcgttggattcaatgccttgctggcggtggtgtcttacctggtggtggtcggccagatcaagcgggtggagctgaaggcgccgcccggc

SEQ ID NO: 39198 - DNA, 1167 bp, Xanthomonas campestris
atgtccattgtccgcatgaccgacctcgatctttccggcaagcgcgtgctgatccgccaggatctcaacgtgccgatcgacaacggccagatcacctccgaacagcgcatcaccgcctcggtgcccaccatcaagctggcgctggaaaagggcgccgcggtgatggtgacctcgcacctgggccgcccgaaggaaggcacctggagcgaggaagattcgctggcgccggtggccgcgcgactgaccaccctgctgggcttggacgtgccgctggtgcgtgactgggtcgagggcgtggacgtggcgccgggccaggtggtgctgctggaaaattgccgcatgaacgtgggcgagggcaaggatgacgaagcgctcgcacgcaagtacgccgcgctgtgcgatgtgtttgtcatggacgccttcggcaccgcgcatcgtgcgcaggcctccacgcatggcgtgatccggttcgcgccggtggcagccggtggcccgctgctgatggccgagctcgacgcgctggccaaggcgctggacaacccggccaagccgctgctggcgatcgtggccggcagcaaggtttcgaccaagctggaactgctggccaacctggtcaacaaggtggaccagttgatcgtcggcggtggtatcgccaataccttcatcgccgcggccggccacgatgtgggcaagtcactcagcgaaccggacctgatcccgaccgccaaccagatcgtcgccgatgccaaggcacgcggcgcggagattccgctgccaaccgacgtggtggtggccaagcagttcctgcccgatgccgaggcgagcgtgaagtcgctcgaccaggtggatgccgacgatctgatcctggacatcggcccgcagactgccgcgcactatgccgaactgattgccaatgccggcaccgtggtctggaacggcccggtcggcgtgttcgagttcgagcccttcagccatggcaccgagaccctggcgcgtgccattgccgcgtccgaggcgttctcgatcgccggtggtggtgacacgttggcggccgtggacaaatacgccatcgccaaggacgtcacctacatctcgaccggcggcggcgcgttcctggaatttttggaaggcaagaccctgccggcggttgccgcgctcgaggcccgc

SEQ ID NO: 39199 - DNA, 1464 bp, Xanthomonas campestris
atgaaagaacgtcaacgccgcaccaagatcctcgccacgctgggaccggccacggatccgcctggtgtgctggacgccttgttcaaggcgggcgtcaacgtggtgcgcctcaacttcagccacggcgacccgtccggccaggccaagcgcgctgccgaagtgcgtgccgccgccgtccgcgtcggcgccgaagtgggcatcctggccgacctgccgggcccgaagatccgcatcgagcgctttgccggaggcaagatcaagctgaccatgggcgatcgtttcgacctggtggccgatatcaatgcgccggccggcgatcagcatcaggtgggcgtgagctacctgggcctgccgcaggatgtcaccgccggtgacgtgctgctgctcgacgatggcctggtgcagctgcaggtcaccgacgtgcagggcgcgcgcatcgtcaccaccgtgctcaacgatggtgtgttgtccgaccgcaagggcctcaacaagcagggcggcggtctgtcgctgggcgcgttgaccgagcgcgacaaggagctgatcggcatcgtggccaagatcggcgtggacttcatcgcggtgtcgttctgccgtaacgcgcaggacatgcacgacgcccgccagatcgcccagcagcacggctgcgatgcgcagttggtgtccaagatcgagcgcaccgaagcgatcgagaacctggtcgaaatcgtcgaagcctccgacgtggtgatggtggcgcgtggcgatctgggcgtggaaatcggcgatgccgaattgccgggcctgcagaagaagatcattcgcgagtcgctggcgcagaacaaggtggtgatcacggccacccagatgctgcagtcgatggtggaaagcccgatcccgacccgcgccgaagtactcgacgtggccaacgcggtcatcgacggcaccgatgcggtgatgctctcggccgaaaccgctgccggtgcgtatccggtgcgtgcagtggaagcgatggcgcgcatctgcctgggcgccgagcaccagttcgagttcgataccgacttcgaagcggcgcaacgcaacctgcagcgcgccgaccaggcgatcgcaatggcgaccatgttcctgtccgagcacatcggtctgggcggcgtggtggcgttgaccgaatccggcggcacgccgcgttacctgtcgcgcttccgttccaacatgccgatctatgcattcacccgtcatgacggcgcgcgtcgccagatggcgatgatgcgtggcgtgttcccgatcggtttcgacagccgtggcctgaccccacgcgaagccgcgcgcgcagcgatccgcctgctggtggagaacgagcgcatggggcctggcgaccgcgtggtgttcaccagcggcgagcacatggaaacccatggcgccaccaacacgctgcgtctgctggaagtgggcgaagacggccgcgccagcggtctgggcgagctg

SEQ ID NO: 39200 - DNA, 1002 bp, Xanthomonas campestris
atgagcatcgaacagcttgccgaaaccgcccaggccatggtcgccccgggcaagggcatcatcgccatcgacgaatcgaccagcacgatcgccaagcgcttttccggcgtcggcatcgagaacaccgaagaaaaccgtcgtgcctaccgcgaactgctgctgaccacgcccaagctgagcgattacatctccggcgccatcctgttcgacgaaaccatccgtcagaagaccaaggacggcgtgccgttcgccaagtacatggccgaccacggcatcatcccgggcatcaaggtcgacaagggcgcgcagccgctggccggcatgccgggcgagttggtgaccgaaggtctggacggcctgcgtgcgcgtctggaggagtactacaccctgggcgcgcgcttcgccaagtggcgtgcggtcatcaacatcggcgaagacattccgtccggcacctgcatcgaggccaatgcgcatgcgctggcccgctatgccgcgctgtgccaggaacaaggcctggtgccgatggtggagccggaagtgatcatggatggcgaccacgacatcgagacctgctacgaagtcaccgaagccacgttgcgttcgctgttcggtgcgctgtatgagcagaacgtcgtgctcgaaggcaccatcctgaaggcctcgatggtcatctccggcaagggctgcgaagagcaggccagcgtcgaagaagtggccgagtccaccgtgatgtgcctgaagtcgaccgtgccggcaatcctgccgggcatcgtgttcctgtccggcggccagaccgacgagcagtccaccgcgcacctcaacgagatgcaccagctgggcaacctgccgtggccgctgagcttctcgtatggccgcgcgatgcagcaggccgcactgaagctgtggtccaaggacatgaccggcaactacgccaaggcgcagcagatcatttacgagcgcgccaaggaaaacggcttggctgcactgggcaagtggaagggc

SEQ ID NO: 39201 - DNA, 723 bp, Xanthomonas campestris
atgaccgcgctgcctgccacatcgatcgccgctccttcgctggacgacctggacgcgctcaacgcgcacctggagacgctgcgcgccgacgaacgcgttgcctgggcgctgcagcacggcccccaacaagcggcgctgtcgtccagcttcggcgcgcagtcggcggtgacgttgcacctgctcacccagcagcgcccggacatcccggtgatcctgatcgacaccggctacctgttcccggaaacctaccgctttgccgatgcattgaccgaacgcctctcgctcaacctgcaggtgtatcgcccgctggtcagccgcgcctggatggaggcgcgccatggccgcttgtgggaacagggcatggtaggcatcgaccagtacaacaacctgcgcaaggtcgaaccgatgcgccgcgcgctggacgaactcaacgtcggcacctggttcaccggactgcgccgcagccagtccggtgggcgcgcacagaccccgatcgtgcaaaagcgcggggaccgctacaagatcagcccgattgccgactggaccgaccgcgacgtctggcaatacctgcagacgcacgcactgccgtatcacccgctgtgggaacaaggctacgtgtcgatcggtgacttccacaccacccgtcgctgggagccgggcatgcgcgaagaagacacgcgcttcttcggactcaagcgcgagtgcggcatccacgaagacatc

SEQ ID NO: 39202 - DNA, 1695 bp, Xanthomonas campestris
ccgattcccatgacccactccgtcgaagacatcaaatccaccagccgccgcttgcgcggatcgctggagcagagcctggccgatccggtcaccggggcgttgcgcgaggacgatcagacgctgatcaaataccacggcagctaccagcaggacgaccgcgacatccgcgatgagcggcggcggcaaaagctcgagccggcatatcagttcatgatccgcacgcgcacgccaggtggagtgatttcgcccagccagtggctggcactggatggcatcgccacgcgctatgccaaccattcgctgcgcatcaccacgcgccaggcgttccagttccatggtgtgatcaagcgcgagctcaaggccacgatgcaggcgatcaacgccaccttgatcgacacgctggccgcctgcggcgatgtgaatcgcaatgtgcaggtggcggccaacccgctgctgtcgcaggcgcatgccacgctgtatgccgatgccgcgcgcgtgtccgagcatctgctgcccaacacgcgtgcctattacgagatctggctggatgaagagcgcgtgtccggttcgggcgccgaggacgaaccgatctatggcgaccgctacctgccgcgcaaattcaagatcggctttgccgcgccaccccataacgatgtggacgtgttcgccaacgacctgggcttcatcgccatcctgcgcgagggccagttgctcggctacaacgtcagcatcggcggcggcatgggcgccagccacggcgatgcggagacctggccgcgcgtggccaacgtgatcggcttcgtcacccgcgatcagttgctggatatcgccacggccgtggtcaccacccagcgcgacctcggcaatcgcgccgtgcgtaagcgcgcgcgcttcaagtacaccatcgacgaccacggcctggacaccatcgtggcggagatcgaacgccgcgcgggattcagcttgcaacctgcgcagccgtttgcattcgcgcataacggcgaccgctacggctgggtggagggcgaacagggcgattggcatctgacgctgtcgctgccggccgggcgcattgccgacaccgacaccgccgcgcacctgagcgggctgcgcgccatcgcgcagttgcagatgggcgagttccgcatgacgcccaatcagaacctggtgattgccggcgtcccggccgaacagcgcgcgcagatcgaccaactggtggcgcagtacggcctggatgccggcaacctggcgcccaccgcgttggcgcgcggcgcgatggcctgtgtggccttgccaacctgcgggctggccatggccgaggccgagcgctatctgccggatttcagtgctgcgctgcagccgctgctggaacgccacgggctggcgcagacgccgatcgtgctgcgcctgtccggttgcccgaacggctgttcgcggccgtatctggctgaaatcgcattggtcggcaaggcaccgggccgctacaacctgatgctgggcggcgaccgccgcggccaacgcttgaacacgctgtaccgcgaaaacatcaacgaagccgacatcctcgccgcgctcgagccactgctagcgcgctatgccgcagagcgcgaccagcacgccgacgaaggcttcggcgacttcctgcatcgcagcggcctgatcgccctgccgccctaccccacccaccgtcatctc

SEQ ID NO: 39203 - DNA, 1842 bp, Xanthomonas campestris
ctccagcagcacgaatccaaaccgctgctgcgcttcatcacttgcggcagtgttgacgatggcaagagcacgctgatcgggcggttgttgtacgacagcaagcggctgttcgatgaccagctagccgcgctggaaagtgatagcaagcgccatggcacgcagggcgacggcatcgactacgccttgctgatggatgggctggccgccgagcgcgagcagggcatcaccatcgatgtggcgtaccgctacttcgataccgaccaacgcaagttcatcgtcgccgattgccccgggcatgagcagtacacgcgcaacatggccaccggcgcctccaccgccgatgtggcggtggtgctggtggatgcgcgcaagggcgtgctggtgcagacgcggcggcacagctacatcgtctcgttgctgggcattcgccacgtggtgctggcggtcaacaagatggacctggtggactatgacgcgcaggtgttcgccaccatcgtcgacagctatcgcgccctggcggcgcagttgggcattgccgatgtgcaatgcattccgctgtcggcactggccggcgacaacctgtccagcgcgtccacgcgcatgccgtggtaccaggggccgcatctgctgcagcacctggacagcgtgcagctggagacgcccgatgcagtgagtgggttgcgcctgccggtgcagtgggtcaatcgccccagcgcgcagttccgtggctatgccggcaccattgctgccggccaggtacgcaccggcgatgcggtggtggtggtgccgtccgggcgccgcgcgcatgtggcgagcgtgctggatgccaatggcgtggtcgacagcgcacgcgccgggcaggccgtgacgctgaccttgcgcgaagagatcgacatcagccgcggcgacatcatcgccgccgtggacgacccgccggaagtggccgaccagttcgccgcgcacgtgttgtggatggacgatgccgcgttgctgccagggcgcccgtactggctcaagatcggcacccgcacggtcaccgccagcatcagcgagatcaagcacaaggtcgatgtgaacacgcaggagcggctggccgccaagcggctggagctcaacgaggtgggctactgcaacctgtcgctggacgagccgatcgcctttgccccgtatgcgcgcaaccgggtgctgggcggcttcatcctgatcgaccggcagaccaatgccacggtcgcggccggtgcgctggagttcgcgttgcgccgcgccggcaacgtgcattggcagcacctggatgtggaccgcgccgcgcgtgcgcgcatcaagggccaggcgccacgtgtgctgtggttcaccggcctgtccggtgcgggcaagtccacggtggccaacctggtggacaagcgcctgcatgcgctgggctatcacaccttcatcctggacggcgacaacgtgcgccacgggctcaaccgcgatctgggcttcaccgacgaggaccgcgtggaaaacatccgccgcgtggccgaggtggcacggctgatggccgatgccgggctgatcgtgctggtgagcttcatttccccgttccgtgccgaacgccagctggcacgcgagcgtttcgactcgggtgaattcgtcgaagtgtttgtggacgtgcctctggcggtcgccgaggcacgcgacgtgaaaggcctctaccgcaaggcccgcgccgggcagattcccaatttcaccgggatcgattcgccgtacgaggcgcccgagcgcccggaaatccatcttcacgccgatggtgagaacgtagaggcgctggcgcggcatgtcctggaatacctgggcctggag

SEQ ID NO: 39204 - DNA, 2559 bp, Xanthomonas campestris
cgcctgcccacctgggcggtgcccgagcactacagtctggccatcaaggtggatccggagcaggcgcagttcagcggccgcaccaccatccgcgtgcagctcaagcaggcatcggaccatctctggctgcacggcaaggagctgaaggtcagcaaggccacagtgaagccggccaagggcaaggcactcaccgcacgctacgtcgatgccgatgcgcagaccggcgtggtgcgcctggatttcggccgcacgctcaaaccgcagacgctcaccgtggacatcacctacagcgcgccgctcaatcagcagctgcagggcctgtatcaggtgaagtaccagggcaaggcatatgcgatgacgcagatggagccgatcagtgcacgctatgcgttccccggtttcgatgagcccgcgttcaagacgccgttcgacctgagcctgaccgtgcccgcgggcgatcaggccttggccaacaccatcgccacctccaccaagccggccggcaagggctggaagacggtgagctttgcaccgacgctgccgctgcccacctatctggtggcctacgcggccggcccgtgggatgtggtggacgtgccggccatgccggccaccccacagcgccccgcagccacaccgctacgtggcatcgccgcccagggccagggcccgcgcatcacccccgcgctggaccagaccccggcgattattgcggcgctggaggactactacgcgttcggttacccgttcgacaaactcgacctggttgctgcaccggacttcagcgccggcgccatggaaaacccggggtttgtgaccttccgcgactggctgttgctgctggacaaggactcgccggccgaaaacgtgcagcgctccttcaacaccaacgcgcacgagctggcgcaccagtggaccggcgacaccgtcaccatggcgtggtgggacgatttgtggttgaacgaagcgttcgccacctggatgcagcagaagatcaccatgcagctgcacccggaataccgtgccaatctggaccgcatcggcggtgcgcagcacgcgatggataacgacagcctggtcagcgcacgcaagatccgccagccgatcaccggcaatggcgacatcgaaaccgccttcgacggcatcacctaccagaagggtgcggcggtgctggcgatgttcgaaggtttcgtcggcgaggacgtgttccgcgagggcatgcgcgcctacatcgccaagcacaagttcggcagcgccaccgccgatgacctggtcgatgcgatcgccgaagccgccggcaagggcgaggatttcaaggccgcattccgcagtttcctgaatcagccgggcgtaccgtacctgcagacgcaggtggcgcgcgagggcggcaagaccgtggtcaaacttcagcagcagcgctacctgccgctgggctcatccggttccaccgcgcagcagtggggcgtgccggtgtgcgtgaagtacggcaagggcaagaatcaggtgggcaccgcctgccaactgctggaaagcggcagcggcagcatcgtgctggaaggtgccggcaagaacacctgggtgttcccgaatgcgcgtggcgccggctactaccgtttcagcctgccgaagaagcagctggccgcgctcggcaagcaggtcgcccagctcgacgaaaacgaaaagctttcctacgccgatgctatcgatgcggcgtatcgccacggtgatgccgacaccgaggtggtgcttgcagcgatgaagcaactggccggcgccgagtctgccgatgtgtccaccgcgttggtggaccgcttcgtctggatctggcgccaccaggccaccaccgatgcgcagcgcgccaccctgcgcaaggcggccgagcaggcctacctgccgcgcctgcgtcagctcggctacacccgccgcgccaaggagtcgatcgacgacaccacattgcgtgcgtccctggccggcctgttcggcctgtggctgcaaaccccggaggtgcgcagcgcgctgctggcccagggcgatgcggtgctggcaggtggcggcaatggcctgaacttcgccgcggccaatcccgacctgctcggcaccgtgctggcggtgaccgcgcaggagcgcggcgcggcggccgtgcagacgctgatccaggcgctgcgcacgcatgccgacccggcacagcgcaacgcgatgatcgccgcgctcggcgcggtgcaggatccggcgctgctcacccaggtgcgcgactttgcattgaccgatgcgatcaaggtcggcgagatgaagagcctgctgacgcgtgggcatagctatgacgcctcgcatgcctcgatgtggccgtggttcaccgccaacttcgaccgcatcgtgcagcgcagtggctcgttcgatggcggcggcctgccgtcgctgggcgcgtccaacggctgcagcgtggaggaagccgatcgtctggatgcgttcttcaagccacgcctggccacgctcagcggcgccgaccgcggcctggcccagaccggcgaggcgatccgcctgtgcgccgcgctcaagcag

SEQ ID NO: 39205 - DNA, 2481 bp, Xanthomonas campestris
atgaccaccaacgacacccttgccgcgatcgccgccggtacccttgcacccaccagcgctcccgccagtgtgaccgtgcccagccccgcacacccggagttgagtgacccgtcggacgtcgtgccgcccccccgccaagccattgcaatgcacgcacagaccatcgaagaacaaaccgtctccacctggatcaccaaggaagccggcaaccgcaagatcccgttcgagccggcgcgcctggagcgcgccatcgaccagatccatgccgaattcccgcagctggacgtgggcgactacaagcgctcggtgttcggcttcgtcgagcgcaaggacagtgtcaacgccgacgacctggtcgaccacctgatccgcgaggccgaggcccgcgtcgatctgaccaccccggagtgggagcacttcgctgcgcgtctgtacctgcgccgcctgtacaagcgcgccagccgcaaccgcttctacgacgccggccagaagtacggctcgttcgtgggcctgcaggaaagcctggccgaccgtaacgtctattccaacgacatcctcaagagctattccaaggaagagctcatcgaggcgggcaagatgattgcgcccgagcgcgacacgctgttcgcctacaacggcctgtacctgctggccacccgttacctggccaccgacaactcgcgcggcgtgttcgagctgccgcaggagcgctggctgaccatcgccctgtacctgatgcaggacgagaagccgcgcgagcgccgcatgcagctggtgggcgaggcctactgggcgctgtccaacctgtacatgaccgtggcaaccccgacgctggccaatgccggcaaggtcggcgggcagctgtcgagctgcttcatcgacaccgtcgacgacagcctgcagggcatctacgactccaacaccgacgtggcgcgcgtgtccaagcacggcggcggcgtgggcgcgtacctgggctatgtgcgttcgtcgggctcggcgatccgcggtgtgtccaactcgtccggcggcgtggtgccgtggatcaagcagctcaacaacaccgccgtgtcggtggatcagcttggccagcgcaagggcgccatcgcggtctacctggacattttccaccgcgacatcgaatcgttcctggatctgcgcctgaacaacggcgaccagcgtctgcgcgcgcacgacgtgttcacctcggtgtgcatcccggacctgttcatggaagcggtcgagcgccgcggcgactggtacctgttcgatccgcatgaagtcaagcgcatcaagggctggtacctgcaggacttctatgacgagaagaagggcgacgccaacagcagcttccgcaagaagtacgaggaagtggttgccgacgagcgcatcacccgcaagaccgtcaaggcgatcgagatcttcaagcggatcatggtcagccagctggaaaccggcaacccgttcatgttctaccgcgatgaagtcaatcgcaagaatccgaacaagcacgagggcatggtctattcgtccaacctgtgcaccgagatcctgcagaacatgagccccacgcggatgatgcaggaaatcatcagcggcaatcagatcgtcaccaccaagaaggccggcgacttcgtcgtgtgcaacctgtcctcgatcaacctgggccgcgcgatcaccgtgcaggccgaccaggccgatctgctgggtgccgacgtgctggagcggttgattccgatccaggtgcgcatgctcgacaacgtgatcgatctgaatcagttgccggtgccgcaggccaccatcaccaaccagaagtaccgcgccatcggcctgggcaccttcggctggcatcacctgctcgcgcagaaggccatccactggaatgccaaggaagccgaggactacagcgacgagctgtacgagcgcatcaactacctgaccgtccaggcgagcatggagctggccaaggaaaagggcacctacagcgtgttccgcggcagcgattggcacaccggtgagtacttccgtgcgcgcgattacaacagcccgcagtggctggagctgtccgcgcaggtggcggtcaacggcgtgcgtaacgcctggatgctggccgtggcgccgaacatgagcaccgcgcagattgccggttccaccgcgtcgatcgacccgatctacagcgcgttctactacgaagaaaagaaggacttccgtcgcccggtggccgcgcccggcctgtcgctggacacctggccgtactacgaaaagggcgcctacaaggtcgaccagttcgccagcgtgcgccagaacgcgcgtcgccagcgccacatcgaccagtcgatcagcttcaacttctatgtgcccagcaccatccgtgcgagcacgttgctggatctgcacatgaccgcctggcgtgaaggcttgaagaccacgtactacgtgcgttccaacgatatcgacatcagtgaatgtgagtggtgttcgagc

SEQ ID NO: 39206 - DNA, 1035 bp, Xanthomonas campestris
gcaacaccgcttgagcgcatcaagatcctggagccgcgtcaccccaaccgctccaccgccatcatcaatggccagacctccggcatcctcaactggaacgacattccgtacccgtccttttatcgggcgtacaaggagctgtcgaccaacttctggatccccgacgaggtggacatgaagggcgacgcgcgccagtacaacgagctctcggcgcgcgagaaaaatgcctatgactcgatcatcggcttgctggccacgctggattcgccgcagacgcgtttcatctacaacgtcgccgaatacatcaccgacccggccgcgcatgccaatgccgcgatcatcggccagcaggaagtgatccataacgagagctacagctacgtgctggcctccatcaccggcctggccgaccagaaccgcgtgttcgagatcgcgcgcacgcacccgaccatcatcaagcgcaatgcgccgatcatgggcgcctacgacgacttcatgcgcgacaagacggccgaaacgctgatccgcgcgctgatccagtcctcgatcctggaaggcatcaacttctattccggctttgcgtacttctacaatctggtccgccagaaccgcatgaccggcaccggcaagatcatcagcttcatcaaccgcgacgagctggcccactccaagttcatcagcgaattgatccgcgccatcatcggcgagaaccaggcgctgcagggcgaccagctcaccgattacgtgcacaaggccttcgagcacgcgatcgacctggaaacggtgtggacggccgaagtgctggacggcatcgacggcatcgacgtcgacgagatgatccgctacgtgaagtaccgcgccaacaagatggccggcatgctcggcatcgagaagctgtacgaaggcgccaacgacaacgtaatgccgtggatcaaggcctacgccgacaacttcaccgagaccaagaccgacttcttcgagatgcgcaatgcctcgtacaagaagaccaattcggataacggcttcgacgacttg

SEQ ID NO: 39207 - DNA, 927 bp, Xanthomonas campestris
ttgaattccccatctccgaccgcggcacccgccctgcgcgtgtgcgacctgcgcaagacctacgacaacggcacccaggcgctcaagggcgtgtcgctggacgttgcgcctggcgactttttcgccctgctcggccccaacggggcgggcaagtccaccctgatcggcatcatcagctcgctggtgaacctctcgcagggccaggtcgaggtgttcggcaccgatctggtccgccaccgcagcgatgcgatgcggctgatcggcctggtcccgcaggaagtgaacttcaacctgttcgaaaagcccttcgacatcctggtcaactacgccggtttctacggcatgccgcgcgagcaggctgccgccctggcggaggccgagctgcgccgcgcgcatctgtgggaaaaggcgcaggtgatgagccgcacgctctccggcggcatgaagcgccgcctgatgatcgctcgcgccatgatgacccagccgcggctgctgatcctggacgagcccaccgccggtgtggacatcgagatccgccgcgacatgtggcgcgtgctcaaggagatcaatgccgccggcaccacgatcatcctgaccacccactacctggaagaggccgagcacctgtgccgcaacctggccatcatcaaccacggccagatcgtcacccagggcccgatgcgcgagctgctggccaagctcgacgtggaaggcttcctgttcgatatcgatggtgagttgccggcgcagcttccggtgatcgaaggcaccacgctcaccgcaatcgacggccatacgctggatctggacatgccgcgcgcgatggacctcaaccgcgtgttcgctaccctgggcgatgccggcatccgggtgcgctcgatgcgcaccaagagcaaccggctggaagaattgttcgtccgtctgacc

SEQ ID NO: 39208 - DNA, 753 bp, Xanthomonas campestris
ttccccctcaagcttgtcgacaggcgcatgctcgcgcccaccgtggcccactgccagttcctgcgtgatgacgggcagccgctggatttccagcccgggcagttcattcagatccatttccagtacgccgatggcaccgatgccaagcgcagctattcgctggcgaccatccacgaccacgcgctgggaccgggcgaggcggtggagatcgcggtgagcttcgtgcccggcggctcggccaccgcgctgttcgaaggcctggagattggcgaccagctgcaggccagcggcccctacggcaagttctgcctgctgccgggcgaccacaaccggcgctacctgctgatcgccaccggcaccggggtgacgccgtatcgctcgatgctgccgctgctggccgaggcaatcgccagccgtggtctggaggtggtgctgctgcaaggcgcacgcacgcccgccgagctgctgtacggcgatgatttccgcgcgtttgccgatgcgcatccgcagttccgctacgtgccgtgcttctcgcgcgagttgcccgaacacccgcatgccgacgtacggcatggttacgtgcagcaacatctggccgagttcttaccgacggccgatggcgacatcgcctacctgtgcggcaacccggacatggtggacacctgcgcggtggcgctgcgcgaggcaggcctgccgaatgcacagatccgccgcgagaaatacgtgagcgcgtcaccgcccaagcctgcggcc

SEQ ID NO: 39209 - DNA, 747 bp, Xanthomonas campestris
ccacgccacggaggcgcacgcatgatcgtcgtcgacagtttgcacaagtcgttcaagaccaagaccggcctggttaaggcggtcaacggggtcagcttcaacgccgccgatggccagatcaccggcttgctcggccccaatggcgccggcaagaccaccaccttgcgcatgctctacaccttgatgacgcccgaccagggcagcgtccgcgtggatggcgtcgatgccgcgcacgacccggtcgcggtgcgccgcgcgctgggcgtgttgccggatgcgcgcggcgtgtacaagcgcttgagcgcacgcgagaacatcgcctacttcggccaattgcatggcatgtcgcgcacgcagatcgccgagcgcacgcgcctgctgtcacatgcactggacatggacgacatcctggaccggcagaccgaaggtttcagccagggccagcgcaccaagaccgccattgcacgcgcgctggtgcacgacccgcgcaacgtcatcctggacgaacccaccaacgggctggacgtgatgaccacgcgcgcgatgcgcggcttcctgcagcaactgcgcgccgaagggcgctgcgtgatcttctccagccacatcatgcaagaggtggcggcgctgtgcgatcgcatcgtcatcattgccaagggcaccgtggtggctgccggcaccgccgatgaactgcgcgcggccactggcgaagacaacctggaagacgccttcgtcaaggcgatcggttcg

SEQ ID NO: 39210 - DNA, 825 bp, Xanthomonas campestris
atgagcctcgccatcctgtgcccagggcagggcggccaacacgccggcatgttcgcgcgcatcgcgcagctgcccgtggcctccgaggtgatcgccaccgctgccagcgtgcttggcgccgatcccatcgcactcgctgccgatccgcgtcgcttcgacaacgccattgcgcaaccgctggtctgcgccggcacgttggcgcattggcaggcattgcgtgcgcagttgcccaccccaaccctggtgctcggctacagcgtgggcgagcttaccgcgcacgcggtggccggcagcatcgatatccctacctgcctgcacctcgcggccacccgcgcacgggtgatggatgccgccagcccggcagacgccggcctgatggccgtggtcggcctgccgatcaccgccttggacgcgctctgccagagccatggcgtggccctagcgatcatcaacggcgacgaccatgccgtgctcggcgggccgcgcagtgcgctggccgcactgggcaacgatgcctccgcgcgcggggcccgcgtcacccacttgccggtcagcgtgccggcgcatacgcactggctgcagccggccgccgatgcgttcgccgcggtgctgcaggacagcgccgtgcgtgcgccaatgcatcgcgtgctggcagggatcgatgcgcgtgccgtcaacacgccacaggcggtggtgagcagcctgtctgcgcagatcgcgcgcaccgtgcgctggcatgacgtgctggtgcaggccgcggaacgtggcgcgcgggtgtttctcgaacttggcccgggcagcgcgttggcacgcatggcgcgtgag

SEQ ID NO: 39211 - DNA, 2284 bp, Xanthomonas campestris
atgttcagcaaagacctagagcaaaccatcggccagtgctacaagcgagcccgtgaggcgcggcatgaattcatgaccgtcgaacacctgctgctctcgctgctggacaacccctccgcgcaagccgtcttgaaggcctgcggtgcggaccaggtgcgtctgcacactgacctggaacaggcgatcgaggcctcggtctcgcgcctggccgaggacgatggccgcgacacgcagcccaccctgggcttccagcgcgtgctgcaacgcgccgtctaccacgtgcagtcctccggcaagaaggaggtcaccggcgccaatgtgttggtggcgatcttcggcgaaaaagactcacatgcggtgtacttcctgaatcagcaggacatcacccgcctggatatcgtcaattacctctcccacggcatcgccaagctgggtgaagacggcgagcagccgtccgcctccgatggtgagcccaagagcgatgcgggcgagggcgaaggcaagggcgatgccttggccgagtacgccaccaacctgaacgatcatgcccgcaacggcaagatcgacccgctcgtcgggcgtgcggacgagatcgaacgcaccatccaggtcctgtgccgccgccgcaagaacaacccgctgtacgtgggcgaggccggcgtgggcaagaccgcgatcgccgaaggcctggccaagcgcatcgtcgatgccgacgtgccggaagtgctggctgacgcggtgatcttctcgctcgacctcggcgcactggtcgctggcaccaagtaccgcggcgacttcgaaaagcgtctcaagggcgtgctgacggcgctgaagaaggtgccgaacgcggtgctgttcatcgacgagatccacaccatcatcggtgcgggctcggcgtcgggcggcaccatggacgcctccaacctgatcaagccggccctggcgtcgggcgagctgcgctgcatcggctcgaccacgttccaggaataccgcggcatcttcgagaaggaccgtgccctggcacgccgcttccagaagatcgacattgtcgagccgaccgtcggtgaaaccttcgaaatcctgcagggcctcaagcccaagtacgaagcgcatcacggcgtgacctatgccgacgacgcgttgcaggcggcggtggatctgtcggtcaagcacatcggcgaccgtctgctgccggacaaggcgatcgacgtgatcgacgaagccggtgcgcgccagcgtctgttgcccgaagggcagcgcaaggagctcatcgacatcgaggagatcgagaccatcgtggcccaagatggcgcgtattccggccaagcaggtcagcgcgaccgacaaggacgtgctgcagcatctggaacgcaatctcaagatggtgatcttcgggcagaacccggcgatcgaaacgctggctggctcgatcaagctggcgcgctcgggcctggccaatccggagaagccgatcggcaacttcctgttcgctggcccgaccggtgtgggcaagaccgaggtcaccaagcagctcgcgctgcaattgggcatcgagctggtgcggttcgacatgtccgagtacatggaagcgcattcgatcagccgtctgatcggtgcgcctccgggctatgtcggtttcgatcagggcggtctgctgaccgaaaagatcgtcaagacgccgcactgcgtgctgctgctggacgaggtggagaaggcgcatccggacatcttcaacatcctgttgcaggtcatggaccgcggcatcctcaccgataccaacgggcgcgaagcgaacttcaagaacgtgatcctggtgatgacgaccaacgccggtgccacgcaggcctcgcgtcgttcgatcggtttcaccaagcaggatcattccaccgatgcgatggaatcgatccgccgcggtttcacgccggagttccgcaaccgtctggatgcgatcgtgcagttccagccgctgggctttgaccacatcctgcgggtggtggacaagttcatcatcgagctggaaatgctgttgcaggaaaagcacgtgtcgctgtcggccacgccgaccgcgcgcgactggctggcccagcatggcttcgatccgctgatgggtgcgcgcccgatgtcgcgcgtgatccaggagaagatcaagcgcccgctggccgacgagttgctgttcggcaagctggtggaaggtggccgcgtcaatatcgacgtcaaggatggcgagctggtggtcgaagcgcatccggaaccggagcgcctgttgccggctacggttgattga

SEQ ID NO: 39212 - DNA, 1185 bp, Xanthomonas campestris
attcaagaagcctacatcgttgccgccacgcgtacgccggtgggcaaggcgccgaagggcgtgttccgcaatacccgtcccgacgacatgctggcgcacgtgttgcgcacagtggtggcgcaggcgccgggcatcgatctgtcgcggatcgacgatgccatcatcggctgcgccatgcccgagggcgagcaaggcatgaacgtggcgcgtatcggcgtgctgctggccggcctgccgaataccgtggccggtcagaccatcaaccgcttctgttcgtccggcatccaggccgtggcgatggcggccgaccagatccgtctgggcaatgccgacctgatgctggccggcggcaccgagtcgatgtcgatggtgccgatgatgggcaacaaggtcgcgatgtcgccgaatgtgttcgccgacgaccacgtggcgattgcctatggcatgggcatcaccgccgagaaggtcgccgaggaatggaaggtctcgcgcgaagatcaggatgcgttcgcgctggcctcgcaccagaaagccatcgcggccattgcggctggcgagttccgcgacgaaatcactccgtacgaaatcctgtcgcatcagcccgacctggccggcaacgtgattgcgctgcgcaagcgtctggtcgacaccgatgaaggcccgcgtccggacagctcgctcgaaggtttggccaagctgcgtccggtgttccgtaacggccagttcggcggcagcgtcactgccggtaattcctcgcagatgagcgatggtgccggcgcagtgctgctggcctccgagcaggcaatcaaggattacggcctgaccccgctggcacggtttgtgagcttctcggtggccggtgtgcgcccggaagtgatgggtatcggcccgatcgcggcgattcccaaggcgctcaagcaagccggcctgaccaaggaccagatcgactggatcgaactcaacgaagccttcgccgcgcaggcactggccgtgatccgcgacagcgaactggatccgtccaaggtcaacccgctgggcggcgcgatcgccctcggccatccgctgggcgcgaccggcgcgatccgtgccgcaacgctggtgcacggcttgcgccgccgccagcagaagtacggcatggtcaccatgtgcatcggcaccggcatgggcgcggcgggcatcatcgaa

SEQ ID NO: 39213 - DNA, 423 bp, Xanthomonas campestris
atggcgctggagcgcaccctgtccatcatcaagcccgacgccgtcgccaagaacgtcatcggtgaaatctacagccgcttcgagaaggctggcctgaaggtcgtggccgccaagtacaagcagctgtcgcgccgcgaagccgaaggcttctatgccgtgcaccgcgagcgtccgttcttcaacgcgctggtcgagttcatgatctccggcccggtgatgatacaggcgctggaaggcgagaatgccgtggccgcacaccgcgacctgctgggcgccaccaacccgaaggacgccgcaccgggcaccatccgtgccgacttcgctgattcgatcgatgccaacgccgcccacggctcggattcggtcgagaacgctgccaacgaagtcgcgtatttctttgctgcaactgaagtggtctcgcgc

SEQ ID NO: 39214 - DNA, 816 bp, Xanthomonas campestris
aagcatcgccctctccaccagcaggtcattgtcatcaccggtgcctccagcggcatcggcctgtgtaccgcgctgaccgccgccgaagcaggcgccagtgtcgtcctggttgcgcgcagtgctggtgtgctgcaggaagtggccgacctgctcaccgcgcagggacaccaggccatcgccgtggtcgccgacgtcaccgaaccggcgcagctgcaacacgccgcagacacggcaatcgcacgcttcggccgcatcgacacctgggtcaacaatgccggcgtggcgatcttcggcctgttacaggacgtagacgatcacgacagccggcgcatgttcgatatcaatttctggggcgtggtctatggctcgcgcatcgcgctcccgcacctggccgcaagcggcggcgcattgatcaacatcggcagcgaagcctcggaggccgtggtcccctggcaaggcatgtattcggcatccaagcatgcggtgaaaggcttcaccgacagcctgcgcatcgagatcgaaggcctggccaaacagccggtgtcggtggtgctgattcaacccaccgcggtggacacgccttatccgcagcatgcgcgcaactacatgcaagcagaaccgcaactaccgccgccgctgatcgaaccgatgcgcgttgccaacgccatcctgcatgcggccgaacacggcggccgcgacgtcaaggtgggcgcgatggccaatgcaaatatcaccgtgacccggctgatgccgcgcgtggcggatgcactctccgccatgcggtccaagacccaacaacaggatcgcgctgccgtc

SEQ ID NO: 39215 - DNA, 768 bp, Xanthomonas campestris
attgcgacctacaacgtcaatggcatcgccagccgcctgccgcacctgctgcaatggctgcaacgcgagcagccggatatcgtggggctgcaggaattgaaatccacgcaggaggcatttccggaacaggcgatccgcgatgcgggctacggggtgatctggcagggccagcggtcctggaacggcgtggcactgctggcacgtggcgcggagccggtagagatccggcgcggcctgccgtgggatccggcggacacgcagagccgctatctggaggccgccatccacggggtgatcgtgggttgcctgtacctaccgaatggcaacccgcaacccgggccgaagttcgactacaaattgaagtggttccagcgcctgcttcggcatgcggccacgctggtggcgctgccacatccggttgcgttgatcggcgacttcaatgtggtgcccaccgatgcgcacatctatgaccccaagggctggcgcaaggacgcattgctgcagccggagagccgcgccgcgtacgcgcagttgctggcgcagggctggaccgacagcctgcaggccatccacggcgatgcaccggtctacacgttctgggactactttcgtcagcacttcgcgcgtgaccgcgggctgcgcatcgatcatctcttgctcaatcgcacgttggcggcggggctacgcgatgccggggtcgacaagtgggtgcgtgcgctggagaaggccagcgatcatgcgccgccctggatcacggtggatgtgccg

SEQ ID NO: 39216 - DNA, 2721 bp, Xanthomonas campestris
tcgccgatgcatcgcaccacgcgctccacctgctgttactgcggggttggctgtggcgtgttgatccacagcacgcacgatgacgccggcgagcgcatcgtcggcatcgaaggcgacccgctgcatccggccaatcacgggcgcctgtgcagcaagggcctggcgttgccgcagaccgctgccagccagcagggccgcgtgctggcgccggagctgcgccgccaccgcgacgcatcgcgcacggcggtgagctgggatcaggccttgactcacgtcaccggcaaactggctgcaatcatcgaccagcacggcccggatgcggtggcgttctatgtctccgggcagctactgaccgaggactattacgtcttcaacaagctcgccaaggggctgttgggcaccaacaacatcgacaccaactcgcggctgtgcatgtccagcgcggtcaccggctacaagctcgccctcggcgccgatggcccgcccacctgctatgaggatctggagctggcgcagacggtgctgtttgccggcagcaacatggcctacgcgcatccggtgctgttccgccggctggaagacgcgcgcgcgcgcaaccccgagattcgctggatcgtgatcgatccccgtcgtaccgacaccgcggccatggccgacctgcaccttgccatcgaacccggcactgacgtcgcattgttcaacggcatgctgcatcacctgatctgggagggtctggtagatgcgcgtttcgtggcggcgcagaccgaagacttcgatgccctcaagcacatgctgcgcgaatacacaccgcgcatgagcgccgagatctgcggaatctcgcacgaggacctggtgcaggcggccgagtggttcgggcgcagcccggctgcgttgtcgctgtattgcatgggcttgaaccagtcggcgcacggcaccgacaagaacctggcgctgatcaacctgcacctggccaccggccagatcggcaagccgggcgccgggccgttttcgttgaccggtcagcccaatgcgatgggcgggcgcgaagtgggcggcatggcaacgatgctggccgcgcaccgcgagatcggcaatgcgcaggatcgcgcggaagtggagcgcgcctggggcgtgccggccgggcgcatcagcagcacgccgggcgcaccggcggtgcaattgttcgagcgcctgcgcgcgggcacgctcaaggcggtgtggatcgtgtgcaccaaccccgtgcattcgatgcccgatatcgccggcgtgcgcgcggcgctggagcaggccgaactggtgatcgtgcaggacgcgttctcgggcaccgacaccgtgccttacgccgacgtgctgctgccggccgccagctggggcgagaaggacggcaccgtcaccaactccgagcgctgcatcacccgcgtgcgcaaggcagtggaaccgcccggccaggcacgtgcggactggtggattgcgcgcgaggtggcacgccggctggaagcgcgcctggccccgcagaagggcgccggcctgttcgcgttcgacacgccggcgcagatcttcgatgagcaccgcgcgttgacggtagggcgcgacctggatatcggcggcctggaccacgccgcactggatgcacgcgggccgcagcagtggccattcccggcgggtgccacgcaaggccaagcgcggcgttacaccgatggcgtgtttgcaacccccaacggacgtgcgcgcttccatgccacgccgtaccgcaaggttgccgagcccacctcggcacgctttccgatgcgcttgctgaccggccgcttgcgcgatcagtggcatggcatgtcacgcagtggtcgcgtgcccggtgcgtttgcgcatagccccgaaccggcattgcgcatgcatccggacgatgccgtgcgccgtggcctgcaagcgggcgaactggtgcgtgtggccagcaagcgcggcgcgctggtgctgccgttggaactgtccgacgagctgcgctcgggtacggtgtttgcggccatgcactggagcgcgcagacgctggccagcggcggcatcaacgaagtcagcacgccggccgtggacacacgctcgcagcagcccgagctcaagcacgcggccgtgcgcgtggaaaaggctgcattcggctggcatctgctggcggcacgccgcggcgatgcgctggccctgcagcaagccttgcagccgttgctgcgcgattgcggctatgccggcctgcgcctgcatgccgagccgggcggcgatgccggcgggcagtgggcagtgttgcatgcggcttgcgagcgcgcgccgtcagcggagtggatcgaccggttggtggccgcgttgcagttaccggccggtgccgacgtgctcgaataccgcgacctgcgccgcgggctgatgcgccgggtgggctggcggctgcaggacgggcacagccatatcgatggcgtgctgctcactgcggcgcaacccagcgcggccaatcagtcgctgctggacacggccttgcgcgggcagccgtggcgcggcgcgcgcctggccgtgtttgcgcagacccagggtgcgccggccgatccgattgtgtgcacctgcatgcacgtgtccagcgccgcgattcatgccgccatcgacgacggcgccgacctggcgcagctcaagcaacggctgggctgcggcacggtgtgtggctcctgcgttccacaactcacccggctg

SEQ ID NO: 39217 - DNA, 4140 bp, Xanthomonas campestris
tcttattcgttcaccgaaaagaagcgtatccgcaaggacttcggcaagcagcgctcgattctcgaagtgccgttcctgcttgccatccaggtggattcctaccgcgaattcctgcaggaagacgtggagcccaacaagcgcaaggacctcggtctgcacgcggctctgaagtcggtgttcccgatttccagctacagcggcaacgccgcgctggaatacgttggttacaagttgggcgagcccgtgtttgacgagcgtgaatgccgtcagcgcggcatgagctatggcgcgccgctgcgcgtgaccgtgcgcctggtgatctacgaccgcgagtcgtcgaccaaggccatcaagtacgtgaaggagcaggaggtctatctcggcgaaattccgctgatgaccgaaaacggcaccttcatcgtcaacggtaccgagcgcgtgatcgtctcgcagctgcaccgttcgccgggtgtgttcttcgaccacgaccgtggcaagacccacagctcgggcaagctgctgtacagcgcccgcatcattccgtaccgcggttcctggctggacttcgagttcgacccgaaggatgcgctgttcacccgtatcgaccgtcgccgcaagctgccggtctcgatcctgctgcgtgcgcttggctacaacaacgaagagatgttggccgagttcttcgagatcaacacgttccacatcaatcccgatgaaggcgtgcagctggagctggtgccggagcgtctgcgtggcgaaacgctgaacttcgacctggccgatggcgacaaggtcatcgtggaagccggcaagcgcatcaccgcgcgtcacgtcaagcagctggaagccgccggcgttgccgcgctggccgtgccggacgactacctggtcggccgcatcctgtcgcacgacgtggtcgatggctcgaccggcgagctgctggccaatgccaacgacgaaatcagcgaagaccagctggctgcgttccgcaaggccggcgtcgatgccgtgggcaccttgtgggtgaacgacctggatcgtggcccgtacctgtccaacaccttgcgtatcgacccgaccaagacgcagctggaagcgctggtcgagatctaccgcatgatgcgtccgggcgagccgccgaccaaggaagctgcgcagaacctgttccacaatctgttcttcaccttcgagcgctatgacctgtccacggtcggccggatgaagttcaaccgccgtgtcggccgcaaggaagtgctgggcgagtcggtgctgtacgacaagaagtactttgccgagcgtaacgacgaagaatccaagcgtctggtcgccgagcacgccgacacctccgacatcctggaagtgatcaaggtgctgaccgagatccgcaacggtcgcggcgtggtcgatgacatcgatcacctgggcaaccgtcgcgtgcgttcggtcggcgaaatggccgagaacgtgttccgcgtgggcctggtccgcgtcgagcgcgcggtcaaggagcgtctgtcgatggcggagtcggaaggtctgaccccgcaggaactgatcaacgccaagccagtggctgctgcgatcaaggagttcttcggctcctcgcagctgtcgcagttcatggaccagaacaacccgctgtcggaagtgacgcacaagcgtcgcgtctccgcgctgggcccgggcggtctgacccgcgagcgcgccggcttcgaagtgcgcgacgtgcatccgacccattacggccgcgtctgcaccatcgaaacaccggaaggcccgaacatcggcctgatcaactcgctggccgtgttcgcccgcaccaaccagtacggcttccttgagacgccgtaccgtaaggtgctggacggcaaggtctccgacgacgtcgagtacctgtcggcgatcgaagaaaacgagtacgtgatcgcacaggcgaatgcgctgaccgacgccaagaacatgctcaccgagcagttcgtgccgtgccggttccagggcgagtcgctgctcaagccgccggctgaagtgcacttcatggacgtctcgccgatgcagaccgtgtcggtcgccgcggcgttggtgccgttcctggagcacgatgacgcgaaccgcgcactgatgggcgccaacatgcagcgccaggccgtgccgaccctgcgttcgcagaagccgctggtgggtaccggtatcgagcgtgcggttgcgcgcgactcgggcgtgaccgtgaatgcccgccgtggtggtgtgatcgaacagatcgacgccgcacgcatcgtggtcaaggtcaacgaggcagaaattggcggcggcaccgatgccggcgtggatatctacaacctgatcaagtacacccgctccaaccagaacacctgcatcaaccagcgtccgctggtgaacgtgggtgacgtgatcgcgcgcggcgacgtgctggccgacggcccgtccaccgacatcggtgaactggcgctgggtcagaacatgctgatcgccttcatgccctggaacggctacaacttcgaagactccatcctgctctccgagcgcgtggtggaagaggatcgttacaccacgatccacatcgaagaactgacctgcgttgcgcgtgacaccaagctggggccggaggaaatttccgccgacatcccgaacgtgtccgagcaggcgttgaaccgtctggatgaaagcggcgttgtgtacatcggtgcagaagtgcgcgccggcgacatcatggtcggcaaggtcacgccgaagggcgagagccagctgaccccggaagaaaagctgctgcgtgcgatcttcggtgagaaggcctccgacgtgaaggacagctcgctgcgcgtgcccccgggcatggacggcaccgtcatcgacgtgcaggtcttcacccgcgacggcatcgagaaggacaagcgtgcgcgccagatcgaggaatccgagatcaagcgcgtcaagaaggacttcgacgaccagttccgcatccttgaagcggccatctacgcacggttgaggtcccagatcgtgggcaaggtcgccaatggcggtccgaacctgaagaagggcgacaacgtcaccgacgcgtacctggacggcctgaagaagtccgactggttccagctgcgcatgaaggacgacgacgcagccgatgcgatcgaacgcgcgcagaagcagatccaggcgcacgagaaggaattcgaagcacgcttcgccgacaagcgcggcaagatcacccagggcgatgacctcgcaccgggcgtgctgaagatggtcaaggtgttcctggcagtgaagcgccgcatccagccaggcgacaagatggcaggccgccacggcaacaagggtgtggtctccaacgtcgtgcctgtcgaggacatgccgtacatggccaccggcgagccggtcgacatcgtgctgaacccgctgggcgtgccgtcgcgtatgaacatcggccagatcctggaagtgcatctgggctgggcagccaagggcctgggtcgcaagatccagcgcatgctggaagcccagaccgcagtcagcgagctgcgcaagttcctcgacgacatctacaaccacgacagcgcgatcaatgccgagcgcgtggacctgtcgcagttcagcgatgaggaattgctcaacctgggcaagaacctgatcgatggcgtgccgatggccaccccggtgttcgacggtgccagcgaagcggaaatcaagcgcatgctggaactggccgaactgccgcagagcggtcagacccagctgtacgacggtcgtacaggcgaagcgttcgatcgcaagaccacggttggctacatgcattacctgaagttgaaccacttggtcgacgacaagatgcatgcccgctcgaccggcccgtactcgctcgttacccagcagccgctgggcggcaaggcgcagttcggtggtcagcgcttcggtgagatggaagtctgggcgctggaagcctacggcgcggcctacaccctgcaggaaatgctgacggtgaagtccgacgacgtgcagggccgcaaccagatgtacaagaacatcgtcgatggtgagcacgagatggtcgcgggcatgccggaatccttcaacgtgttggtgaaggaaatccgctcgctggcgatcaacatggaactggaa

SEQ ID NO: 39218 - DNA, 822 bp, Xanthomonas campestris
atgccattgatgaagttcaaacccacctctcccggccgtcgttccgccgtgcgcgtggttactcccgatctgcacaagggcgcgccgcatgcggcactgctcgactcgcagagcaagtccggtggtcgtaaccaccatggccgcatcaccgtgcgtcacgtcggtggtggccacaagcagcactaccgcatcatcgacttcaagcgcaacaaggaaggcattccggcgcgtgtggagcggattgaatacgatccgaaccgtaccgctcatatcgccctgctgtgctatgtcgacggcgagcgccgctacatcatcgcccccaagggcctgaaggcgggtgaccaggtcatcgccggtgccaacgcaccgatcaagaccggtaacgcgctgccgctgcgcaacatcccggtcggtacgacggtccacggtatcgagctgaagccgggtaagggcgctcagatcgcacgtgcagccggtgcagccgtccagctggtcgctcgcgaaggcatctatgccacgctgcgtctgcgctcgggcgaaatgcgcaaggtgccggtcgagtgccgcgccaccatcggcgaagtcggcaacgacgagcacaacctcgagaagctgggcaaggccggcgccaagcgtcggcgcggtgttcgcccgaccgttcgcggtgcggccatgaacgcgaacgatcacccgcacggtggtggtgaggccaaggctggccagggtaatccgcatccggtcaccccgtggggtgttccgaccaagggttacaagacgcgcaagaacaagcgcacccagcaattcatcgtccgcgatcgtagg

SEQ ID NO: 39219 - DNA, 1431 bp, Xanthomonas campestris
cggcccgcgcaagttgttctgatgggtccggctgcggccggcgtctgcgatcttctggagtacacgatgtccgcttcttcccactcgaccgaccaccagccggacgcctggtcgccgcaaagctggcgccaacgcacggcgctgcagatgccgacctatccggatgcggcggcgttggagcacacgctcgatgagctgcgccaattgccgccgttggtgacgtcgtgggaaatcttcgcgctcaagcgccagctggccgaagcgcaggagggcaagcgcttcctgctgcagggcggcgactgcgcggagaacttcagcgattgcgaatcgggcaccatctccaatcgcctgaaggtgctgctgcaaatgagcctggtgctggtgcatggcttgcgcctgccggtggtgcgggtgggccggtttgcaggccagtacgccaagccgcgttcggccgataccgagacgcgcgatggcgtaacgctgccgagctaccgcggtgatgtgatcaacgcgccggccttcaccgaagccgcgcgcgtgcccgatccgcgccgcatgatcaccgcgcattcgcgctcggcgatgacgatgaatttcgtgcgggcgctgatcgatggcggcttcgccgacctgcatcatcccgaatactggaatctgcagtgggtgggttattcgccgctggcagccgactaccagaagatggtgtcctcgatcggcgatgcggtgcgcttcatggagacgttgtcgggagcggaggtctacaacctcaatcgcatcgacttctacacctcgcacgaggctttgctgctgccctacgaagaaggtctgacccggcaggtgccgcgccaatggggttggttcaacctcagtacgcattacccgtggatcggcatgcgcaccgcggcgctcgatggcgcgcatgtggaatatctgcgcggcgtgcgtaacccgatcgcgatcaaggtggggccgtcggtgcagccggatcagttgctgcgtttgatggatgtgctcaatcccgaagacgagccaggccgcctgagcttcattcaccgcatgggcgccgcacagattgccgagaaattgccgccgctgctggatgcggtcaagcgcgacggccggcgcgtgctgtgggtgtgcgatgcgatgcatggcaataccgaaagcaccggcaacggctacaagacgcggcggttcgacaacatccgtagcgaggtggaactgtcgttcgacctgcacgccgccgcaggcacgcgtcttggcggggtgcatctggaactgaccggcgaagatgtcaccgagtgcaccggtggcgcgcgtgagctgaccgaacgcgacctcgagcgtgcgtaccggtccagcgtggatccgcgcctgaattacgagcagtcgctggagatcgccatggcgatcgtacgcaaacagcaacag

SEQ ID NO: 39220 - DNA, 990 bp, Xanthomonas campestris
aaacaccccatgaaagcacccgttcgtgttgctgtgaccggcgctgccggccagatcggctatgccctgctgttccgcattgcctccggcgaaatgctgggcaaggaccagccggtgatcctgcagttgctggaactgtccaacgaaaaagcccaggccgcgctcaagggcgtgatgatggagctggaagactgcgcgttcccgctgctggccggtatggtcggcaccgacgacgccgaagtggcgttcaaggacatcgacgtcgccctgctggtcggtgcgcgtccgcgcggcccgggcatggagcgcaaggacctgctgctggagaacgccaagatcttcaccgcgcagggcgctgccctgaacaaggtcgccaagcgtgacgtcaaggtgctggtggtcggtaacccggccaacaccaatgcctacatcgcgatgaagtcggcgccggatctgaacccgaagaacttcaccgccatgctgcgcctggaccacaaccgtgcgctgagccagctctcgctcaagctcggcaagccggtcggcggcatcgagaagctggtggtgtggggcaaccacagcccgaccatgtacccggattaccgtttcgccacctccgatggcgcgtccatcggcgatgcgatcaacgaccaggaatggaacgccggcaccttcatcccgaccgtgggcaagcgcggcgcggcgatcatcgaagcgcgcgggctgtcgtcggccgcatcggctgccaatgccgccatcgatcacgtgcgtgactgggtgctgggcagcaatggcaagtgggtcaccatgggcgtgccgtccgacggttcctacggcattccggaaggcgtgatcttcggcttcccggtcacgaccgagaacggccagtacaccctggtcaaggatctgccgatcgacgacttcagccagaagtacatcgacaagaccctggccgagctggaagaagagcgcagcggcgtgtcgcatctgctg

SEQ ID NO: 39221 - DNA, 609 bp, Xanthomonas campestris
atgaagctgtatacaaagccgggcgcctgctcgctcgcagatcacatcgtattgcgctggtccggcctgccgttcgagctcactgtggtcgacgcggccacgatgaagtcgcctgactatctacgcctgaatccggccggcgcggtgccgctgctggtggtcgaccaatgggcactgacccagaatgcggcgatcctcaactatatcgccgacaccgcaccgctgaccggcctgggtggcgacggcaccgcgcgtagccgcgccgagatcaatcgctggatcgccttcgtcaacgccgatctgcatccgaccttcaagccgctcttcggcagcacggcgtatctgcaggaagacgcgctgatccagcgcagccacgaggatgcgcgcaccaaactgcgcacgctctacacgcgtgtggatgcgcatctgcagggccgcaattggttagccggcgacacgcataccggcgccgatgcctacctgttcgtcaccttgcgctgggcgcacaaggccggcgtggacctgtccggcctgagcgcgctcgatgcgttcttccagcgcatgttggcagatgcagacgtacaagccgcactgcaagccgaaggcttg

SEQ ID NO: 39222 - DNA, 1482 bp, Xanthomonas campestris
ccccctttgtaagcgagccctgcaatgagcgaatccgtcccacgcgtttccctgttgatcgatggcgccctggttgtctctgccaccacgcactggcaggacgtggtcaacccggccgaccagagcgtgctggcccaggtgccctttgccacaccggccgaggtggacgcggccgtggccgccgcgcagcaggccttcgtgggctggcgcaagacgccgatcggaacccgcgcgcgcatctttctcaaataccagcagctgattcgcgaacacatgcctgagctggccgccatcctcagcgccgagcagggcaagaccctggccgatgccgaaggcgatgtgttccgcggcctggaagtggtggaacacgccgcggcgatcggcaacctgcagctgggcgagctggccaacaacgtcgccaatggcgtggacacctacaccttgctgcagccgctaggtgtgtgcgccggcattaccccgttcaacttcccggccatgattccgctgtggatgtttccgatggccatcgccaccggcaataccttcgtgctcaagccttccgagcaagacccgatggtgaccatgcgcctggttgagcttgcgctggaagcaggcatccccaagggcgtgctcaacgtggtgcacggcggcgaagaagtggtcaacgcgctgtgcgatcaccccgacatcaaggcgctgtcgttcgtgggctccaccaaggtgggcacgcatgtgtatcgacgtgcctcgctggccggcaaacgcgtgcaatgcatgatgggcgccaagaatcacgcggtggtgctgccggacgccaatcaggagcagaccctcaatgcgatggtcggcgcggccttcggtgcggccggccagcgctgcatggccgcctccacgctggtgctggtgggcgaggcacggcagtggattccggcgctggtggccaaggccaggggcttgaaactgggcgccggcagcacgccgggcaccgatgtggggccgctgatttcctgcgcggcgcgcgagcgcgtcgaaggcctgatcgcctcgggcgtggcgcagggcgccaccctggaactggatggacgcacgccgcaagtgcctggtcttgagcacggcaattttgtcggccccaccattttctccggcgtcaccccgggcatgcgcatctatgacgaagaaatcttcgggccggtgctggtgatcctggaagcggccacgctggaagaggccatcgcgctggtcaatgccaaccccaatggcaacggcaccgcgctgtttacgcagtccggtgcggccgcgcggcgcttccaggaagatatcgacgtgggccaggtcggcatcaacgtgccgatcccggtgccggtgccgctgttctcctttaccggctcgcgtgcttccaagctcggcgacctggggccgtacggcaagcaggtggtgatgttctacacgcagaccaagaccatcaccgcgcgctggttcgac

SEQ ID NO: 39223 - DNA, 1122 bp, Xanthomonas campestris
gatttgaacgacgaacagcaggccttccgcgccgccgcgcgcgacttcgccgacaaggaactggcaccgcacgccgcgcgctgggacgcggaaagccacttcccgcgcgaagccatcggcaaggcggccgagctgggcttctgcggcctgtacaccgacgaaggcgttggcggcctgggcatgcggcgcctggacgcggccatcgtgttcgaggagctggccacggtcgatccgtccacttccgccttcatcaccatccacaacatggccacctggttgattgccagctacggcaatgacggcgtgcgtgcgcagtggggcgaggcgatgaccagcggtgccaagctgggctcgtactgcctgaccgagccggggagtggctcggacgcggcctcgttgaagacccgcgcccagcgcgacggcgacgactacgtgctcaacggcagcaaggccttcatttccggcgcgggcgccaccgatgtgctggtggtgatggcacgcaccggtgaagacggcgcacgcggcatcagtgcattcgtggtggcggccgatgcaccgggcatcagctacggccgcaaggaagaaaagatgggctggaatagccagcccacacgtggcatcaccttcaccgatgtgcgcattcccgccggcaacctgctcggcaaggaaggcgaggggttcaagatggcgatgaaggcgctggacggtggccggatcaatatcgccgcctgctcgctgggcgccgcgcaaggcgcactggatgcggcgcgccgctacatgggcgagcgccggcagttcggcaaaaagttggccgatttccaggcgctgcaattcaagctggccgacatggccacgcaactggtggccgcacgccagatggtgcacaccgcggcgcgcaagctcgacgccggcagccacgacgcaacggtgtggtgcgccatggccaagcgctttgccaccgacgccggctttgcgatctgcgacgaggcgctgcagatccacggcggctatggctatatccgcgaatacccgatcgagcgcctgctgcgcgacagccgcgtgcatcgcatcctggaaggcaccaacgaggtgatgcgcatgatcatcgcgcgccacctgctc

SEQ ID NO: 39224 - DNA, 555 bp, Xanthomonas campestris
ctgatgtccacgctcaccatttcccaggccctggcccaagccgatctgttggtcgaccgccctgccatcgacgccgccgtcgccaccatcgccgatgcgatcgcgcgcgactacgctggcgaagtgccggtgtatctcaccatcatgcacggcgcgctgccgttctccggccagttggcgctggagctgggcgcgcgcggccaggacctgcagttcgactatctgcacgccacccgctaccgcggcgaaaccaccggcggcgagctggtctggaagcaccgcccggccactgcgctgttcggccgccgggtgatcctggtcgacgacatcctcgatgagggctacaccctgcagggcgtgcgccagtggtgcctggagcagggcgccaccgatgtgcgcgtggcggtgttgaccgtcaagcgccatgaccgctgcgtgccgggcgttaccgccgactacgtgggcgtggaagtggccgaccgctacgtgttcggcttcggcatggacgtcaacgagcagctgcgcggcattcctgccatctatgcgatgaagcag

SEQ ID NO: 39225 - DNA, 1173 bp, Xanthomonas campestris
atgtccgacatcgtcatcgttgctgcaaaacgcactgccatcggatcgtttcttggccagttcaatggcgtccccgcccccacgcttgctgctgccgccattgaaggcgcgctggcgcagtcgggcgttgccgcggccgatgtctccgaagtgatcgtcggctgcgtgttgcccgccaacctgggccaggcgcctgcgcgccaggccgccattgcggccggcatcccgacctcgaccggcgccaccaccatcaacaaggtgtgcggttcgggcatgaaggcaatcatgttcggccacgacctgatcaaggccggttcggccagcatcgtggtggccggcggcatggagtcgatgagcaacgcgccgcatctgctgccgaactcgcgcaccggcaaccgctacggcaattttcaggcggtggaccacatggcgtgggacggtctgaccaatccctacgatggccaggcgatgggcgtgttcggcgaagccactgccgagaagttcggcttctcgcgcgccgatcaggatgcctatgccatcgcctcggtagaacgtgcacaggctgcgcaacgcaacggcgcatttgccgatgaaatcgtgccggtgaaagtcgccacccgcaaaggcgagatcgtcgtggatagcgacgagcagcccggcaaatccgacgtggccaagatccccaccttgaaggcggcgttcaagaaggacggcactgtcaccgccgctagctcgtcgagcatttccgatggcgccgcaatcaccgtgctgatggcggccgatgaggcgcagcgccgcggtatcacaccgctggcgcgcatcgtaggccatgtcacccattcgcaggcaccggaatggttcaccaccgcgccagtggccgcgatccagtcgctggtcggcaagatcggctggacgctggacgacgtggacctgtttgaaatcaatgaagcgttcgccgtggtggcgatgacaccgatcaaggaattgggaattgcacacgagaaggtcaacgtgcacggcggtgcctgcgcgctcggccacccgatcggtgcatccggtgcacgcttggtggtgacattggtgaatgcgttgcgcagccgcggcggcaagcgcggaatcgcgacgctatgcatcggcggcggcgaagcaactgccattgctatcgaattgatt

SEQ ID NO: 39226 - DNA, 903 bp, Xanthomonas campestris
atgagcattgctgcgttctggcacggcgtgttgccggccatcactaccccgttcaccgccaacggcgacatcgaccacgacttcctggccaagcatgccaatcagctggtggacgccggctgcaccgcgatcgtgccgctgggttcgttgggcgaagccgccaccttgagcgtggacgacaagctcgccatcctcaagacgttggtaacggccttgcagggccgcgtgccggtggtgccgggcatcgccagcctggccacgggcgaggcggtggcattggcaaaggcggcaaaggaactgggctgcggcgggctgatggtgttgccgccgtacgtgtattccaccgactggcgcgagatgggcgcgcatgtgcgtgcggtgatcgcggccaccgatctgccggtgatcctctacaacaacccggtggcctacaagaccgatttcggcccggcacagatcgccgagctggcggccgaattccccaatctgcaggcagtaaaggaatcttccggcgatgtgcgccgcttcgccgcgctgcaggaattgctgggcgatcgtctggcgctgctggtcggcatggacgacgccatcgtcgaaggcctgagcatgggcgccaaggggtggatcgccgggctggtcaatgcatatccgaaggagtcggtacgcctgttcgaactggcacgcgacggcggttaccccgccgccaaggaactgtacgactggttcctgccgctgctgcgcctggataccgtgcccaagttcgtgcagctgatcaaactggtgcaggaaaaggtgggcctgggcagcgagcgtgtccgtgcgccacgcctggtggtggacggtgccgagcgcgaggcagcgctgaaggtgatcgaccacgccatcgccaccgcgcccagcctg

SEQ ID NO: 39227 - DNA, 1961 bp, Xanthomonas campestris
ctgaaccggtttgcttgccgggccttcgcatggggaggacaatatggcttcagcacattgacacgatgatgatcgactccacccgctatccgcgcctgtcgcgcatccagactcccgacgatctgcgtaccttcgaggaggccgacctcaccgcggtcgccgacgaactgcgtgcctacctgatcgaatcggtgggcaagagcggcggccatttcgccgcgggtctgggggtgatcgaactcaccgtcgccctgcactatctataccagacgccggtcgaccaactggtgtgggacgtgggccatcagacctacccgcacaagatcctgaccgggcgccgggaccagatccacacggtcaagcagaaggacggcgtggcgccgttcccaaagcgcgaggagagcgtgtacgacaccttcggtgttgggcattcgtcgacctcgatctccgccgcgctcggcatggcgatcgccgcgcagcgcaatggcgacgaccgcaaggtggtcgcggtgatcggcgatggcgcgatgaccgccggcatggtctacgaggcgctcaaccacgccggcggcatggacccggaacccaacctgctggtgatcctcaacgacaaccgcatgtcgatttccgaggcagtgggcgggctgaccaagatgctcggccgtgccagcggcagccgcacgctcaacgcgatccgcgagggcggcaagaagatcctcggcgacaagaagaacaaccccaccgcgcgcttcgtgcgccgctgggaagaacactggaaaggcatgttcgtgccgtccacgttgttcgaggaaatgggcttccactacaccggcccgatcgatggccacgacctgcccagcctggtcggcgcgctgaagaccttgaagaccttgaagggtccgcagctgctgcacgtgatcaccaccaagggcaagggctacgagctcgccgaaggcgaccagattggttaccacgcggtcggcccgttcgacccgagcaagggcctggtggccaaggccggcgccaagaaaccgacctacaccgatgtcttcagcgactgggtgtgcgacatggcggcggccgatcccaagatgctggtgatcaccccggcaatgcgcgaaggctccggcctggtgcgcttcagcaaggaatatccgcagcgctatttcgatgtcgcgattgccgagcaacacgcggtcaccctggccgccggcatggcaacgcaaggtgccaagccggtggtggcgatttattcgaccttcctgcaacgcggttacgaccagctggtgcacgacgtagcggtgcagaaactggatgtgctgttcgcgatcgatcgcggcggcgtggtcggcccggacggcgccacccacgctggcaacctggacctgagcttcctgcgctgcgtaccgcacatggtggtgatggcgccggccgatgaagccgagtgccgccagatgctcaccaccggtctgcgttatgagggcccggccgcggtgcgttatccgcgtggcaccggccccggcaccgcactggatgcttccttgaccaccctgccgatcggcaaggcgcagctacgtcacagcggcgcacgcatcgcactgctcggcttcggcgccacggtggatgccgctgaagcggtcggccgcgagttgggcctgaccgtggtgaacatgcgtttcgtcaaaccgctcgacaaggcgatgctgctggagctggccaagtgccacgaagcctttgtcagcatcgaagacaacgtggtggccggcggcgcaggctcgggcgtctccgagctgctcaatgccgaaagcgtgctgatgccgatgctgcacctgggcctgccggacagcttccagcaccacgccagccgcgaagacctgctcgcagaagccggaatcgaccaggccggcatccgcgccgccgtgctcaagcgctggccgcagctgatggcaaagggccagcaa

SEQ ID NO: 39228 - DNA, 1305 bp, Xanthomonas campestris
atgcatgctgcccgcggtgacgaaaggagagggcggcgcgcgagtttcagtgccaccccggtgtcggacgttattgcgaaaaccgcagcgcgcccaacatgtgccctggctcgccacgcatgcgcccgcgcggccaggtgggcgatgccagtctcgacccgcaccaagtgccgccatccccatcccatcgctacggatggcgctgtgctcgccgtgcaagccccacgactgcgccaacattgcgcaggcagctgggtctgcctggccggccacggtatgctgcgcgccttcaccaacgaggcggatctgttgaacgcattgccgctgcgcatcctgggcaccgggtgccacgttcccgccacggaagtgacgtcgcaagaactggacgcacgctggcagttgccgccgggaaccacgttcgcgcggctgggcgtcgccacgcgccactatgcaggcgagggcgaaacggcctcgtccatgggcgccgccgccgcgcaagcggcattggtcagcgccggtatcgatagcggcgagatcgactgcctgatctccgcctgcagcgtgatggagcagccgatcccgtgccaggcagtgctgatccagcgtgccctggggctgggtgactctggcatcccggcattcgatgtcaacgccacctgcctgagttttctggtcgcattggacatggccacaaacgcgctggccctgggccgctatcgccgcgtgctcatcgtctccagcgaagtggcgtcgggcgggctggatgcggcggtgccatcgaccgccggcttgttcggcgatggcgctgccgccgtggtggtcgggcgcagcgcgccggacgaagactcggcgctgctgtccagccgcctggccagctacggcagcggtgccgagctgtgccgcatccgcggtggcggcagccgctatccgcgtggcgaagacaccacgcccgaagccacgcgggtcttcaccatggatgggcgcggtgcgtatcgctttgcggcgcgccacctgccggcgttctgggaccagctgctgcgcgacgccggtaccgagaccaccgcactgcgctgcctgatcccgcatcaagcctccggtggcggcctggatcatgtggtgcaggcgctcggcctgcgcccggagcaggtggtgcgcatcctgcacgcgcatggcaaccaggtggcggcatcgctgccacacgcgctgcatcaggccagggtcacgcagcagctgcagcgcggcgaactattcgcgatgctcggcaccggtgccggcctgtcgatcggcggcatggtgttgaggtac

SEQ ID NO: 39229 - DNA, 1005 bp, Xanthomonas campestris
atgagtgagattcaatccctgaccgcgcaggcgttggccgatgttgctgccgcgcacacgccggaccagctggaaacgctgcgcgtcgcgctgctgggcaagaacggcagcatcaccgcccagctcaagcagctcggcacgttgccggccgaccagcgcaaggcggctggcgaggcgatcaatctggcgcgcgatgcgctgaccacggcgctttccgagcgcaaacaggtgctcgaaaccgcagcgctggacgcccgtctggaaggtgagcgcatcgatgtgacgctgcccggccgacgcggtgagcgcggcggtctgcatccggtgacgcggaccctggagcgcatcgtcgagatctttgcgcggctgggttacgagttgtccgacggcccggagatcgaggacgactggcacaacttcgaagcgttgaacttcccgccgcatcatccggcgcgtgccatgcacgacacgttctacttcggcgatggccgcctgctgcgcacgcatacctccggcgtgcaggtgcgttacatggataccgcagtggccaccaagagtggcccgccgctgcgcatgattgcggccggcaaggtgtatcgctccgattcggatcagacccactcgccgatgttccatcaggtcgaaggtctgctggtggacgagcattccaacttcgccgatctcaagggcaccttgtccgagttcgtgcgtgcgttcttcgagcgcgatttcgaaatgcgcttccggcccagctatttcccgttcgttgagcctggtgcggaagtggatatcgcctggcagcagcccgatggcagcacccggtggctggaagtgcttggctgcggcatggtgcacccgaacgtgctgcgcagcgtcggcatcgatccggagcgctacaccggcttcgccttcggtctgggcgtcgagcgctttgcgatgctgcgctatggcgtcaacgacctgcgtgccttcttcgaaaacgacgtgcggtttctcaggcagttt

SEQ ID NO: 39230 - DNA, 2016 bp, Xanthomonas campestris
ccgctgcactacccgcagttcgacaagatcaaggacagcgacttcgcgcctgccttcgacgccggcatggccgcgcagttgaaggaagtggacgcgatcgccaaccagaaggccaagccgaccttcgacaacaccatcatcgcgctggaaaagagcggcgccacgctggatcgcgccaccacggtgttcttcaacctggtgggcgccgacaccaacgatgcgcgcaagaaactgcaggccgactactcggccaagtttgccgcgcaccgcgatgcgatttcgctcaacggcaagctgttcgcgcgcatccagaccctgtacgaccagcgcagcaagctcggcctggatgcgcagggcgtgcgcctggtcgagaagtactacagcgatttcgtgcgcgatggcgccaagctgtctgacgccgacaagaccacgctcaaggccatgaacgccgagctggccaacctgggcaccaccttcagccagaacgtgctggccgaggtcaacgccgcggccgtggtggtggatgacgtcaagcagctcgatggcttgtctgacgagcagatcgccgccgctgccgaagcggcgaaggcacgcaagctcgacggcaaatacgtgatcgccctgctcaacaccaccggccagccgccgctgacccagctcaagaaccgcgagctgcgcaagaagatctacgccgcctcggtgtcgcgtggcagccatggcggccagtacgacaacaccgccctggtctcgcgcatcatgaccctgcgtgccaacaaggccaagctgctgggattccccacgtacgctgcgtattcgcttgaaaaccagactgccaagacgcctgaagcggtcaacgcgatgctcggcaaactggcaccggccgcggtggccaacgccaagcgcgaagccgccgacctgcaggcgatgatcgacaaggaacaaaaggccgcgcgcaagcccaccttcaagctcgaagcctgggattgggcctactacagcgagaaagtgcgccaggccaagtacaacttcgacgagtcgcagctcaagccgtatttcgagctgaagaacgtgctggaaaacggcgtgttctatgcggccaaccaggaatacggcctgaccttcaagcagcgcaccgacctgcccacctaccgcgacgacatcaccgtctatgacgtgttcgacgccgacggcaagcagctggcgatcttcattgccgacatgtatgcgcgcgaatccaagcgcggtggcgcctggatgaattcctacgtctcgcagtcagagctgaccggtttcaagccggtggtggccaaccacctcaacatccccaagccgccggccggccagccaacgctgctgacctgggatgaagtgaccaccatgttccatgagttcggccatgccttgcacggcatgttctcagacgtgaaatacccgtatttctccggcaccagcgtgccgcgcgactttgtcgagttcccctcgcaggtcaacgagatgtgggccgacgagccgtcgatcctgaagaactatgccaagcattatcagaacggcacgccgatgccgcaggcattgctggacaaggtgattgccgcgtccaagttcaaccagggctttgccaccaccgagtatctgggtgcggccatgctcgaccagaactggcaccagatcagcgccaaccaggtgccggacgccgcaggcgtgatggcgttcgaagccaaggcgctggccgatgacggcatcgcctatccgcccgtgccgccgcgctacaagaccccgtatttcagccacatcatgggcggctatgcggccggctactacgcctatatctggtccgaagtgctggatgccaacacgcagcagtggttcaagcagcacggcggattgagccgcgccaacggcgaccgcttccgtcagaccctgctttcgcgcggcggtagcgtggatgcgatggagctgttccagaacttcgccgggcatgcgccgcagatcgagcccttgctggagaagcgcggcctc

SEQ ID NO: 39231 - DNA, 1916 bp, Xanthomonas campestris
ccaacacccccagcgcacgcggcccccggcacactatgcccatgtcagcatcccgacccggcgccagcgcgcccgccccccgtaccggccccaccctgcgcgagcgcttcgatgcgctgcgcaacctgccgcccttcctgcgccagatctggcagaccagccgctggttgagcgccagcagcatcggcctgcgcgtgctgcgcgcgctgatgccgatcgccacgttgtacatcggcaagctgatcatcgacgaggcgatccacttggtgggccaaccgccggcattcgattcgttgacgcaggcattggccagcggccgactcaaccggctactggagttgctggcgctggaactggcgctggcaatcggctcggacctgctcggccgcctggtcggctacgccgatgccttgctgtcggagttgttcaacaacgcggccagcgtgcggctgatggaacatgccgcgcagctggatcttgaggattttgaagaccccgaccggcaggacaagctggatcgcgcacgccgccagaccatgaaccgcatgaacctgatgagccagttgttcggccaggtgcaggatgctatcaccgtggccagcctggcggttggcctgctggtgtatgcgccctggttgatcgtgctgctggccattgcgttgattccggccttcatcggcgaggcgcatttcaacgcgctgggctactcgctcaacttccagtggaccccggagcgccgccagctcgactacctgcgccaggtcggtgccagcgtcgaaaccgccaaggaagtgaagatcctcaacctgcaccggtttctgattacgcgctaccgccggctggccgacaagttcttccaggccaatcgcgcgctggcacgcaagcgcgcgctatggggcgcgctgctggcggcgctgggcacgctgggctattacgcggcctatggctacatcgcctggcgcacggtgcgcggcgatttcagcatcggcgatctgacctttctggccggcagcttcctgcgcctgcgccaattactggagggcctgttgatcgggttttcgcaggtcgccgggcaagccttgtatctggacgatctgtattcgttcttcaacatcgtgccggagatccgctcgcgcccgaacgcgctgccggtgccgcggccaattcgccagggcttcgtgttcgaggacgtgggcttccggtacccagaggccgaacactggacgatgcggcatctgaatttcgagctgcgcgccggcgaagtgctggcgctggtcggcgaaaacggcgccggcaaaaccaccttggtgaaactgctggcgcggctgtacgacccggacgaaggccgcatcctgctcgacggccgcgacctgcgcgattacgacctggacgatgtgcgcgccaacctgggcgtgatcttccaggacttcgtgcgctaccacctgagcattggcgagaacatcggcgtgggccaggtggatgcgatggacgacactgatcgcatccgcaccgccgcgcaacgcgcgatggccaccgagctgatcgacagcctgcccgatggctacaaccagctggtggggcggcgtttcaagaacagcgtggacctgtcgggcgggcagtggcagaagatcgccatcgcgcgcgcctacatgcgcgatgcgcagctgatgatcctggacgagcccaccgccgcactggatgcgcgcagcgagttcgaggtgttccagcgtttcaaggaactatcagacaaccgcaccgcggtgctgatctcgcaccgtttttccagcgtacgcatggccgaccgcatcctggtactggccgatggccgcatcgaagcaagcgggacccacgccgaactgatggcacaaggcgggcgctatgcggagttgtttgagctgcaggcggcggggtatcgg

SEQ ID NO: 39232 - DNA, 609 bp, Xanthomonas campestris
ctttaccacgcccccagcaccgccgccctggtcgtgcactggatgttgatcgaactgcaggtgccgcacgtgctgcatccactggacttcgaccggcgcgagcaaaaatcccccgcgtatctcgcgctcaacccggccggcgtggtgccgaccctggtgctggagggccaggtgctgaccgaagcggcggccatcgtgttgcacctggccgacctgcatccgcaggcgggcttggcaccgccgccggggacgccggcacgtgcggcgtactaccagtggatgttcttctgcgccaacaccttgcagcctgcgtatcgcgcctggttctacccggacgagccggccggtgctcagcaggctgatgccgcgcaagcgcaggcccggcggaagctggaggcggcctgggcgcaagtggacgcgcacctgcaggcgcacggcccgtatctgctgggcgacacgctgtcggcggccgatttcctgctgaccatgctgatgcgctggtcgcgcaatatgcccaaacccacggatacctggcccgccttgcacgcgcatgcccagcggatgaaggcgcggcctgccttccgggagacctaccggcgcgagggcctg

SEQ ID NO: 39233 - DNA, 1128 bp, Xanthomonas campestris
ccacctcggccagcacccatgtccaagcaccgtacccgtcccctaatgctgatcgccctggccgctgcgccgttggcgcatgggcaggaaatcgctccgcagccggcatcgccgcaggcctgtacctccgtgacttcggatgccgcgcgtctggcgtgctacgaccaggcgctgggatataccccgcaggccgtgcaggaggcagatgccgccgcgcagttggccaagcaggccgccaaatcggaagacacccgcaagatcagccgcatgggcgatttcttccgcgccgacggccaggaccagccgaaggaagaagcggtcgccaatgccggccgcggctcgctgctggatcgccgctgggagctggccaaggattccaagctgggcaccttccagctacgcggctacaagccggtctacctgctgccggcattctggaccagcgacaccaaccgcacgccgcagtcgccgaacccagccaactcggtcagcacgccacagcaactggacagcgccgagttgaagttccagctgagcttcaagaccaaggtggttgaggatctgttcggcgacaacggcgatatctggatgggctatacccagagctcgcgctggcaggcctataactccgatgcctcgcgcccgttccgcgagaccaattacgagccggaagcgatgctggtgtttcgcaacaactacagcatcttcggctggaaaggccgcatgagcggcatcagcatcaatcacatgtccaacggccgcgaagacccgctgtcgcgttcctggaaccgggtgatcctcaacatcggcctggatcgcgaaaactgggcgctgaccttgcgcccgtggttccgtatcaaggaagaccgtgccgacgacaataatccggatattgaggattacatgggccgcggcgacgccaccctggtctataacaaggatggccacgaattcgccttgattgcccggcattcgctgcgtggcggcgaccgctcgcacggctcggtgcaactggattacggcttcccgatcaccaacctgttgcgcggccacgtgcaggtgttcgatggctacggcgagagcctgatcgactacaaccacaaggccacctatgtgggcgtgggcgtg

SEQ ID NO: 39234 - DNA, 1113 bp, Xanthomonas campestris
cctgatgacttgttcgacgtgcgtgcgcagctcagcgatgacgaacgcgcggtgcaggatgcggtggcacgtttcaccgatgcgcgggtgctgcccggcatcggcgaggcattcgacgccgtgcgcttcccgcgcgaactggtccccgagctggcagcgctgggcttgctgggtgccagcctgccggtgagcgagggcggcgccggcctgggcgcggtggcgtacgggctgatctgccaggagctggagcgcggcgatagcggcctgcgcagctttgtcagcgtgcaatcgtcgctgtgcatgtatcccatccatgcctatggcagcgacgcacaacggcgccagtggctgccggagatggcggccgggcgggtgatcggctgtttcggcctgagcgaggcgcaaggtggttcggacccggcggcgatgaccacgcgcgcggtgcgcgacggtgacggttggcggctgcgtggcgccaagatgtggatcaccaacggcagcatcgcggacctggcaatcatctgggcacataccgacgacggcgtgcgtggctttctggtggacacacgcagcgagggtttccgtgcgcaggacatcggccacaagatgagtctgcgcgcctcggtcacctcggcggtgttcctggacgatgtcttcgtgcccgagcagcaacgcttgccggatgcactgggattgaaggcgccgctgggctgcctgagccaggcgcgcttcggcatcgcctggggcgcgatcggggcggcggtcgcctgcctacgcgaggcgctggcttacagcggcgagcgcattctgttcgggcggcccctggcggccacgcaaagcgcgcagatcaagctggccgacatggcgcgccggatcgccaccgcgcagctgctggcgctgcaactagggcggctgaaggaggccggcacgctgcgcccggaacagatctcgctggcgaagtggaataattgccgcatggcactggatgtggcgcgcgagtgccgcgacctgcttggggcggcggggatcaccaccgagcacgtggcgatccggcatgcgctgaatctggaatcggtgattacctgcgagggcaccgaaaccgtgcatcgcttt

SEQ ID NO: 39235 - DNA, 1974 bp, Xanthomonas campestris
aagcggccctcttccgacaagttgatcgcaagtgagggtgccatggctgatgtttatcccgtcgatcccgcgttcgccgctgatgcgcgcattacgcgcgagcagtacgcaacgctgtaccgcgaatcgatcgaacaccccgagcagttctggggcaaggccgcgcagcggctggactggttcaagcaacccacccagatcaaggacgtcagcttcgcgctggacgacttccacgtgcgctggttcggcgacggcgaactcaatgccagcgtcaactgcctggaccgccagctggccacccgcggcgacaagaccgcgctgctgttcgaacccgacagcccggattcgccgtcctacccggtcacctaccgcgagctctatgagcgcgtgtgcaagctgggcaacgcgctgcgcaacctgggcgtcaagaagggcgaccgggtcaccatctatctgccgatgatcgtcgatgcggccgtggcgatgctcgcctgcgcgcgcatcggtgcggtgcactcggtggtgtttggcggctttgcggccaactccatcgccgaccgcgtgatcgactgccagagcaagctgatcatcaccgccgacgaaggcctgcgcggcggcaagaagatcccgctcaaggcgaacgtggacgcggcgctgaagatccccggcaccaacacggtcgaaaccgtgctggtggtgcgccacaccggcggtgcagtggacatgcaggccccgcgcgaccgctggttccatgacgtggtcgatggccagccggccgagtgcgaacccgagcgcatgaacgcggaagacccgttgttcatcctctacacctccgggtccacaggcaagcccaagggcgtgctgcacaccaccgccggctacctgctgtttgccagctatacgcatgaagtggtgttcgacctgcgcgaggacgacatctactggtgcaccgccgacgtgggctgggttaccggccacagctacatcgtctacggcccgctggccaacggcgccaccgcggtgatgttcgaaggcgtgccgaattaccccaacgtctcgcgtttctgggaagtgatcgacaagcaccaggtcaccatcttctacaccgcgcccaccgccatccgcgcgttgatgcgcgaaggcgaagcaccggtcaagaagacctcgcgcagcagcctgcgcctgctcggcagcgttggcgagccgatcaatcccgaagcctggcgctggtactacgaggtggtcggcgacagccgctgcccgatcgtggacacctggtggcagaccgaaaccggcggcatcctgatctcgccgctggccggcgcagtggacctcaagcccggctcggccaccctgccgttcttcggcgtgcagccggccctggtcgatgccgaaggcaagatcctggaaggcgccaccgagggcaacctggtgctgctggattcgtggccgggccagatgcgcaccgtctacggcgaccaccagcgcttcatcgacacctacttccgcacctacccgggcagctacttcaccggtgatggctgccgccgcgacaccgatggctactactggatcaccggccgcgtggacgacgtgatcaacgtctccggccaccgcatcggcaccgccgaggtggaaagcgcgttggtgtcgcacccgaaggtggccgaagcggccgtggtcggcttcccgcacgacgtcaagggccagggcatctacgcctacgtgaccctgatcgccggcgagacgcccagcgaagagctgcacaaggaactggtgagctgggtgcgcaaggagatcggcccgatcgcctcgccggaccatctgcaatgggccccgggcctgccgaagacccgctcgggcaagatcatgcgccgcatcctgcgcaagatcgccgaaaacgccccggatcagctgggcgatacctccacgctggccgatccatcggtggtggattcgctggtcaatgagcgg

SEQ ID NO: 39236 - DNA, 771 bp, Xanthomonas campestris
atgaagattgcctcctggaacgtcaactcgctcaacgtgcgcctgccgcacctgcaacagtggctggccgattttgcgccggacgtggtgggcatccaggaaaccaagctggaagaccacaagttcccggatgcggcactggccgcgctgggctaccgcagcgtgttctgcgggcagaagacctacaacggcgtggcgatcctgtcgcgctcgccggcgctggaggtgcagatgggcatccccgggttcgatgacgtccagcagcgcgtcatcgccgccaccgtcgatggcgtgcgcatcatcaatctgtatgtggtcaacggccaggacgtgggcaccgacaagtacgcctacaagctgcgctggctcgaggcggtgcacgactggatcgcgcaggagctgcagcgccacccgcagctggtggtgctgggcgacttcaacatcgccccggacgcgcgcgacgtgtacgagccggaggtgtggagcgacaaccacatcctcacctccaccgccgagcgcggcgcactgcacaagctgttggcgctgggcctgcacgatgcctttcgcctgcatcacgacgatgccggccacttcagctggtgggattaccgccaggccgcctaccgccgcaacctggggctgcgcatcgacctgacattggtgtcggatgcgctgcgcgcccgcgcggtggaggcgggcatcgaccgcgaaccgcgcacctgggagcgccccagcgaccacgcaccggcgtgggtgcggctggccgaggca

SEQ ID NO: 39237 - DNA, 798 bp, Xanthomonas campestris
gtggtatcggtgcatgtggaaaaccgcattgcgtgggtaaagtttgcgcggccggacaagcgcaacgcgatgagcccggcgctcaatcgccgcatgctggacgtgctggacgagctggaattcgacgacaacgtcggcgtgctggtgcttggtggcgaaggtaccgcgtggtcggccggcatggacctgaaggaatactttcgcgagaccgaagcacaaggcctgcgcggcgtgcgccgatcgcaacgcgaatcctatggctggttccgccggctgcgctggtaccaaaaacccaccatcgccatggtcaacgggtggtgtttcggcggcggcttcggcccgttgttcgcctgcgacctggccatcgccgccgacgaggcgcaattcggcctgtcggaaatcaactggggcatcctgcccggtggcggcgtcaccaaggtggcggtggaattgctctccatgcgcgatgcgatgtggatgacgctcaccggcgaactggtcgacggcaggaaggccgccgaatggcgcctggtcaacgaaagcgtgccgttggaacggttggaaacacgtacgcgcgaagtggccgagttgctgctcaagaaaaatccggtagcgctgaaatatgccaaggatgcggtgcgtcgcgtcggcaccatgacctacgacgaagccgaagactatctggtacgcatgcaggaagcggccaactcgttcgacaacaacgcgcgcaaggaaggcatccgtcagttcatcgatgaaaagcgttacaagcccggtctgggtgcgtacgagccggac

SEQ ID NO: 39238 - DNA, 1383 bp, Xanthomonas campestris
ccgtggggtttattcatcgatggtcagtggcgcgccagcaccggcagccagacgctggatgtcatcgcgccgcacaccgaagaacgcctgctgcgctacaccgaaccatcgcatgccgacaccgaggccgcggttgccgcggcgcgcagagccttcgatagtggcccctggccgcagctgccgccgccagaacgcggcgccgcgctgaagcgcattgccgagcatttgcgggcgcgcatgccggaactggcagatgcatggaccgcgcaggtcggcgccgtcatcggtttcagtcggcgcgcctccaagcaggcgccggatctgttcgactactacggcgacctgatcaccacccacccgttcgtcgagccacgcacgcgctccagcggcgggcgcgtgcatgtggtacaggaaccggtcggcgtggtcgtcgccatcacgccgtggaatgcgccgttggtgctgctctgctacaaggtcgccgccgcgctggcggccggctgcacggtggttgccaagccgtctccggaaacgccgatcgacgcctatattctggccgaatgcatcagcgccgccgggctgccggatggcgtgttcaatctgctaccggccgggcgcgaggtgggtgaacagctgatccggcacccttcggtggacaaggtgagcttcaccggctccacccaggcagggcgatcgatcggtgtggcctgcgccgagcgcctggcgcgcgtcgggctggagctgggcggcaagtcggcggcgatcgtgctggaggatgccgacatcgagaaagtgctgcccagcctggtgccctactcgatgccgatcaccggccaggtgtgtttcgcgctcacccgcgtactggtccccgcgcatcggcgcgaggccatcctgcacgcgtattgctcggcgctggccacgctcaaactcggcgacccgtttgccgccgacacgggcatgggcccgctggcactcggccgccagttggaacgtgtgcaaggctacatcgcccagggcagcgccgaaggcgcaaagctggtcatgggcggcgggcggccagagcacttgccacgcggtttctttcttgagccgaccgtgtttgcaggtgtgacgccggagatgaccattgcccgcgaagaaatcttcggccccgtcgtgagttttatcgactatcacaacgaagaagatctgatcgccaaagtcaacgacagcgattacggcctgcatggcaccgtctatagcgacgatcccgaacgcgcctacgcgattgcgcgacgcgtgcggagcggcagccattcgatcaacggcatgtgcgtggatatcgagatgccgttcggtggtgtcaaacactccggcatcggccgcgaaggtggcatcgaaggc

SEQ ID NO: 39239 - DNA, 1419 bp, Xanthomonas campestris
ccgcagcggcttgctgcccgcgacctgctgctgcaacaggaatggacctacgccgaactggacgacctgatcggtcgcctggctgccgtgctgcagacacgcggctgtgtcgacggcgaacggcttgcggtgctggcgcgcaattcggtctggcaggttgcgttgcattttgcctgtgcgcgggttggtgcaatctacgtaccgctcaactggcggctgagtggcactgagctggatgccttgttgcagcgtgcagagcctcgcttgctgctgggcgacgatgtcgctgccggacgcgcgcaggtggaaggcttcgcccgcttcatcgacaacgccaagcagcttgcacctgccgaaacaccctacattccgcccgatcgggtcagcctgatcctgttcacctccggcacgtccggccagcccaagggcgtgatgttgagcgaacagaacctgcaacaggtcgcgcacaacttcggcgtcaccacacgggtggaagcgcacagcagttttctgtgcgaggcgccgatgtttcatatcatcggcctggctaccaacgtgcgcccggtgctggcaatgggcggctcgatccaggtctccaatggcttcgagcccaaacgcacgctgggctggctgggcaacccggcattgggcatcacccattacgtcggcgtgccacagatgatgcaggccttccgcagccagccaggcttcgatcctgcagcgctccgtcatctcaccgcgttggtcagcggcggcgcgccgcacgccagcgaggacctgctgggctggctggaggatggcatcccgatggtctgcggcttcggcatgagcgaagccggcaccgtgttcggcatgtcggtggattgcgaggtgatccgcagcaagctcggtgcagcgggaatctcatcacccaccgtgcagacgcgggtcgtggataacgagggcaacgactgtgaggtgggcatgccgggcgaactgctgttgcgcgggcccaacctcagccccggctattggcgcgacccgcaggccactgccgagatgcgcgatggcgcgggctggttccgcaccggcgacatcgtccgacgcgatgccgatgggtttttctgggtagtcgaccgcaagaaagacatgttcatttccgggggtgaaaatgtgtatcccgcagagatcgaagccgtgctggccgaccatccagaaatccgcgagtgcgccgtggtcggcatggccgacgcgcaatggggcgaagtgggctatctggcgatcgtgccagccactgaaaccccggacctggagcggattcgcagctatctgagcgaacgcctggccaagtacaaggtacccaagcacctgcgcgtggtcgcggcgctgccacgcactgccacgggcaaactgcaaaaagcgcgcttgaaggatgcactg

SEQ ID NO: 39240 - DNA, 510 bp, Xanthomonas campestris
gtctttgccctcatgaaactctcgctcatcgtcgccttcgaccgcaaccacgccatcggccgcgacaacgatctgccgtggaagctgcccgatgacctgaagcgcttcaaggcgctgacactgggtaagccgatcctgatggggcgcaagaccgcgcagtcactgggccgtgcgctgccagggcgcctgaatctggtgctgacgcgctcggggcaggtgcctttcgagggcatgcatgcagtggtttcggtagacgaggcgatcgaacgcgcggcgcaggaaggtgcgcaggagctgtgcgtgatcgggggaggcgaggtgtaccgcctgaccatggagcgcgccgatctgctggcggtcaccgaagtggacacggctgtcgagggcgccgatacgcacttcccgccgatcgatccggcggtgtgggtgcccgcagagcgcagcgcgcatgcggcagacgcgcggcacgccttcgctttcagtttcgtggattaccagcgccgctgacgg

SEQ ID NO: 39241 - DNA, 702 bp, Xanthomonas campestris
atgaaacaactgtccttgcgcgcactgttgtgcgcactcgccattgcgtccagccccctgcaggccgccgcgccgcctgccgcgccacaggtgccggcacaggtctccaacgcggcatgggaacaggacatgcagcgcttcgtggccagcgatgcgcagcaaccgccgcccaagcacggcatcgtgttcgtcggcagttcgtcgatccgtttctgggaaacgctggcgcaggatttccccggcaagccggtgatcaaccgtggctttggcggatcggaagtgcgcgacagcacctggtacgccgaccgcatcgtgattccctacgcgccgcgccaggtggtgttgtatgccggcgacaacgacctcaacagcgggcgcagcccggagcaggtgcgcgacgatgtggtggctttcgtcacacgcatccgcagcgcacttccccaggcacgcattggctacctgtcgatcaaacccagcccgtcgcgtgcacagctgctgccggcgatcgtgcgcgccaaccagctgatcaagcaggcattggccaaggtgccgcggaccgactacatcgacatctatacgccgatgctggatgccaccggcaagccgcgcccggagctgttccgcgaggacatgctgcacatgaagccggaagggtacgcgctctggcgcaaagcggtggcgccggtgctggagcgcaagtaa

SEQ ID NO: 39242 - DNA, 453 bp, Xanthomonas campestris
agtcaccccatttacgagctgccgatcgacgtcaatcagatccagacgctgatcccgcaccgctacccgttcctgctgatcgaccgcgtcatcgagctggacctggaagccaagcgcatcgtcgggcagaagaacgtcaccatcaacgagccgttctttcaggggcacttcccgacccgtccggtgatgccgggtgtgctgatcatcgaagcgctggcgcaggccggcggcgtgatgacccagctcggcctgggccgcgatgcgctgtccaagctgttctacatggtcaaggtcgacaacgcccgcttcaacaagcaggtggtgccgggggatgtgctgatcctggaggtgcagatgaagcgcctgatccgcaacatgggatgctattacggcgaagccaaggtcaacggcgaaatcgtggccagtgccgaagtcatgtgcgccggcgccagg

SEQ ID NO: 39243 - DNA, 909 bp, Xanthomonas campestris
cccttcagtgatgtcttgcagcgcgacggtgaggtggtgctggatggcgcactggccaccgagctggaacagcgcggctgtgatctcaacgacgccttgtggtcggcacgggtgttgatggagcagccggaactgatctaccaggtgcaccgcgactacttcgccgccggtgcgcagtgcgcgatcaccgccagctaccaggccactccgcagggctttgccgcgcgcgggctgggcctggcgcagtcgcaggcgttgattgcacgcagcgtggcgctggcggcgcaggcgcgcgcggaccacctggccgcgcatccgcaggcggcgccgctatgggtggccggctcggtggggccgtatggcgcttatctggcggatggttccgaataccgcggcgactacgcgctgccggtggcgcagatgctcgacttccatcgcccgcgcatcgcggcgttggtggatgccggcgtggatctattggcctgcgaaaccttgccctcggccagtgagatcaccgcgctgcgcctgttgctggaggagttcccgcaggtgcatgcgtggttttcgttcaccctgcgcgatgccgcgcatctgagcgatggcacgccactggcgcaagtgattccggctctggacgcgtgcccgcaggtggtcgcggtgggcatcaattgcattgcgatcgagcaggtcaccgccgcgctgcagtcgctggccgcgctcaccagcttgccgctggtggtgtatccgaattccggtgagcactacgacgccagcgacaagcgctggcatgcgggaaccacagtggcgtgttcactggcgacgcaacgcgcgcaatggcatgcggccggtgcgcgtttgattggtggctgctgccgcaccacgccggccgacatcgccgcactggtggcg

SEQ ID NO: 39244 - DNA, 1380 bp, Xanthomonas campestris
gagccctcgtccaccgacgcaccgcagttccagcgcagcatgcaggtgcgccatctggtgatgctgtccctgggcggcgtgatcggcacgggattgttcttcaacaccggctacatcatcgccagcaccggtgcgctgggtacggtgctggcgtacctgatcggcgcgctggtggtgtatctggtgatgcaatgcctgggcgagctggcggtggcgatgccgcagaccggcgcgtttcatgtgtatgcggcgcgctatctggggcctgccaccggctacgtggtggcctggttgtactggctcacctggacggtggcgttggggtcgagcctcaccgctgccgcgttctgcatgcagtactggtttccgcacagcccggcgtggccgtggtgcctgctgttctgcgtgctgattttcagtttgaacatggcgtcggcacgctggtttgccgaaggcgaattctggttttcgctgatcaaggtagtgaccattgtggtgttcatcgtgctgggcggcgcggcggtggtcggctggctgccgctggccgacggcagcccggcgccgggagtgcgccatctgcgcgccgatggctggtttgcgcacggcaccgtgccgatcctgatgacaatggtggcggtgaatttcgctttctccgggaccgagctgatcggcatcgcagccggcgaaactgcacagcctgcacgcgcaatcccgctggcgatccgcaccacgttgatccgtctggtggtgctgttcgtcggcaccgtgctggtgctggccgcgttgctgccggcgcacgcggcggcggtggagaccagcccgttcgtgcgcgccttcgagctgctgggcattccgtatgccgcaggtctgctcaacgcggtgatcctcaccgcgatcctgtcggcggccaactccgggttgtatgcggcggcccgcatgctgtggtcgttggccaacgagggcaccttgccggcgcgctttgcgcggctgacccggcgtggcatcccgctgcctgcgctggtgctgagcatgcttggcgggctgctggcgctgctgaccggtgtgtacgcggccgacaccgtgttcgtggcgatttctgcagtctccgggtttgcggtggtggtggtgtggctgagcatctgtgcctcgcactattgtttccgccgccagctgctgcgtgacggcatcgcactggacagcctggcctaccgcgcgccgtggtatccgtggacgccgctgattggtggtgcgctgtgcgtgctggcctgcgcggggctggcgtttgatccgcagcagcgcattgcgctgtggtgcgggattccgttcgtggcgctgtgttacggcgcccatgcagtgacccaacggcttgcagcccggaga

SEQ ID NO: 39245 - DNA, 804 bp, Xanthomonas campestris
tggctgcgtgcgctgccgttcatcgccttgcacctggcctgctttgcggtgttctgggtcggtgtgtcgtggttcgcagtgggcatggccgtggcgctgtacgcgctgcgcatgttcgcgctgaccgggttctatcaccgctatttctcgcaccgcgcattcaagacctcgcgcgtggtgcagttcgtgttcgccgcgatcgccgccacctgcgtgcaacgtgggccgctgtggtgggccgcacaccatcgcaaccatcaccgccataccgacaccggccgtgacccgcattcgccggcacagcacggcttctggtggagccataccggctggttcctgaccccgcgcaacttccgcaccgattgggaagtgattccggatctgcgccgctttaccgagctgcgatttctggaccgcttcgacatcgtgatgccggtgctgctggcgctgggcctgtacctgctcggtgactggctggcggctgcagcgcctggcctgcagaccaatggcgcgcagttgctggtgtggggcttcgtgctgtccacggtggcgttgttccatgccaccttcaccatcaattcgctggcgcaccgcttcggcagccggcgcttcgacacccgcgacgacagccgcaacaactggctgctggcgctgctcaccttcggcgaaggctggcacaacaaccatcatttctttcccggctcggcgcgccagggcgtgcgttggtgggaatacgacatgacctggtacgggctcacggtgatgtcgtgggtgggcctggtgtgggatctcaaaccgatgccc

SEQ ID NO: 39246 - DNA, 1935 bp, Xanthomonas campestris
accaagcgctttgccggtcagctgcatctgtctgcggccgatcgtgcgcgccgttccaacgtgcgtggcaagccgaccggccgtccgggttcgtcgtcgtcgcgtcgcaacgatggtggtcgcggtagcaatcagagcaacagtggcccgcacgggttcgagcgtccgaccgcaccggtggtgcgtgaagtggcgatcggcgagaccatcaccgtcgccgatctggcgcagaagctcgcgctcaagggcggcgacgtggtcaaggcgctgttcaagatgggcgtcatggcgaccatcacccagagcatcgatcatgacaccgcggcgctggtgaccgaagagctcggccacaaggcggtgcgtgcggacaatgccgacttcgaagatgcgctgctggcgcatgccgaagacgcccagggcgaaaccacctcgcgtccgccggtggtcaccatcatgggtcacgtcgatcacggcaagacctcgctgctggattacatccgtcggaccaagattgcctctggcgaagccggcggcatcacccagcacatcggtgcgtaccacgtcgaaaccggccgtggcgtcatcagcttcctggatacgcccggccatgccgcgtttacctcgatgcgtgcgcgcggcgccaagatcaccgacatcgtggtgctggtcgttgcagccgatgacggcgtgatgccgcagaccaaggaagcggtggcgcatgccaaggcggcaggcgttccgttgatcgtggcagtcaacaagatcgacaaggccggcgcggatccgctgcgggtcaagaacgagttgctggctgaaaacgtggtggccgaagacttcggtggcgatactcagttcatcgaagtgtcggccaaggtcggtaccggtgtggacacgctgctggatgcaatttcgctgcaggcagaagtgctggaactcaaggcagtggccgatggccgcgccagcggtaccgtgatcgaatcgtcgctggacaagggccgcggcccggtcgcgacggtgctggtgcagcagggtgcgctgaagcgtggcgactacctggtgtgcggtattcaatacggccgcgtgcgtgcgttgttcgacgaaaccggccaccagccggcctctgcgggcccgtcgattccggtgcaggtgctcggcttgtccggcgtgccggaagccggcgacgacttcgtggtcgtcgacgacgagcgtctggccaaggacgtggcgcagcagcgcgaaaccaagcgccgcgaatcgcgtctggtcgcctcggccaccaaccgcatggaagacatcctggcccagatgggcaagggcgaaggccagcaggtgttgaacctggtgatcaaggccgacgtacagggttctgtggaagcgctcaagcagtcgctggtggcgttgtccaatgacgacatccgcatcaacgtgatccactccggcgtgggcggcatcaccgagtcggatgcgaattcggcagcggcctccaaggccacgatcatcggcttcaacgtgcgtgcggatgcatcggcacgcaagatcgtcgagtccaacggtatcgatctgcggtacttctcgatcatctatgacgtgatcgaccaggtgaagcaggtggcgtccggtctgctcggcgtggaaatccgcgaagagatcatcggtatcgcgcaggtccgcgatgtgttccgcagctcgaagttcggcgcggttgcaggctgcatgatcatcgaaggtgtggtgaagcgcagcaagccgatccgcgtgctccgcgacagcgtcgtggtgttcgagggcgagctggaatcgctgcgtcgcttcaaggaaaacgtcgacgaagtgcgcaacggcaccgagtgcggtattggcgtgaaggcctacaacgacgtcaaggcgggcgaccagatcgagtgcttcgagcgcatcgaagtggcgcgtacgctg

SEQ ID NO: 39247 - DNA, 1410 bp, Xanthomonas campestris
ggcgactgggttcccggtagcggcggcacgctgcagatccatgagccggccaccggcggcctgttgcacgaggtcggcaaggccgatctatccgatgtggaggccgccattgcgcaggccaagcatgcccaacgtgcctgggcaatcacctcgccgcgcgagcgtgcagcggtgttccaccgcgctgcgcaactgatggaagcgcaccgcgccgaggctaccttgctgatcgcgcgcgagaccggcggcatcatgcccaaggccgagcgtgaggtgagcgaggcgattgcctactaccagcaagcggccgggctgccgctgcaggcgatgggccaggtgctgccaaccgccgcaggccagctcagcctggccaggcatttgccgctgggcatcattgcggtgatttcgccgttcaacttcccgctgatcctgtcgctgcggtcggtggcaccggcgctggcgatgggcaatgcggtgatcctcaagccggacccgcgcacgccgtataccggcggtgtgatcatcgcccaagtgctcgaagaagccggactacccaaggggctgctgcacgtgctgcacggcggcgccgacatcggccaggccctggtcgaagcgccggacgtgccgatgattgccttcaccggctccaccgctgccgggcgccggatcggcgagctcgccggccgtcacctgaaaaaggtggcgctggaactcggtggcaataatgcagtgatcgtgctcgacgacgccgacctggagcgcgccgcatcggcaatcgccttcggtgcatacctgcatcaaggccagatctgcatggccaccggccgtgtgctggtgcaacgcggcgtggccgacgcgctgaccaaactgctggccgacaaggcacgccacctgccggtgggtgacccggtcagcggcacggtggcgctgggcccgatcatcggccagcgccagttgcagcgcgtgctggacatcgtcgatgacagcatcgacgccggcgcggtggtcgaagccggcgccacccacgacggcctgttctatgcagcgaccgtgttgtcgaacgtgcgcccgggcatgcgggtgttcgatgaggaagtgttcggcccggtgatcaacatcacggtgttcgataccgacgaagaagccgcggtactggccaatcacggcgaatacggcctggtggcaggcatcatgtcggcgtcggtgtcgcgcgccatggtgctgggcgagcaattgcacaccggcttgctgcacatcaacgaccagaccgtggccgatgaggtcatcaatccattcggtggcacgggcgcttcgggcaacggcaccagcgtgggtgggccggccgattgggagcagtacatgcactggcaatggctgacgatcaagcacgcggtgccgcagtacccgttc

SEQ ID NO: 39248 - DNA, 1491 bp, Xanthomonas campestris
atggaaaagaaatacgtccttgcgatcgaccagggcaccaccagctcgcgcgcgatgttgttcgatcgccagggcaaggtggccggcgtggcgcagcgcgaattcggccagatctttccgcagccgggctgggtggaacacaacccgcgcgagatcatgaccagcgtctacaccaccattaccgagctgctcaacaacgcgcagatcgacgcgcgcgagatctcaggcatcggcatcaccaaccagcgcgagaccgcagtggtatgggacaaggccaccggccagccgatctacaacgccatcgtctggcaatcgcggcagaccaaggacatctgcacccagctcaaagaggccggccatgagcagatggtgcgcgacaagaccgggctgctgatcgatgcgtatttttccggcaccaaggtcaagtggattctcgaccacgtggacggcgcacgtgaacgcgcacgcaagggcgagctcgccttcggcaccatcgatagctggctgatctggaacctcaccggcggcaaggtgcacgtgaccgactacaccaatgcctcgcgcaccatgatgtacaacatccacaccctggagtgggatgccgagctgctggagatgctggacgtgcccgcgcagatgctgccggaggtgcgctcctccagcgaggtctatggcatgacccagacccagtacttctacggggaacaggtacccatcgccggcattgccggcgaccagcaggccgcattgttcgggcaagcgtgctttgaaccgggcatggcgaagaacacctatggcaccggctgtttcatgctgatgaataccggcgacaaggccgtggcctccaaggccggcttgctgaccaccatcgcctggggcatcgacggcaaggtggaatacgcactggaaggcgccatcttcgtggctggctcggtggtgcagtggctgcgcgatgggctgcgcatgttcggcaaggcgagtgattcgcaagcctacgcggagcgtgccggcgacaacgacggcgtgtatttcgtcccggccttcgtgggcctgggcgcgccgtactggcgcagcgatatccgcggtgcggtgttcggcctgacccgcggcaccagcaaggaacacttcgtgcgcgcggcggtggaatcgatggcctaccagacccgcgatgtgctcaccgcgatgcagagcgattcggggatcgaactgaaggagctgcgcgccgacggtggcgcgatcgccaacgacttcatggcgcagttccaaagcgacattctcaacgtgccggtgctgcgtccggaggtggccgaaaccaccgcgctgggcgcggcctacctggcgggcctggccaccggattctggagcagccgcgaagaaatcgccaaacaatgggcggtggatcgtcgcttcgagccgaacatgcccgaagagcggcgcgaacagttgtatgccggctggcagcaggcagtggaagccacgatgggcttccgc

SEQ ID NO: 39249 - DNA, 1503 bp, Xanthomonas campestris
gcaccgatgggcgagacatacgatcttctggtaatcggcggcggcatcaacggggtcggcattgcccgtgacgcggccgggcgcggtctgtcggtgtgcctgtgcgaacaggacgacctggccgcgcataccagcagcgccagcaccaagctcatccacggtggcctgcgctatctggagcagtacgagttcgcattggtcggcaaggcgctggccgaacgcgaggtactgctgcggctagcgccgcacatcatctggccgctgcgcttcctgctgccgcatcagccgcatctgcgcccggcctggatgattcgcgccgggctgttcctgtacgaccatcttggcggcagcaagcgcagcctgccgcgctcgcgccggctgtcgctgcgcacccatccggttggccagccgctgcaggagtcgctgcgcaccggctttgtgtattccgacgcatgggtgcaggacgcgcggttggtggtgctcaacgcgatggatgcggccaagcgtggcgcgcagatccatacgcgtacgcgctgcgtcggcgcctggcgcgatgccgggttctggtacgcggagctggaaggccgcgacggacgccgccgcaccgtgcaggcgcgtgcgctcgccaatgcggccggtccgtgggcggtgtcgttcctggacaaggtggccgcggtgccgcaccagcatgcgctgcgcctggtcaagggcagccacatcgtggtgcccaagctgttcgaccacgaccacgcgtacatcttccagcaacccgatcgacgcatcgtgtttgccattccctacgagcacgacttcaccttgatcggcaccaccgacgtggactacgaggccgacccgtccgcacccaagatcgacccggccgaagtgcagtacctgtgcgatgcggtgaatctgtatttccagcagcagatcactccgcaggatgtggtgtggaactacagcggcgtgcgtccgctgctcgacgacgccgaagacaacgccgccgaagtgacccgcgactatcagctggaagtgctcaccgacggcgcaccattgctcaacgtgttcggcggcaagctcaccacctaccgcaagctcgccgaagaagccgtcgaccggctgacccaggccctgggcgcgcgcaagccggcgtggaccgcgcgtggcgaagccctgcccgggggcgaacaacgcgacatcgccagcctgctggagcgcgtgcgcactgcgcgtccctggctgccggcggccaccgcacagcggctggtgcgcaactacggcacctgtgccgagcagttgctcggcgatgcgcaggacatggctgcactcggccagcattttggtgcggacctgtaccaggccgaggtggattacctgtgcgcccgcgaatgggcgcagaccgccgacgacatcctgtggcgccgcagcaaactgggcttgcgtgtggatgccgaggggcgcgcgcgcctggaggcgtatctgcagacgcagcccgctgcgcacgcc

SEQ ID NO: 39250 - DNA, 1200 bp, Xanthomonas campestris
gaggtctatctggtggatggcattcgcacgccgatcggccgttacggcggcgcactgtccagcgtgcgcgccgacgacctgggcgcggtgccgatcgccgcgttgttggcgcggcatccacagctggacccggcggccatcgacgatgtctacctgggctgcgccaaccaggccggcgaggacaaccgcaatgtcgcgcggatgagtgtgttgctggctggtttgcccagttcggtgccgggcagcacggtgaatcgcctgtgcggctcgggactggaagcggtgggcattgcggcacgcggcatccgtgccggcgaactggagctggcagtggctgggggcgtggagtcgatgtcgcgcgcgccgtgggtgatgggcaaggcggaatcggcgttcgcccggaaccagcacctgcacgacaccacgatgggctggcgcttcatcaatccgcgcctggaagcgacctacggcgtggagctgatgggcgagaccgccgagaacgtcgcgcagcgctacgccatcagccgcgacgaccaggatgcgtttgccctgcgcagccagcagcgcaccgccgccgcgcaggccgccggcttcttcgacgacgagatcaccgcagtggcggtggccgggcgcaagggcggcgagggcgtgcaggtcatgcgcgacgaacacccgcgggccgatgccagtgccgaggccctggcgcggctcaagccggtgttccgccagccgggcacggtcacggccggcaatgcggccggcctcaatgacggtgccgccagcctgttgctggcctcggcgcgcgcgctgcacctgcacgggctcacgccacgcgcgcgggtgctggggtttgcctcggcgggcgtggagccaacctacatgggcatcggcccgatcccggccacgcaacgcctgctggcgcggctggggctgcagatcgcgcaattcgatgcgatcgaattcaacgaagccttcgccgcgcaggcgctggcctgcacgcgcgcgttcggattggccgacgatgccgcgcacgtcaatgccaatggcggtgcaatcgcgctgggccacccgctgggcatgagcggtgcacggctcgcactgacgctgctgcgtcaactcgacgcctgcaatggccgccgcggattggccagcatgtgtattggcgttggccagggcgtagcgctggcgatcgagcgtgtt

SEQ ID NO: 39251 - DNA, 1962 bp, Xanthomonas campestris
aaggtgctgatcgccaaccgcggcgaaatcgcctgccgcgtcatcgccacctgccgccggctgggcatcgccaccgtggcggtgtattcggatgccgaccgcgacgcgcgccacgtgcgtctggcagatgaagcgatccatattggtgcgtcaccggcgcagcaaagctacctgcgcggcgacgccatccttgccgcggcacgcgccagcgatgcacaggcgatccatcccggctacgggtttttatcggaaaacgccgggtttgccgacgcctgcgcgcaggcaggggtggtattcatcggcccgcccgcgcaagcgatccgcgcgatgggcgacaagagtgctgccaaggcgctgatgcagcgcgccggcgtgccgctgacgccgggctaccacggcgacgagcaggcacctgcgtttctgcgcgcacaggccgatgcgatcggctacccggtgctgatcaaggccagcgccggcggcggcggcaagggcatgcgccgcgtggatgccagcgcagcattcgaagacgcgttggccagctgtcagcgcgaagcgcaatcggcgttcggcaatgcgcatgtgctggtggaaaaatacgtcgagcgcccacggcacatcgagatccaggtgttcgccgatacccatggcgcggtggtgcatctgttcgaacgcgactgctcggtgcaacgccgccatcagaaagtgctggacgaagcccccgcacccggcatgaccgaacagcgccgcgcggcgatgggcaaggcggcagtggatgccgcacgggcggtgggctacgtgggcgccggcacggtggaattcatcgccgggccggacggcgatttttatttcatggaaatgaacacccggctgcaggtggagcaccctgtcaccgagctgatcaccggcaccgatttggtggactggcagctgcgcgtggccgccggcctgccgctgcccaagcgccaggacgaattgcgcatccatggccatgccctggaagcgcgcctgtacgcagaagatgccgaccgcggcttcctgccttccaccggcaccttgcggcaactgcgcctgccggccgcgagcgcgcacgtgcgcatcgatgccggtgtggaacagggcgacaccatcagcccgtattacgacccgatgatcgccaagctgatcgtctgggatcacgaccgccccgccgcgctggcgcgcatgcgcgacgcattggcacactgccatgcgatcggggtgaccaccaacagcgcgttcctggcgcggctggtcagcacgcaggcgtttgcgaatgccgacctggacaccgccctgatcgaacgcgagcaggcggcgctgtttcccgcgccgcagccgccgcccatggcatggtggtgcctggccgcggtgctggtggccaaagccgcaccgcacgccgccgccgacccagccgacccgttctcgccgtggcagctcgacgacggctggcgtatcggcgcacatgccgcgcgtacgctggtgctggaggccgcaggcgggcgccgcatactggcggtgcggcccaccgccgatggctggcaggtggacagtgccgatcaaacccacacgctgcgctatcacgcgcacggcgagcacctgcgtgtggacatggatggccgccaatggcgcgcgcagatactgcgcgatggcactgccatcactgtgctcagtggcgcgcagcgcgcgcatttccaacatcacgatgccctggtcgaagccgagcaaccggcgcaggccgaaggtggcctgaccgcacccatgcccggccgcgtggtcgcgctggttgcgccgctcggcgagccggtccgccgtggccaggccctggtggtgctggaagccatgaagatggagcacaccctgcatgcacctgccgacggcaccgtgcaggcctatctggtggccgaaggcgacctggtcgcagacggtgtggcgttagtggaattc

SEQ ID NO: 39252 - DNA, 1158 bp, Xanthomonas campestris
atgcatgtgccgtccttgaatttcgagcttggcgaagacatcgatctgctgcgcgaaagcgtggccgccttcgccagccaccatatcgccccgcttgccgcggcggccgatcacgacaacgtcttccccgcgcagttgtggcggctgttcggtgagcagggcctgctgggcctgaccgtggaagaagcatacggcggcagcggcatgggctacctggcgcacgtggtggcgatggaagaaatttcgcgtgccggcggtgcgatcgggctgtcctacggcgcgcactccaacctgtgcctcaaccagctgcgcaagaacgccacccacgaacagaagcagcgctacctgcccaagctgtgcaccggtgagcacgtcggcgcactggcgatgagcgaggccggttcgggctcggacgtggtgtcgatgaagctgcgcgccgaggcacgcggcgaccgctttgtactcaacggcagcaagatgtggatcaccaatggccccgatgccgacgtgctggtggtgtacgccaagaccgaccccagcgccggtgcgcgcggcatcactgccttcatcgtcgaaaagggcatgcccgggttttccaccgcgcagaagctcgacaagctcggcatgcgcggctccaacacctgcgaactggtgttcaccgattgcgaagtgccggccgaaaacgtgctgggcacgctcaacggcggcgtgcgcgtgttgatgtccgggctggatttcgaacgcgtggtgctggcgggtggaccactcggcttgatggccgcggccatggacgtggtgctgccgtacgtgcacgagcgcaagcagtttggcgagccgatcggcaccttccagctgatgcaggccaagctggccgacatgtacgtggggctcaacgcgtgccgtgcgtacgtctatgccgtggcacgcgcctgcgatgccggccgcaccacgcgccaggatgcggctggcgcgattctgtatgccgccgagaaggccacctggctcaccggccaagcgatccaggtgctgggcggcaacggctacatcaacgagtaccccaccgggcggttgtggcgcgatgccaagctgtacgagattggcgccggcacgtctgaaatccggcgcatgctgatcggccgcgagttgttcgaacgcact

SEQ ID NO: 39253 - DNA, 801 bp, Xanthomonas campestris
atgactgtccccgcatttggcctcggtacgtttcgcctcaaggaccaggttgtcatcgactcggtgcgcaacgcactggcgctggggtatcgcgccatcgataccgcacagatctacgacaacgaagcgcaggttggccaggccattgccgatgccggcgtgccgcgcgatcagctgtttgtgaccaccaagatctgggtggaccggttcagccgcgacacgctgcaacccagcctgcaggaaagcctgcgcaagctcggcaccgattatgtcgacctcaccctgatccactggccctcgcccaaggaccaggtgccgatgcgcgagtatctggaggcgctggccgatgccaaggcgcaggggctgacccgcgcgatcggtgtctccaacttcaccattgcgctcacgcgccaggcaatcgagatcctcggcgccgatgcgatcgccaccaaccagatcgaagtgcatccgtacctgcagaaccgcacgctgatcgcgttcctgcgcgagcagggcatccatgtcacctcgtacatgaccctggccgtgggcgaagtgctcaaggatccggtaatccaggcgatcgccaagcgccacgacgccacgccggcgcaggtcacgctggcctgggccctgcagcagggctattcggtaattccgtcctcgaccaagcgggcgaatctggaaagcaacctcaaggcgcagagcctgcacctgagtgagcaggacatggccgagatcgccgcgctggaccgtggcgaacgcctggccaacccgaaagcgattgcgcccgactgggac

SEQ ID NO: 39254 - DNA, 765 bp, Xanthomonas campestris
cacggcatgcacagcaccacacccatcaccctgatcaccggcggcagccgcggcctgggccgcaacgccgcacacgcactggccgccgccggccacgacatcgtgctgacctatcaccgccaggccgacgacgcggccgcagcggtggcccacatccagcaactgggccgccgcgcgcatgcgctgcaactcgataccgcagacgtgtccacgtttgccgactttgctgcgcggctcaaagacgtgctggccagttgggagcggaaccagttcgatgcgctggtcaataacgccggcaccggcttgcacgcgcccatcgccgacaccaccgcggaccaattcgatgcgctggtgaacatccatctgaaagggccgtatttcctgacccagaccctgttgccgttgattgccgacggcgggcgcattctcaatgtctcgagtggtctggcgcgtttcgcgctgccggggtcttcggcctacgccatgatgaagggaggcatcgaagtgtttacgcgttacctggccaaggagctcggcgcacgcggtatttccgccaacaccctggcgccgggcgcgatcgaaaccgacttcaatggcggcagcgtgcgcgacaacgcgcaggtgaacgcgatggtggcctcggtcaccgcattgggccggccggggcagccggacgatatcggcccggtggtcgccgcgctacttgcgcccggcacggcgtggatcaatgcgcagcggatcgaggcatccggcggcatgctgatc

SEQ ID NO: 39255 - DNA, 1998 bp, Xanthomonas campestris
atgacccagcccacccgccgccagctggccaacgccatccgtttcctcgccgccgatgcggtcgaagccgcaaaatccggccaccccggcatgcccatgggcatggccgatatcgccgaagtgctgtggaacgatttcttccggcacaacccgaacaatccgcagtggttcaaccgcgaccgtttcgtgctgtccaacggacacggctcgatgctgcagtacgcgctgctgcacctgtccggctacgacctgccgatcgagcagctcaagcagttccgtcagttgcacagcaagaccgccggccaccccgagcgcagcgaaacgcctggagtggaaaccaccaccgggccgctggggcagggctttgccaatgcagtcgggttcgcgctggccgagaagttgctggcgcagcgctataaccggcccgaactggaaatcgtcgaccaccgcacctgggtgttcatgggcgacggttgcatgatggagggcatctcgcacgaggccgcctcgctggccggtacctggggcctgggcaagctggtcgcgttctgggacaacaaccagatctccatcgacggcaacactgccggctggttcagcgacaacaccccggcacgcttcgaagcctatggctggcatgtgatccgtgatgtggacgggcacgacgccgagaagatcaagacggccatcgaggcggcgctggaaaacagcgacaagcccacgctgatctgctgccgcaccaagatcggcttcggtgcacccaccaagtcgggcaaggaatcctcgcacggcgcaccgctgggcaaagaggagctggaaggcgcgcgcaaggcgctggaatggccgtacggcccgttcgagattcccgaagagatctacgccggctggcgcgcaggtggcaccggcacgctgcgtcaggccgagtgggagcagctgttcgacaagtacgccaagcagtacggcgaacaggccgacgagctgacccgccggtcgcgtggcgagttgccggccgacttcatcgcccaggccgatgcctacatcgccaaggcgcaggaagatggccagaccatcgcctcgcgcaaggcatcgcagctggcaatcgaagcgttcgcaccgctgctgccggagctggtcggcggctcggccgacctggcgcattccaacctcaccttgtggaaggccagcaagtcggtcgccaccgacgacccgaacgccaactacgtgtattacggcgtgcgcgaattcggcatgaccgccattgccaacggcctggcgctgcatggcggcttcatcccgttcgacgccaccttcctggtgttcagcgactacgcgcgtaacggcgtgcgcatgagcgcgttgaatccggcgcatgccatccatgtgtacacgcacgactcgatcggtctgggcgaagacggcccgacccatcagccggtcgaacacctggcctcgctgcgctacatccccaacaacgatgtgtggcgcccgggcgatgcggtggagtcggcggtgagctggaaggccgcgatcactcgcaaggacggcccgagctgcctggtgttcagtcgccagaatctgcagcaccagccgcgcagcgccgagcagatcaagctgatcgaacgtggcggttacgtgttggccgatgccgaaggcggcacgcccgacgtgatcctgatcggcaccggctcggaagtgggcttggcggtggaagcgaagaagacgctggatgcggccgggctgaagacacgcgtggtgtcgatgccgtccaccgacgtgttcgatcgccaggatgccgcgtaccgcgagcaggtgctgcccaatgccgtgcgcaagcgcgtggcggtggaagcgggcgtgaccggcttctggcgcaagtacgtgggcctggacggtgcggtgatcgggatcgacacgttcggcgcgtcggcacccgccgaccagctgtatgcgtacttcaagatcaccgccgagcacgtggtcgaggccgccaaggcgctg

SEQ ID NO: 39256 - DNA, 1293 bp, Xanthomonas campestris
atgaccgcatccccagccgcgcgccgcccaggcctgcccctgcattggaagatgggcattggcttcgccatcggcctggtgctgggtctggccgtgtactacctggccgggagcgacgccgaatgggtgcggctggtgaccaagtacgtcaccacgccgttctcgcagatcttcctcaatctgatcttcatgctgatcgtgccgctgctgttttcggcgctggtggtcggcattgcggaaatgggcgacatccgcgcgttgggccgggtgggctggcgcacgctgggctacacggtggtgttgtcgggcattgcggtgttgctgggcttggtcctggtcaatgtgctcaagcccggtgcaggcgtggacccgcaactggccaaccagttgatccaggaaaatgccgaccgcacccgcgagatcatctccagctccggcaatcagccgcagggcatggacatgctgctttccatcgtgccgaacaacgtgattgcggcggcctcgagcaatggcgcgatcctgtcattgatgttcttcgcggtgatgtttggcgtgggcatggtgctcactgccgacgaaaaagtggccacgctcaagcgcggcattgaaggcatcttcgagatctcgatgaccttgatcgggctggtgatccgcctggcgccgtacgcggtggcctgtttcatgttcaatctggccgcgttgttcggcttcgatctgctgattcgcctgggcgcctacgtcggcgtcgtggtgctggcgctgggcctgcacatggtggtcagctacgggctggcggtgaagttcgccgggcgttcgccgatcggcttcttccggcagacgcaggaggccacgctgatggcgttctccaccgcctccagcaacgcgaccttgccgactgccttgcgcgtggccgacgagatgggcctgccaccgcgggtctcgcgcttcgtgctcaccgtgggcgccaccgccaaccagaacggcaccgcgctgttcgaaggcgtgacggtgatcttcctggcgcagttcttcaatgtggacctgagcatcggccaacaattcatggtgatgatcgtctgcatcctgggtggtatcggtaccgccggcgtgccctccggctcgctgccggtggtggcgctgatctgcgcgatggtcggggtcaacccggtcggcatcggcatgatcctgggcgtcaatcacttcctggacatgtgccgcaccgcgctgaatgtcaccggcgatctggcgttgacgacgctggtggctaaaggtgagaaatagggaatcgggaat

SEQ ID NO: 39257 - DNA, 2037 bp, Xanthomonas campestris
atggccactcgcaagttcacccagcgctcgcgcattcgcgaaggccgtcccaatccactcggtgccacctgggatggcctgggcgtcaatttcgcgctgtattcgcgcaacgccacccgcgtggagctgtgcctgttcgacgagcgtggccgtgagcaggaacgcattcccttacccgaatacaccgacgaggtctggcacggttacctgcccgacgcgcgcccgggccagctttacggctaccgcgtgcatggcccgtacgcacccgatgccggccaccgcttcaaccacaataaattgctgctggacccgtatgccaagcagatcgtgggcgagctcaaatgggcgccgcatctgttcggctacaccatcggtcatcgcgacaaggacctgagttttgaccgccgcgacagcgccgcgttcatgcccaagtccgcagtgatcgacccggcctttacctggggccaggaccgcccgccgcagaccccgtggaaccgcacggtgatctacgaggcgcacgtgcgcggcctgagcatgctgcacccggccgtgccaccggaaaaccgcggcacgttctcggcgctgaagaccgacgagctgatcgatcacatcagttcactcggcgtcactgcggtcgaattgctgcccgtgcacgcctttgtcgatgaccagtacctgctggaaaaaggcctgcgcaattactggggctacaacacgctgggctttttcgcgccgcagggccgttacatgtccacgcgcacggtggccgagttcaagcagatggtggcgcggttgcaccacgccgggctcgaagtgctgctggatgtggtctacaaccacaccgccgaaggcaacgagctcgggccgacgctgtcgttcaagggcatcgacaacgccagctattaccgcctggccgacgatcgccgtttctacatcaacgacaccggcaccggaaataccttcgacctcaccaacgttggcgcgctgcgcatggtgatggattcgctgcgttactgggtgcaggaaatgcacgtcgacggcttccgcttcgacctggccagcatcctcggccgcgagcgctatggattcgatccttcaggcagcttcctggatgccgtacgccaggatccggtgctcagccagaccaagctgatcgccgagccgtgggacatcggccccggcggttatcaggtgggcaacttcccgccaggttgggtggagtggaacgacaaattccgcgacaacgtgcgtgcgttctggcgtggcgatggcggccagctggcagaactggccacgcgcctcaccgggtcggcagacctgttcaaccacagcggccgccgccccaccgcgtcggtgaatttcgtcaccgcgcatgatggcttcaccttgcgcgatctggtcagctacgaaggcaaacacaacctcgccaacggcgaagacggccgcgatggcagcgatcacaatatctccgccaactacggcgccgaaggcgagaccgacaaccccgccatcaagcagctgcggcggcaacagatgcgcaacctgctggccaccttgctgctctcgcaaggcacgcccatgctgctggccggcgatgaattcgggcatagccagaacggcaacaacaacgcgtattgccaggacaacgagctgacctggatcgactggaccgcggccaccaaagccgccgccgccgatcaggccgccttcgttcgccgcctgatccgcatccgccagcggtacccgttgctgcatcgcgcacgcttcttcgacggcaagttcgatgaagcactgggcctgaaggatctgacctggctggcgcccaacggcaacgagatggacgaagccgcctggcacgaccccgaagcccgcgcgctgatgctgcgcctggacggtcgctcgccgaccaccggcctgcgcgagatcgccgccaatgtgacgctgttgatgctgatcaatgccgcgcccaccagcgtcgctttcacgctcccggcgatgcacgacgaacactggcgcgtgctggtggacaccgcgcgt

SEQ ID NO: 39258 - DNA, 2142 bp, Xanthomonas campestris
ctgcaggcgatcgccgccgggctccccggcgacgcctttgcggtgttggggccgcacgtgcaggccgatggccgcttgcgtgtgcgggtcctggcgcccggcgccgaggctttggggctgatcgatggccgcggcaagttgctggcccgcatgcaggccagcccgatcgacggtgtgttcgaaggcgaactgccggcagaggccgcgtaccgcctgcgcatcgtctggccggacgtggtgcaggagatcgaagacccatacgcgtttgcgccgcagatcgatgaatcggcgctgctgcagattgctgccggcgacggccaggcgctgcgcgccaacctgggcgcgcggcatgtgcaggttggcgaggtgcccacggtgcgttttgcggtgtgggcgccgcatgcccagcgcgtggcagtggtgggcgacttcaacggttgggagccacgccgccacccgatgcgccagcgcagcggcggcatctgggagctggtgctgccacgcgtggagaccggcgcgcgctacaagtacgccatcaccaccgccgatggccgggtcttgctcaaggccgacccggtggcccgccaaagcgagttgccaccggccaccgcctcggtagtggccagtgcggatgcgtttgcctggaccgatgccgagtggatggcacgccgcagcgccgctgccgagccggcgccgctgtcgatctatgaagtgcacgctgcctcctggcgccgcgacggccacgatcagccgctggactgggtgtcgctggcggcgcagttgatcccgtacgttcaggagctgggcttcacccatatcgaactactgccgatcaccgagcatccgttcggcggctcgtggggctatcagccgctgggcttgtacgcgcccactgcaaggcacggcagcccggacgggtttgcccagttcgtcgatgcgtgccaccgcgccggcatcggcgtgatcctggactgggtcagcgcgcactttcccgatgatgcacatgggctgagccagttcgacggcagtgccacctacgagcacgccgacccgcgcgagggcatgcatcgcgactggaatacgctgatctacaactacggccggcccgaggtcaccgcgtatctgctcggcagtgcgatggagtggattgcgcattaccacctcgatggcctgcgcgtggatgcggtggcctcgatgctctaccgcgactacggccgtgccgagggcgagtgggtgcccaacgcccacggcgggcgcgagaacctggaggctgtggcgttcctgcgccagctcaccggcgagatcgccagccagttccccggcgtgctgaccattgccgaggaatccaccgcctggccgggcgtgaccgcgccgatcagcgaaggcgggctgggctttacgcataagtggaacatgggctggatgcacgacacgctgcactacatgcagcgcgacccggccgcgcgcgcccagcaccatagccagctgaccttcgggctggtgtacgcgttttccgagaggttcgtgctgccgctgtcgcatgacgaagtggtgcacggcaccggcggcctgcttggccagatgcccggcgacgactggcgccgctttgccaacctgcgcgcctacctggcgttgatgtgggcgcacccgggcgacaagttgctgttcatgggcgccgaattcggccagtgggcggactggaatcacgaccgctcgctggactggcacctgctcgatcacgcgccgcatcgcggcatgcaacagctggtgcgcgatctcaaccgcgccttgcgccgcgtgcctgcgttgtaccgcggcaaccaccgtgccgatggcttcgagtggagcgtggccgacgatgcgcgcaacagcgtgctggccttcattcgtcacgaccccgacggcggcgcgccgctgctggcagtgagcaacctcaccccgcagccgcaccacgactaccgcgtcggcgtgccgcgtgccggcggctggcgcgaaatcctcaataccgacagtgcccattacggcggcagcaatcttggcaatggcggtcgtctgctgaccgaaccgaccgggatgcatggccacgcgcaaagcctgcgcctgacgctgccgccgctggccacgatctacctgcaagcggag

SEQ ID NO: 39259 - DNA, 1386 bp, Xanthomonas campestris
ttgttcgtggtgtcggagatggcggacttcatcaaggccggcggcctgggtgatgtggcggcggcactgccgcgcgcattgcgccatcgctacgacgtgcgcgtgttgatccccggctaccgcgcggtgctggcgcgcgcgggcaaggtggagatcgtgggtcgtgtgctggcgcatgccgcgctgccggcctgcgacatcggccgcatcgtgcaatcggacggcctgccgatctacatcctgctgtccaaggaactgttcgaacgcgatggctcgccgtatgtgagcaccagcggttcggagttcgaagacaacgcaatccgctttgccaccttgtcgcacgctgccgcgcagatcgccgccggccgtgccgggctgggctggcggccgcgcctgctgcatctcaacgactggccgtgtgccctggctgccgcctacgtgcgctggtccggcggcaccacgccgtgcctgctgaccatccataacctggcctaccagggcctggtgccgtattcgatggccgccgcactgggcatcccggccgagcgcgtctcggagctggagttctacgggcagatgtcgttcctgcgcggtggcatcgtgcatgccgaccacgtcaacacggtgagcgtcagctacgcgcagcagatcaccggcccggcgcagggctgcgggctggaccgcctgctggccggccgcgccgccaagggcgcgctgagcggcatcgtcaacggcatcgacgccagctgggacccgcgcaccgacgaatacctggacagccatttcagcgtgaaccactggcagggccgccaggccaacgccgcgcaggtgcgcaaggccttcggtctgcgtgagagcaccggcccgctgttcgcggtggtgtcgcgcctggtgcaccagaagggcctggacctgatttgcgaggtcgccccgcagatcgtggccgctggcggccagatcgcggtgatcggcggcggtgagccggagatcgaacaacaggtggccgagctgacccggcgctatcccggccaggtcggtgcgttcatcggttttgaggaaggcctggcgcggcgcatgttcgccggcgccgacttcctgctgatgccctcgcgcttcgagccgtgcggcctgagccagatgtacgcgcagcgcttcggctgcctgccgatcgcgcatgccaccggcgggctgatcgacaccgtggacgatggtgtcaccgggttcctgttccagcaggccagcgccgaagcgctgcggcgctgcctggagcgcgccttccgcaccttccgcctgcccagcctgctgtcggcgatgcgccgcgccgcgatgctgcggcccagcggctgggatgtggcgggcaagaaatacatctcgctatacgagcgc

SEQ ID NO: 39260 - DNA, 1185 bp, Xanthomonas campestris
atggctcgccccgatctgcacgaacggatttcgtcgctgcgcaaattgcgcgtggcccaggagcgggtgcgggtgcggcggcaggtgggccgccgcgacggcgtgcgcctggaaatcgatgggcgttggctgaccggtttctgctccaacgattacctggggttgtcgcagcagtttgaagtggtggccgcgctgcaggatgccgccgcgcgcgatggcgccggcgcgactgcctcgcatctgatctgcggccatcacaccgcgcacgagacgctggagcgcgacatcgccgaatggctgggctatccgtcggcgctgctgttcggcagcggcttcatcgccaacctggccgtgcagcaggcgctgctcagcgaagaagacgatgtctgcgtgcaggaccggctcaatcacgccagcctgctggatgccacgcgcctggccggctgccggttgcgccgctacccgcacctggatgtggaaggcgcgatgcgccagctcaagggcgcgccggagggcgcggcaatgctcgccagcgacggtgttttcagcatggatggcgacgttgcgccactgcgtgcgctgagcctggtcgcgcgcatgcaggaggccttgttctatgtcgacgatgcgcacggcgtgggcgtgctggggccgcagggccgcggttgcgtggccgatgccgggctcggcgtggccgaagtgccgctgcaattggtcaccctgggcaaggccctgggcggctatggcgcggtggtggtgggcgaagaagcgctgatccgccacctggccgaaaccgcgcgcccgtacatctacaccaccgcgctgccgcccgcgcaggtggccgccaccctggctgcggtgcgcctggcgcgtcgcgacgattggcgccgcacgcggctgaccgaactgatcggcacattccgcgatggcgcgcgccggcatggcttcgaactgatggcctcggacacccccatccagccattgctgtgtggcgaggaagccaccgtgatggcgatgtcggcagcgctggagcaagccggcttcttggtcggtgcaatccgcccgcccaccgtgcccgaaggcaaggcgcggctgcgggtgacgttgtcggcattgcacacgccgcaacaggtgcaggccctggtcgatgccatcgtgcaggcgcgcgatgtggtcagccgccag

SEQ ID NO: 39261 - DNA, 777 bp, Xanthomonas campestris
ttgaaggagcaccgcatggatctgggaatcgccgggcgctgggccttggtatgtgccgccagcaagggcctgggactgggctgcgcacaggcgctggcacgcgaaggcgccaatgtcgtgattgtcgcgcgtggccgcgaggctttggagcagtccgccagcaacttgcgcgccctgcccggcgcgggtgaggtacgcagcgtcgtcgccgacatcaccaccagcgaaggccgtgccgctgcgctggccgcctgcccgcaggtcgacatcctgatcaacaacgccggcgggccgccgccgggcgatttccgtcagtgggagcgcgcggactggctgcgtgcgctcgacgccaacatgctggccccgatcgaactgatccgcgccacggtcgatgcgatgcgcgcgcggcgcttcggccgcatcgtcaacatcacctccagcgcggtgaaggcgccgatcgacatcctgggcctgtccaacggcgcgcgcgccggtctcaccggctttgtggccgggctggcgcgcagcaccgtggccgacaacgtcaccctcaacaatctattgcccggccagttcgccaccgaccggctgcgcggcaacttcgccgcgatcgccgagcaacaaggcaccagcgccgaggcggtggccgcgcacaaacgcgccggcatcccggccgggcgctttggcgagccggacgaattcggcgcggcctgcgcattcctgtgcagtgcccaggccggctacatcaccgggcagaacctgctgattgacggcggc

SEQ ID NO: 39262 - DNA, 591 bp, Xanthomonas campestris
atgagccagtccgaccagcccgattcatccgttacccaggcccaggccgaagaggccgtgcgcaccctgctgcgctgggccggtgaggatcctgcccgcgaaggcctgctggacaccccgcgccgggtggccgaagcctatggcgactggttcagcggctaccgcgaagaaccgcgcgcctacctggagcgcaccttcgaagaagtggccggctacgacgaattgatcgtgctgcgcgacatctcctacgaaagccattgcgagcaccacatggcgccgatcatcggcaaggtgcacgtgggctacctgccgcgcggcaaggtggtgggcatcagcaagctggcccgcgtggtggaaagctacgcgcgccgcttccaggtacaggaaaagatgaccgcacagatcgcccagtgcatccaggacgtgctgcaaccgcgcggtgtgggcgtggtggtggaaggcgcgcacgaatgcatgaccacccgcggcatccacaagcgcggcgtcagcatggtgacctccaagatgctcggcagcttccgcgaggacgcgcgcacccgcgccgaattcctgcagttcatcgaagtgggc

SEQ ID NO: 39263 - DNA, 2154 bp, Xanthomonas campestris
cccggcgtgacccgcgccctggccgaagcgcggcacggcgatgcattcgccgtgctgggcgcacatcccagcaccaacggccgcctgctgcgcacctatcaccccggcgccgagcacgtcaccgccgtgctggcggatgggcgcgaggtaccgctggaagccggcccggaaccaggcctgtttgccggcgaattgccggccgagggaggctaccgcctacggatcggctggccgggcggcacccaggacaccgcagacccgtacgcgttcgggccgctgctcagcgacttcgacctgcacctgatcagcgaaggccaccatctgcagctggccgatgcgctgggtgccaatgtggtggaagtggacggcgtgcgcggtacgcgctttgcggtgtgggcaccgaacgcctcgcgcgtggcggtggtgggcgacttcaatagctgggacgcgcgccggcacccgatgcggctgcgccaccaggccggcgtgtgggagctgttcgtgcccgacgtgggccccggcgcgcactacaaatatcagctgcgtggcccgcatgggcatgaactgccggccaaggccgacccggtggcacgccgcgccgaactggcgccgggcactgcctcgatcgtggccgaccccacgccgcaccagtggagcgacgacggctggatggccacgcgtgcgcgccgccaggcgcacgacgcaccgatgagcatctacgagatccatgccggctcctggctgcgcgaggaaggcctggatctggattgggatggcctggccgatcgcctgattccgtacgtggccgacatgggcttcacccatgtggagctgatgccggtgaccgagcatccgttcggtggctcgtggggctaccagccgttgggcctgttcgcgcccaccgcgcgcttcggcagcccggatggctttgcgcgctttgtcgaccgctgccaccgcgaaggcatcggcgtgatcgtggactgggtgccggcacactttcccaccgacgcgcacggcctggcccacttcgacggcaccgcgctgtacgaacatgccgacccgcgcgagggcttccaccgcgactggaatacgctgatctacaaccatggccgccgcgaggtgtctggctttctgatcgccagcgcgctggagttcctgcagcgctatcacgtcgatggcctgcgcgtggatgcggtggcctcgatgctgtatcgcgactacagccgcaatgccggcgagtgggtgcccaatatccacggcgggcgcgagaactacgaaaccatcgcgttcctgcgccggctcaacgcggtggtgcgcgagcacgcgccgggtgcggtgaccattgccgaagaatccaccgcctggccgggcgtgaccgcggatgtgtcgcatggcggcctgggcttccactacaagtggaacatgggctggatgcacgacacgctgcattacatcgggctggacccgatctatcgccgctatcaccacggcgagctgactttcagcatggtgtatgcgtactcggagcgcttcgtgctgccgatctcgcacgacgaagtggtgcacggcaagggctcgttgctgggccgcatgccgggtgacgactggcagcgtttcgccaacctgcgcgcctatctcggtttcatgttcacccacccggggcgcaagttgctgttcatgggctgcgagttcggccagcccaccgagtggaaccacgatgctggcttgccgtggcatctgctcgatgacgcacgccaccgcggcgtgcagacgctggtgcgcgacctcaaccacctgtacgcgcaataccccgccttgcacgcgcacgacgacgacccatcgggctttgcgtggctggtaggggatgacgcggccaacagcgtggtggcgttcctgcgcaagggcaaacgcggcgatgcaccggtgctggtagtgatcaactacaccccgatggtgcagcaggggtatcgcctgggggtgccgcagggcggcctgtggcgcgaagtgttcaacagcgatgccggcatctacggcggtgccaacctgggcaacggcggtgcggtgactgccgaaccgcagtccatgcatggccacgcgcagtcgctgccgttgctgctgccgccgctgggcgtcatcgtgctgaccccgcagggc

SEQ ID NO: 39264 - DNA, 747 bp, Xanthomonas campestris
aatccgttcagtctcgaaggcaaggtcgcactggtcaccggtgccaacactggcctgggccagggcatcgcgctggcactggcagaggcgggcgccgacatcgccgccgccggcatccaggcaccgaccgagaccgaagaaaaggtcaaggcgatgggccgccgcttcgtcgccatcgaagccaacctgatcagcatcgagccggtgcagcgcatcctcgatgaaaccctcgccggcctgggccgcctggacatcctggtcaacaatgctggcctgatccgccgcaccgatgcggtggatttcagcgagcaggattgggacgacgtgatgaacgtcaacctgaaatcggcgttcttcatgtcgcaggccgccggccgccacttcatcacgcagggcagcggcaagatcatcaacatcgcctcgatgctgtcgttccagggcggcatccgcgtgccgtcctacaccgccagcaagtccggcatcgccggcatcacccgcctgctggccaacgagtggggcagcaagggcgtgaccgccaacgccatcgcccccggctacatggccaccgacaacaccgcgcagctgcgtgccgaccaggaccgcaacaagtccatcctggaccgcatcccggccgcgcgctggggtgtgccggccgacctcggcggcgcggcggtgttcctggccagcagcgcctcggactacgtcaacggcgccatcatcccggtcgacggcggctggctggcgcgc

SEQ ID NO: 39265 - DNA, 741 bp, Xanthomonas campestris
tgggggatgctggccgtgctgctggtgttcacccaactcaccatcttcgcggtgaccttgtacctgcatcgcagccaggcgcaccgcggtgtggatttccatccggtcatcgcgcatttcttccgtttctggacctggctcaccacctcgatgatcacccgcgagtgggtggcgatccatcgcaagcatcacgccaaggtggaaaccgaggaagacccgcacagcccgcagaccaagggcatcggccaggtgttctggcgcggcgtggagctgtaccgcgaagcacgcgcgcagcgggccgacatcgagcagtacggcaagggcgcgcccaatgactggatcgagcggcatctgtacacgccgcacgccaacgccggcccgatcgcgctgttggtggtcaacagcgtgctgttcgggctgcccggtatcgcactgtgggcgatccagatggcgtggattccgttctgggccgccggcgtggtcaatggcctggggcattggtggggctatcgcaatttcgagtccgccgacacctccaccaacctgaccccgtgggcgctgtggatcggtggcgaagaactgcacaacaatcaccatgccttcccgagttcggcgcggttttcgatgcggcgctgggagctggacatcggctggatcgcgatccgctgcctgcaggcgctgggcctggccaaggtgctgcgggtggcgccgtcgctggacattcgccccaacatcgccgtg

SEQ ID NO: 39266 - DNA, 711 bp, Xanthomonas campestris
atgtcagcgttcaaagacaagtcggtattggtgctcggtggcagccgggggattggggccgccatcgtgcggcgcttcgtgagcgagggcgcgcgggtgacgtttacctatgccggctctgtcgaggcggcgcagcgcctggccagcgacaccggcagcaccgcggtgctggccgacagtgccgaccgcgatgcggtcatcgaaacggtgcgccgcagcgggccgctggatgtgctggtggtcaactccggcatcgccttgttcggcgatgcgctggaccaggatccggacgcggtggaccggctgttgcgcatcaacgtgcacgcgccctaccacgccgccgtggaggccgcgcggcagatgccgcccggcgggcggatcatcgtgatcggctcggtcaacggcgaccgcatgccgctgcccggcatggcgtcctacgcgctgagcaaatccgcgctgcaagggctggcgcgcgggctggcccgcgacttcgggccgcgtggcatcaccatcaacgtggtgcaaccgggcccgatcgataccgatgccaacccggaaaacgggccgatgaaagacctgatgcacagcttcatggcgatcaaacgccacggccgtgccgacgaagtggccggcatggtggcatggctggcaggcccggaagcgagctttgtcaccggcgcaatgcatacgatcgatggcgcgtttggagca

SEQ ID NO: 39267 - DNA, 1264 bp, Xanthomonas campestris
atcttcgtcaatccacagcggcggtttcaggcgttgctgggcattggcggggcgatcaccgattccagcgcggaaaccttcgccaaactgcccaagcaggcgcagcggcaactgctcaccgcctactacgacccggacaagggcatcggctacacgctggcgcggaccaccatccatagctcggatttcagcagtggcagctacacctatatcaaggaaggcgacgcggcgctgaagaccttttcggtgcagcacgatgcgaaataccgcattccgatgctgcgccaggccattgctgcggccggtggcacgctcaccacgtttgccagcccgtggagcgcgccggccttcatgaaagacagcaacgccatgctcaagggcggcaagctgttgcccgaatatgcgcaggcctgggccacgtactacacgcgcttcattgccgcgtatgaaaaggccggcatcccgatctggggcatcagcctgcagaacgagccgatggcagtgcagacctgggagtcgatgctgttttctgcggaagaagagcgcgactttctcaagaatcatctgggccccaccatggccaaggccggctatggcgatcgcaagatcatcgtgtgggaccataaccgcgacatgatggtgcaccgcgcgcatgtgatcttcgatgatccggaggcttccaaatatgcgtggggcatgggcttccactggtacgaaacctgggccgggttcgcgccgatggtggagaacgtggcggcggtggcacaggcgtacccggacaagcacctgctgctcaccgaagcggcggtggaaaagttcgacccggccaagctgcagcactggcccaatggcgagcgctatggcacggccatcatcaacgacctcaatcacggtgcggtgggttggacggactggaacatcctgctggacgagcacggtggccccaatcacgtgggcaactattgctttgcaccggtgcatgccaacacgcgcaccggcgaggtgatctacacgccgagctattggtatatcggccacttttccaagttcatccggcctggcgcgcagcgggtgagtgcggcgagcagccgcagtaacctggctaccactgcgttcgtcaacagcgatggcagcctggcgacggtggtgatgaatgccacggatgtggcgatccgctacaacctgtatgtgggcgatgcctccagcgtgctggagattcccgcgcatgcgatccagacggtggtgctggcgcagtgaggcgtcg

SEQ ID NO: 39268 - DNA, 861 bp, Xanthomonas campestris
atgcagaacccgctcacccagttcccgcagcccacctttccggagcagacccaggaagcgcccggcaccattcatgagctgcagcccaaggccgaccatggcgagcagagctatcagggcttcggccgcctgcagggccgcaaggcgctgatcaccggtgcggactcgggcattggccgcgccaccgccatcgcctatgcgcgcgaaggcgcagacatcgtgctcaactacctgcccgaagaagaacaggatgccgccgaggtggtgcagctcatccaggctgaaggccgcaaggccatcgccgtgccgggtgacctcaaggacgaagccttctgcaaccagttggtggagcgtgcggtgaaagaactcggcggcctggatctgctgatcaacatcgccggcaagcagaccgccatcaaggacatcgccgacatcaccaccgagcagttcgacgctaccttcaagaccaacgtctacgcgatgttctggctgtgcaaggcggccatcccgcatctgccgccgggcgcatccatcatcaacaccggctcgatccagtcttaccagccctcgcccaccctgctcgactacgcctccaccaaggcggccatcgtcaacttcaccaaggggctggcgcagcaggtggccgaaaaaggcatccgcgtcaacgccgtggcgccgggcccggtgtggacgccgctgcagcccagcggtggccagccgccagaaaagatcccggaatttggctcggaaacgccgatgaagcgcgccggccagccggtggaaatggcaccgctctacgtcctgctcgcctcgcaggaatcgagctatgtcaccggcgaggtgttcggcgccaccggcggc

SEQ ID NO: 39269 - DNA, 1125 bp, Xanthomonas campestris
cgtcaggagcactcatccatgaaatcccgtgcagcagttgcattcggacccggcaagccgctggaaatcgtcgagatcgacgtggcaccgccgcaggccggcgaagtgctggtccgcatcacccacaccggcgtctgccacaccgacgcgttcacgctgtcaggggatgacccggaaggtatttttccgtcggtgctcggacacgaaggtggcggcatcgtcgagcagatcggcgaaggtgtgaccggcgtcaaagtgggcgatcacgtcatcccgctgtacacggccgaatgccgcaagtgcaagttctgtctctccggcaagaccaacctgtgccaggccgtgcgcgcaacccaaggcaagggtttgatgcccgatggcaccacgcgcttctcctacaacggcgagccgatcttccactacatgggctgcagcaccttcagtgaatacaccgtggtgccggagatctcgctggccgtggtgaacccggaagcgccgctggaaaaagtttgcctgctgggctgcggcgtcaccaccggcatcggtgccgtgcacaacaccgccaaggtcaagccgggtgagagcgtggctgtgttcgggctgggcggtattggtcttgcggtgatccagggcgcggtgcaggccaaggccgggcgcatcctggccatcgacaccaacccgggcaagttcgacctggcgcgcagcatgggcgccaccgattgcatcaacccgaaggattacgacaagccgatccaggaagtgatcgtcgagttgaccgatggcggcgtggatttcagcttcgaatgcatcggcaacgtcaacgtgatgcgttcggcgctggagtgctgccacaagggctggggcgagagcgtcatcatcggcgtggccggtgccggccaggaaatcagcacccgcccgttccagctggtgaccggccgcgtgtggcgcggctcggccttcggcggcgtcaagggacgtacccaattgccgggcatggtggagcagtcgatgaagggcgagatcgatctggatccgttcatcacccacaccatgccgctggaacagatcaacgaagccttcgacctgatgcatgaaggcaagtcgatccgcaccgtgattcatttc

SEQ ID NO: 39270 - DNA, 1470 bp, Xanthomonas campestris
atgccacgtttccccgaccagctgctgtacatcggcggccgctatgttcccgcccgcggcggccacacgttcgaggtggtgaacccggccaccggtgaagtccttgccaacgtccacaacgccggcgccgacgatctggatgcagccgtggacagcgccaaggccggccaacggcactgggccgcactcacggtggtggagcgctcacgcatcctgctgcgtgccgtcgcgctactgcgcgagcgcaacgacgccctggcggagctggaaacgctcaacaccggcaagccgctgagcgaaacgcgcagcgtggacatcgtcaccggcgccgacgtgctggagtactacgccggcgtggcgcaggcgctgcaaggcgtgcaagtgccattgcgcgaaggcagcttcttctacacgcggcacgagccgcttggtgtggtgggtgctatcggcgcgtggaattacccgatccagatcgcgctctggaaagccgcaccggccctggccgccggcaacgcgatgatcttcaagcccagcgaggtgacgccgctcaccgcgctcaagctggctgaaattttcaccgaagccggcctgccggatggcgtgttcaacgtgctgcccggcgacggcgccagcgtgggccacgcactcaccgagcatccggagatcgaaaagatcagcttcaccggtggcaccgcaaccggccgcaaggtgatggccagcgcctccagctcgtcgttgaaggacgtgaccatggaactgggcggcaagtcgccactgattgtctgtgccgatgccgacctggacctggcggccgacatcgcgatgatggccaacttctacagctccggccaagtgtgcaccaacggcacgcgcgtcttcgtgccacgtgcactgcgcactgcattcgaagcgcgcctgctggcacgcgtgcaacgcatccatatcggcgacccgctcgatgagcgcaccacgttcgggccgatggtcagtgccgcgcacatgcagcgcgtgctggaacacatcgagcaaggcaaggccgaaggggcgcgcctgctgtgcggtggcgagcggctgcgcgatggtgcactggcgcagggctgctacgtggcgccgaccatcttcagcgattgcaccgacgtgatgaccatcgtgcgcgaagagatcttcgggccggtgctgagcctgctcacctacgacgacgaagacgaggcaatcacgcgcgccaacgccaccagctatgggctggcggcgggtgtggtgacgccggacctgtcacgcgcgcatcgtctgatccatcgcctggaggccggcatctgctggatcaacacctggggcgaatcaccggcgccgatgccggtgggcggctacaagcaatcgggtgtgggccgcgagaacgggctggccacgctgcaggcctacacacgcaccaagtctgtccaggtcgaactggaacgctacgcgtcggtgttc

SEQ ID NO: 39271 - DNA, 1665 bp, Xanthomonas campestris
atgcaacgcgaatacgactacatcatcattggcgcaggctcggccggcaatgtactggccgcgcgcctcaccgaagacccgggtgtcagcgtgctgctgctggaagccggcgggccggattaccggctggatttccgcacccagatgcccgccgcattggcgtttccgttgcagggccgccgctacaactgggcctatgagacagagccggaaccgcacatggacaaccggcgcatggagtgcgggcgcggcaaggggctgggtggctcatcgctgatcaacggcatgtgctacatccgcggcaacgcactggatttcgatcattgggccaagcgcccggggctggaagactggagctaccgcgatgtgttgccgtacttccgcaaggcagaaacgcgcgacatcggcgccaacgattaccacggcggcgaaggcccggtgagcgtggccacgccgaagaacgacaacaacgtgctgttccaggcgatggtcgatgctggcgtgcaggcgggttacccgcgcaccgacgacctcaacggctatcagcaggaaggcttcgggccgatggaccgcaccgtgacgccgcaagggcggcgtgccagcaccgcacgcggctatctggacatggccaagccgcgcgacagcctgcacatcgtcacccacgccaccaccgaccgcattttatttgccggcaagcgcgcggtcggggtgcattacctggtgggcaacagcagcgaaggcatcgacgcgcacgcgcgccgcgaagtactggtctgtgcgggtgcgattgcctcgccacagttgctgcaacgctccggcgtgggtgccccggacctgttgcgcgcgctcgacgtgcagctggtgcacgacctgcccggcgtggggcagaacctgcaggaccacctggaggtgtacatgcaatatgcatgcaccaagccggtgtcgttgtacccggcgctacagtggtggaatcagccggccattggcgccgagtggttgtttgccggcaccggcaccggggccagcaaccagttcgaggccggcggtttcattcgcacccgcgaagagttcgactggcccaatatccagtaccacttcctgccggtggcgatcaattacaacggcagcaacgcggtaaaagagcatggcttccaggcccatgtgggctccatgcgtacacctagccgcggccgcgtgcatgccaggtcgcgcgacccgcgccagcatccgtcgatcctgttcaactaccaatctaccgaccaggattggcaggaatttcgcgacgcaatccgcatcacccgcgagatcatcgcccagcccgcactcgacccttaccgtgggcgcgagatcagccccagcgcagactgtaagaccgacgccgagctggatgcgttcgtgcgcgcacgcgccgaaaccgcgtatcacccctcgtgctcgtgtgcgatgggcaccgacgacatggcggtggtggatgggcaaggccgcgtccacggcatggaggggttgcgcgtgattgatgcctcaatcatgccgcgcatcatcaccggcaacctcaacgccaccaccatcatgatcgccgagaagatcgccgaccggatgcgcgggcgcgcactgctgccgcgcagcaccgccgactattacgtggcgggtgatgcacctgtgcgc

SEQ ID NO: 39272 - DNA, 1234 bp, Xanthomonas campestris
ggcaaggtggtcgaagtgatcggcaccatgctcaaggtggctggtgtgcaggtcagcctgggcgaggtgtgcgagttgcgccagcgcgacggcacgctgttgcagcgtgccgaggtggtgggcttcagccgcactctcgccttgctggcgccgtttggcgagctggtggggttgtcgcgccagacgcgcgtgatcggattggggcgtcccttggcggtgccggtcggatcggcgctgctggggcgcgttctcgatggactgggcgagccggcggacggccaggggccgcttgcaggcgacgattgggtgcagatccaggcgcaggcgccggatccgatgcgccggcgcctgatcgaacagccgctaccgaccggtgtgcgcatcgtcgatggcctgatgacgctgggcgaaggccagcgcatgggcattttcgccgcagctggcgtcggcaagagcaccttgatcgggatgttcgcgcggggcacgcagtgcgatgtcaacgtgatcgtgctgatcggcgagcgcgggcgcgaagtgcgtgaattcatcgagatgattcttggcccggacggtctggcacgcagcgtggtggtgtgcgcgacctccgatcgctcctccatcgagcgcgccaaggcggcttatgtcggcacccgccatcgccgaatattttcgcgatcggggcatgcgggttctgctgatgatggactcgctgacgcgctttgcccgcgcacaacgcgagatcggtctggctgccggcgagccgcccacgcgtcgcggcttcccgccgtcggtgttcgccgagttgccgcgcctgctcgaacgtgccggcatgggcgagacgggctcgatcaccgcgttctacacggtgctggccgaagacgacaccggcagcgatccgatcgccgaagaagtgcgcggcatcctggatggccatctgattctgtcgcgcgagatcgccgccaggaaccagtacccggcgatcgatgtgctgggaagcctgagccgggtgatgagccagatcgtctctgccgaacaacgccagtacgccggccagctgcggcgtttgctggccaagcacaacgaggtggagaccttgctgcaggtcggcgaataccgccacggcagcgatgcggtcgccgacgaagcgatcgccaggatcgatgcgatacgcgacttcctgagccagcccaccgatcagctcagcgactatgacaccatcctggaacagcttgcc

SEQ ID NO: 39273 - DNA, 747 bp, Xanthomonas campestris
aagcatgtgttgatcaccggcggcgccggtggcatcggcatcgagctgatacgcgtgttcgcaaacgcatcctgccgggtgacattcactcaccgcccaggcgaagacagccggcgccgcgcactcgacctggtcgcggcgtttggtgacgatcgtgtccacgcacatgcattagatgtcggcgatcggcggagccacgctgctttcatgcacgctttgacgatgccggtggatatcgtgatccacaacgccggcgtgggcaccaagaccgtggagcgtgcggctgccacgtacaaggaacaggacgaggcgttttttcgcgtcaacacgatcgggccgttgtggttgagcgaagatctgattcccggcatgcaagcgcgcgggcagggcaagattctgttcatgagttcggtggatggtggcatcacccactttccgcgcttccgtgcggccgatggcatgagcaaggcggccgtcgcgtttttgggccggcaacttgctgcaacgcttgcctgcaccgggatcgacgtgttcaccgtatgtccgggtgccaccgatacgccgatgttccaggccagtaccttgaatgcgctgtcgccgcagcagcgacaggagctggaggcctcgctgcctggtggccgcctgatcgagccgcgcgagatcgccgatctctgcttctacctttgtcgcgatgaagcgcgcatcttgcgcggcgctgtcatcgacgcctcgcttggcttgggcgtc

SEQ ID NO: 39274 - DNA, 1057 bp, Xanthomonas campestris
tactgggattacatcaaggtcgagcagttgcttgccttgcaaggcggttttgataacgacgaacgtggcatcaataatgacgaggtgctgtttatcagcgtacaccagatctatgagctatggttcaagttgattttgcgtgagctgagctcgtcgcggaatattctggcggcgcattcgagcaatagcccggagattgtgctggctgtgcgctcactaaagcgcgccatttcggtattcgggcaagccaatcagcattttcagctgatggagactgatgaccgcgcgggatttcctggaattccgtgagcgactggctccagccagcggtttccagtcggcccaattgcgtgaaatcgagatcctgttgggcctggaggacacgcagcgtatttcgatcggcaacgggtgctcgtaccgggatgcactcaaattgcccggtggcgcgccgtcatcgtcggcgcaacgcgtcgaagcacgtgcggccgatgggccaagcttcaagcattgtctgtacgactggctgtcacgcgtgcccattgacggctcgaatgcgccagcggatatcacgcggtttcttgaggcgtacctggcctcgctgcgtgcggagaatgatcgccgactcaagctggcaagcagtggcctggctgcggcagagatcgagcagttgagggcgcgttatgcggcagaagacgctggcgcacaggcatttctattggccgaagacgatccgcaggccagcgatgcggagcgtgaaacgcggcgtgcgggacgtgcggcgatgctctttatagagagctaccgcgaattgccgcagcttgcatggccgcatgcgttgctcgaaagcgtgcttgagctggagcaggccatgctgatctggcgacagcggcatgcccgcatggtggagcgcttcatcgggcgccgcataggcacagggggttccagcggcgtcgactatctggatcagaccgcgcgctaccgcattttcaccgagctgtggacagtgcgttccctgttgctgcgcaaggctgccgtgccccagatccgatcgagtgcg

SEQ ID NO: 39275 - DNA, 2622 bp, Xanthomonas campestris
ttcttgcaaaccgccgacaccaaagacaaaaccaaactcagcacgggcgccgccgagcacaccccgctgatgaagcaattcttcgcagccaagtcggactaccccgacctgctgctgttcttccgcatgggagacttctacgagctgttctacgacgatgcgcgcaaggccgcgcgtctgctggatatcacgctgacccagcgcggcagttccggcggtgcgccgattccgatggctggcgtgccggtgcatgcctacgagggctatctggcgcgcttggtggcgttgggcgagtcggtggcgatctgcgagcagatcggcgatccggcactggccaagggcctggtcgagcgcaaggtggtgcgcatcgtcaccccgggcacggtcaccgacgaggcgttgctggacgagcgccgcgacacgctgttgatggcgatctcgcgcagcaagcaaggctatggcctggcctgggccgatctggccggcgggcgtttcctggtcaatgaagtggacagcgtcgatgcgctggaagcggaaatcgcgcgcctggaaccggccgagctattggtgcccgacgaagacaactggccggaattcctgcgtggacgcgtcggcgtgcggcgccggccaccatggctgttcgacgccgatagcggccggcgtcagctgttggcgttcttcaaattgcacgacctgtccggcttcggcatcgacgacaagccctgcgccaccgcagcggccggcgcgctgctcggctatgtcgaagaaacccagaaacagcgcttgccgcatctgacctccatcgcgatggaagtggccagcgaggcgatctcgatgaacgcagccacacgccggcatctggagctggacacgcgcgtggatggcgatacccgcaacaccttgctcggcgtgctggacagcacggtcacgccgatgggcgggcgcctgctgcgccgctggctgcatcgcccgttgcgtctgcgcgaggtactggtgcagcgccaccacgcggtcggcagcctgatcgacaccggcgccgataccgacgtgcgcgaggccttccgcgcgctgggcgatctggagcgcatcctcacccgcgtggcgctgcgctcggcgcgcccgcgcgatttctccaccttgcgcgatggcctggcgctgctgccgaaagtgcgcacgatcctcgcgccactggattcgccgcgcctgcagacgctttatgccgaactcggcgagcacgatgccaccgcgcatctgttgatcagcgcagtggccgaacaaccgccgctcaaattcagcgacggtggcgtcatcgccaccggttacgacgccgatctggatgagctgcgccgcctgtccaccaacgccgaccaattcctgatcgacctggaacaacgcgaacgcgccagcagcggcatcgccacgctcaaggtcggctacaaccgagtgcacggctactacatcgagatcagcaagggccaagccgagaaagccccgctgcactacagccgccgacagacgctgaccaacgccgagcgctacatcaccgaagaactcaagagcttcgaagacaaggtgctatcggcgcgcgagcgctcgttgtcgcgcgaaaaactgctctacgaaggcctgctcgacgcactcggcggcgagctggaaggcctcaagcgctgcgccagtgcattgagcgaactggatgtgttggccgggttcgccgaacgggcccaggcgctggattggtcgcaacccgaactggaaagcgcgccgtgtctgcacatcgaacgcggccgccacccggtggtggaagccgtgcgcgaccagccattcgaacccaacgatctggacctgcacccggaccgccgcatgctggtcatcaccggcccgaacatgggcggtaaatcgacctacatgcggcagaacgcgttgatcgtgttgctggcgcatatcggcagctatgtaccggccagccgcgcggtgatcgggccgatcgaccgcatcctcacccgcatcggcgccggcgacgacctggcgcgcgggcaatccaccttcatggtggaaatggccgagaccagctacatcctgcatcacgccacgccgcaatcgctggtgctgatggacgagatcggccgcggcacctccacctacgatggcctggccttggccgatgcggtggcgcgtcatctggcccacaccaatcgctgctacacgctgtttgccacgcattatttcgagctcaccgcgctggcggatgcctcgcatgccggtggcggcagcggcatcgccaacgtgcatctggatgcggtggaacacggcgagcgcctggtgttcatgcatgcggtcaaggacggcccggccaatcgcagcttcggcttgcaggtggccgcgctggccggcctgccgaaggcggcggtgcagcaggcacgccgccggctggccgaactggagcaacgcggcggcgacagccacgctgccgagatggcacccgccgcgctggatgcaccgcagcaattcggcctgttcaccgcgccgtcttcggccgcgcaggaagccttgcaggcgctggatccggacgaactgacgcccaagcaggcactggaagcgctgtaccggctcaaggcgctgctc

SEQ ID NO: 39276 - DNA, 2267 bp, Xanthomonas campestris
cgcacccaggtaaatgccatgactaccgaagcaaagtgccccttcaaccacagcgtcgtcggcgccggcaccaccaatcgcgattggtggcccaagcaactgcgtgtggacctgctcaaccagcactcggcccgctccaatccgctggcggcgtcttttaactacgcggaagccttcaagcgcctggacctgcagacactcaagcaggagctgcgcgcattgatgaccgattcgcaggactggtggccggccgacttcgggcattacggcccgctgttcgtgcgtatggcctggcacagcgccggcacctaccgcaccggtgacggccgcgggggcggcggccgcgggcaacagcgcttcgcgccactcaacagctggccggacaacgtcagcctggacaaggcacgccgcctgctgtggccgatcaagcaaaagtacgggcaggcgatttcctgggccgacctgatgatcctcaccggcaacgtcgcgctcgaatccatgggcttcaagaccttcggctttgccggcggccgggaagacacctgggagccggaccaggacctgtactggggccgggaaaccaagtggctgggtggcgatgaccgctacgcgcacggctcgccgggcgtggaccaggcgcatggcgtgctggtcaaggacgacgacagcgaagtgcagcacacccgcgatctggaaaacccgttggccgccgtgcagatgggcctgatctacgtcaacccggaaggcccggacggcaatccggatccgctattggcggccaaggacatccgcgacaccttcggccgcatggccatgaacgacgaagagaccgtggcgctgatcgccggcggccacaccttcggcaagacccacggtgctgccgatgcggcgcacgtggcggccgagccggaagccagcgacctggaaagccagggcctgggctggcacaacagcttcggcagcggcaagggcggcgacaccatcaccagcggcctggaagtgacctggaccaccaccccggcgcagtggagcaacgactttttcgaccacctgttcggcttcgagtgggagctgagcaagagcccggccggtgcgcaccagtgggtggccaagaacgcccaggccatcattcccgatgcgcacgacgcctccaaaaagcgtttgccaacgatgctcaccaccgacctggcactgcgcatcgatccggcgtacgaggccatctcgcgccgcttccacgccaacccggaccagttcgccgatgcctttgcgcgcgcctggttcaagctcacccaccgcgacatgggcccgcgcgcgcgctatctcggcgcggatgtgccggccgaagaattgctgtggcaggacccgatcccggccttaaaccatgcgctgatcgatgcgcaggacgctgccgcgctcaagcagaccgtgctgagctccggcctgagcgttgcgcaactggttgccactgcctgggcctcggcgtccagcttccgtggctcggacaagcgcggcggtgccaatggtgcgcgcattcgtctggccccgcagaaggactgggcctccaacgagcctgcgcagctggcccaggtgctggccacgctggagcgtatccaggccgacttcaatgcacgccagtccggtggcaagcagatctcgctggccgacctgatcgtgctgggcggcaatgccgcagtcgaacaggccgcgcacgccgccggccacgcggtcaccgtgccgttcgcccccggccgcatggatgcctcgcaagcgcagaccgacgtggaatcgttcgcagtgctcgagccggtagccgatggcttccgcaactacgccaaggcccgctacgcggtgtctgccgaagcgctgctgatcgacaaggcccagttgctgaccctcaccgcaccggaaatgaccgtgctggtcggcggcctgcgcgtgctcggcgccaacaccgggcagtcgcacaatggcgtcttcaccacccgtccgggcgtgttgagcaacgacttcttcgccaacctgctcgacatgcgcaccgagtggaaagccacgtccgagaccaaggaaacctacgaaggccgcgaccgtgccaccggtgagcacaagtggaccggcacccgcgtggcatctggtgtttggttccaactcgatcctgcgcgcggtggccgaggtctatgccagcgccgcacgatcagcaaaagtttgtgcaggacttcgtgcccgcgtggaccaaggtgatgcagctggaccgtttcgacctggcctga

SEQ ID NO: 39277 - DNA, 1434 bp, Xanthomonas campestris
caggtgtcgcggcatctgttcgggcagttcgccgagcacctgggcaccggcgtgtatggcggtctctgggttggaccggagtcttccattcccaacacgcgcggctatcgcaacgacgtgctggcggcactgaaggcgattgcggtgccgaatatccgctggcccggcggctgcttcgccgatgagtaccactggcgcgatggcatcggcgcgcccggcaaacgcccgatcagcgtcaacacgcactggggcggcgtggaagagtccaaccgcttcggcacgcacgaattcatggacttcaccgagctgctgggcaccgacgcgtacgtggcgggcaatgtcggtaatgccgcgccggacgaaattgcacagtgggtggaatacatgaccgccggcacgcgctccagcctggcggagcaacgtcgcgccaacggccgccaggcaccgtggaaggtgccgttcttcggcgtcggcaatgagttgtggggctgtggcggcaacatgcgggtggagtacgccgccgatgtgtatcggcgctaccagaccttcgtcaaggcgccgtccgaccagaaaatcctgaagattgcgcccggccccaacaacgacgattaccactggaccgaggtaatgatgcgcgaggcgggcacgctcatggatggcctgagcctgcattactacaccgtgcctggcggctggccgccgcgcgcctcctccaccgacttcgacgaagcagcctggatcgagacgctgtcgcgcacgctggtgatggacgagctgatcaccaagcacagcgcgatcatggaccgctacgacccggccaagaaagtggcgttggtggtggacgaatggggcacctggtacgccggcctgcctggcgccaacccgggctttttgcaccagcagaacagcctgcgcgatgcgctggtggcagcgttgaacatcgacatcttcagtgcgcatgccgatcgcgtgcgcatggccaatatcgcgcagatgatcaatgtgctgcaggcgatgatcctgaccgatggcgaccggatggtgctgaccccgacctatcacgtatttgcgatgtacaagccgttccaggatgccacccacctgccactgcaattgcagccccccgactatcggcatggcgacatccacgtgcccgccgtgcatggctcggcggtcaaggccaaggatgggcatgtgtatgtggcgctcaccaatctggatgccaacagcccggccacggtcagcgtggcggtggacggggtcagcgtgcgcggcgtggaggggcaactgctcaccgcaccgacgatcaccgcgcacaacaccttcgctgcgccccgcaccgtgcaaccaaccgccttcaccggcgcgcggatccagggcaacacgctgcaggtggcgctgccggcacgggcgatcgtgatgctcaagctacgt

SEQ ID NO: 39278 - DNA, 819 bp, Xanthomonas campestris
ttgcgtttcaccaagatgcatggcgccggcaacgatttcgtggtgctggatctgcgcaatggcacaccaccgcccgatgccagcctggccgcgcggttggcggatcgtcatttcggtgtgggctgcgaccagatcctgaccatcgaaacgccacgcagcgccgaggcggtggccgcctaccgcatctggaattccgacggatcacactcgcagcagtgcggcaatggcgcgcgctgtgtggccgcgtggctggtgcgcgagggcaccgcgcagggcgatgtcttcaccatcgacagccccttcaccgcgcaccgcgtcgagcgattggacgcgggcacatattcggtagcgatgggtgtaccgcagttcgagcccacgcagattccgctggccggctttgcccatgcgcgcgacgaatacgcgctgcccgtgcacggagaaaccgtgcgctttggcgcggtgtcgatgggcaacccgcacgcggttgtggaagttggccgggtcgatgcggcgccggtggagcgggtaggtgcgttgctgcaacagaatgcggcgtttcccgaatcagtcaatgtcgggtttgcacaggtggtggacccggcgcatgtgcggttgcgtgtgtacgaacgcggcgttggcgaaacgctcgcctgcggcagcggtgcgtgcgcggccgcggtggtgctgatgcatcggggccgggtcgagcgcgatgtacgggtgtccttgccgggtggcgaattgcggatccgctgggccggcgagcaggcgcaggtggtgatgtccgggccggccgtgttcgtcttcgatggagagtgg

SEQ ID NO: 39279 - DNA, 1923 bp, Xanthomonas campestris
tccattgcattggccggctgttccaacgaatccacgccgccggcgtccactgccgccgccccggccgccaccgccaaggctcccgtgaaagcagacgcccgcaaccacgacgaaagctcctacgcccagccgcagctggtggtcatcaaggacctggcgctggatctgaagctggatttcgacgccaagcagatcggcggcaccgccacctacacgctggactggaaggacaaggccgccaagcagctggtgctggatacgcgcgagctcagcatcgcccaggtgcaggccgacgatggcaagggcacgctgtcgccactgcagttcgtgctggcgccggccgacaagaccttcggcagcatgctcaccatcgaaacccccgaccagccggccaaggtcgtcatcacctaccacactgcgcccaccgcatcgggcctgcagtggctggagccggcgatgaccgaaggcaagcaactgcctttcatgttcagccagtcgcaggcgatccacgcgcgcagctgggtgccgttgcaggacacccccagcgtgcgcttcacctatagcgcgcatgtgacctcgcgcccggacgtgatggtgctgatgagtgccgacaacgaccccaaggccgcgcgcgacggcgactacagcttcaagatgcccgagccgattccctcgtatctgctggcgatcgctgccggtgatgtggtgttcaagccgatctccgcgcgctcgggcgtgtgggccgagccgagcatggccgacaaggctgcgaaggaattcgaagacaccgagaagatgatcggtgccgccgagaaactctacggcccgtatcgctggggccgttacgacatgctggtgctgccgccgtcgttcccgttcggtggcatggagaacccgcgcctgaccttcgccacgccgacggtgatcgtgggcgacaagtcgctggtgtcgctggtggcgcacgagctggcgcatagctggtcgggcaacctggtgaccaatgcgagctggaaggacatctggctgaacgaagggttcaccacctacgtgcagggccgcatcaccgaagcgctgtacggcaacgagatggccgagatggagcgcgagatcgaccagggtgatttgctggccgaagtgaagggcatggcgccggccgaccaggccctggcgctgccgccgctggccgagcgcgacccggatgaagcgctgagccaggtggcctacgtcaagggcgcgtggttcctgcagttcctggaacagcgcttcgggcgcgaggtgttcgacccgttcctgcgtggctggttcgacgatcatgcgttccagagcgcgaccaccgaccagttcgtcgactatctcaacaagaacctgctggccaagcatcccaacacggtgagcgcggccgaagtggacgcctggttgaagcagccgggcatcccggccttcgccgccaaggcacgctcgcgcagcttctcgatcgtggacaccgcacgtatcgcctggagcggtagcggcacgctgcccaacaagcaggtcaccggcgaatggggcacgcaggagtgggtgcatttcctcagcggcatgggcgcgactttgaagcccgaacaactcaagcagctggacgatgcctaccacttcaccggcacgcccaacggcgagatcgcaatgcgctggtatccgttggcgatccgcagcggctacatcgatgcacgcccggccgcgggcgagttcatcgaacgcgtcggccgtcgcaagctggtgctgccgatctatgccgagctgctgaagaccccggacggcatcaccttcgccgagcaggccttcgaaaaggccaagccgagctaccacccgatcaccaccgcgtcggtggccgagatgatcgccaaggccaaggccgcgccgccagcgcagccgtaatggccgggg

SEQ ID NO: 39280 - DNA, 1779 bp, Xanthomonas campestris
gccgcagtggtcgataccgatggcgaattcaccaccaacgccagcaacccggataactggggcggtgtcggtcgcgacttcgccttgacccgccacagcccgttggcggagatcaatcgcgacaacgtcaagaacctcaagatgtcgtgggaaatgaagaccgacgccacgcgcggccacgaaggccaaccgctggtgatcggcagcatcatgtacatggtcagcgcgtatcccaacaacgtgtacgcgatcgatctggcatcgcaggacgacggcggcaaggtgttgtggaaatacaccccgcagcaggacgaacgctcggtggcagtggcgtgctgcgacacggtcaaccgcggcgcatcgtatgccgatggcaagctggtgttcggcagcctgagtggcgatgtgatcgcgctcgatgccaagaccggcaaggaagtgtggaagcagaaacttggccaccccgacaagggcgaaaccatcaccatggcgccgatcattgccgacggcaaagtgatcgccggcatcagcggcaacgagttcggcgtgcttgggcgcgtggccgcctacaacctggccgatggtaagcaggcgtggtcctgcgatgcggccggcaccgacaaatccatctgcctgggcgccgatttcaacaaggccaacccgcaacatgggcagctcggcgacctgggcgtgaagacctttcccaacgacgaatggaagcgcggcggcggtgcggcctggggctggtacagctacgacccgaagctgaagttgctctactacggcaccggcaacccggggctgtggagcccgtcgtaccgctgcggcaaaacctcgcatgaggaatgcaacaacggcgagcatgacaacaagtggtcgatgaccttgttcgcccgcaagatcgacaccggcgaagcggtgtggggctaccagaaaaccccgttcgaccagtgggattacgacggtatcaacgagccgatcctggtcgacctgaccatcgacggcaaggaagttccctcggtggtgcagttcgatcgcaacggctttgcctacgtgctcgatcgccgcgatggcacgctgctgcgcgcgcacaagttcgtgccggccaactgggccgaacgcatcgacatgaagaccggccgcccggtgaaggtggctgcgcattcgccactggaacgcggcaagaaagtgcaggcgttcccgtcggcaatgggcggcaaggaccagcagccgtgctcggtggatccggccaattcggcggtgttcttctgcggcaccaacaactggcacatggagcttgagccgcaggaacgcggcaacaccatgatgggcctgccgtatgtgttcgccaacgtgatgatgaagcccaacgagcccggcgcactgggcattgtcaaggcgttcgacgtggtggaaggcaagtccaagtgggagatcaaggagaagttcccggtgtggagcggcaccctggtcaccgatggcgggctggtgttctacggcacgctggacggctggttccgcgcagtggacaaggacaccggcaagaagctgtgggagatgaagttgccctccggcatcatcggcaacccgatcgcctacaaggccaatggccaccagtacgtggcggtgttctccggcatcggcggctggattggtttgccggtggcggcaggtctggatccggctgatccgtacggcgcgctgggtgctgccgggctggcgtttggcgccggtttcgacaagatcccgctcggcggcatggtgcataccttccgcatc

SEQ ID NO: 39281 - DNA, 942 bp, Xanthomonas campestris
cctacgcaaaggcctgactcgatgtccgcactgatctgtggttccctcgcctacgacaccatcatggtgttcccggaccagttcaagaaccacatcctgccggacaaggtgcacatcctgaatgtgtcgttcctggtgccgcgcatgcgccgcgagttcggcggttgcgccggcaacatcgcctacaacctgcatctgctgggcggcgcaccgatcccgatgggcacggtgggccaggatttcggcccctaccgcgagcatttcgagacgctgggcatcgacctgtcgcgcgtgaagatcatcgatgacctgttcaccccgcaggcgttcatcaccaccgaccacgacaacaaccagatcaccgccttccatccgggcgcgatgatgcgcagctacgagaaccacgtgcgcgacgtgtcgggcgtgaccctgggcctggtgggcccggacgggcgcgaaggcatgatccagaacgcggaagagttcgctgccggcggcatccccttcatcttcgatcccggccaggccatgccgttgttcaacggcccggagctgcgcgagttcatcgagcaggccgactacgtggtggtcaacgactacgagtccaacctgctgcaggaacgcaccggctggaacgagcaggacatcgtgtcgcgcgtgcaggcctacatcaccacgcagggcccgaagggcgcgctggtgcacacgccggaaaagacctacgacatcccgccggcgcacgagcgccgcgtggtcgaccccaccggctgcggcgacgccttccgcgccgggctgatctacggcatccagcacaactacgactggctgaccatcggccgcatgggcaacctgatgggcgcgctgaaggtggagcacccgggcacgcagaaccagcgcttcgacttcgccgagttcaacgaccagttcaagcagcagttcggc

SEQ ID NO: 39282 - DNA, 1215 bp, Xanthomonas campestris
ctttgtctttcgcttgcctcacaggcgagcgccatcacccaggcaaccggcgatggtcgtgcagtctccgagcctggtattccggcgacctgccaggcggtaaaggccgagcacacggctagcgcgcgccagttcgcggcggcattggaaagtgcgccgcccgataccaaaaacatccaggccgcactgaccgcgtgtgcggggaagaatggcagcgtgctgctgacggcgggcgcgggcaacgcgttcctgaccgggccgctgtcgattcctactggcgtgacgttggtggtcgatcagggcgtcaccgtgtacggctcgcgtaaccccgccgattacggcagtggctgcggcacggccggttccaagagtggcggatgcctgccgttgatcagcgtcaagggcaccaggtccggtgtgatgggtgtgcgcatcggtgggcgccagggcaccatcgatggccgtggtgacctgaccatgctcggcaagagcaccacgtggtgggagttcggcgagaacgccaagaaggccaaccaggtgcagaacagcccggacctgatcaaggtgcagaattccagcgcatttacgctctacaacgtcaatctgatcaatgcggcgtacttccatttcttcgcgcatatcgtcgatggcctgaccatctggggcacgcgggtgaagtcgccagcgaccagccccaacaccgatggcctggacctggatagcgtggtcaacgcaaccgtgttcgataacgatgtgatgggcggcgacgattgcgtggcgatcaagaccatcgcctccaagtccggcaacatcaccttgcgcaacaatcgttgctacggcacgcacggcatctcgatcggcagcgaggtgatgtccggcgtcagcaatgtgttggtcgattccactgccatcaccgccagcgacgatgccggcaaccgcagcaccgacaacaacggtctgcgcatcaagaccagcatcggcaagggcggcccggtcagtctgattacctatcgcaatacctgcctgtacggcgtcaccagcccgctggtgatcaacccgttctattccagcggcggcagcggcaccgcgcccaccttcagccagattgtcgtcaatggcttgcggaccaccggcgatgcgggtctcaagggcaagggctggatcctggaaggctataacgagcagacaccgctggacctggtgcttgccaatgtt

SEQ ID NO: 39283 - DNA, 2373 bp, Xanthomonas campestris
ggtgcggcgctcgcctatgaaggcgggcgcctggtggccgttggtggctcctggtactacgtgctggccggtatcgccgtgctggtggccggtgtgctgctggcactgggcaaacgcgctggcctgtggctgtttggcgctacgttggcggccaccatcgtgtgggcgctgtgggaagtgggcctggatggctggggcctgatcccacgtctggcctggatctcggtgctcggcctggtgctgttgccgttctggggcgtggcgcggcggcgcatgcagccgttgtccgggctcggctatgtcgtggtcaccggcgtgctgccggtgctgggtgcggcgctgatcctgtggccgctgctggtgccgcgcaatgtggaactggccgatgcatccaagcagccggccgatgcggcaacgccgttcagccgtggcagcgtgcccagcccggacgggaacgtggcggccaaccacgatgccagtaactggaccgcctacgccggttccaacctgtccaaccattacacccccggcgcgcagatcacgccggagaacgtcaagggcctcaaggtggcctgggaattccataccggcgatctcaagccgaaggattccaagctgggctatgcgttccagaacaccccgctcaaggtcggcgacctgctctacatctgcaccccgacccagaaggtgattgcggtggaggcggccaacggcaaggagcgctggcgcttcgacccgcagaccaatccgaaggcgatggccggcgtggccgccaccacatgccgcggcgtgtcgtactaccaggcgccggaaggcactgccgagtgcccgacgcggatcttctggccgatggtcgatggccgcctgggtgcgctggatgcgcagaccggcaagctctgcgccagcttcggtaacaacggctatgtggacctcaatgccggcaccggcaacaccaagccgggcttcgtcggcccgacctcgccgccggtggtcatgcgcggtgtggtgatccagcccaccgggcaggtgcgcgacggtcaggaacgcgatgcgccgtccggcgtggtgcgcggcttcgacgcgctcaccggccagctgcgctgggcctgggatctgggcaacccggccatcaccgccgaaccgccggccggccagacctatacccgctccaccccgaacgtgtggtcgctgatggccgccgatgacgagctggggctggtgtatctgcccaccggcaacgctgccggcgacttcttcggcaagggccgcaccccgcaggaagaggaatacaccgcctcgctggtggccgtggatgcggcaaccggcaaggagcgctggcacttccgtaccgtcaatcacgatctgtgggactacgacatcggcccgcagccgaacctggttgattggccggttgccggcggtggcacccgccccgccgtgatccaggccaccaagtccggccaggtgttcgtgctcgaccgcgccaccggccagccgatcatgcctgtcaagcagatcgccgtgccgcagggcaccgaccatggcgactggaccgcatccacccagccggtgtcgccgggcatgcccaacaccgtgggtgcgcccagccgtgactacgagaccatcgttgaatctgacgcgtggggcatgaccccgttcgaccagctcgcttgccgcatcgagttcaagaagctgcggtacgaaggcatgttcaccccgccaagcctgcagggctcgctgtcgttcaccggcaaccatggcggcatcaactggggcggcgtgtcggtcgatctgcagcgcggcatcatggtgatgaacagcaatcgcctgccctataccgagcacgtctacccgcgcacggtgatgaacgagctgggcgtggtgtcggtgttcaacggcagcagcaagaccaagggctacatggcgcaggaaggcctggcctatggcgcgcgcaaggagccgtggatgtcgccgctcaacacgccgtgcgtggcaccgccgtggggctatatctccggcgtggatctgcgcacgcagcaggtgatctggcgccgtccgctgggcaccggttacgaccagggcccaatgggcatcccgtccaagaccaagttcgagatcggcaccccgaacaacagcggctcgctggccactgccggcggcgtcaccttcatcggtgccagcctggacaacttcatccgcggctttgacacccgcaccggcaagcaggtctgggagacccgcgtgcctgcgggcccgcaggccgcgccgctgagctacaccatcgatggcaagcagtacatcgttgccgcggtgggtggccatgtccgcatggaaaccaagtcaaaaaacagcgtctttgcctgggcactgccc

SEQ ID NO: 39284 - DNA, 1356 bp, Xanthomonas campestris
atgagtcgtctggtggtggtatccaatcgtgtggccgtgcctggtgaaagccgtgccggcggcctggcagtgggcttgttggcggcgttgaaggagcgcggcggggtgtggttcggctggagcggcaagaccgtgcgcggcgacagcggcggcatgcacgagcagaccgacggtgacatcaagttcgtcaccatggacctcaacaagcgcgacatcgattcctactacaacggctttgccaaccgcacgctgtggccgctgctgcacttccgcctggacctggtcgattacgaccgcgccacgcgcgaaggctacctgcgcgtcaatcgcctgttcgccgagaagctggcgcccttgctcaaggacagcgacacgctgtggatccacgattaccacatgattccgctcggcgcgatgctgcgcgagctcggtgtgggctgcaagatgggcttcttcctgcatgtgccgatgccgtcggccgacctgatgcaggcgatgccggatcacgcgcgcttgttcagcacgttctacgcgtacgacctggttggcttccagacccagcgcgatgccgaacgcttcaaggcgtatgtgcgcctgttcggtggtgggcgcgtgctggagggcgatctggtggaaggcccgggtgggcgccgcttcagcgctgctgcgttcccgatcggcatcgacaccgatctgattgccaatcaggccaaggcgtcggtctccaagcaggcagtgcgcgatcttcgcgaaagcctgcgcgggcgccagctcgcgatcggcgtggatcgcctggattattccaagggtctgcccgagcgcttccagggctttgagcgctatctggagcgctacccggatcaatccggcagcctcacctatctgcagattgcaccggtctcgcgcggcgacgtcaacgaatatcgccagctgcgcgggcagcttgagcagatcgcaggccacatcaacggtggtcatgcggagccggattggacgccgctgcgttacgtcaaccagaacttcagccatgccacgttgaccggattttatcgcgctgcggccgtgggtttggtgacaccattgcgcgacggcatgaatctggtcgccaaggaatttgtggcagcgcaggatccggagaatccgggtgtgctggtgttgtcgttgctggccggtgcggccgatgagatgaaagaggcgctgttggtcaatccgcatgatctggatggtgtggccgatgcaattgcgacggcggcgagcatgccgttggcaacgcgggtggagcgttggcacgcgatgatggatcacttgcgcaagaacaacatcaatcattggcggcagcggtatttgcaggcgttg

SEQ ID NO: 39285 - DNA, 720 bp, Xanthomonas campestris
ccccttccgtcgccgccattgctggacgatgcctgcgcattgttcctggacgtggacggcaccctgatcgactttgcgcacacccccgaagcagtgcagttgctgccggaggtacgcgacgcaatcgcgcgccttagcgagcgccttggcggcgccgtcgccctggtcagcgggcggccgctatcccaactggacgccctgttcgcacccctgctgctgccggccgccggcctgcacgggcacgagttgcgcagcgacgcagccgcacgcgcggcaatgccgcaagacacctccgaatggttgcacggcttgcataaacgcgccgctgcactcacgcatcaacatcctggcgtgctggtcgaagacaaaggcgtcagcgtcgctctgcattggcgcgcgcaaccacttgccggccccgacgtactcgccttcgcacagcaggaaatcgcggcgctgtcgggtcaccgcctacagcccggcgatcacgtcgttgaatttgttcccgaaggcagcaacaagggcctggcggtcgagcagctgatgcagcagcaggcatttgcgggccgcacgccggtgtttgtcggcgacgacctcaccgacgaattcggtttccaggcggccaatcgcctcggcggctggagcgtgctggtcggcgaccgcgcccagaccgacgcacgcttccgcgtgtcgggcaccgccgccgtgcatgcctggttgcag

SEQ ID NO: 39286 - DNA, 2574 bp, Xanthomonas campestris
atgcggatggacaagctcacctcgcggttccagcaggcgctggccgacgcgcaatcgctggccgtgggccgcgaccacaacatcatcgaacccgtgcacgtgctggccgccttgctcgaccagagcggcggcagcacgcgcccgctgctgtcgcagtccggcgtcaacgtgccggcactgcgcgagcgcctgggcgaagcgctggacaccctgcccaaggtgtccgggcaggaaggcaacctgtcgatcggcaacgatctcaatcgcctgctcaaccagaccgacaagctcgcccagcaacatggcgatgccttcatcgccagcgagtggttcgtgctggccgctgccgacgatgccagcccgctgggcgtggccttgcgcgcggccggtggcgacaagaagaagatcgaagcggccatcgataaattgcgcggtggcgaaacggtgcaatcggaaaatgccgaggagcagcgccaggcgctggagaagtacaccatcgacctgaccgcgcgcgcggagagcggcaagctcgatccggtgatcggccgcgacgaagaaatccgccgcaccatccaggtgttgcagcgacgcaccaaaaacaacccggtgctgatcggcgaaccgggcgtgggcaagaccgccattgtcgaaggcctggcgcaacgcatcatcaacggcgaggtgcccgaaggcctgcgcggcaagcgcgtgctgtcgctggacatgggcgcgctgattgccggtgccaaattccgcggcgaattcgaagaacgcctgaaggcggtgctcagcgacctgtccaagaacgaaggccagatcatcctgttcatcgatgagctgcacaccatggtcggcgccggcaaggccgatggcgcgatggatgccggcaacatgctcaagccggcgctggcgcgcggcgagctgcattgcatcggcgccaccacgctggacgaataccgcaagtacatcgaaaaagacgctgcgctggagcgccgtttccagaaagttttcgtgggcgagccgacggtggaagacaccatcgccatcctgcgcggcttgaaggagcgctacgcggtgcatcacggcgtggagatcaccgacccggcgatcgtggccgcggccaccttgtccaaccgctacatcaccgaccgtcagttgccggacaaggccatcgacctgatggacgaagccgcatcgcgcatccgcatggagatcgattccaagcctgaagagctcgaccgcctggagcgccgcctgatccagctcaagatccagcgcgagatgctcaagaaggaaaaggacgaggcctcgcggcaacgtctggccgatctggaaagcgacatcgacaagctcgagcgcgaattctccgacctcaacgaagtgtggaagtcggagaaggccgcgctgcagggcaccaccaagatcaaggagcagatcgagcacgccaagctggagctggaagcggcgcagcggcgccaggactacgccaagatgagcgagatccagtacggcgtattgccgcagctggaaaagcagatgctgctggccaacgaagtggagcatcacgacttcaagctggtgcaggaccgcgtgaccgccgaagaaatcgccgaggtggtgtcgcgttggaccggtatcccggtcaacaagatgctcgaaggcgagcgcgacaaactgctgcgcatggaagacgaactgcaccgccgcgtggtggggcaggaagaggcgatcaaggtggtgtccgatgcggtgcgccgctcgcgtgccggcctgtccgatcccaatcgtccgagcggttcgttcctgttcctgggcccgaccggcgtgggcaagaccgagctgtgcaaggcgttggcggatttcctgttcgacagcaccgaggcgatgatccgcatcgacatgagcgagttcatggagaagcattcggtctcgcgcctgatcggtgcgcctccgggctatgtgggctacgaggagggcggttacctcaccgaggcggtgcggcggcgcccgtattcgctgatcctgctcgacgaagtggagaaggcgcacgccgatgtcttcaacatcctgttgcaggtgctcgacgatggccgcctcaccgacggccagggacgtaccgtggacttccgcaataccgtcatcgtgatgacctccaacctgggctcgcaccagatccaggagttgtccggcgacggcagcgccgaggcctacacgcagatgaaggcggcggtgatgggcgtggtgcaggcgcacttccgcccagaattcatcaaccggctcgacgacatcgtggtgttccatccgctggacaaggcgcagatcaagtcgatcgcgcgcatccagttgcagggcctggaaaagcgcctggccgaacgcggccttaagctggacctggacgacccggcgctggaattgctgggcaatgtcggcttcgacccggtgtatggcgcgcgcccgctgaagcgtgcgatccagtcgcaggtggaaaacccgctggcccagcagattctctccggccagtacaccagcggcgacaccgtgcgtgtacgcaccgaaggtggacatctggcgttt

SEQ ID NO: 39287 - DNA, 1266 bp, Xanthomonas campestris
aagcctgaaaccatcgccgtgcacggtggctaccgtcctgatcccaccacccgcgcggtggcggtgccgatctatcagaccgtggcgtatgccttcgacgacacccagcatggcgcggatctgttcgacctgaaagtgcagggcaacatctacagccgcatcatgaatcccaccaacgacgtgctggaacagcgcgtggctgcgctggaaggcggcatcggtgcgctggcactggcgtcggggcaggcggcggtgacctatgcgatccagaccattgccgaggctggcgacaacatcgtctcctccagcgcgttgtatggcggcacctacaatctgttcgcgcacacgctgccgcagttcggtatcaccacgcgctttgccgattaccgcgatccgcaggcgtttgccggcttgatcgacgagcgcaccaaggcggtgttcgtcgagtcgatcggcaacccgcgcggcaacatcaccgacatcgaagcggtggcggcagtggcgcatgcgcacggtgtgccgctgatcgtggacaacaccgtcgccacgccgtcgctgctgcgcccgatcgacttcggcgcggatatcgtggtgcattcgctgaccaaatacctgggcgggcacggcaacagcatcggcggtgcgatcgtggacagcgggcgcttcccgtgggcggcgcacaaggcgcgctttgcgtgtctcaacgagccggacgtgagttaccacggcgtggtctataccgaagccctgggcgaggccgcctatatcggtcgtgcgcgcgtggtgccgctgcgcaataccggtgcggcgttgtcgccgttcaatgcattcctcattttgcaaggcatcgagaccctgccgctgcgcatggagcgcatcaatgccaacacgttggcgattgcccggtatctgcaggaacacgcgcgcgtggcctgggtcaattacgccgcattgccggatcaccccgagcatgcgttggcgcagaagtatctgggcgggcatggctcgggcgtgttgaccttcggactgccgggtggacgcgcggcgggtgcgcggtttctggatgcactgcagctgttcacacggttggtcaacattggcgacgccaaatcgctggccacgcatccggcctccaccacgcaccgtcagctcggcccggccgaactggagcatgccggcgtcagcgaggacaccgtgcggttgtcgattgggatcgagcacatcgatgatctgctggcggatctggagcaggcgctgcagggcgcg

SEQ ID NO: 39288 - DNA, 1149 bp, Xanthomonas campestris
cgcgcagcggtggcgcagttacgtgcgcacagcgacgccccgctatgtgcctacgtctacgacctggccgcactggatgcgcacgcagcgtggatgcgtgcgcagctgccgcccggctgcacgctgttctacgccgccaaggccaatgccgaaccgcagatcctgcagacgctggcgccctatgtggatgggttcgaagccgcatccggtggcgagctcgcctggctgcatcagcagcaaccggatgcgccgttgctgtttggtgggccgggcaaactggagagcgaactggcgcaggccgtgcgcctgcccgactgcaccgtgcatgtggaaagcctgggcgaattgcagcggctggcggccattgcgcggcagatcgcccagcccgaccgccggcgcatcccggtgttcctgcgcatgaacatcgccgtgcccggtgcacagaccacgcgtttgatgatgggcggccaaccatcgccattcgggctggacccggacgacctggatgctgcgctgatgcagctacgcgccagcctggcactggagttgcgcggcttccatttccacctgatgtcgcaccaacgcgacgccgccgcgcagctgcacctgatcgcggcgtatctgcgcaccgtgcagcactggcggcagcgccatggcctggggccgctgctggtcaatgccggcggcggcttcggcgtggactatctgacgccagaggcctcgttcgactgggcaggcttctgcgccggcctgcccgccgtgctgcatgcacacggcgacggcctgcaactgcgcctggagccgggccgctatgtcagcgccagctgcggctggtacctgatggaggtgctggacatcaagcgcagccacggcgcgtggtttgcgattgcccgtggcggcacccatcacttccgcacgccggccgcgcaaggccacgaccatccgtgcgtggtggtgcgcggtgcacacgcaccggtgctgcgcgacaccccggtcaccctggtcggccagctctgcacgcccaaggatgtgctggcccgcaatcagcgcgtcgcagcgcttgcccccggcgactgcctggccttcccgctggccggcgcctacgcctggaacatctcgcatcagcagttcttgatgcacccgccaccg

SEQ ID NO: 39289 - DNA, 1911 bp, Xanthomonas campestris
atgatttccctgcgcaacttctccatgcgacgcggcgagcgtctgctgctgtccaacgtcgacctgaccatgcatgccggctaccgcgtcggtgtggtgggccgcaacggcactggcaagtccagcctgtttgccgcggtcaagggcgagctggaagccgacaagggcgacgtcgacctgcctggcaaggtgcgcaccgccagtgtctcgcaggaaaccccgtccttgcccgacccggcgctgtcgttcgtgctcggcggcgacatcgaggtgtccgccatcctgcagaaggaagccgaggcgaccgcacgcgaggactgggaagcggtggccaatgcgcaccagaccatggccgagctgggcgcgtacgacgccgaagcgcgcgctggcaagctgctgcacggcctgggcttcccggccgatacccaccatcgcgcggtgtcctcgttctccggcggctggcgggtgcggctgaacctggcgcgcgcgctgatgatgcccagcgacctgctgctgctggacgaaccgaccaaccacttggacatggacgcggtgctgtggctggagcaatggctgctcaagtacccgggcaccttgctgctgatcagccatgaccgcgagttcctggacaacgtcgctacccacacgctgcacctgcacggcggcaccgccaagctgtacgtcggcggctacaccgatttcgagcgccagcgcatcgagcacctgcgtcagcagcagattgcgcacgacaaggaacaggccgagcgcgcgcatctgcagagcttcatcgaccgcttcaaggcgcaggccagcaaggccacccaggcgcagagccgcatgaagcgcctggccaagatggccggcaccgaggcggtgcgcgccgagcgcgaattccgcatccagttcgcccagcccaatcggctgccgttttcgttgatccggctgaatcatctggatgccgggtatgcggcttcgccgcgggaatcgggaatcggggatggggaatcgcaaaagcgtgggtccagcgatgcgattaccgtgctgcacgatgttggattcgggctggaggcgggcgaccggatcgggttgctggggcccaatggcgcgggtaagtcgacgctggtcaaaacactggtgggtgagcttgcaccgctgtcgggcgagcgcagtgcgcacccggacctgcgcatcggctacttcgcccagcacacggtggaatcgctgcatgaaggccagtcgccgatggaccatttccgcgatctgtcgccggacggttccaatcaggcgttccgcgatttcctgggtaaatggaatttcgctggcgaccgtgcgtttgaagtggtggatggcttctccggtggcgagcgcgcgcgtcttgcgctggcgttgattgcctggcagcagccgaacgtgctgctgctcgacgaaccgaccaaccatttggatctggaaatgcgcgaggcgctggccgaggcgctgagcgacttcgaaggcgccatcgtgatggtctcgcatgaccgccatctgatcggcctggtctgcgacagtttctggcgcgtggccgatggcgtggtcgagccgttcgatggcgacctggacgaatacgccgcctggttgcgcagccgcccggccgcgcagggcaccaagcagaagatggccgaagtggcaccgaccccgccaccgccgaccaagccactgccgccgaaaaaggccgtcaacccgcacaagttggccagcgccgaaaagcgcgtgggcgaactggaagccgcgttggcggacctggaccggcagctcgccaacccggccaactatccagatgccgacaagatggcggtattgggccgcgagcgtgaaaccaccgcgcagcagctggccgctgccgaagcggcctggatggagttgctggacggc

SEQ ID NO: 39290 - DNA, 2094 bp, Xanthomonas campestris
atgatcgatcttcctcgccgccgcatgctgcaggccggccttgccggtggtgcttccaccttgctgccaagcatcgcgcgggcagcggccatcgcaccggaccgccgcagcggcacgctggaagacctgcagcatgtggtgatcctgatgcaggaaaaccgcgcgttcgatcattacttcggcagcctgccgggcgtccgtggcttcggcgaccgctttccgattcccgcaccaccgctgccgggcgcgcctgcgcgtaccgtgtggctgcaacccagcgaggacggccgccaatggctggccccgttcgcgctggataccgcagcgcagttcggctacatgcgcgtgcagggcacgccgcacagttgggtggacgcgcagcgcgcctgggatcacggccggctcggcaactggccggcggccaagcacaaccacgcgctggggtattaccgccgcgcagacattccgttccagttcgcgctggccgatgcgttcaccgtctgcgatgcgtaccacgccgcgatccagaccggcaccaactccaaccgcgtgttcctgtggaccggcggcaacgatccgctggcgcgcgccggtgggccggtgatcggcaactcgcacgacaactttcccgcgctgggcgggttcgccgagccctatcgctggaccacgtatgtggagcaattgcagcgtgccggcgtgtcctggcagatctaccaggacatgcgcgacaacttcaccgacaacccgctggccggcttcgacgtcttccgccaggcctacagccagacgcccggccacgatgcgcaactgcgcgcgcgtggggtgagtacgcgtggcgtggagcaactgcgcgaagacgtcatcggcgggcgcctgccgtcggtgagtttcatcattgccgatgccgccggcagcgaacatcccgacccctccagcccggcccagggcgcggcctataccgcacgcgtgctggatgcgctcaccgccgatccgcaggtgtggagccgcacggccttgctgctgatgttcgacgagaacgatggcttcttcgaccacatgccgccgccggcgccgccttcgccggacccacgtgcggctggcggctttgccggtgcgtcgagcatcgccaccgacgacgagtatcaccgccacccggcgccgggcgagcagaaggtggacctgccggagtggcgcgggcgcccatacggcctgggcccgcgcgtgccgctgtacgtactctcgccctggagccgcggcggctgggtggattcgcaggtctacgaccacacctcggtgctgcgcctgctggagcggcgcttcggcgtgccatgcactgcaatcaccccgtggcggcgcgcggtgtgtggcgatctcactgcggcgttcgatttcagccgcacggacacgcgcccgttcgtcggcacgctgccggatatcagcgccaccgccacgcgcgccgccgccctgcaccaacacacgttgccaccgctgccgcccaccttgcagccaccggagcaagctttcggcctccggcgttcgcgcgcggtgccgtatcgcccccgtgtgcaactcgatgtcgtgcaggcccgcggcgaagtggtgttgcgcatggccaatgccggcgcggcggccgtgctgcacgtctacgagcgctacgacctggccgcgattccgcgccgctacaccgtcggcgccgatgcgccgctggacggcacctggacgacctacgacggccgctacgacctgtgggttctcgggccgaacgggttccatcgccattaccgcggcgatgtgggcgtcgcccccttgatcgccgatgttgcgcaagatcccggtgatgcacaggcgctccgcctgacgctgcacaaccccggcaacgtgccggtcgcggtcacgctgcaaccggccgcgtatgccaacgcgcaaccgcgcgagggtgtcaccatcgcgcccgggcagcatcaccagcgcagctggagcgccgcggccaccggcggctggtacgacctgtggatcgaacacgacggcgcaagccaacgcctggccggccgcgtggaaaccggagcagacagcgtcagcgacccggccatgggc

SEQ ID NO: 39291 - DNA, 1446 bp, Xanthomonas campestris
ctggtgatggtctatcaccgcctgccgtatgacgaagtggtcgagcacggcgagctggtgcgccgcgcgccgcgctcgcccaacggcatcattccctcgctgctgagcttcttcgaaggtggccagcgcggctcgtgggtggcctggagcgtggacgaccccaagcgcgggccgttccagacccacaccgaggtggatgcgcagcgctacccgacgctcaccgccgcacgcgtgccgctgagcaagagcgaggtggacatcttctacaagcggttttccaaggaagcgttctggccgatgctgcatgtgttctgggaacgcgcgcgcttccgcgaggacgactggcaggtatttcttgcagtcaaccgcaagtttgcacaggccacctcgaccgaggccgcgcacggcgccacggtctggatccatgactacaacctgtggatggtgccggcgtacctgcgcgagctgcgcccggatctgaagatcgcgttcttccatcacacctacttcccctcggctgacgtgttcaatgtggtgccatggcgccgcgagatcatcggtagcctgatgtgctgcgattacgtgggcttccatatcccgcgccaggtggagaacttcgtggacgtggtgcgcggcgtgatgccggtggaacgactggcgcaggaaagctgcgcgccacggtttctcacctatggctgcgcggtgggcctggacaccatgaccacctgcctgcgtgttgccgatcgcgacgtggcgctgggcgcgcatccggtgggcaccgacctgcgccgcattcgcgccgcgctgagcaagccggacgtgcgcaacgacatcttcaagctgcgccgcgagatcggtgcgcgcaagctggtgttgtcggtggagcggctggattacaccaagggcacgctggcgaaactggaggcgttcgagcgcctgctcgacagccagcggcagctgctgggcaaggtcaccttgctgatggtgtgcgtgccggcggcgcgcgagatgaccatctaccgcaccttgcagacgcagatcgaacaggcggtgggccgcatcaacgggcggttctcgcggctggactggacgccggtgcgcttcttcgcacaggccctgccgttcgagcaggtggtggcgcattacgccgccgcgcaggtgatgtggatcacgccgctgcgcgatggcttgaatctggtggccaaggagttcgtggcggtgcaaggcatcgaaggcggcagcggcgtgctggtgctgagcgaatttgccggcgcggctgcagaactcaaaggcgcggtactgaccaacccgcacgacccggccgatctggcggccggcctgttgcaggcactggcgatgcccgatgacgaggcggccgggcgcctgcggcagctgtacgacagcgtggagtactacaacatcgaccactgggggcgcgacttcctg

SEQ ID NO: 39292 - DNA, 2142 bp, Xanthomonas campestris
ctggccgctgccatcaccctggcgctggctgcttgttctggaaaagattcgtccggtaaggagtccaccaccgtgcccgagaagaccgctaccacccagaccccggatgccgcgccgaacccgctgctgaccgccagcacgctgccgttccaggcgccgccgttcgacaagatccaggacagcgattacctgcctgcgttcgaggaaggcatgcgccagcacctggcggacgtgcgcaagattgccgacaaccccgagccggccaacttcgacaacaccatcgaggcgatggagcgcagcggcgaaacgctcacccgcgtctcgcgcattttctttggcctggtgcaggccgataccagcgacgcccgccagaaaatccaggaagaggtggcgcccaagttggccgcgcaccaggacgagatcaatctggatcccaagctgttcgcacgcgtcaaggcgatctacgatcaacgcgatacgctgagcctggagccggagcaaaagcgcctggtcgaacgccattacgaaaaactggtgcgcgccggcgcgcagctgtccgacgccgacaagaccacgttgcgcaagctcaacgtggaggagaccacgctctccacgcagttccataccaagctggtggccgcctcggctgccgccgccgtggtggtggacgacaaggccaagctcgatggcttgagcgagggcgacatcgccgccgccgccgatgccgccaaggcgcgcaagctcgatggcaagtatctgctgaccctgcagaacaccacccagcagccggtgctggcgtcgctgaaggatcacgacctgcgcgcgcgggtgatgaaggcctcgcaaacccgtgccgaacagggcgacgccaacgacacccgccagaccatccagcggctggcgcagctgcgcgcgcaaaaagccaagctgctcggcttcgacagctacgccgcctacagcctgggcgaccagatggccaagacgcccgacgccgcgctcaagctgttgaccgacaccgtgccggcggcgaccgccaaggcgcgccgcgaagtgggcgagatgcagaaggtcatcgatgcgcagcagggcggcttcaagctcgctgcggcggattgggacttctacgccgagcaggtgcgcaaggccaagtacgacctggacgaatcgcagatcaagccctatttcgaactggacaacgtgctgcagaacggcgttttctacgcagccacgcagctgtatggcatcaccttcaagcagcgcaccgacatcccgacctatcacgcggatatgaaggtgtacgaagtgttcgatgcggacggcacctcgatggcgctgttctacaccgactacttcaagcgcgacagcaagtccggtggcgcttggatggacgtgttcgtggagcaggacgggctgaccggcaccaagccggtggtctacaacgtgtgcaacttcaccaagcccgccgcgggccagccggcgttgctgagctttgatgacgtcaccaccttgttccatgagttcggtcacgcactgcatggcatgttctccaaggtgaagtacccctcgatcgccggcaccagcacctcgcgtgactttgtcgagttcccctcgcagttcaacgagcactgggcgtccgacccgaaggtcttcgccaactacgccaagcactaccagaccggtgcagcgatgcccgatgccctggtggagaagatcaagaaggccaagaccttcaacagcggctacgccaccaccgagtacttgtcggcggcattgctcgacctggcctggcacacccagccggccgatgcaccgctgcaggacgtgagcaagttcgaggccgatgcgttgaagcgcttcaaggtcgatctggccgaagtcccgccgcgctaccgcagcacctatttcgaccacatctggggcggcggttattcggccggctactacgcctatttctggtcggaagtgctcgatgacgacgcgttcgagtggttcaaggaaaatggcggcctgacccgcaagaacggcgacaccttccgcgccaagatcctttcgcgcggcaataccgtggatctggcgacgctgtaccgcgatttccgtggcaaggatcccagcgtcaaggcgctgttggaaaaccgtggtttg

SEQ ID NO: 39293 - DNA, 984 bp, Xanthomonas campestris
atgaagattctggtaacgggtggtggcggctttctcgggcaggcgctgtgccgtggattggtggcgcgtggacacgaggtggtgagctttcagcgcggtgactatccggtgctgcacaccttgggtgtgggccagatccgtggcgatctggctgacccgcaggcggtgcggcacgcacttgccggcatcgatgcggtgttccacaacgcggccaaggccggggcatggggcagctacgacagctatcaccaggccaacgtggtgggcacgcagaacgtgctcgatgcgtgccgtgccaatggcgtgccgcgcttgatctacacctccacgcccagcgtgacccatcgcgccaccaatccggtggaaggcttgggcgcggacgaagtgccgtacggcgaagacctgcgtgcgccgtatgcggcgaccaaggcaattgccgaacgcgcggtgctggcggccaacgatgcgcagctggccaccgttgcgttgcgcccgcgcttgatctgggggccgggcgacaaccacctgctgccgcgtctggcggcacgtgcgcgcgccgggcggctgcggatggtgggcgatggcagcaacctggtggacagcacctacatcgacaatgcggcgcaggcgcacttcgatgcgttcgcgcatctggcgccgggcgctgcgtgcgcaggcaaggcgtacttcatctccaacggcgaaccgttgccgatgcgcgagctactcaaccgtttgctggcggcggtggatgcaccggcggtgacgcgctcgctatcgttcaagacggcgtaccgcatcggtgcggtgtgcgaaacattgtggccactgttgcgtctgccaggcgaagtgccgctgacgcggtttctggtcgagcagctgtgcacgccgcattggtacagcatggaaccggcgcgacgtgacttcggctatgtgccgcagatcagcatcgaagagggtctgcaacggctgcgatcctcatct

SEQ ID NO: 39294 - DNA, 1014 bp, Xanthomonas campestris
atgctcttccagaatgtctccatcgcgggactggcgcatattgatgcgccgcacacgctgacttccaaggaaatcaacgagcgcctgcaaccgacctacgaccgtcttgggatcaagaccgacgtattgggcgatgttgccggtatccatgcacggcgcttgtgggaccaggatgtccaggcatcggacgccgccacccaggctgcccgcaaggccctgatcgatgccaacatcggcatcgagaagatcggcttgctgatcaatacctcggtgagccgtgattacctggagccgtccacggcctccatcgtgtccggcaacctgggtgtcagcgaccactgcatgaccttcgacgtggccaacgcctgtcttgccttcatcaatggcatggacatcgctgcgcgcatgctcgaacgcggcgagatcgactacgccctggtcgtggatggcgaaaccgctaaccttgtttacgaaaaaaccctcgagcgcatgacctcgccggacgttaccgaagaagagttccgcaacgaactcgctgcgttgacgctgggctgcggtgcggccgccatggtgatggcacgttcggaactggttcccgacgcgccgcgctacaagggcggcgtgacgcgctcggccaccgagtggaacaagctgtgccggggcaacctggaccgcatgttcaccgacacccgcctgctgctgatcgaaggcatcaagctggcgcagaaaaccttcgtggccgccaagcaggtgctgggctgggctgtggaggagctggaccagttcgtcatccaccaggtcagccgcccgcacacggcagcgttcgtgaagtccttcggcatcgacccggccaaggtcatgaccatcttcggtgagcacggcaacatcggcccggcctcggtgccgatcgtgttgagcaagctcaaggagctgggccggttgaagaagggcgatcgcatcgcgctgctcggcatcggttcgggcctgaactgctcgatggccgaagtggtttgg

SEQ ID NO: 39295 - DNA, 1710 bp, Xanthomonas campestris
aagaagacggtggcgcggttcgtggccgaaacgctggaaagtgccggggtggagcgaatctggggggtgaccggcgatagtctcaacgggctgaccgatgcgttgcgcgagatgcagagcatcgaatggatgcatgtgcgccacgaagaggtggcggcattcgcggccggcgcagaggccgcggtgaccggcaagctggcggtgtgcgccggcagttgcgggccgggcaatctgcatttgatcaatgggctgttcgattgccaccgcagccggcagccggtgcttgccatcgccgcgcatatcccctcgtccgagatcggcttgagctatttccaggagacgcatccgcaggagctgttccgcgaatgcagccacttcgtcgagctggtgaccaacccggcgcagttgccggaggtgctgcaccgcgcgatgcgcacagcgatcctgcagcaaggcgtggccgtggtggtgattcccggcgacatcgcgctgatggaggtcgacaaacacctctctgccgcgtggcccgtgctacgtgcaccgcggctgctgccggcggccgaggacgtgcagcaactggcggagatcctgcagcagagcaaggcggtgacgttgctctgcggcagcggctgtgccggggcgcacgatgcggtggtggcgctggccgacacgctgggcgcgccgatcgtgcatgcgctgcgcggcaaggagcatgtggagtggagcaacccgttcgatgtcggcatgaccggcttgatcggcttcagctccggctatcacgccatgctcaattgcgacaccttgatcatgctgggtacggatttcccttatcgccagttctatccgaaggacgccacgattgtgcaggtggaccgtgacccggctgcacttgggcgtcgcacgcccttgcagctgggcattgccgccgatgtgggcgaaaccatcgctgcactgttgccgcagctggagcggcgcgaggagcgcggctttctggacaagtcgcttgcgcactaccgcaaggcgcgcgaggggctggacgaattggcggtgccggcggacgaaggcgagcccttgcatccgcaattcgtcacccgcctgatcagccagattgccgacgaagatgcggtgttcacctgcgacgtgggcacgccgaccgtgtgggccgcgcgctatctgcgcatgaacggacagcgccgcctgctgggctccttcaaccacggctcgatggccaatgcgatgccgcaggcgctgggtgtgcaggcggcctgcccggggcggcaggtgatttcgctctccggcgatggcgggtttgcaatgttgatgggcgacttcatttcgctggcgcagttgaacctgccggtgaaggtggtggtgttcaacaacgcatcgctgggatttgtggcgatggaaatgaaggcggccgggtatctggataccggtaccgagctgcgcaatccggatttcgctgcgatgagcaatgcgatgggcatcctggggctgcgcgtggagacctcctcgcagctggagcgggcactgcgccaggcgttcgcgcattcgggcccggccttggtcgacgtgcgcattgccacgcaggagctggtggtgccaccggcgatcaagctggaacaggccaagggcatgggcttgtatctgctcaaggcggtgatgagcgggcggggcgatgaggtgctggcgctggccaagaccaac

SEQ ID NO: 39296 - DNA, 1020 bp, Xanthomonas campestris
atgagcgatccgacacagaaaatcgccgttctcggcgccggttcctggggcacggccctggcggcgctggttgcccggcacggtcacccgaccgtgctctggggccgcgatgcggcgatggtggatgccatcgaccgcacccacgagaaccctcgctatctgccaggcattgccctgccggacagcctgcgcgcgaccaccgatcttcagcagaccatcgccggcgccagctggatcctggtggtggtgccgtcgcacgcgtttaccgaaacaatcaagctgctcgcgccgctgcgcccagctggcgcgggcatcgcctgggccaccaagggcttcgagccgggatccgggcgcttcctgcatgaagtggcgcgcgacatccttggccccagcgtgccgctggccgtggtgaccgggccctcgttcgccaaggaagtcaccctgggcctgccgaccgcgatcaccgtgcacggcgatgacgccgcgtttgcgcaggtggtggccgatgccatgcacgggcccaccttccgcgcctacaccggcgatgacatggtgggcgccgaactgggcggcgccatgaagaatgtgctggcggttgccaccggcgtggccgatggcatgcagctgggcctcaacgcccgtgcgggcctgatcacgcgcggcttgaacgaaatgctgcgcctggccgcggtcatcggcgcacggccggaaacattgatgggcctggccggcctgggcgatctggtgctgacctgcaccggtgatctgtcacgcaatcggcggctgggtctggcgctgggacgcgggcagagcttgagcgatgccatccgtgagatcggccaggtggttgaatcagtgcagaccgccgacgaggtcatgcgtcaggcagagcagcatggcatcgagctgccgatctccaacgcagtgcgtgcagtcctgcatggcgagatcaccccggaagcgggattgaaggaattgctggcacgcgagcgcaagcccgagtatccgcagaccttgttt

SEQ ID NO: 39297 - DNA, 750 bp, Xanthomonas campestris
atgacccacacgcgcacaaatggcacttcctggaccctgctgtcgctgcgccccagcggcgagcacgcgccgctgcggcgtgcggtggcccggcatggcggccagttgctggcggtgtcgccctggcgcctgcagatcaacgatacgctgcaggcacgcgatgcgctgcggcacgcactgggagcgccgattgtcgtgttcaccagcccggccgccgtgcacgcggcgcaccggctgctgcccctgcagcggcctggaccggcccagtgggcaagcgtgggcgaaggcacggcgcgggcgctgcaggcctgcgggatcgacgcggtggtgcgcccggcgcgcatggacagcgaaggcctgctggcactgccggcgttcaatcccccgctgcacgccgtgggcctggtcaccgcgcccggcggccgcggcatgctggcaccggcgctggagcagcgcggtgcgcggatcctgcgcgcagatgtgtatcagcgtgttgcgctacggctgcgtgcgtcgacagtgcatgtgttggagaccgcgctgccacgcagcgtgatggccctgagcagcagtgaagcactgatgttgatcgtgcagcagctgccgccgtcattggccactgcattgaagacccgcccggtggtcgcctccagcgaccgcatgctggaagccgcccgcgctgccggcttcatgcaggtccatcgcgcggagggcccactgcctgcgcaattggcagccgccgccgctgcg

SEQ ID NO: 39298 - DNA, 1296 bp, Xanthomonas campestris
tcccccatgcaaggtcagcccatgcccgcagcccgtcccgtcgccatcctgggcggcgttcgtatcccgttctgtcgccagaacaccgcatacgcggacgtgggcaacctgggcatgtcggtgcgcacgctgggcgcgctggtcgaacgcttcgggctgcatggccagcaactgggcgaggtggcgatgggggcggtgatcaagcattcctccgactggaacctggcccgcgaagccgcgctgtcgtcgggcctgtcgccgctgacgccgggcatcaccctgcagcgcgcctgtggcaccagcctggattcggtgatcaccatcgccaacaagatcgcgctggggcagatcgactcgggcatcggcggcggctcggacaccacctccgaggtgccgatcgtctacggcaagaagctgcgggcgcgcctgctggccgccaaccgcgcgaaggcgaccagcgacaagctcaaggcgctgctacgcggtttcaagctgggcgagctcaagccagagttccccggcgtggccgagccgcgcaccggcaagagcatgggcgaacactgcgaagacatggccaaggaatggaacatctcgcgtgattcgcaggacgaatgggcagtggcttcgcaccacaagttggcggccgcgtatgagcgcgggtttttcgattcgctgattgccccgttccgtggcgtgtcgcgcgacaacatcctgcgcgcggacacctcgctggaaaagctggccacgttgcgcccggcgttcgacaagacctccggccgcggcacgctcactgccgccaattccaccccgctcaccgatggcgccgccgcggtgctgttgtccagcgaagcctgggcgctggcccatggccacacgccgatggcctacctgcgcgatgcacaggtctcggcggtggatttcgtgcatggcgagggcctgctgatggcgcccacggttgcggtgccgcagatgctggcccggcacgggctgaccttgcaggacttcgacatctacgagatccacgaagccttcgccgcgcaggtgctgtgcacgctgcgcgcctgggagagcgaggattactgccgcaatcgcctggggctggacgcgccgctgggccgcatcgacccggacaagatcaacccgctgggctcctcgctggccaccggccacccgtttgccgcgaccggcgcacgcgtcgtggctaccgcagccaagcagctggaagaacgcggcggcggacgtgccctgatttcgatctgcaccgccggcggcatgggcgtggtggcgatcgtggaa

SEQ ID NO: 39299 - DNA, 963 bp, Xanthomonas campestris
atctactccagaatcgcgggcacgggtagttatttgcccgaaaaggtgttgaccaacgacgatatgtccaagatcgtcgacaccagcgatgaatggatccgctcgcgtaccggcatccgtgaacgtcacatcgttgccgacgaccagaccaccagcgacctggcgtacttcgcctcgctgaaggcgatggaagcagccggtgtcactgccgacgagatcgacctgatcgttgtcggcaccaccaccccggacctgattttcccgtccactgcgtgcctgttgcaggcgcggctgggcaatgtcggctgcggtgccttcgacgtcaacgcggcctgctcgggcttcgtctacgcgctcagcgtggccgacaagttcgttcgcagtggcgacgccaagaccgtgctggtcgttggcgccgaaacgctgacccggatcgtcgactggaccgatcgcaccacctgcgtgctgtttggcgacggtgcgggcgcggtcgtgctcaaggccgacgaagacaccggcatcctcagcacccatctgcatgccgacggcagcaagaaggaattgctgtgggatccggtcggtgtgtctgttggcttcggcgaaggcaagaacggcggtggcgcgttgctgatgaagggtaacgacgtgttcaagtacgccgtcaaggcgctggactcggtggtcgatgaaaccctcgccgccaatggcctggacacgcacgacctggactggttgatcccgcatcaggccaatctgcgcattatcgaagccaccgccaagcggctggatctgccgatggagcaggtggtggtcaccgtcgaccggcatggcaatacctcgtcggcctcggtgccgctcgcgctggacgaagcggttcgctccggtcgcgtgcagcgtggccagttgctgctgctggaagccttcgggggcggatttacctggggctcggcgctgctgcgctac

SEQ ID NO: 39300 - DNA, 936 bp, Xanthomonas campestris
gtgaccgaatctacgctcgctttcgtgtttcccggccagggctcgcagtccctgggcatgctggctgaacttgccgaactgcatccgcagatccgcgagaccttcgtcgaggcctccgatggcgccggcgtcgatctgtgggccctgtcgcagggcggcccggaagagatgctcaaccgcaccgaatacacccagccggcgttgctggccgccggtgtggcggtgtggcgcctgtggaacgcgcagcgcggcgaacgaccggcggtgctggccggccatagccttggcgagtacaccgcactggtcgctgccggcgccttgtcgctgcacgatggtgcccatctggtgcggctgcgcgggcagttcatgcaggcagcggcgcccgccggtgtcggcgcgatggccgcggtgctgggcgccgaggatgcgctggtgcgcgaggtctgtgtcgaggcctcgggcagccaggtggtggtgccggccaacttcaattcgcccggtcagattgtgatcggtggcgatgcggcggcggtggatcgcgcgctggcgttgctggccgagcgtggcgtgcgcaaggcggtcaagctggcggtgagcgtgccgtcgcacactccgctgatgcgcgaggcggccaaccagttgggtgaggcgatggccgggttgacctggcacacgccgcagattccggtggtgcagaatgtcgacgcgcaggtgcacgccggccacgaggcgatccgccaggccctggtcgagcagctgtatctgccggtgcagtggaccggctgcgtgcaggcgctggccgcgcagggcatcagccggatcgccgaatgcggcccgggcaaggtgctgagcgggctgatcaaacgtatcgacaaaagcctggatgcccgttcgctcgcgaccccggccgattacgccggcgcgctggatgcgtgg

SEQ ID NO: 39301 - DNA, 741 bp, Xanthomonas campestris
atgagcaagccattgcagggcgagatcgctctggtcaccggcgccagccgcggcatcggcgcggccatcgccgatacgctggccgcccagggtgccacggtcatcggcacggccacctccgcctccggggccgctgccatcggcgagcgcctggctgccaacggcggccacggccgggagctcaatgtcaccgatgcggccgcggtcgatgccttgatcgatgcgatcggcaaggagttcggtgcggtctcgatcctggtcaacaacgccggcatcacccgcgacaacctgctgatgcggatgaaggacgacgattggcaggcgatcatcgacaccaacctgaccagtgtcttccggacctccaaggcggtgatgcgcggcatgatgaaagcgcgcaagggtcgcatcatcaacatcgcctcggtggtgggtgtgaccggtaatccgggccagaccaactacgcggcggccaaggccggcatcattgcgttttccaagtcgctggccaaggaaatcggctcgcgcgggatcactgtcaatgtggtcgcgcccggcttcatcgataccgatatgaccaaggcgctgccggaagatgccaagacagcgttgctgcagcagatcgcgctgggccatctggggcagccggacgacatcgccaatgcggtggcattcctggctggcccgaccgcccgttacatcactggtgagaccctgcacgtcaacggcggcatgtacatgccg

SEQ ID NO: 39302 - DNA, 237 bp, Xanthomonas campestris
atgagcaccatcgaagaacgcgtcaagaaaatcgtcgtcgaacaactcggcgtcaaggaagaggaagtcaccaccagcgcatcgttcgtcgatgacctgggtgccgactcgctggacaccgtcgagctggtgatggcgctggaagaagagttcgagtgcgaaatcccggacgaagaagctgagaagatcacgtcggtccagcaggcgatcgactacgtcaaggctcacgtcaagagc

SEQ ID NO: 39303 - DNA, 1227 bp, Xanthomonas campestris
cgtcgtgttgtcgttaccggcatgggcatggtgtcgccgctgggcaatgatctggccaccagttgggatgggatcatccacggtcgctcgggcattggcccgatcaggcagatcgatgcctcgcagttcaccaccaggatcgcgggcgagatcaagaatttcgatcccacccagtttgtgtccgccaaggacgtcaagaagatggattcgttcatccactacggtgtcggcgcctcgttcatggcgttggacgattccgggctggagatcaacgaaagcaatgccgaacgcgtgggcgccattctgggctccggtatcggcgggctgctcggcatcgaagagcagaccatcaaattgcatgagggcggcgcgcgcaagatttcgccgttctatgtgcccagcaccatcatcaacatgctgccgggtcaggtgagcctgatcaaaggcctgaagggcccgacgttctcggccgtgtcggcctgcgccacctccaaccattcgatcggcactgcgatgcgcatgatccagcacggcgatgccgacgtgatgctggccggtggcgccgagcgcggttcgtccccaagttcggtgggcgggttctgcgcgatgaaggcgatgtccacgcgcaacgacgaccccaccgctgcatcgcgtccgtgggacaagcagcgcgacgggttcgtgctgggcgacggcgccggcgtgctggtgctggaagagtacgaacacgccaaggcacgcggcgcgcgcatctatgcagagctggtcggtttcggtgccagttcggatgcgttccacatgaccgcgcccagcgaagacggcgaaggcgcggcgcgcagcatggccgcagcgatgcgcgacgccaagctcaaccccgagcagatcggctacctcaacgcgcacggcacttccacgccgctgggcgatatggctgaaaccatggcgatgaagcgtgcgctgggcgaccacgcgtacaagaccatggtcagctcgaccaagtcgatgaccggccacctgctcggcgcggccggcggcgtagaagcaattttctcggtgatggcgctgcataccggcatcattccgccgaccatcaacctggaagagcccagcgaaggctgcgatctggattacgtgccgaacgtggcgcgcgaggtgcaggtggatgcggtgatgtccaacggcttcggctttggcggcaccaacggcaccctggtgttcaaacgcatc

SEQ ID NO: 39304 - DNA, 612 bp, Xanthomonas campestris
atcacgttgtgggggcggcgcaattccagcaacgtccgcaaggtgctgtggtgccttgaagaggcgggcgtggcgtatacctcgatcgaggtgggcggcgcattcggcggaaacgacacacctgcgtaccgcgcattgaatccgaacgggctggtcccagcgctccaggatggcgcgctggtgctgtgggaatccaacgcgatcgtacgctatctggcggcgcgttacgcaccggcgttgtacccgcactcaccggccacgcgtgcgctgggcgaccgctggatggactggaccacgtcgacctttgccggcgtgtttcgtgatctgttctggggcgtgttgcggaccccgcaggccgaacgggatgccacacggattgccacagcgcttcaacgctgcggtgagctactcgcagttgccgacgctgcgctggcacagcagccgtatctgtccggcgacgacttcgcgatgggtgacattccattgggcagctttatctacgcgtgggtcgagattccaatcgaacggcccgagttgccgcatctgcacgcctggtatcaaagattgcgtgcgcggccggcctaccagcgtggcgtgatgacgccgctgact

SEQ ID NO: 39305 - DNA, 711 bp, Xanthomonas campestris
gaggggcgtatccagttggaaccgtcatggaaggcgcgggtgggggagtggttgttgcagccgcagatgcaggagctgtccgcgttcctgcgccagcgcaaggccgccaatgcgcgggtgttcccgcccggcccgcagatctttgccgccttcgatgccaccccgttcgagcaggtcaaggtggtggtgcttggccaggacccgtaccacggcgaaggccaggcgcatgggctgtgcttttcggtactgcccggggtgccggtgccgccgtcgctgctgaacatctacaaggaaatccaggacgacctgggcattccgcgccccgaccatggctacctgatgccatgggcgcgccagggcgtgctgctgctcaatgcggtgctgacggtggagcagggccgcgccggcgcgcaccagaacaagggctgggaaggcttcaccgaccatgtggtggaaaccctcaacagcgagcgcgagggcctggtgttcctgctctggggcagctacgcgcagtccaagggcaaagtgatcgaccaggcgcgccaccgggtgttcaaggccccgcatccgtcgccgttgtcggcgcaccgcggcttcctggggtgcaaacatttctccaagaccaacgaccatttgcagcggcgcgggctgagcccgatcgactggtcgttgccgccgcgcgcggcgctggatcttagcctcgccggcggc

SEQ ID NO: 39306 - DNA, 1295 bp, Xanthomonas campestris
atgagcgacaaaccgctgaccgatttgactttttcctcgttcgacctgcatccggcgctggtcgccgggctggagagcgccgggtttacgcgctgcacgccgatccaggcgctgaccctgccggtcgccctgccgggcggcgacgtcgccggccaggcccagaccggcaccggcaaaacgctggcgttcctggtcgcggtgatgaaccgcctgctgatccgcccggcgctggccgaccgcaagccggaagatccgcgcgccctgatcctggcgcccacccgcgagctggccatccagatccacaaggacgcggtcaagttcggcgccgacctgggcctgcgctttgcgctggtctacggtggcgtggactacgacaagcagcgcgagctgctgcagcagggcgtggacgtgatcatcgcgaccccgggccggctgatcgactacgtcaaacagcacaaggtggtctcgctgcacgcctgcgaaatctgcgtactggacgaagccgaccgcatgttcgacctgggcttcatcaaggacatccgcttcctgctgcggcgcatgcccgagcgcggcacccgccagacgctgctgttctcggccacgctcagccaccgcgtgctggagctggcctacgagcacatgaacgagccggaaaagctcgtcgtggaaaccgagaccatcaccgccgcgcgggtgcgtcagcgcatctatttcccctccgacgaagagaagcagacgctgctgctgggcctgctgtcgcgcagcgaaggcgcgcgcaccatggtgttcgtcaacaccaaggcgttcgtggagcgggtggcgcgcaccctggagcggcacggctaccgcgtgggcgtgttgtccggcgacgtgccgcagaagaagcgcgagtcgttgctgaaccgcttccagaagggccagctggaaatcctggtggccaccgacgtggccgcgcgcggcctgcacatcgatggcgtcaagtacgtctacaactacgacctgccgttcgacgccgaagactacgtgcatcgcatcgggcgcaccgcgcgcctgggcgaggagggcgatgcgatcagcttcgcctgcgagcgttatgcgatgagcctgccggacatcgaggcctacatcgagcagaagatcccgggtcgagccggtgactaccgagctgctgaccccgttgccgcgcacaccgcgcgcaacagtgtaaggtgaagaggtcagcgacgacgctggcgacagcgtgggcacgatcttccccaaagcacgcgagcagcgtgcggccgacgaagcgcgtc

SEQ ID NO: 39307 - DNA, 3102 bp, Xanthomonas campestris
atcaccgctgcctggctcaaggacgaaaccgagcacgtccgtgaattgctggagcaggcgcgcctgccggccgcagagcaggccaaggtgcaggcgctggccgccgacctggtcacccgggtgcgcgcacgtgcccaggatcagggcgcgatcgaagcctttatgcgccaatacgatctgggcagcgaagaaggcgtgctgctgatgtgcgtggccgaagccttgctgcgcattcccgaccaggacaccgccgacaagctgatccgcgacaagctgggcgaggcggactggaaaaagcacgtgggtggcagtgattcggtgctggtcaacgcatccacctggggcttgatgctcaccggcaagctggtgcagctcaacgaccttacccgcgccgatgtgccgggcgccttcaaacggctgatcggccgcgtcggcgagccggtgatccgtttggccgtgcgccaggcgatgaagatcatgggccaccagttcgtcatgggccgcaccatcggcgaggcgctggcgcgttcgcgcaagggtgacaacgccaattaccgctattcgttcgacatgctcggcgaaggcgcgctgaccatgaaggatgcgcagcgctatctgcaggcgtatcgcgatgccatccacgccatcggccgcagtggcagcttcgtcggtaccgacgtgtttgccgcgcccagcatttcgatcaaattgtccgcgctgtatccgcgctacgaacacgccaagcgcgcacgcgtgatggccgagctggttcccggcgtgctggagctggcacaactggccaagtcctacggcatcggctacaccgtcgatgccgaagaggccgaccgcctggagctctcgctggacatcatcgaagccacgttttccgatccatcgctggatggctgggagggctacgggctcgcagtgcaggcgtatcagaagcgcacgccctacacgatcgatttcctcgccgatctggcgcgtcgcgttggccgccgcattccggtgcgtctggtcaagggcgcgtattgggacgcagagatcaagcgtgcgcagatcgacggccaccccgggtatccggtatttacccgcaagcagaacaccgacgtgtcctatctggcctgcgcacgccgcatgttcgcgcacagcgacgcgctgtacccgatgttcgccacccacaacgcacagaccatcgctgcggtgcgcgcgatctcggcagggaaaacctacgagcaccagaaactgcacggcatgggcgatgacctgtatgccgaggtgattccggccgatcggctgggattgccgtgccgggtgtatgcaccggtcggctcgcacgaagacctgttgccgtacctggtccgtcgtctgctggaaaacggcgccaactccagcttcgtcaatcgcatcaccgatgaagacgtcgccatcgaagacctgatccgcgatccggtcgaggcggtgtcctcgtttgcgtccatcccgcaccccaagatcccgctgccggccgacctgctgcgcagccagaaccagaacaggaagaactccatgggcgccaacctcgccaacgacaacgatctgcggcagctggccgaccaactcactgccgcgatcaagccgtggaacgccgcgccgctggtgccgggtgccgtgatcaccacgccaagcgaggccgtgctcaacccggccgaccgccgcgagacagtcggccactggcagcctgcggacccggccaccgtgcagaaggcattggcgtctgccgcagccgcccagccagcgtggaatcgcacgcctgccgccagccgcgccaccattctcgaacacgccgcagacctgctcgaggcccgcatgccggagttcatggcgatctgcgtcaaggaagcagccaagaccctgccggacgccgttgccgaggtacgcgaagccttggacttcttgcgctattacgctgcccaggcgcgtgcgcagtttggtgcgcctgagcgcctgccgggccccaccggcgaatccaatgagctgcagctgcatggtcgcggcgtgttcgtctgcatcagcccctggaacttcccgctggcgatcttccttggccaggtcgccgcagcgctggcggcaggcaacgccgtcatcgccaagccggccgagcagaccaatctggtgggctttgcggcggtcaaactgttgcatgaagccggcgtgccggaagccgctgtgcagttcctgcccggcgatggcgccacggtcggcgccgcgttgaccaacgatccccgcgttgccggcgtcgctttcacagggtccaccgacaccgcccgcatcatcaatcgcaccctcgccgcgcgtgacgccgcgattggcgtactgatcgccgagaccggcggccagaatgccttcatcgccgattcgtcctcgctcccggaagccgtagtcaaggacgccatctccagcgccttcatctctgctggtcagcgctgctccgcagcccgcgtgctgttcgtgcaggaggacatcgccgacaaggtcatgaccatgctcgccggcgcgatgggcgagctgaaaatcggcgacccggccctgctctccaccgacgttggtcccgtaatcgacgccgatgccctgaagatcctggaagaacacgcgagccgcatggacagcgaagcacgcctgatcggcacgaccacgctggacagcgccacggcatatggcagcttctttgctccacgtgcctacgaactgaagtccctggcgcagctgcagcgtgagattttcggccccgtgctgcacatcattcgctggaaagccgaccagctggattcggtcatcgatcagatcaacgccaccggctatggcctcaccctgggcgtgcattcgcggatcgatgagaccatcgatcgcatcacctcgcgcgtggccgtaggcaatgtctacgtcaatcgcaaccagatcggcgctgtggtcggcgtgcagccgttcggtggccagggattgtcaggcaccggcccgaaggccggcggtcctcactacctgctgcgctttgccaccgaaaaggtcgtcaccgtgaacaccaccgcagccggcggcaatgcttcgctgctgaccttgggtgac

SEQ ID NO: 39308 - DNA, 1440 bp, Xanthomonas campestris
aagaatttccacctgcccgacctgggcgaaggcctgcccgacgccaccatcgtcgaatggttcgtcaaggagggcgaccccgtgcgcctggacgacccgctagtatcgatggagaccgccaaggcggtggtcgaagtgccctcgccgttctccggcaccgtggtcaagctcgccggcgcggccggcgatgtgatcaccaccggtgcggtgctggcgcagttcgcgctggatgcctcgcagccgcagcgtgcggacggccaggacaccggccacgggcatggccatggcgcgcctgccgcagcgccgaccccgagcactggcgaaagcgcggccggccccaccacccgcgtggtggcctccgatgagggtggcgagattgccgatgccgacagcgacggtggccgcgacgatgccggcaccgtggtcggcgcgatgcagagctccaacgccgtgcagagcgagcaggccatcgccgtgggcggcgtgcgcgccatgccggtggtgcgcgcgctcgcacgcaagttgcgcgtggacctgacccaggtgcgcgccaccggcccggatggcacggtgacgctggcggacgtgaagcaggcggctgcggcaggcacggcgcaggccgtgcgcggcgcagtgatcgcaccaatcggcggcgcagcggcggcaagccttggcggcgatcatgggcagcgcccggccgcagccggcacgacgtcgccgcaggccagcaacaccacacgtactgccgaccaggcgcgctccacgctgtcggccagcggcaagccgatgcgcacgcaatcgccgggcaccctggtcaagggccagcccgaacagctcaagggcgtgcgccgcaacatggcgcgcgtgatggccgatgcgcacaccaaggtggtgcccaccacgctcaacgacgacgccgacctgcacgcctggcaacccggcaacgacgtcaccgtgcgcctggtgcgcggcatcgtgcgcgcctgccaggccgtgcccgcgctcaacgcctggttcgacggcgaggcgctgagccgcacgctgcacccgcaggtggacatcggcattgcggtggacaccgaagaaggcctgttcgtgccggcactgcgcaacgccgacatgctggacgcgcacggcatccgcgaaagcatcaaccgcctgcgccagcaggtggaaaaccgcagcatcgccgcgtccgagctgagcggctacaccatctcgctgtccaacttcggcatgtttgccggccgctacgccacaccggtggtggtgccgccgtgcgtggcgatcgtcgccgccggccgtgcgcgctaccagctcaccccggtgatgggcggggtggaaacgcacaaggtgatgccgttgtcgctgaccttcgaccaccgcgccgccaccggtggcgaagcggcgcgtttcctgcgcgcactgatcgacgatctg

SEQ ID NO: 39309 - DNA, 945 bp, Xanthomonas campestris
atcaccctgatcgaagccatcacccaggcgctggcctgggagctggaacacgaccccgcggtgctggtgctgggcgaggacgtaggggtcaacggcggcgtgttccgcgccaccgccggcctgcagcaacgcttcggcagcgcgcgcgtgctcgacaccccgctggatgaaaccaccatcgccgggctgagcgtcggcctggccgcgcaaggcatgaagccggtggccgaagcgcagttcgacggcttcgtgtatcccatggtcgatcacctgatctgccacgccgcacgcctgcgcaaccgcacccgtggccgcctgcattgcccgatggtgctgcgcgtgccgtggggcggcggcatccgcgcaccggaacatcacagcgaggccaacgaagccatcttcaccaacgtgcccggtttgcgtgtggtgctgccgtcctcgccgcagcgtgcgtatggcttgttgctggccgcaatccgcgacccggatccggtgatctacatggagcccaagcgcatctaccgccagtacaaggaagtggtggccaatgacggcgaagcgctgccgctggatgtctgcttcgtgctgcgcgacggcaccgatgtgaccctggtgacctggggcgcgcaggtgaaggaagcgctggaagcagccgacaaactggccagcgaaggcatcagcgccgaagtcatcgacgtggccacgctgcgcccgctggatttcgacaccattgccgaatcggtcgccaagaccggccgctgcgtgatcgtgcaggaagccccgcgcactgccggtttcggtgcggagattgctgcgcagcttgccgaaaaatcgatgtacgacctgctcgctccggtggaacgggtgaccggctatgacacgcatatcccgctgttccggctggagatgaagttcctgcccagcgtggagcgcatcgtcaccgcc

SEQ ID NO: 39310 - DNA, 1074 bp, Xanthomonas campestris
gtagccgcgcagttcgaaatcgaatatctgcaatacatggacgcggacggccaactggtccgcgacgatctgccggccgacgccgccaacccgcaacagttgctcgctctgttcaagcgcatgctgttcgtgcgcaccttcgacagcaagtcgatcgcgctgcagcgcaccggcaagctcggcacctacgccgccagcctgggccacgaggccacccatgtgggcatcggtgcctcgatgcgcagcggcgatgtgttcgcgcccagctaccgtgaatacggcaccatgttcgaacgcggcgtgcgtccacgcgatgtgctgctgtactggggcggcgacgagcgcggcagcgactacccgcgcgatgccgatgcggcgatcgacttcccgatctgcgtgccgatttccacccaatgcctgcacgcggccggcgcggcgctgtcgttcaagctgcagggcaaggcgcaggtggcagtggcgtgctgcggcgatggcggcagctccaagaccgacttctacgccgcgctcaactcggccggcgcctacacgctgccgctgatcctgtgcgtgatcaacaacggctgggcgatctcggtgccgcgctcggcgcagaccggtgcgcagacgctggcacagaagggcctggccggcggcctgcactgcctacaggtggacggtaacgacctcatcgccgtgctcgaagccatgcgccaggcgcgcgcgcgcgcgctggccggcgatggcggcaccgtgatcgaattcctcacctatcgcctcaccgaccacaccaccgccgacgacgcccgccgctaccgtggcgaggacgaagtgaagcaggcctggacacgcgaaccgatgctgcgcctgcgccgctatctcaccgcgcaaggtctgtgggacgaggcgcaggaagaagcctggaaagccgagtgcggcgcgcgcatcgacgaagaggtcaatgcgtacctcaataccccggtgcagccggtggaagcgatgttcgattatctgtacggcgacccgccggccgaactgctggcccagcgcgccgaggtcatcgccctggaggcccgt

SEQ ID NO: 39311 - DNA, 798 bp, Xanthomonas campestris
gatctggaagggcggctgacctacggcggctacctgcgcctggaccagttgctgagtgcgcagcagcccttgtccgagccggcgcaccacgacgaaatgctgttcatcattcagcaccagacctccgagctgtggctgaaactgctggcccacgagctgcgcgcggccatcgtgcacctgcagcgcgacgaggtctggcaatgccgcaaggtgctagcgcgcagcaagcaggtgctgcgccagctgaccgagcagtggtcggtgctggaaacgctgacccccagcgagtacatgggctttcgcgacgtgctcggcccctcgtcgggcttccagtcgctgcaataccgctacatcgagttcctgctgggcaacaagaatccgcagatgctgcaggtgttcgcctatgaccctgccggccaggcacggctgcgcgaagtactggaagccccgagcctgtacgaggaattcctgcgctacctggcgcgcttcgggcatgcgattccgcagcaataccaggcccgcgactggaccgctgcgcacgtggccgacgacacgctgcggccggtgttcgagcgcatctacgaaaataccgaccgctactggcgcgaatattcgctgtgcgaagacctggtggatgtggaaacccagttccagctgtggcgcttccggcacatgcgcacggtgatgcgggtgatcggcttcaaacgcggcaccggcggctccagtggcgtggggttcctgcagcaggccctggcactgaccttcttcccggagctgttcgacgtgcgtacgtccgta

SEQ ID NO: 39312 - DNA, 1047 bp, Xanthomonas campestris
aatccgatgggcatcgacgggttcgaattcgtcgaattcgccgcccccgccggccaggccgcgcagttgcacgactacttccgcaagatgggcttcaccgcggtgctgcgccatcgcagccgcccgatcaccgtgtatcgccagggcggggtgaactttctgctcaacgaagacccggattcgttcgcggccgatttcgccgccgcccacggcccgtgcgcctgcggttttgcgatccgcttccgcaccccggccgacaccgtgctgcagaccgtgctcggcaacggcggcgaagccgtgcagaacaagcccgacacgcgcgcggtgccggcgccggtggtcaagggcattggcgattgcatgctgtacctggtggaccgctacggcgaggcggggagcatctacgacgccgactacgaggcaatcgaaggcgccgaccagcacccggccggcttcgggctcaccttcatcgaccacctgacccacaacctgtacttcggcaacatgcagcagtggtcggattactacgagcggctgttcaacttccgcgagatccgctacttcgacatcaagggcgccaagaccggtttggtgtccaaggcgatgactgccccggacggcattgtgcgcattccgctcaatgagtcttccgacccgaagagccagatcaacgaatacctggacgcgtatcagggcgaaggcattcagcacatcgcctgcttcaccgacgacatctacacctcggtggaacggatgcgcgctgccggcgtcacattcctggacacgccggacacctatttcgacgtggtggacctgcgcattcccgatcatggtgaagacgtcgagcgcctgcgtcgcaacaagatcctgatcgacgccgacgtggacaccaaacagcgcaagttgctgcagatcttcaccagcaactgcatcggcccgatcttcttcgagatcatccagcgcaagggcaatgaaggcttcggcgaaggcaacttccaggccttgttcgaaagcatcgagcgcgatcagatgaagcgtggggtgctt

SEQ ID NO: 39313 - DNA, 1266 bp, Xanthomonas campestris
tacatgaccggcttcggcaatgaattcgccagcgaggcagtagccgataccttgccggttggccagaactcgccgcagcgtgtggcgcacgggctgtatgccgagcagttgtcgggtactgcattcaccgcgccgcgcggcgaaaatcggcgcagttggctgtaccgcatgcgtcctgctgcggtgcacgggacgttctcgctgatcgagcagtcgcagttccacaacgatttcggccacggaccggtgccgccggaccagttgcgctggagcccgctgccgttgccgcagacacccaccgatttcatcgatggcctgtacaccatggccgggaatggtagccccgaagcaatgaatggcgtggccgtgcatctgtatgcggccaatgcctccatgcaggatcgcttcttctataacgccgacggcgagctgctgctggtgccgcaactcgggcgcctgcgcgtgcacaccgagctcggcatgctcgagctggagccgcagcagatcggggtgattccgcgcggcgtgcgcttccgggtcgagctacgcgacggcaccgcacgtggctatgtctgcgagaacttcggtggtttgctgcacctgcccgacctggggccgattggcagtaatggcctggcgaatccgcgcgacttcgaaaccccgtgtgcggccttcgagcaacgcgaaggccgctttgaactggtggccaaattccagggccacctgtggcgtgcggacatcggccattcgccactggacgtggtggcctggcacggcaactacgcgccgtaccgctacgacctgcgccgcttcaacaccatcggttcgatcagcttcgatcatccggacccgagcatttttacggtgctgacctcgcccagcgacacgcacggcacggccaacatggatttcgctatcttcccgccgcgctggctggtggcgcagcacaccttccgcccaccgtggttccaccgcaatgtggccagcgagttcatggggctggtgcacggcgtgtacgacgccaaggccgacggcttcgcgccgggcggtgcgtcgctgcacaactgcatgagcggccacggcccggatgccgccaccttcgacaaggcttcgcaagccgacctgtcgcggccggacgtcatcaccgagacgatggccttcatgttcgaaacccgcgccgtgctgcgccccaccgcgcaatcgctgcacgcaccgcatcggcagggcgattaccagcagtgctgggcggggttgcgcaatgcattt

SEQ ID NO: 39314 - DNA, 465 bp, Xanthomonas campestris
ctgcaaatccgccccgccacgcccgccgatgcggcgctgctgcacgaactggtcaccgcgctggcggtgtacgagcgcgagcccgacgcggtgaaggccacgcctgaggatctgcgcgccagcctgttcggcgacggtgccaccgcgcacgcgctgctctgcgagcagggcggccaggtgcttgggttcgcggtgtatttcttcaattactccacctggctgggccgcaacggcctgtatctggaagacctgttcgtgcggccgcaagcgcgcgggcagggcgccggcctggcgctgctgcggcatctggcgcagctggcggtggacaagggctgcggacgcttcgagtggtcggtgctggactggaaccagccggcgatcaagttctaccaggccgtgggtgcccgccccatggagtgctggaccgtgtaccggctcgacggcgagcgcctggccgcgtttgct

SEQ ID NO: 39315 - DNA, 1989 bp, Xanthomonas campestris
cgcgccagccgcacgctgagcgcactcacccgccagctcgacgacaccaacaccgcgcaggcgcgcatgcagcaggagttgcagcgccacggcgaactggaacaggaactgctgcgcgccaagcaagccgccgaagccgcctcgctcgccaaaggcgaatttctggccaccatgagccatgagatccgcaccccgctcaacggcatcatcccgatgctggagctgatctcgcgtggccagctcagcctggaccaacgcgacatgctgcagaccgccaccggcagctcgctgcagctgctgcgcattgtcgacgacatcctggattactccaagctcgaagcgaacaagctcgaactggaaatcaccaccttcaacctgcgcgagctgctcgacggtgtcgcccagctgatgcagcgcaccgccgaaggcaagcaactgcgcctgggcctggacatcgaaccgtcggtgcgcctgctggtgcgcggcgacccgatccggctacgccaggtgctgggcaacctgatcggcaacgccatcaagttcaccgaacgcggcagcgtggacatccagctgcggcgcctgggcgaaacccgcgcccagcacctgctgcgcttccaggtccgcgacaccggcatcggcatcgcagcggaccagcaggcgcgcctgttccgctccttcgcccaggccgatgcctccactacccgcctgtatggcggcaccgggctgggcctggccatctgcaaacgcatcatcgacctgatgggcggccgcatcggcgtggaatcggagcccggtcgcggcgccacgttctggttcgaaatcccgctgctcaaggtcatcggcgacctgcaacagaccaccggcgccgacgccgcacgcgtgatggtgatcagttccgacgcgcgcctgtcgcagcggctcaagcgcctgctcgacagctggggcatctcgcacgtgctgatggaaaccacccaggaagcgctggagcgcgtgcgccgccacaccgacgacgaaggcttccgctgcgtcatcgccgaccacgagacgctgcgctacagcgcgcgcgccgtgcatcgcgccctggcacggccggaagacctcagcggctcacggctgatctggctctacggcgacgagccggtacccgacgaactgcaagccaacgccaccctggtgccgcgccagagcccggacgaaaccctgcgcgcgctggtactgccacccgagcccaagccatctgtggcgcccacgctggcgtccgcgatgatccccgagccactgccgccgccagtggcgcatgcgcgcgacgtgcgcatcctgttggtcgaagacaacccggtcaacctgctggtcgcgcaaaaactgctgggcgtgctcggcttcgaggccgacaccgccaccgatggcgaagccgcgctgagcagcatggagtccacccgctacgacatggttttcatggattgtcagatgccggtgctggatggctatgccgccacccgccgctggcgcgccatggaaaccgaaagcggtggccgcccgatcccgatcgtggcgatgaccgccaacgccatggccggcgaccgcgaacgctgtctggccgcgggcatggacgactatctctccaagccggtcgcccgcgaacagctcaatgcctgcctgcagcgctggctgccgcgccaggccctgttgccaggcccaagcaccggagcccccagcgcggatgccgagagcgctgccagcgccgcacaggcgcgcgcgctgccgatcctggagagcggcgtcatcgacgagttgtacgaggtggcaggcgcggacaccatccgcatcctgcagctgttcctggaagacgcccccggcatcatcgaagggctggaagcggccgccagcaatcgcgacagcatgcatctgcgcgatctggcccacaccctgaagtcctccagcgccaacgtcggcgcccaggcgctagccaacgccgcccgccgcatcgaa

SEQ ID NO: 39316 - DNA, 927 bp, Xanthomonas campestris
atgcaccagcagacgctatggttgttcagcggcattgcgctggtgttggtggtggccacgctcatttccgaaaccttgcgttggcgtgcgcgcgcgcagcccagcgcagtgctcgataatctggtggcccgcatccgcgcctggtgggtgatggccggcgtggtaggcattgcgttcgtgttcgggcgcgccggggtgatcgggctgtttgcgctggtgtcgttgttcgcgctgcgcgagttcatcaccctcacgcccacccggcgcggcgactactacgcgctgctggcggcgttctacatcgtgttgccctggcagtacgggctggtgtggacgggttggtatggcatgtacacgttgctgatcccggtctatgcgtttttggtgctgccgatcctggccaccatcggcggcgacaccacgcgttatcttgagcgcaccgccaaggtgcagtggggcttgatgatctgcgtgttctgcatctcgcacgtgccggcactgctgaatctggagatccccggttatgccgggcggaatctgctgctgatcgccttcctggtgatcgtggtgcagtcctcggacgtgttgcagtacgtgtggggcaagctggccggccggcatctgattgcaccgaagctgtcgccgtccaagaccgtggaaggcttcatcggtggcgtgctctcagccagcctgctcggcatggcgctatggtggatcaccccgttcgcaccgtggcacgcgttcgggctggcgctggtggccaatctgatgggcttcttcggcgggctggtgatgtcggcgatcaagcgcgatcgcggcatcaaggattggggccacatgatcgaaggccacggcggcgtgctcgatcggctggattcggtgtgtttcgccgcgccggtgttcttccacctgattcgctacggctgg

SEQ ID NO: 39317 - DNA, 633 bp, Xanthomonas campestris
atgatcgacctgtactactggcccacccccaatggccacaaggtcaccttgtttctggaagaggccgggctggagtacacgctcaagccggtcaacatcggcaagggcgcgcagttcgagcccgccttcctgcagatttcgcccaacaacaagataccggccatcgtggaccacgcaccggccgggggcggcgcgccgctgagcgtgttcgagtccggcgcgatcctgctgtacctggccgagaagaccgggcgctttctgccgcgcgacgcacgcggccgcatcgcggcgctggaatggctgttctggcagatgggcgggctgggcccgatgagcggccagatgggccacttcactgtctatgcgccggaaaagattccctacgcgatcgaacgctacaacgccgaggtgcgccggctgcatggcgtgctcgacaagcgcctggccgagcacgcgttcctggccggcccggaatacggcatcgccgacatggccagctacccgtggatcgaagtgtatggcgacctcaagccggactatgccgcgttccctcatgtgaagcgctggcacgacgccatcgccgcacgcccggccgcccagcgcgcgtacgcgttgaaggacaaggtcaacccg

SEQ ID NO: 39318 - DNA, 2226 bp, Xanthomonas campestris
atgcgcgccctgttcgccgcccttgccctcatgctcagcaccgtccccatggcccacgccgaaaaactcaccctggaggccatcaccggcccgttgccgttgtctggcccgacgctgatgaagcccaaggtcgcgcccgatggttcgcgggtgaccttcctgcgcggcaaggacagcgaccgcaaccagctggacctgtgggaatacgacatcgccagtggccagacccggctgctggtggattccaaggtgctgctgcctggcaccgagatcctgagcgatgccgaaaaggcccgccgcgagcgccaacgcatcgcggccttcgccggcattgtcgattaccaatgggcaccggatgcgcacgcgctgctgttcccgctgggtggcgagctgtatctgtacgacttgcgcaagaccggcagcgccgcggtgcgccaactcacgcatggcgaaggcttcgccaccgatgccaagctctcgcccaagggcggctttgtcagtttcgtgcgggcgcgcaatctgtgggtgatcgatcttgccagcggcaaacaactgcaactgacccgcgatggcagcgacaccatcggcaatggcgtggccgaattcgtcgccgacgaagaaatggatcgccacaccgggtattggtgggcaccggacgattcggcgatcgccttcgcgcgtatcgatgaatccgccgtgcccatccagaagcgcccggaggtctacgccgaccacaccgaggtgatcgaccagcgctatccgcaagccggccaaccgaatgtcaccgtgcagctcggcgtgatcgtgccgcgcgcgtcagcaacgccgcagtggatcgacctcggcaagcaagcggacatctacctggcgcgggtggactggcgcgatgcgcagcggctgaccttccagcgccagtcacgcgaccagaaaaccctgcagctgatcgaagccacgctggccagcggcaagcagcgtgtgctgatcaccgagacctcgccaacctgggtgccgctcaccaacgatctgcgctttctcaaggacggccgctttctctggaactccgagcgcagcggctacgagcacctgtacgttgcctctgaggacggcaccacgctcacgccgctgacctccggcgcctgggtggtggatgcattgctggcggtcgatgagcaggctggcctggtgtacttcgccggcagcaaggactcgccgacgcaaacccacatctacgcggtggcactgggcggcggcgccatcgaaaaacgctcggcatccaacggcacgcatgcggccagcttcgccaacaacgccagcgtgtatgtggatacgtggtccaacaccaccacgccgccgcagatcgaactgtttcgcgccaatggcgaaaagatcgccaccttgttgcagaacgatgtggccgacccgcagcatccctatgccaaataccgccaggcgcagcgcccggtggaattcggcacgctcactgccgccgatggcagcacgccgttgcactaccggctgatcaagccggccggtttcgacccgtcaaaacgctatccggtcgtagtgtatgtctacggcggcccggccgcgcagaccgtggtcgatgcctggcccggtcgtggcgatgcgctgttcgatcaatacctggcgcagcgtggctacgtggtgttttcgctggacaaccgcggcaccccgcggcgtggccgcgcgttcggtggcgcgctgtacggcaagcagggcacggtggaagtggacgaccagttgcagggcgtggcgtggctcaagacgcaacgctgggtggacgcggcacgcatcggcgtgcagggctggtccaacggcggttacatgaccttgatgctgctggccaagcacagcgaggcgtatgcctgcggggtggcgggcgcaccggtcaccgattggggcctgtacgacacccattacaccgagcgctacatggacctgcctgccggcaacgcggccggttatcgcgaggcacgcatcgccacccacctggatggcctgcgcgccaagctgctgctgatccacggcatggccgacgacaatgtgctgttcaccaactccaccgcgctgatgagcgggttacaacaacgcggcacgccattcgaactgatgacctatcccggcgccaagcatgggttgtcgggcaagaccgcattgcatcgctacaagacggcagaagcgttcctggcgcgttgcctgcagccc

SEQ ID NO: 39319 - DNA, 996 bp, Xanthomonas campestris
atggcccacccccactaccgtccccgtcgtatgcgccacgatgcgttttcgcgccggttgatgcgcgagaacacgttgaccaccgacgatctgatctggccggtgttcgtacatgagttgccagggcgcgcgccgattgcctcgatgcccggcgtcgaacgtctgtcgctggacgagttgctgcgcgaggcggaaaacgcgctggaactgggcatcccggtgatcgatctgttccccgtgatcgaccccgccggcaagagcctggacgcggccgaagcctggaatccggacggcctggcgcagcgcgcggtgcgcgccctcaaggcgcgctttcccgagctgggcatcatgaccgacgtggcgctggatccgtacaccacccacggccaggacggtttgatcgacgccaagggttatgtactcaacgagatcaccgtcgaggcgttggtgaagcaatcgctgtcgcatgcgcaggcgggcgtggacatcatttcgccctcggacatgatggacgggcgtatcggtgcgatccgccgcgcgctggatgccgaggaccatctcaacgtgcgcatcatggcgtattcggccaagtacgcctccgcgttctacggcccgttccgcgatgcggtgggcagcgccggcaatctcggcaaggccgacaagaccacctatcagatggacccggccaacagcgacgaggccatgcgcgagatcgcgctggacctggaagagggcgcggacatggtgatggtgaagccaggcatgccgtatctggatgtggtgcggcgggtcaaggaagagttccgcgtgccgaccttcgcctaccaggtcagcggcgagtacgcgatgttgaaggccgccagcgccaatggctggctggacgaacgcaagtgcgtgctggaagcgctgatggcgttcaagcgcgccggtgccgatggcgtgctgacctacttcgcgccgcaggtggcgcgctggctgcgcgaggactaagcgcag

SEQ ID NO: 39320 - DNA, 849 bp, Xanthomonas campestris
atgcccgtatcccgttatgccgtgttcggacaccccgtcgcccattcgctgtcgccggccatccatgccgacttcgggaagcagaccggcatcgcgctggactacaccgccatcgacgccgcgccggaggaattcaccgccgcgctggagcgcttcgcggccgacggtggcaagggcgccaacgtgaccctgccgctgaaggaagccgcgttcgccctgtcggcgagcctgagcgaccgcgcgcgcgtggctggtgcggtgaacacgctggtgcgcaacgacggccagtggcagggcgacaacaccgatggcgccggcctggtgcgtgacctcaccgagcggcacggcctagatctgcgcggccgccgcgtgctgctgctgggcgccggcggtgccgcacgcggcgttgcgccggcgctgctggaggccggcatcaccgagatggtggtggtgaaccgctcgcccgagcgcgccgatgcgctgtgcgatgcgctgggcgaacccgggcgcgtggtgtcgcgctatctggaagacctgcgcgagctgggcgacttcgagctgatcgtcaatgccaccgctgccggccgcgatcgcgacgccggtgcgttcgcgctgccgctgggcctggtcaacagcctcactgcggcggtggacctcaattacggcgccaccgccatcgccttccttgcctgggcacgttcggcgcagtgccgctacgccatcgacggcctgggcatgctggtcgagcaggccgcggaaagctttgcgctgtggcacggcgtgcgcccgcagaccgacccggtgtacgacgcgctgcgtgcgcgcgacgccgtgttggtcagcgccgac

SEQ ID NO: 39321 - DNA, 1527 bp, Xanthomonas campestris
gacgccatgcgccctggatccctcatggtgctagccctgctagcccccacgctgatcgccccgccggtctttgcccaatccgtcctgacccgcgacaacggcgccaaggtcggcgacaaccagaattcgcagaccgccggtgccaccggcccgacgttgctgcaggacgtgcaactgatccagaagctgcagcgcttcgatcgcgagcgcattcccgagcgcgtggtgcatgcgcgcggcaccggcgtcaaaggcgagttcaccgccactgccgatctgtccaacctgaccaaggccaaggtgttcagcgccggcgaaaagaccccggtgttcgtgcggttctcctcggtggtgcatggcaaccattcgccggaaacgctgcgcgacccgcacggcttcgccaccaagttctacaccagcgaaggcaactgggatctggtcggcaacaacttccccaccttcttcattcgcgatgcgatcaagttccccgacatggtccacgcgttcaagccggatccgcgcaccaacctggacgatgattcgcgtcgtttcgatttcttctcgcacgtgcccgaatccacccgcacgctgaccctgctgtattccaatgaaggcaccccggccggctatcgcttcatggatggcaacggcgtgcacgcctacaagctggtcaacgcgcaaggcgaggtgcattacgtcaagttccactggaagacgctgcagggcatcaagaatctcgaccccaagcaggtcgccgcggtgcaggccaaggactacagccatctgaccaacgatctagtcggtgcgatcaagaagggcgactacccgaagtgggacctgtacgtgcaggtgctcaagccggacgacctggccaagtttgacttcgacccgctcgatgccaccaagatctggccggatgtgccggagcagaaggttggccagatggtgttgaacaagaacgtcgacaacttcttccaggagaccgaacaggtcgcgatggcgccggccaatctggtgccgggtatcgaaccgtcggaagaccgcctgctgcagggccgtatcttttcgtacgccgacacgcagctgtaccgcatcggtaccaatggcctgagcctgccggtcaaccgtccgcgtgtggccgtcaacaatggcaaccaggacggcgaagccaacaccgggcacaccaccagcggcgtgaactacgagccgagccgtcttgaaccgcatccgcaggacaccgccgcgcgttacagcgagctgccgttgtcgggcaccacccagcaggccaagatcacccgcgagcagaacttcaagcaggccggtgagttgtatcggtcctacagcaagaaggatcgcgccgatctggtgcagagttttggcgagtccctggccactaccgacaccgagagcaagcacctggtgctgtcgttcctgtacaaggccgaccccgagtacggcgccggtgtcacccgcgtggccaagggcgatctggcgcgcgtgaagcagctcgcgtcgaccctgcaggac

SEQ ID NO: 39322 - DNA, 540 bp, Xanthomonas campestris
ttggccgtaaccgccaacgctgcctcgccggcaccggtcgcggccaaggcgccgaccgcggcggcaacgcctgcacagatcaagacacagctgcagacctacttcttcgacgccgcgcgtgaggggcgtcaggacatgctgggcgaattcatccgctcgcattacgacctcaatacgcgcgacgaaaagggttacaccgcgttgatcctggccgcgtatcacggccaggccccggcagtggagcagttgctgcaggccggtgcggacccgtgcgcgcaggacaagcgtggcaataccgcgctgatgggcgcgatcttcaagggcgagctggccatcgccaaacggctgatgcaggccgactgcgcaccggaccagcgcaacaatgccggccagaccgcggcgatgtacgccgcgctgttccagcgcaccgatgtgctcaaggatctcgccgccaagggagcagacctgagcatcaaggatgcgcagggcaatgaagtgaccaagctgcaacgcggcgaattcgccaccgcgccggcacgc

SEQ ID NO: 39323 - DNA, 498 bp, Xanthomonas campestris
aacaaattggtgttcgtgggcggcatgggcgcgggcaagaccaccgcggtgcgtgcgatctccgacgtggaaccggtcagcaccgaaatgccgctgagccaggatgcctacggcgacaagacctacaccaccgtggcgctggactacagctcgatcgagctcgaagacggcgagctgctgcacgtctacggcgtacccggccagaaatacctggatttcatgtggcccctggtgtgcgacggcgccctgggcgtgatcgtgctgaccagcgcgcgcgatacgcagatgcgcgacaccacgctggagctgctgcgcgaattttcgcggattgcgccagaggccagcctcgccgttggcgtcaccatgaccgacgaggtgcaggaatttctgctgccgccgttccgcgaggcgctggtggccgcaggcttccgtatcccggtcatgcgcgtggatgcgcgctcggccacccagatcaccttcctggtgaaaacgctgctt

SEQ ID NO: 39324 - DNA, 897 bp, Xanthomonas campestris
gtttccctgattggcgtgcccaccgacatcggtgccggccaccgtggtgcccggatggggccggaggcattgcgcatcgccgggctgcaggaggccttgatcgggcgcggcgtcgaggtgcgtgacctgggcaatctggatggcccgcgcaatccctggcaggcaccgcaggccgggtaccggcatctggacgaggtggtcgcctggaaccaggcgctgatggacgccagctacgcagagctgtgcgcaggccgcatgcccgtcatgctgggcggcgaccattgcctgggcatcggttcgatcaccgcggtggccaagtactgccgcgagcagcatcgcccgctgcgggtgctgtggctggatgcgcattcggacttcaataccagcgaggtaaccccgtccggcaacgtgcacggcatgccggtggcctgcctgtgcggccttggcccgcaggcgctaacccacctgggcggcagcgcgcccgccgtgttgcccgagcagatccggcagatcggcatccgctcggtggacccggacgagaagcgcctgatcaagcagcaccgcatcgacgtctacgacatgcgctacatcgacgaagccggcatgaagcgcaccatggaagcggccctgcaaggcatgagcgccgatacccacctgcacgtgagcttcgatgtggacttcctggaccccagcattgcgccgggcgtaggcaccaccgtgccgggcgggccgaactaccgcgaggcccagctggtgatggagatgatcgccgacaccgggcgaatggggtcgctggatatcgtggagctcaatccggtgctagacaaccgcaacgccaccgccgagctggcggtggatctggtagaaagcctgtttggcaagtcgacgctgatgcga

SEQ ID NO: 39325 - DNA, 1962 bp, Xanthomonas campestris
ctcaatcccccgcaaagcgctgccgtcctgcactgcgaaggtcccctgttggtgctggccggtgccggcagcggcaagacgcgcgtgatcgtggagaagatcgcgcatctgatcgccatcggccgttatccggccaagcgcatcgccgcgatcaccttcaccaacaagtcggccaaggaaatgcgcgagcgtgtggccaagcgtatccgtggcgacggggccgacgggctgaccatctgtaccttccacgcgctggggttgaagttcctgcagatcgagcatgctgcggccgggttgaagcgcgggttttcgatcttcgattccgacgatgcggccgcgcagatcaaggacctgatgcatggggccaagcccgatgcgatcgaagacgccaagaacctgatttcgcgggccaagaacgccggcatgtcgcccgagcaggcgatggctgcggcgcgcagcaaccgcgagaaggaagcggccagcctgtatgagcgctaccaggcgcggctgaccaccttcaacgcggtggacttcgacgacctgatccgcctgccggtgcagatcctggaggccaacgaagagatcgtgatgggctggcgcgaacgcatcggctacctgctggtcgacgagtgccaggacaccaacgatgcgcagtaccggctgctgaagatgctggccgggccgcgcggcaactttacctgcgtgggcgacgacgaccagagcatctacgcctggcgtggcgccaacccggaaaacctgcagcagatggggcgcgactacccggcgctggaaatcatcaagctggagcagaactaccgttgctccaaccgcgtgctgcgtgcggccaatgccttgatcgcgcacaacccgcacgagcacttgaagaccctgtggagcgaccaggccgacggtgagcgcattcgcgtgtgggagtgccgcgacagcgagcacgaagcggaaaaagtggccgccgagatttcgttcctgggcacggccaagcaggtgccgtggagcgatttctgcatcctgttccgtggcaacttccagtcgcggccactggaaaaggcgctgcagttgctgcgtgtgccgtaccacctcaccggcggcaccgcgtttttggagcggcaggaggtcaaggacgtgctgtcgtggttgcggctgatcgtcaatcccgaagacgacgccgcgttcttgcgtgcggtgcagtcgcccaagcgcgaagtcggtgcgacctcgctggcgcgattggccgaactggccagtgccaagtcggtgccgatgtcacgcgcggccgaatcgatgggcgcgctgcagcacttgccgccgcgtgcggccaacggcctgagcgcatttaccgacatcctgcgcgatatgcgcgagcattcggccacgctgccggccggcgaattggtgcgcaccttggccgacaagtccggcctgctcaacgacctgcgcaatcagtccaaggacgaagccgggttccagcgccgcaagcgcaacctcgacgagctggccgagtggttcgaaggcggcccgcgtggcgccagcgccagcgatctggcggcgcagttggcgctgctgtcgcgcaacgacaaggacgatggcggcaaccaggtgcgcatgatgaccatgcatgcgtccaagggcctggaattccgctacgtgttcatcgttggctgcgaggatggcgtgctgccgcacgaggtcagcctggaagaaggcaacctgcaggaagaacggcgcctgttgtacgtgggcatcacccgcgccaagcagcagttgtggatgagctacagcaagttgacgcgcaagttcggagagcatgtgcgactgaagccgagccggttcttcgacgagattccggcggcggaactgcaacgcgacggcgccgacccggtggccgatgccgaacgcaagaaggaacgcgccaacgcgggactggcggcgatccaggcgttgttc

SEQ ID NO: 39326 - DNA, 2376 bp, Xanthomonas campestris
cgctatgacgacggcaagccggtggtgtatgtgctcgaggattacggcctctctaatgccctgatcctggacaaggcctgccgcgaggccggcctgccgtcgccgctggtgccgctgccgggcgacccgctggagcgcaagcgcgcctacctggcgttgtcgcggcgcagcagcagcaactcgctgattcccgaacaacgcggcggcaagacgcattccgattcgctggccaagttgctgcaggcgcaccgcgtgcgcgccgacctggacgtgcatctggtgccggtgtcgatcttcgtcggccgtgcgccggacaagcagagcggctggtttgcggtgctgttttcggaaaactgggcgctggtcggccgcttccgccgcctgctctcggtactgctcaatggccgcaccaccatcgtgcgtttcgcgccgcccatctcgctgcgccagaccatggccgaagggctgccgcccgagcgcacgctgcgcaagttgcagcgcgtgttgcgcacgcatttccggcgcatccgcgaggcggtgatcggcccggacctgtccacccgtcgtctgctggtggaccaggtgctggccgccgattcggtgcgcgaagccatcgccacccaggccaagcgcgacaactccaagccggtcgatgcctggcgcaaggcgcacgcctatgcctgggaaatcgctgcggactattccagcccggtggtgcgctcggccagcttcctgctcactcatgtgtggaaccgcatctacgccggcgtgctggtgcatcacctggacaagctcaaacaggccgcgcccgggcatgaagtggtgtacgtgcccagccaccgcagccacatggattacctgctgctgagctacctgttgtatgagcgcggcatcgtgccgccgcacatcgtggcgggcatcaatctcaacctgccggtggtgggcacgctgctgcgcaagggcggtgcgttcttcatccgccgcagcatccgtggcaatgcgctgtattcggcggtgctgagcgaatacgtggcgcagctggtggctggcggttattcgatcgagtacttcgtcgaaggcgggcgctcgcgcaccgggcgcttgttgcagcccaagggcggcatgatcgcaatgacgctacgcgcgtatctgcgccagccgcgcaagccagtgttgttccagccggtgtacatcggttacgagaagctgatggaaggcaacagctatctcgacgaactcaccggccgcccgaaggaaaaggaatcgatctggggcctgctgtggtccatccccaaggtgctcaagcagaactacggccaggtggtggtgaacttcggcgagccgatcgcgctcaacgacgtgctggccaagcacgcgccggaatggaatgacgaaccgctgccagacgatgaaaagccgacctggcttgcaccggcggtggacacgttggccacgcagatccagacccgcatcaactgcgccgccgacgtcaatccaatcaacctgctcgcgctggcgctgctgtccacgcccaagcatgcgatgggcgaagccgatttgatcgcgcagatcgaactgtgcaagaagctgctggccgaaatgccgtattcggaccgcgtcacggtcacgccgcacacgccggcgcgcatcatcacccacgccgaagagatcaacgtgctcacccgcgtctcgcacccgctgggcgatgtgctgagcgtcagtggcgataccgcggtgttgctgagctacttccgcaacaacgtgctgcatctgtttaccgcctcctcgtgggtggcgtgctgcttccagaacaaccgccgcatgagccgcgccgggttgttgcggctgggccgcacggtgtacccgttcctgcaggccgagttgttcctgccgtggagcgaggaccgcttcgccgaacgcatcgagcagaccatcgacatgttcgtgcgcgagggcttgctgctcaacgtcaccgatgacgatggcggcatcctggcgcgcaacaccgggcagaccgacgaagtgttccgcctgcgtgcgatcggccattcgttgcagcaggcgttcgagcgctattacatcgccatttcggtgctggtgaagaacggccccggcgtgctcggtgccggcgagctggaaagcctgtgccagcaggccgcgcaacgcctgagcctgctgtacgcaccggccgcgccggagttcttcgacaagaccctgttccgcagcttcatccagaaactgcgcgaactgcgtctggtgtggccggacgagaacagcaagctgatgttcgacgagcgcctggacgcgtgggccaaggacgccaagttcatcctcggccgcgagctgcgccacaccatcgaacgcgtcagcccggaa

SEQ ID NO: 39327 - DNA, 2511 bp, Xanthomonas campestris
cggcatgtgcgcccgcccgggcacccgggcagtgcggtggcctacgtgcagcccatgttcgacgacagcgcgtggcagcgcgtggacctgccacacgattgggcaattgcagggccgttcctggccgatggcccgcatggcggcatggggcgattgccgagctggggcgttggctggtatcgcaaggcgctgcagattccggccagcgaccgcggccgctcgctgtttctcgatctcgatggcgcgatgtcctacgccaccgtctggctcaacggcaagctggtgggcggctggccgtatggctacaccagctggcgcgtggatctcacgccgtatgtggtgcccggcgggcacaaccagctcacgatccggctggacaacccgcccgactcggcgcgttggtatcccggcggtggcctgtatcgcaatgtctggttgaccaagaccggcccgctccgcgttgcccagtggggcacgcagctgagcacgccgcaggtgtcggccgagcgggcgcaggtgcagctggcggtgcagctggacaatgccggtgccgcccccgtgcaggcgcaggtgagcaccgcgctgtacgcgctggatgacgccagcggcctgcgccgtggcccggcggtggcgcagattgccgcggtgcaggtacaggtggcggcgggtggcaatgcacgcgtgcagggcagtacgcagatcgaggcgccacggcgttggggtccgccaccgacacagcaaccgcatcgctatgtcgcggtgaccgaggtcagccagggtgggcgtgtggtcgatcgtgtcgaaacgccattcggcgtgcgcagcgtggtcttcgacccggacaagggcttagtcatcaacggcgaacacgtgcccatccgcggggtcaacaaccatcacgatctgggcgcgctgggggccgcgttcaacgtgcgcgccgccgagcggcagctgcagttactgcaacacatgggcgccaatgccatccgcatgagccacaacccgcccgcgccggaattgctggagctcaccgaccgcatgggtctgctggtggtggatgaggtgttcgacagctgggaaatgaaaaagaccccgctggatttccacctgatctttccgcaatggcacgagccggatctgcgcgccatgctgcgccgcgaccgcaaccatccctccatcattttgtggagcgtgggcaacgaagtgggcgagcaatacaccggcgaagcgggcgccgcgatcgcacgcaggctgcacgccatcgtgcacgccgaagaccctacgcgcccggcgacggcggcgatgaactacgcctcacccgagatgccgctgccggcggcgctggatgtaatcagcctcaattaccagggcgaaggcatccgcgatacgcccgagttcgaaggcaccgagcgtatccgcaagccgccgcagtacccggccttccatgccaaattcccgcgcaaggccatcctcagcagcgagacggcctcggcgctgagcagccgcggcgtgtacctgtttccggtgagtgcgcagagcagcgcgccggtgcgcgatggccgcggcggcgattcggtggctcaccaggtcagtgcgtatgagctgcacgcggtggatttcggctccagtgccgacaaggtctttgccgcgttggatcggcatccgttcgtggccggcgagtttgtgtggaccggcttcgactatctcggcgggcccacgccgtactacagctcacgcagttcctattccggcattctggatctggctggcttccccaaggaccgctactggctgtatcagacgcgctggcggccggagctgccgatggcgcacctgctgccgcactggagctggccggggcgcgagggccaagtgacgccggtgcacgtgttcacctccggcgacgaggccgagctcttcgtcaacggcgtctcgcaaggccgcaagcgcaaggcaccgttgcagtaccggctgcgctgggatgcggtggtgtaccaaccgggagagctgcgcgtgcaggcttacaaacatggcaggccgtgggccagcgaccgtgtgcagaccgccggccgtgccacgcgcatgcagctcagcgccgaccgcaaccagatccgtggcgatggcaaggacctgagtttcatcaccgtgcgcctgcttgatgccgacgggcgccctgcaccgactgcaggtgaccgcttgcgattccgcgtggaaggcgcaggcgaactggtcgccaccgacaacggtgacccgaccaacctggaggccttcgtcctgcccgagcgcaacgcgttcaacggtctgtgcctggtgatcgtgcgcgccaaaccgggcgcgcaggggccgatcaccgtgcatgtgcaatccgacacgctgcagtccgccagcgtgcaggtgctggcggaatgagcgtggtgttgcccgtggtcgctcgctcagttacagaggcgtccatggcccaacgcgcgcgcaactgcacccgctgtgacagcatcccttccaggaatcact

SEQ ID NO: 39328 - DNA, 1116 bp, Xanthomonas campestris
atgttgctgggcttgctcggcatggccgtctcgcccatcgcctcggcggcctgcgcaccgggcaccacggcgctcaaggacgcgtatgcaggcggctttctgatcggcaccgcggtcaatacggacatcgtctctggcaaggatgcggcctccgcagcgctggttggctgccacttcaacgcggtgaccgccgagaacgtgatgaaggccgaggtggtggcgccgcagccgggcgtgttcgatttcaccgcggccgatgcctttgtcgccgacaggcagcggcgtggcatgttcatcgttggccatacgttggtctggcataaccagacgccggagtggttctttgtcgatgcaaacggcaaaccgaatacgtcgcaggcccaactggaacgcatgcgcgcgcacatcgcgcgcgtggccggccgctacgtgggcaaggtgcaggcctgggacgtggtcaacgagatcatcgacgaggacggcagctaccgctccaccaactgggtgcagcgcgtcggcgatggcgacaccgtggtgcgcaatgcgttcgccttcgcgcagcgctatgcgcccgacgcacagctctactacaacgacttcaacgcctggcggccggccaagcgcgatggcatcgtgcgcatggtcaagatgctgcagcaggccggcatccgcatcgacggcgtgggcatgcaagggcattggggcctgaactacccgagcgtgcaggacatcgaagccgccatcgatgcttacgctgcgctcggggtcaaggtcatgattaccgagctggacatcgacgtgctgccggtcaccaaggaaggccaggtgatcggcaccggctttgcgcacaagcagttccagttacccgaattcaagcacttcctcgacccgtacccggatggcctgccaccacaggtgcagacgcagctacgtgaccgctatgcggaactgttcgcgctgttctggcgcaagcgcgacaagctggcgcgcgtcagcgtctggggcgtcagcgatggcatgtcctggaagaacgactaccccgtgcccggccgcaccaactacccgctgctgttcgaccgcaaccaccagcccaagccggccctggatgcggtgctg

SEQ ID NO: 39329 - DNA, 912 bp, Xanthomonas campestris
cgcctgtcacttttgatgctgttggtcattccgctgctcgcattgctttctgcctgtaccaagagcaatgcaccgccatcgcgatacccggcgattggccatcttgaaagcttccatgcgagcttcagcgatgtggttgcaaccgacgcacgcatcgaaaagctcaccgaaggcttcacctggtccgagggccccacctgggtgcggcagggcggctatctgctgttcaccgatgtgccagaaaacaagctgtatcgctggtccgacgactcagggttatcggtgttcttgtcgccttccggttacgccggcacggatgtcgccgcgctgcgcgaagccggtgccaatggcctgtttgccgaaccgggcggcaccgtgttgctggccgattctggtacccgcatcgtggcgcggctggaccctgccacgcgcacgaaaactccgctggccaccagtttcgacggcaagcgcttcaacagccccaacgatgtggtgcgtcgcgaggatggcgtggtgttcttcaccgacccaccgtatggcttgaagggcatgaacgattcgccggtcaaggaactgcgcttcaacggcgtgtatcgcctgaatactgacggcagcgtgcacctgctcgacgacagcctgagttttcccaacggcatcgcgctgtcaccggatcagcgcacgctctacgtggccaactccgatccggcgcgcccgatctggatggcgtatgcgctggatgcgcagggcgcggtgaccggcaagcgtgtgttcgccgatgccaccgacctggtcaacaaagacacgcccggcttgcctgatggcatggcggtgtcggcagagggccgcctgttcgccaccggccccggcggcgtcattgtgttcgatccggatggccgcagactcggccgcatc

SEQ ID NO: 39330 - DNA, 998 bp, Xanthomonas campestris
tgcattcggcaggctcgccaagctctgccagaatggtcgccatgaacaccacttccgacaccgccctgctggtggtcaacctcggcacccccgagtcgcccactgccccggccgtgcgccgctacctggccgagtttctcagcgaccgccgcgtggtcgccatcccgccgctgttctggaagccgctgctgtatggcgtgatcctgcccatccgcggccccaagtcggcagaaaaatacgccaaggtgtggctgccggatggctcgccgctggcggtgtacacgcggcgtctgaccgaaggcctgcagcaggtcatgcccgactggcacgtcacctgggccatgcgctacggcgcgccggccctgcgcaaggcgctggacggcctgcgtgcgcgcggcatcaagcgcatcgtggtgctgccgctgtatccgcagtattcgaccaccaccaccgcctcgatccaggacgtggtcgatgcctggcgcccgagcgcgccagagatcgcggtggaggtgatccaggactattgcgaagacgccggctgggtggcggcgatcgccgattccatccgcacgcactggcaggtgcatgggcgcagcgagaagctgatgttctccttccacggcctgccgcagcgtgtggccaacgccggcgacccgtatccgcagcagtgcgaacgcagcgcgcaggcgatcgtcaccgcgctgggcctgggcccggatgcgtggcagatgggctaccagtcgcgcttcggtgcagaacgctggttgcagccgtatgccgaacccacgctgtgggcactggccgagggcggcgtgcgcagcttcgacctggtgtgcccgggctttgccaccgactgcctggaaacgctggaagaagtggcgctgggctttgccgaaacgctggccgaacgcggcgccacgctgagctacatcccctgcctcaacgacagcaccacgcatgcgcaggcgttggccgcagtggcccgccgcgcgtga

SEQ ID NO: 39331 - DNA, 374 bp, Xanthomonas campestris
gcaacgctcaccgacggttgagtttcattcaaggaatcggttatcaacgacgtgatcggcgttctgggagtcaagagcggctataacggcggcaccaaggacaaccccacctacaaggaagtctgcagcggcagcaccggccatgccgaggcgatccgggtgcgcttcgataccgatgtggtgagctatggcgagatcctcgacatcttcctcgccacccatgacccgacccagctcaaccgccagggcaacgacatcggcacccagcatcgctcggcgatcttcccgcattaggcattcaggagcgcgaggcgctgaaagcgatcgagcgcgcccgccccgattggcggcatccgatataaaccacgatcaga

SEQ ID NO: 39332 - DNA, 282 bp, Xanthomonas campestris
atgaacttccgtgcgatgcacgaccgcgtgctcgtccgccgcgtcgaagccgaggaaaagaccgtcgacgggatcatcatcctcgacaccgccaaggaaaagccgtacgaaggcgaagtcgccaccgtcggcaccgtcaccaaggtcgtagatgggcaggtaaccccgctcgacgtgaagcacggggatcgcatactgttcggcaagcgtgccggcaccgcagtgcacgtgaacggcgatgacctgctgatcatgaaggaaagcgacatcctctgcatcgtc

SEQ ID NO: 39333 - DNA, 459 bp, Xanthomonas campestris
gcccgcgccgacaacgggcgtgtcggccgtgacgggcagctgccctggcggctcccgggcccatctcaagcggttcaaggcgcagacgatgggccgcccgatgatcatgggccgcaagaccttcgagtccttccccgcccccctgctcggccgccgccacatcgtgctgacccgcgacaccgcttggtccgcctcgggcgccgaaatcgcgcacagcgtcgaggaagccctggcactggccggcgaggatgccgcggtgatcggcggggccgagatcttcgcactgttcctcgatcgtgccacccgcatcgagctgaccgaggtgcatctcgatgccgaaggcgacgccagcgtgcccgctttcgatccggcccgctggcgcgagacagcaccgaggcgtaccctgccgagggtgaacgcccggcctatgccttcgtgacgctcgagcgccagaagtga

SEQ ID NO: 39334 - DNA, 1525 bp, Xanthomonas campestris
cgaccaaaaaggaagagagaatcaacgagaggacacgaacgaaaggagagacgacagagcgggagcgagagaccaaccaacagacaaaggcaacaacgagggacccccacacaccaacgacaaagacaaaagacgccaaaacaccgcacaaaaaatcacagggggcgcaaaaaatcagatccattgccaaggcccaagccaaacagagaacaacacaacaacgggagcaaacgagcgacgacgaggaagaaggaagccattgacgaaagccacaaggacccgagaacgcaaaggggcaagcacgcccaaccaacacaaagcccaacgccaacagggcgaagcgcggaacccccacgcacgacgacggactaacgacaaacagggaagcaggaacaacccggcggcaagaaagaaacgcgagaaccaggaagcggagaaacaaggcgctggcacaaacacagcagcagcgataaacacggcaccaccagaagagcaaccagcgggaaagaacggagtgcacaagagaagcaacaacacagacacaagagagcaccagccaacgcaacggagagtcacgcacaaaaacaaaagacacgaccgagacatggggagagaagaaagcagagcagaccgaacccacacaaactgcacccgacggcgaggagagatcagtcgacgcggctgccgagccaaacaccgccagaactatccaccgacgcgccggaataagcccgcgcaggctagagacaacacagcggaactatcgaaacaaagcatcgcacccacaacgactacgagccaggagaagcaccacagacagactggaacaccggcgcagaaataggcgcaaagaaggctagatcgcaagcccgaagcgagcaccgcgatacggcaaagagagacagcatatcgccagagcacatggaagcagcagcacaagcagcgaggctacaccgagccaacgacgaggagacaagaccaaaagccacgaatgcacgcaagatgaaagcagcagccagcacgcccgaaggatagacgcaatggataagtaagcgacgccgaacgcagacagtgcagacggccagaacaaagcggaatcacacacacgcgaccaccgcagaagcgagacgaccccacagacgcagcgaccaacgaggacaagcgaagacaccgcccacagcgaagagagcgccagagagacgggagagcgcaaacacgagacgcgagagaaatacaagcacgcacgaaatccacccagaccgaaacgaagccaacaagaccaacacgtcacagaccgacagacacagcagacaatggggggacacagtacgagcagacgagcgcacaagaagagaccgcgagcgaaaaaacacaaccggcgaagaagagctgcgtacacacaaagagcaacacgagccacaagagtgaatatgaaaaccactagcaactgaccgagcaggagcacgcaaacagacaaggacgaaaccacagcgtcacgaaaggcgcaagacgcagcccaagccca

SEQ ID NO: 39335 - DNA, 1383 bp, Xanthomonas campestris
agacacaggagctctcagagcgaagagagagaagacatgagacccacgaaaacccagagcatgtgaaataccacaagacaagaacaagcagcccacccgaacagcacgactttctccaagagggaggaacagtatgttatcgacaggacaacgacaccacagacgacagacgggagcgagacaacgaccggggggggagaccaccaacgggcagaggaccgccgcggacatgggagggccatgcgaccgcccagaaccaccgaacccccaaacgggaaaagaaaaaaaccgcgccgccaagaacccacacaaaaggaaaccaggacgccaggagacacaccgaaggagccgccgaagagaacaagcagaccggcgagaacaccaccagaacaacgcgccagacacaaacgacaggccaggataacaaatgagacaactgcaagcggacacaggaacaaacacgagaaggcaccaagaagcacacagccaacgagacaaacacgaccgaacatcagagagagaccgaggaacacgatcgcccacacccggagacgaggcagaaaagcaacgaacgaggacgcaggcaacccaccgagcaccgctgagcacggagaggcaaaaccaaccaaggcccagaccagaagaccatgacagaacagccgcaaccccccagagcaaaccgaagaggagcgcaaaggacacgcccaaacacacaccagcaagcaaagaaccagcacggagcaacaccgaaccacacagagagaacaacaacagaaccgcacacgaaaagagagcaacgcgcacgacacagaaggcggagaaccaaaggacacagacccacgaagaggaccacaagcaaagacacgacgaacacggagggacaccagatagagaaagacagaacagcagaacccacccccaggacaaaggcaacaggcccgaaacaagaacaaacgccacagcgagagacaggacggcgacacacacaaaacaaaccagagcgccagacagacggaagacacagcccgaaacgagaaaccacaacgcaaaaccctgcgcgcacaaacaacaccaccgggcaaaccaaagcaaaaaggaggccggaatacagatcacaacaagaagccaacacacgagcggagcacaaatgacaaatccacgaaccacacaacactcatgctacgcaaagaagagacacggcaagtgaaccagaagacccgagcgccaacagggagcacaacaaagatgcccgcaaccaggaatatgccaagacgacaaaatgacaccaaagacacacaaaaggaaggacgaagagcagaaaaaccgaagggaccacacccgaaaaaaccaaagcaagaaaccgacacaaggaacaacaaaacg

SEQ ID NO: 39336 - DNA, 1125 bp, Xanthomonas campestris
  unsure (1)..(1125): unsure at all n locations
ccacgnggaaccccagaacaagcaggctaacaggtggggcgaacatcggtgccaaaaagcaaatacaaaagagacaccgccacgccgcacggaggacaaaggccatcgatagcgcgatggacaccacaacgaaagaaccatgaaacccacgaacctaccgcacgaatatagagccacagactgcacagaccaaaacaaaacccactgccaacagacaaacatcaaggacccgacacaggacccggaaagaaaggactcactacaaatgacaaacaggaaccctagaacccctgcaaatcccccagacattgcaggcggggacgcaaacacccgagccagaaaaatgcagatccacaaccaagcacaaacacgagccacgtatggtccacaacaaaagagagccaagatgcataaggcgaatatacgatacagaccctagagggaaaagagacggcgccaaacacacaagagaacgcccagatggagagcagcaccgggagaagggccaaaccggaccacgaccctcggcacatcacccgccaaaggcggaccacgaaaaacaatgaacccagaaggccaaacgggaacgaagaacacaacgacgacgcaacagaaagaccgcggacggacacgactcacaacgacacccggaggaaacagagagggtgcccagaactacgagtgcaacgaagggagccgggaacacaaaacgccccacaccggcccaaaccgacagcacatacaccctgaaggtccagagcccggcgcacacccccgggaaaggccaccaccctcgtgagaaggacacgaaacaaactgacaaacaatccggatcacaaaaaagaacacgaaacgcacccaataacacaaacaccgacaggacaaatccacaccccacccccagggaaacaaactgcaaaacacccacccgcagaacatagaatgagagggcaatcaacagaaaccaacccaccggataaatgcgagcgcgggcaactacacgacgaacacacaacagagagagggggaacacggacgaaccaaccgatccaaaagaggcagggaccacgggcgcaccaagaataagaagacaccgacggcctcccatcgcaaaaaaggccacga

SEQ ID NO: 39337 - DNA, 793 bp, Xanthomonas campestris
cccaaacggcggaggcaccgaaaagccgccccgcgggcagggggcccacaaaacaagccctccgaaacaagcgccaagaaaccggggggccggaaaacccacggccggggccccgcggaaaacgagcggcgaaaacgagcaacaacagcagaccaaagccgggcaaagaaaacccacacacagaaaaacacgaaggcacaaggaaaaggcgacgagcaaacaccggagccccgcgaccaaaaccgagcaggcacagaaccacgcagccaacagaaagcaacaccgcacccccggggccaaaaacggaacagggaaaaaagcccgggcgagccccgcgggccacacacaaaaccccgcggcggggggcgccccacaacgaaacaaagggcggcccgaacgcacaaagaggaaagggcccgcaaacacaaggacccccacaagagggcagagaccccaccaaaccaaaacacgaaagcgacgcacgccaaaccccggcggaaaaaaacgcgcacagaacaaaaaaaaaacgaacacacaccacaagaaagcgaaacacgcaaaacagaaccaaaaaaagcaagagccacgccacaaaacacgacagacacaaaagcgacacaaacaacaccacacaagaaaagggcgcaaaacaagggagggacaaccacgacccccccaaagaaaaccacacgggaaaaaaaaaaaccccgcggcgggcacaaccccccccaaaaacccaaaaaaaacacacaaaaacaaaaagaacacagcccaaaaacgaaaaaacacacag

SEQ ID NO: 39338 - DNA, 1406 bp, Xanthomonas campestris
caaccacgacggccgaaccaacgaggccactggcttatcccccgaacaaccgcaccgccccaactgaccaaagcggggcggaggaacacgaaaccggcacgcgagcaataaacaacgggggaaggcccagaccgaccgcaacgcccgaaccacgcccggagcacacagaaagccacaaaacccgcgcgaagggagacccgaaaccagaacaccaaggaaccaccgcgcacgcacaccggaaggcaaagggaaacacagggcgaccagggaccaaacaggccaagggcagagacgcaacaccggccgaaagcaggggacacccgccagagagaaaccaagcagacggctacaaccggaaaccacaacacaacccaccacaggcaaccccagccaagaggcagcccaacgaacaaaacccgaagccaacctacgagaagacacaacacaccaacaggacacggcacgggccgtgcaaccacgcagatgcacaagggcgggagcgataaccgacaaagcgcggagaagcgcgacgcacagagaggcacatcacacgagcagagtgtgggcaggcactagaacacagaccactgcgagaagaacgaacacacagagcaacagcaccaagatgtcggcagcaaccgacacagaagccaagaagaaccaccacaccaaagaccgacggggaacacagcagatatacacaaagaacgccagagcagacgagcaggcaaaaacacggccaccaacacggaggacaacacccaggcgcagagggcacgagacacacaaagagaatacgcaagaatacatcccgatgcccacacacccaaccaaaccccgagtctagacacaacgaccaccagcaagcgcaaatcgacgaagagcgaggcaacaccaggggaagaaaacccactgcacaacacaacacccggacgagaccagagaggggtccaaaagcccgacgggcacaacaccacagcgcgacgaacaccccgcacaggcggccctaaccacagaaagcaaccgagccaggggcgcacaaccgcccagaaacgaactcgaccatccccacaaagacgacagaacaagaaagacgcccgaaagaacacccgccacagacagggacacccacccaggaacacgacgcacaacgccgagacgaacacgaacagaaggaaacgcgagacgccacaagagcagcaggagcacaatgagaccatgcgaacaacgacacgacccaagaacacgacagagacaaacaccatcaaaggaagacacaggcagcaaacacagaagaaaggaaagagagacaggaggaagcacagccaggacagactcaccacggaggcagcgaaccaaaccaggcgcgacaactgcaggagacaacagagaacgacacaccgaac

SEQ ID NO: 39339 - DNA, 973 bp, Xanthomonas campestris
cccacaccggaggcaaaaaccacaccgaaacgcacagcggcaaatccaaccaggaacgcacggggagagacgcacgtttccaatatttttaccacgacacagccccggaaacaacacgacgaaacggacccgacgagagggggggggaaagcacgcaagacaccagggaacaagggggcgcaacaccacgaaaaaacccaaaagacacccgccaagcaaacagggagacccccggacacagcggagaaacacgaacaaacgggaaaacaggggagcaaacagggaaacacggcaagaagaagcgagaacagcagggaaagaccgcaagaacaaaggcggggaacagcggcaaccaccagagcaaacgagacaacaccggggaaccacaacacacaagagggacaaaacgcccgacaacaatccccgcgaaaaaccgggaaaaacacagaacagacgcgccaacaagcggagacaaaacggcgacaacagaaaagcggcaaaggcgagaaagagcggagaaaaaccaggacacgacccgaccacgacggggaaaagagcacagcgcacagaaacccacaaacacagaggagcagaaaccccagcgcacgacaacagcggacgaaaactcacggcaggcaaaaccgcgggcgcacccaacgagcggaggagaaccagcgccgccgaagcaaccgaccgagagcagtgcggcggcaaacaacgcggaggggcaaccgacgcaggcagcaaaaaccggccgcgaagcacaagccacgggaccaacaaacagcgcgaccgcaaaatacaccggcgccggaacacaacacacgcgcaaatagacacactagcacgcgaaaacagatccgcgcgcggaagacacaggcgcacgcagaacacgtaccgacgcaagcgatacacagccgagcggtcgaagcaaaacagcggcgacagcgcatcacacaacccgcgggactac

SEQ ID NO: 39340 - DNA, 1031 bp, Xanthomonas campestris
ggaaacactgccgttgacggtgaaccacccgcgccgtggccccagccgagctgtttccggaatcacttcccaaaatcaaccccacccgaaccaaccgggccctggggggcaaccctttattaccaagacccgaaaagcgtgaaacccgccgtcagcaaaacgtctccaaccacgtagaccaagcatagggaaccgccccccggtgccctgggaacccccttggtccgggagcccccgcacacccagacaactctcacacaccagtaaacctatagacaccaccacacatgaaaatgtgaaagacgccccagaacagaccctgaaaccgagacgaataggcaatcattaatagtccaacctcccatcatcaaagacaccacccaaaccacgatctactaattatcacccctaaccgcagaccactgagaccagggaacttatatcccttgtcttgtagcaaatcctcagaaaccagcacaattggaaatatgtgtattagcccactgtctttgtcaacccctattgacccccgccggagcttatgaacacgtaaaccaacccccagcaagtccacaaattttaccaaatgggccaattctcccgatgaaagcccctagagccccacaagtaaaacaagaccaccaaatggctaacccccccacttgtccttgaggataaggtcgacccgccccacacacttctcatatgaaatgtccctgggaagaccaaagacccgatcacctaaaccaccgtccaatctaatctcccaatgagccggcctttccctttactaatcccttcacaacggcaccgaaaattacaacccagagccccccgccatgcaaatattctcgttggccccgacattcgccatccccaatagaccatagtcccccccagacccgaaagaccgatatacaaacataatattacacctcacccctccacagcccaacctaaaacattcctcccactccccagtgtggacccctccaccacaacagaccaattcactaatcccgaaatgtcat

SEQ ID NO: 39341 - DNA, 600 bp, Xanthomonas campestris
atggcgaacataagtcaccacaaaaaaatagcgggcagggagggggatgaaaacttagcgggacgcgacccgacgggggcgccgaccaaggagaagcagttaggccaacaaggcgagacgcggctagcgggcaaggattcggaggaggatgaggagagacagctcaccgacacccaatgggagaaaccgggccataagcgccaggaccggcaggagcagaaggaaaatcagggtgagagaagaccagcgctgcaggaaacggacgacaagggaaccgcaggccaaacacaagtggagcgccatccccaggccaaacctggcagcgcgcgcgaacaccgaaggctccagaagaaaggctcaagcgaaaaccggccacgcgaggggcagaaggcacgacaacgcgcgggcagcaggcggggccggattaccagaagcgcaacggaccgagcccggcacggagaaaaccgagagggcctgccgccagaaacaacgagcgccaggggcgaccggggggaacgacggcccgagcccaggggcagccaccggccaaaacacaaagggggcgcagggacccaacaggaacgggaccagacaggctag

SEQ ID NO: 39342 - DNA, 1340 bp, Xanthomonas campestris
  unsure (1)..(1340): unsure at all n locations
aggtgaccagtagcgggcactgctgagcacgccggcaaggaaacgagacaaccacgggcaagtatctttgtacaagagcgccancaccnancgagggcggcagcagagctgggccaccgagaaaagccgcccacgcgaggcgaggggaccagtccagcagccgacacggaggacccgaagcagcccgcagaaccccagagaaaagcggccggcgacaggccgggaaagggcgcgaaaggacaagcccacggagccagtgtgaggcacaacggcacaaaggaaagcgggacaccgcgccgacataacaaggggaggaaaaccgagcggagcggccaagggaggcccagaggggacccggggacggcgagggagaaaaaccacgcaggggcgggaaccaaaggggcaaaaaacgagacacacgcagaggcatggaaaaaggcgacaaacggcggacgacgaggacggacccgcggcagaaaaaagcccaacagggggcccacggggaaacgaaagaaaagccggcaaggacgggcggggaggagaggaccggacccaacgaagcacctcgcgcgagaccgcggagaaagcccaccccggcgggggaggcaaacagcgagccacaccccccacaacgagcaagaagacaacaacgccaccccaagaaggaccctaaggaagacccaacaggagagagaggacacccagagaaccgaacacaggcgaaccgccgcgaaaacgggccaagactagaccggggctaccgcacaccacccacagcggggcagagacaggggcgcgcggcacaggcagcaaagagaagaggggaccggcggctaaggccacgacacgaggcaaccgaagaaccaaacgagcggcgagggggcgccacaagaaacaccgccgcaaaccgcaccaggggaaaacacgcaagcaccgcaacaggtcaatggcgtgggagagcccaaaaagcggacgagaggaagaaagaccgaaccgcagcagcaagcggcaagcggcaccgcggcagcactacacccaacccggacgcaacacgcggcgctcgacacagaccggagaccacaaacacatagggcacagcgcgaaaaagcgcgaagcggagaaagcggacacaccgaaacacccagagggacgaaagcgaagacacacggacgcggaccaccaaagagagaatcggacacccacgagaagaaaggcgggacaagatcaaagacgaacggggaacaggaggaaaacgcggagaaccacacaagcaggacacgaaaaaagcgggagaccgcaaccgcgaaatacggcaagcccgccaaagaacgcaacgagcg

SEQ ID NO: 39343 - DNA, 1416 bp, Xanthomonas campestris
  unsure (1)..(1416): unsure at all n locations
aggaagngaagggatgaacaaagcaaacagatggcggccaagaaaaggaacattctaacagtttcttcacacaaaagaaaagccaagcaccagggaccaccggggagcagggggccggaaacaaaagaaaaagacagcgacggaggaaccccacaccaaccgagaaccacaaggacgcccgacgacgaccaaccgaaaacagcgacgccccgagagaaacgggaaagacacaaaacgaagacgggcccgcaggaagacacgaccaagaagcacgacaccacgagggacaaaaacggaaccacaagagaccaacgaacgacagccgaaaacagaacagacgaaccaagcacgacgagcgacagaaccaaagacccaactaataccccaacacaagagacagggaacaaagcacgaagcaagaacgtcaaaacgaacgagagaaccataacacagaaggcaaacaccagacgcaagacaaccggaaaaagcgacccagaacagcaaaagagaacacaaagatacgcgcgaatggccgagacaacacgaccgatgccaacgcaagaaaaacggagacagaagagtgactggaaacaccaaccacacgaaaggcaagcacacgaaccacggaacccaccgacgaaacgcacacacacaacgcaatgacaggaaagcagaggcaatacgaccaaaaacacgcagcgacgccacacaaacgagagaaagcaagagtgacacgacacacacaagaaacgacacgaacgcatcgaaacagcacaatcaggaagcgccggacacgcgaggacaagcacagccaagagaaagaccgaaagcaaacaggcaacaacgaacaacaaaccgaaaaggacacgacacgaagggcaacgaaagacaaggaacgcgacgaaaatcgatacgcagcgagcgctcgaaaacaggagcacgatcagcacgacactgcaccggaacgangagggaagagaagaacagtcgcagcagagaggcacagaataccacaggcacggcaaggaggagcagacgacagatgccgaacagatgaagagaacgaaacgcctggagcacaagtaccaggcaacactaaggaaagagaacgaaaaacgaatgcgccagggacgcacaggacagaaggggaggcaacgagaacaggaccgagcagaccacatgcaccgaaactgcctgaacagagaacgacggacacaagcgacggaaggcgaagcgaagacgcagaagacaagagacgcaaaaacggagcagaaggaacgaaacgacagacacgacccacagagcgacgcctgagagcacatgaacaactcaacaaaacgcaaagagaaccaacaaacgcaagcaaagaggaaggaaccacgaaacagacaccacagacaaacgcacgcatcaagg

SEQ ID NO: 39344 - DNA, 468 bp, Xanthomonas campestris; identical to SEQ ID NO: 38979
  unsure (1)..(468): unsure at all n locations

SEQ ID NO: 39345 - DNA, 687 bp, Xanthomonas campestris; identical to SEQ ID NO: 38980

SEQ ID NO: 39346 - DNA, 955 bp, Xanthomonas campestris
atgccgaagccgctcgagctgttcgactgccggccgatatcctgcaggctctggagcagcaggtcgccgccggtccgcacgatcacgtcgccgcccgacacgttcgcgccgaccagcttggtgtcgtcgcccgacgcgatcgtcagccgcgtgccgccatcgacgacgctgttgacgttgtgggtctgcgaagacgtgcccgaggcgctgctcgacgacacgctcgcggtcgccgaggcggtggcgccgccgacgatgcccacccccagcgaaagacccaggctcgcgccggcgctgtgcgaagaccagttctggttcgcgtgcgcctgcgccgcttcgatcagcacatcgccggttgcagtcagtgcaaccccgttcgtgcccttcaccgacgagccgaggatcgagagatcgccccccgtggcaatgatgccgaccgtgtcgcccgtcaccgatgcgcccaccacggtcgccgcctcgcccgaggtcttcgaacgcgagctcgaaatgccgaggctgaccgaaacgccgacggtgctggtcatcgcgttcattaccgagcggacggtgctttgcgcggtcgaggcggtgttgatcgccagcgccgcagcgccgcctttcgcgctgcccagcgcggagggcagatccgcaagcgtatgtacagcacccgagatgttctcatacgcgccgatcgacacgccgaagctcgaagatttcgagctggagctgctatcccgcacgtccagcgtgttggcgatggtgaccgatgcaccctggagcagcacgtcgccgccagccgccaccgtgctgccggtaatccccagcgccccgcccgagacgatcgtcaggtcgccgttctgcgtaccgatcaccgatccagcctgcgtcacgtcggtcgtgctgccggtagtgctggtcttggcgacgccgaggacagcccgccgccggccaaggg

SEQ ID NO: 39347 - DNA, 2436 bp, Xanthomonas campestris
gtgcataaattcggtggcacctcggttgccgatgccgagcgttaccggcatgtggcgcagctgttgctggcacgcgatgagaccgtgcaggtgacggttgtctcggcgatgaaaggcgtgactgatgcgttgatcgagctggccgaactggccgcgcagaatcgtccagagtggcgcgagcgctggcatgaaacgcgtgcgcgccatcgcggtgcggcggtggcgttgctgggcgagcattccgggcccaccgtggagtggctggacgagcgcttcgagcatctgtcacagatccttgcggcgcttgcagtcatcggcgagctgccgcgcgaagtgcttgatcgcgtgcaggggctgggtgaggtgtattccgcgcagctgctcggcgaccacttccgtgcactgggcgaagactgcgcagtgctggatgcacgcgatgtgctggtggtcaatcgtggcgagctgggcgtggatgtggactgggcggtgagcgcgcagcggctggacacctggcggcaggcgcatccgcagacgcgggtggtggtcaccgggtttgtcgcgcgcgatcgcggcgaccgcatcaccacgctggggcgtaacggcagcgattattcgggcgcgatcttcgcggccttgttcgatgctcacgagctgcacatctggaccgacgtggatggggtgctctcggccgatccgcgcgtggtgcccgaggcggtgcagctggaaaccctgagttacgacgaagcctgcgagctagcctatttcggcgcgaaggtcgtgcatccgcagaccatgtcgccggcgatcgagcgcggtttgccgatcatcatccgcaatacgttccaacccgaacatccgggcacgcgcatcaccgccagcagtgcggtgagcgggccgatcaaggggctgacgctcagcccggatctggcggtactgaatctggaaggcaccggcctgatcggtgtgccggggacggccgagcgtgtgttcgcggcgctgcgcacggcgcaggtgtcggtggtgatgatctcgcaaggctcgtcggaacattcgatctgctgcgtggtcaagcagcatgaatccgagcgtgcgcgcaatgcgctgctgcaggcatttgcgcacgagatcacggttggccaggtgcagcgcgtgcagttgaccaccggcatcagcgtgctggcggcggtgggcgatggcatggccgggcaacccggtgtggcggcgcggctgttcgagtcgctgggccgcgcgcaggtcaatatcctggcgattgcgcagggctcttcggagcgcaacatctcggtggcgatcgatgcggcgcatgccaccaaggccttgcgcgcggcgcatgccggcttctggttgtcgccacagacgttctcggtgggtgtcatcgggccgggcaatgtgggtgcggcgttgctggatcagctgcgtaccgcgcagccgcaactgctcggcaaggccaacctggatctgcgcctgcgtggcgtggtgtcgcgcgggcgcatgttgctggaagagcgcagcgtgaccggcgattggcgcgatgcatttgcagcggcgtctacgcccaccgatctggagcgcttcaccgcgcatctgctctccgcgcacctgccgcatacggtgatcatcgattgcagcggcagtgcggaagtggccgaccgctatgcgggctggctggcagccggcatccatgtggtgacgccgaacaaacaggccggctccgggccgttggcgcgctatgaggcgatccgtgccgccgccgatgccagcggtgcgcgcttccgctacgaggccacggtcggcgccggcctgccggtgatcaccacgctgcgcgacctggtcgataccggcgatgcagtgacctcgatcgaaggcattttctccggcacgctggcgtggctgttcaataaatacgacggcagcgtgccgttctccgagctggtgacgcaggcgcgcggcatgggctacaccgagccagacccgcgcgatgacctgtccggcgtggatgtggcgcgcaagttggtgatcctggcgcgcgaggcggggcgggcgatcagcctggacgatgtcagcgtggaaagcctggtgcccgaggcgttgcgccaggccagcgtggatgacttcatggcacagctgcagacagtggacgccggctttgcgcagcggctggccgacgcgcatgcgcgcggcaacgtgctgcgctatgtcgcgcaactgccgccagatcgcgcgcccagcgtgggcctggtggaattgcctgcgcaccatgcgttcgccaatcttcgcctgaccgataacgtggtgcagttcaccacgcgccgctactgcgagaacccattggtggtgcaaggcccgggcgcagggccggaagtgaccgcggccggcgtgtttgccgatctgctgcgcgtggcggcaggcgagggggcg

SEQ ID NO: 39348 - DNA, 1377 bp, Xanthomonas campestris
aacacccgtttcatcatcctgatcagctgcgtggccacgatcggcggctttctgttcggcttcgacagtggcgtgatcaatggcaccgtcgacgggctcaagcagaccttccagtccagtgccttctttactgggttagaagtagcctcaatgttgatcggctgcgccattggcgccttctttgccggtagccttgccgaccgctggggccgccgcgcggtcctgattatttctgcggcactgtttctggtctcggcgatcgccgctggcgccgcgcacaactcctggttttttattttcgctcgcatgatgggcggacttgcggtgggcgcagccagcgtcatctcgccggcctacatcgccgaggtcgcctccgcgcgctatcgcggccggctcgccaccatgcagcagatcgccatcatcagcgggctgttctgcgcgttcttgagcaactacctgctggccaatgccgccggtgcgtccaccgagccgttgtgggcagggcaggctgcctggcgctggatgttctggatgcaggccatcccgtcgctgttgttcctgctgctgttgctggtcatccccgaaagcccgcgctacctggtggtcaagggccgtcgcgagcaggcgctggtggtgctcaagcggctgtacggtaacgcggccgcacagaccaaactgggcgaaatctccgcctcgatgtcggccgaccagcacaagcccaagttctccgacctgatcagcaagaccaccggcaagatccgcccgatcgtatggattggcgtcggcctggcggtgttccagcagctggtcggcatcaacgtggtgttttattacggcgcggtgctgtggcaggcagtgggcttctccgaacaggacgccttgctgatcaacgtgctctccggcggcctcagcattggtgcctgcctggtcacggtgatgctggtcgacaagatcggccgcaagccgttgctgtggatcggctcggccggtatggcggtatcgctggcactggtgacctacgccttcgccaccgcctcgctggatcccaacggcaagctcgcgatgtccgatgccatgggcatgctcgcgctggttgccgccaacgtctacgtggtgttcttcaacgcctcgtggggcccggtgatgtgggtgatgctgggcgagatgtttcccaaccagatccgcggttcgggcctggccattgccggcgctgcacagtggacttccaacttcgccatcaccgtcagcttcccgatcctgctcggcagcatcggtcttgccggcgcctacggcatctacacggttgccgccttcatctcggtgttcttcgtgctcaagtacgtctacgagacgaagggcaaggagctggagcagatg

SEQ ID NO: 39349 - DNA, 1515 bp, Xanthomonas campestris
ttacccatgacccaagaatcttccgcgccgctgctgtttgcagacctcggcctctcagatgctgtgatgaaggcggttgccgccgtcggctacgagaccccttcgccgatccaggccgccaccatcccggcgctgctggccggtcgcgacgtgctcggccaggcccagaccggtaccggcaagaccgccgcgttcgcgctgccggtgctgtccaatgccgacctgaaccaggtcaagccgcaggcgctggtgctggcgccgacgcgcgagctggccatccaggtggccgaagccttccagaaatatgccgaagccatccccggtttccgcgtgctgccggtgtacggcggccagccgtatgcccagcagctcagcgcgctcaagcgcggcgtgcacgtggtggtgggcaccccgggccgggtgatcgatcacctggaccgcggcaccctggacctgtcgcagctgaagacgctggtgctggacgaagccgacgaaatgctgcgcatgggcttcatcgacgacgtcgaagcggtgctgaagaagctgccggaaaagcgccaggtggcgctgttctccgcgaccatgccgccggcgatccgccgcattgcgcagacctatctgaaggacccggccgaagtcaccatcgcggccaagaccaccacctcggccaacatccgccagcgctattggtgggtgagcggcctgcacaagctggatgcgctgacccgcatcctggaagtcgagccgttcgacggcatgatcattttcgcgcgcaccaaggccgctaccgaagagctggcgcaaaagctgcaggcgcgcggtctggccgcggccgccatcaatggcgacatgcagcaggccgcccgtgaaaagaccattgcccagctcaaggacggcaagctcgacatcctggtcgccaccgacgtggccgcgcgcggcctggacgtggaacgcgtcagccacgtgctgaactatgacattccgtacgacaccgaaagctacgtgcaccgcatcggccgcaccggccgtgccggccgcaacggcgacgcgatcctgttcgtcaccccgcgcgagaagggcatgctgcgcgcgatcgagcgcgccacccgtcagccgatcgaagagatgcagctgccgagcgtggacgcggtcaacgacacccgcgtggcgcgtttcatgacccgcatcaccgagaccctggccggcggtcagatcgagatgtatcgcgatctgctgcagcgctacgagagcgagaacaacgtgccggcgatcgacatcgctgcggcaatggccaagttgctgcagggcgacgccccgttcctgctgactccgccggtgcgtggcgcgcgcgaagacttcgcaccgcgtgagcgcaccgaccgcgccgaccgtggcgagcgcccgcgcttcgagcccaagttcgagcgtggcccgcgtgcgcccgacggcgagcgtggtgcacgtccgccgcgtccggaccgcccggcctatggtgaagacgccggcgccgagcgt

SEQ ID NO: 39350 - DNA, 1165 bp, Xanthomonas campestris
aagggcgcggtgctgtacgacgccggcggctacggcatgctcggtttcggccatacgcccgaggcggtgctcgacgccatggcgcgcccgcaggtgatggccaacgtgatgacgcccagcctggcgcagcgcaagctcgaccgcgccctgcgcgcggagatcggccacacccgcggcggctgcccgttcgcgcgcttcatgtgcctcaactccggctccgaagcggtgggcctggccgcgcgcatcgtcgacaccaacgccaagctgcacaccgatccgggtgcgcgccacgccggcgccaccatcaagcgcctggtggtcaagggcagcttccacggccgcaccgatcgccccgggctgtattccgattccagccgcaagacctacagcaagtacctggccagctaccgcgacgaagactcggtgattgcgattgcgccgtatgacatcgcggcactgcagcacgcctttgacgaggccgcgcgcaaaccactggttcatcgaggcggtgttcctggagccggtgatgggcaaagacgacccggaccgtgcgctgccggcggagttctacgccgctgcgcgcacgctgacccgcaaccacggcagcctgctgctggtggattcgatccaggccggcctgcgtgcgcacggtgtgctgtcggtggtggattaccccggtttcgagcagctcgatccgccggacctggagacctattccaaggcgctcaatgccgcgcaatatccgctctcggtgctcgcggtgaccgagcaggccgcgcaggtgtaccgcaagggcacctacggcaacaccatgaccaccaacccgcgcgcgctggatgtggcttgcgccacgctggcgctgttcaccccgcagatccgcgacaacatccgcctgcgcggtgcacaggcgctgcgcaagctggaagcgctgcaggccgagctcggcggcctgatcaccaaggtgcagggcaccggcttgctgttctcctgcgaactggcaccgcagtacaagtgctacggcgccggctccaccgaggagtggctgcgccaccacggcgtcaacgtgatccacggcggcgagaattcgctgcgcttcaccccgcacttcggcatggacgaagccgaactcgacctgctggtgggcctgatcgccaaagcgctcaag

SEQ ID NO: 39351 - DNA, 1188 bp, Xanthomonas campestris
gactttcatgcgtacccggatgccgccggccatttcggcaagtttggcgggcgcttcgtcgcggaaaccttgatcgcgcccctgcaggaactgtctgccgcctacgatctggcgcgccaggatccggccttcattgccgagtacgacaaggatctcaaacattacgtcggccgccccagcccgatctaccacgccgagcggctgagccgcgaagtgggcggggcgcagatcctgctcaagcgcgaagacctgaaccacaccggcgcgcacaagatcaacaacaccatcggccaggcgctgctggccagccgcatgggcaagacccgcatcattgccgagaccggcgccggccagcatggcgtggccagtgccaccgtcgcggcgcggctgggcctggaatgcgtggtctacatgggcgcgaccgacatcgaacggcagaagatcaacgtctaccgcatgcagttgctcggtgcgaaggtcatcccagtcacctcgggctcggccacgctcaaggacgcgctgaatgaagcgatgcgcgactgggtcagcaacgtgcaggacaccttctacatcatcggcaccgtcgccggcccggatccgtatccgcgcatggtgcgcgatttcaacgccatcgtcggccgcgaagcgcgtgcgcagatgctggaagactacggccgcctgccggatgcgatcagcgcctgcgtgggcggcggcagcaacgccatcggtttgttccatgcgttcttgaacgaccccggcgtcaagatctacggcgccgaagcggcgggtgatggcattgccagcggccgccatgcggcatcgatcgccgccgggcgccccggcgtgctgcacggcaatcgcacgtatgtgatctgcgatgacgacggccagatcatcgagacccattcggtctcggcgggcctggactacccaggcgtggggccggagcatgccttcctctccgacagcggccgtgccgtgtaccagggcatcaccgacgacgaagcgctggccgcgttccacttgctggcgcataccgaaggcatcctggccgcgctggaatccagccatgcggtcgcgcagtcgatcaagcttgcgcgcgaaatgcccaaggacgcgctggtgctgtgcaacctgtccggccgtggcgacaaggacgtgcacaccatcgccgcacgcgaaggcatg

SEQ ID NO: 39352 - DNA, 498 bp, Xanthomonas campestris
atgaaccccgctcccaatctcgtgatgatcggcccgatgggcgccggtaaaagctgcatcggccgccgcctggccgagcgcttcgggctggatttcgtggatgtggaccaggccatcgtcgagcaggtcggcagcagcatccccgcgatcttcgaacagcacggcgaagcgcgctttcgccagcacgaagccgaggccctgcacggcctgctcgcgcagagcaacaaactggtctccaccggcggcggcgcgatcctggatgcgggcaatcgccagcgcatccgcgagcgcggcttcgtggtgtacctgcatgtgagcgtgccggcccagctcacccggctggcgcgcgaccgcaatcgcccgctgctgcagcgcccggaccgcgaacaggtgctgcacggcatggccgcgctgcgcaccccgctgtaccaggaagtggccgacctcaccctggaaaccgatcacctttcccccgccgaggccaccgcgcagctggtg

SEQ ID NO: 39353 - DNA, 1089 bp, Xanthomonas campestris
cgcagcgtcgaagtcgacggcgcgcagccgtacaccatctccattgcgccgggcctgctggccgacggcgcgcgcctggcccgccacgtacgcggccgccacgtgctgctgctcagcgacacccaggtggcgccgcactatgccgccggcgtgcgcgctgcactgttgcaggcgcggccggacctgcagcttggcgaactggtcatcgccgccggcgaagcctccaaaaccctggacaacttctccctggcgatcaccgcactggccgaactgggcgccacccgcgatgcctgcgtgttcgcgctcggcggtggcgtggtcggcgatctggccggctttgctgccgcctgctggatgcgcggggtggattgcgtgcaactgcccaccagcctgctggcgatggtggattcctcggtcggtggcaagaccgcggtggacatcccgcagggcaagaacctggtgggggcattccacccgccacgcgcggtgattgccgataccgacaccttgcgcaccctgcccacgcgcgagctgcgcgctggcctggcggaggtaatcaagtacggcgccatcggcgacccgttgttcttccagtggctgcatgccgaacgccgcgcgctgctggacggcgacccggccgcgctggcgcaggcgattgcacgcagttgcgagcacaaggccgacatcgtggcgcgcgacccgctggaaaaaggcgagcgcgccctgctcaacctgggccacaccttcggccacgccatcgagacagaacagggctacggcgcgccgggtaacgacaacctcaaccatggcgaagcggtggcagtgggcatggtgctggcagcgcggctctcggccgcactgggcatggccgacgcccaggacaccgaggcactgcgcaccctgctgcatgaattcggcctgcccacccagatcccgaccggcctggcaccggaagccctgctcggccgcatgcggctggacaagaaaaacatcgccggccgcctgcgcctggtgctgtggcgcgggatcggcaaggccgaagtcgtccccgacgtggacgaagctgcggtgctggagattctggccgac

SEQ ID NO: 39354 - DNA, 1464 bp, Xanthomonas campestris
atgctgaagtctctgttgagggtcaaaccgatcgagcccgccggacgtgtggatgcgggcgaaccggtcgaaggcagcctgcagggcgaagcgacgctgcaacggaccctcaccgccaagcacctgatcatgctcggcatcggcgcggtgatcggcgcaggcatctttgtgatgaccggccaggcggctgccaaccatgctgggccagcggtgatgctgtcgtttgtcttcgcgggtatcgcctgcacgtttgccggcctgtgttacgccgagttcgcggcaatgatgccggtctccggaagtgcttactcgtattcctacgcgacgcttggagaaggcatcgcctggttcattggctggtgcctggtgctggaatatctgttcgcagggtcaagcgtcgcggtggcgtggtctgcctatctgatcagcttcatcaccggcacgctgggtcttccgttccccacagagctgaccaacgccccgcttgcctggatcaatggcgaattcgtggcgtctggcaacatcctcaacctgcctgccgtgctcatcgtggctgcggtgagtgggttgtgctatgtcggcattacccagtcggccttcatcaacgcaattgtcgtggcgatcaagatcgcagtgatctgtctgtttgttggcttcggcgcggcatatatcgacccggccaactggcatcctttcattcccgaaaataccgccccaggcgtatttggctggagcggcgtattccgcgctgcctcgatcgtgttctttgcctacattggcttcgatgcggtatcgacctcggctggagaaaccaaggacccgcaacgcaacatgccgatcggcatcctcggctcgctggcggtgtgcaccatcatctacatcatcgtgtgtgcagtgctgacaggtttgatgccatatacccagcttggcactgccaagccggtggccactgcgctggaagcgcacccgcaactgacttggctcaagactgcggtggagatcggcgcgatcgccggcctgtcctcggtggtgctggtgatgctgatggcacagccgcgcatcttctacaccatggccaaggatgggttgatgcccaaactgttcggcaaggtgcacccgaaattccacacgccatatgtcggcaccgtgatcgtgggggtggtcgccgcatcactggcggggttgatcccgctcagcgtgctgggtgaactggtgtcgatgggcaccctgctcgccttcgccaccgtgtgcgccggcgtaatggtgctgcgtttcaccaagcccgagctggagcgtccgttccgtgtaccgctggcaatgatagtttgtccgttgggtacgcttgcgtgcctggccctgttcttccaggccttccaggaacactggaaggtgttcgtgggctggaccgtgatcggcctggtcatctatttcggctacggcatccaccatagccgtctggctcgc

SEQ ID NO: 39355 - DNA, 1350 bp, Xanthomonas campestris
ctgcaacgcgcgctcggtccctgggggctgaccgccctgggcatcggcgcggtgatcggcggcggcatcttcgtgatcaccggccaggccgcggccgaccatgccggcccggcgatcgtgctgtcgttcgtgctcgcggcgatctgctgcgcgttctgcgccatggcctacgccgaatttgcggcgatggtgccagtctccggcagcgcctacacctatacctacgccaccttcggcgagctggcggcctggttcatcggctggatgctggtgctggaatacggcgtctctgcctcggcggtcgcggtcagctggaccggatatttcctcagtctgctggaacacttcggcatccatttgccggccgccctggtcagcgcaccgctggacggcaagctgcagcgcaccggcgcgatcgccaacctgcccgccgccggcatcgtgttgttgctgacctggctgtgctatgtcggcatccgcaagtcgtcggcgatgaacatggcgatggtgatcctcaaaaccgggctgatcatcctggtcattgcggcgggctggaagtacgtggacccggccaactggcatcccttcatccccgccaacgaagcaccgggcaagtacggcatggaaggtgtgctgcgtggcgcggcgatggtgttcttcgcctacatcggcttcgaggcggtgtcggtggcggcgcaggaatcgcaccgtccgcaacgcgatctgccgatcggcatgatgctgtcgctggtgatctgcaccgtgctctacatcgccatggccgcggtgatgaccggcctggtgccgttcacccagctgggcaccgatgagccggtagtgaccgcagtggccgcgcatccgcagctggcctggttgcgcgtggtggtggaagtgggtgcgctgatcgggctgtcgtcggtggtgctggtgatgatcatcgggcagccgcgcatcttcatgatcattgcgcgcgatggcctgctgccggcggtgttcacgcgcatccatcccaagtaccgcacgccgcacatcaacacggtgattaccggcatcggcatcgctctgcttgcggccgtcttcccgctggatgtgctgggtgagctgacttcgatgggcacgttgatcgcctttgctgccgtgtgcgccggtgtattgatcctgcgccgcacccatccggaactgccgcgtccgttccgcatgccggccgcgtggctgatctgcagcgccggtgtactcagctgcctggctttgctgtcggctatgacgctgcacaactggatgctgatggggctatggaccctggtcgggctggtggtctatttcggctacggctatcgccacagtcgtctg

SEQ ID NO: 39356 - DNA, 1734 bp, Xanthomonas campestris
aacgcgccgcaggtgtcgtcctggcagacctatcggcgtctgctggcattcgctaaaccttaccggctgctgttggtggccgcgttgatcgccgcattgatcgaggccgccgggaccaccggcttcctggccttgatgaagccgatcaccgacgagaccttcatttacaagaacgccgaggtcagccgctggctgccggtgcagatcatcctgttgttcgtgatccgcggtgcggccggttacatcaccgacatggcaatgggcaagtctgcgcgcagcatcgcgcgcgatctgcgcgtcaaggtcatgtccaagtatctgcgcctgccgggctcgcgcttcgactccgaaccggtgccgtcgatgctgatccgcctcggctcggactcggatcaggtcgcgcaggccgccgtggatgccgtgaaggtgatgatccagcagtcgctgcaggtgatcggcgcgttggcgttgatgctgtggcatagctggcaggtcacgctcaccattctggtgctggcgccggtgctggcttgggtgatggacaaggtggcgcgccgttatcggcggatcagtcacagcatccaggagagtggcgcgcatctgttgcaggccgccgaccagaccttgtccagccatcaggaggtcaagatctacggcgcgcagcagagcgagatggagcgctactcgggcctggccgaccgcaatctcaggctggccatgaaagtcgaatccacgcgcggcatttccaccgccaccgtgcagatgatcggcgcgatcggtctgtccgcgctgctgttcgtggcgggcgcgcaggcattggccgggcgcctgacggccggcgattttgtggtgttgatgacctcgatgctgacgatcattccgggcctcaagcagctcaccaatgtgcagaacatggtgcagcgcggcctggcgtctgccgaacgcctgttctcggtgctggacagccctgacgagcccgaccagggccaggtgccgttgacgcgcgccaagggtttgatcgaattccgcgatgtcaccgcgcgctatccggggcaggccaatcctgcgttggccgatgtcagcttcgtggcacagccgggcaccgtcacggcgatcgtcggccgctccggcagcggcaaatccagcctgatcaagctgattccacgcttttatgaggccgagtccgggcagatcctgctcgacggtcacccggtgcaggcctatgcattggccgatctgcgccgccagattgccctggttggccaacaggtgatgctgttcgacggcagcattgccgagaacgtggcatacggcgaaatgcgccagtgcgatgccgggcaactggagcgcgccatccagggtgcgaatgcgatggagtttgtcgcgcagctgccggagggcctgcagtcgcacgtgggtaccaagggcgggcgcctgtccggcggccagcgccagcgtctggcgatcgcacgcgcgatgctcaaggacgcgccgatcctgatcctggacgaggcgaccgccgcactcgataacgaatccgagcggctggtgcaggacgccttgcacaagttgatgcccgaccgcaccaccttggtgatcgcgcaccggctgtcgacgatcgagcatgccgaccaggtgctggtgatggaccagggccgcatcgtcgagcgcggtacgcatcaggaactgctcgcgctgggcgggctgtactcgcacctgcacggcatgcagttt

SEQ ID NO: 39357 - DNA, 3007 bp, Xanthomonas campestris; identical to SEQ ID NO: 38991

SEQ ID NO: 39358 - DNA, 591 bp, Xanthomonas campestris
ttgaccatccccacgtggctgacactgctgaggatcgtgatgatcccggtgttggtcgtggtgttctacctgccgtacaagtggaccaatttcgcctcggccggtgtgtttgccctggccgcgatcaccgactggctggatggctgggtcgcgcggcgttatcaccagtattcggcgtttggcgcatttctggacccggtggccgacaagctgatggtcgccgtggcgttgttcctcatcgtgcaagggcatcccacgccgtggatggcgttctgggcggcggtcatcgtgggtcgcgaaatcgcggtgtctgcattgcgcgagtggatggccgagatcggccagcgtgccaaggtgcgcgtggcaatgatcggcaaggtcaagaccaccgcacagatggttgcgttgctctgtttgctgtattcggtcacgccggggcagatgcccacgcatgaaatctggctgggcaacctgatcttccaggcggggtactggaccctggcaatcgccgcattgctgacgttgtggtcgggtttccagtatctgcaggccgcatggccaagtttgcgtgccgatgaaaaggccgcgatt

SEQ ID NO: 39359 - DNA, 729 bp, Xanthomonas campestris; identical to SEQ ID NO: 38993

SEQ ID NO: 39360 - DNA, 939 bp, Xanthomonas campestris
caaagccccaatcgtctgaaatacgcaggcgtcaacatctccggtgcggagatccagtcgtccaaaaaaccgggcgtgctcaatatcgactaccgctatccaaccgcgtccgagtacaggtacttcgcgggcaagcaaatgaacatcgtgcgcctgccgatcctgtgggagcgcatgcagcccaaagctcaaggtccgctggatcaggcacaactggcattgctgaagcaggcagtggccaacgccaaggccgccaatcaatacctgattatcgatgtgcacaactacgccaagtactacggccagaagattggcagtaagcgggtgccggtgcgcacgttcaccgatctctggcgccgtctggccatcgcgttcaagagcgacaacgccgtgattttcgggctgatgaacgagccgtacgacatctcgccagagagttgggccgccgccgcgcaggcgtccatcgacagcattcgtgccaccggtgccaccaacctgattctggtgcccggtgcattgtggtcgggcgcacacagctggtattccaccgtggccgggcagtccaatgcagtggcgcttgcgaacatccgcgacccattgaatcgctatgcgatcgaagtccatcaatacctggacaccgactccagcggcaccagtgccggttgtgtgagccgcacgatcggtgcggagcgcttgcgcagtttcaccggctggctgcgcgcgcaaggcaagcgcggttttcttggcgaattcggcaccgccaataacgcaacctgcactgcggcgctggacggcatgctcggttatctcgaaaccaaccacgatgtgtggatcggttggacgttctgggcggcaggcgcgtggtggaacaccagctatccgttcaatgtgcagcccgatgcgcaaggccgcgacaagccgcagatgaaaaccttgagc

SEQ ID NO: 39361 - DNA, 939 bp, Xanthomonas campestris
acgcgtgcactcaagtacgccggcgtcaatttggcgggtgcggaatttgcgtcatcgaaaaaacctggcgtcctcaacaaggactacatgtatcccgccagcaccgattacagctatttcgctgggactggaatgaacgtgattcgcctgccgatcctgtgggaacgtctgcaacctgccgcacgcggcgagctggatccggcgcagctggcactggtgcagcaagcggtggcacgcgccaaggcatcgggcatgtatctggtgctggatatccacaactacagcaagtactacggttataaaatgggtgggccggaagtgccgctcgccacctttgccgatctgtggcggcgcctggcggtgatcttcaacagcgataacgccgtgatcttcgggctgatgaatgagcccaacaacatctctgccagcgaatgggccggtgcagcgcaggcaggcatcgatgcgatccgtgccaccggcgccaacaatctgatcctggtaccgggcgcgctgtggaccggcgcacacagctggcactcgctgaccagcgatgggtattccaatgcaaccgcgttggcatcgatcagcgaccctctcaatcgctatgcgttcgaagtgcatcaatatctggatgccgattccagcggcacctccagtgtctgcgtcagtgaaaccatcggcgccgatcgcctgcgtgcgttcaccgaatggctacgcaccaacaacaagcgtggttttctcggtgagttcggcaccgccaacaacgccgtctgcaataccgcgctgcaaggcatgctggcctacatggaaaactacgccgatgtctggctgggctggacatggtgggcagcgggcgcatggtggaacaccagctacgcctacaacgtgcatccgaacaaggacggcaccgacaagccgcagatggtcatcctctcgccg

SEQ ID NO: 39362 - DNA, 948 bp, Xanthomonas campestris
cgcctggtcctgatccttgccggcttagtgctggcctcatccgcgcacgccggcttgtccgtgtcgggcacacagctgaaggaatccaatggcaataccttgatcctgcgcggcatcaacctgccgcatgcctggtttgccgatcgcaccgatgccgcgctggcgcagatcgcggccaccggtgccaacagcgtgcgggtggtgctcagttccggccaccgctggaaccgaacgcccgaggccgaggtggcgcgcatcatcgcgcgctgcaaggccctggggttgatcgcggtgctggaggtgcacgacaccaccggctatggcgaagacggcgccgccggcagcctggccaatgccgccagttactggaccagcgtgcgcactgcgctggtgggccaggaagactacgtgatcatcaacatcggcaacgagccgttcggcaatcagctcagtgccagcgaatgggtcaacggccacgccaatgcgatcgccacgctgcgtggcgccgggctcacgcatgcgctgatggtggatgcgcccaattggggccaggactggcagttctacatgcgcgacaacgcggcggcgttgctggcgcgcgacagccgccgcaacctgattttcagcgtgcacatgtacgaggtattcggcagcgacgcggtggtggacagctacctgcgcaccttccgcagcaacaatcttgcgctggtggtgggcgagttcggcgccgatcatcgcggcgcgcccgtggacgaggcggcgatcatgcgccgcgcgcgcgagtacggcgtgggctatctcggctggtcgtggtcgggcaacgacagcagcacgcagtcgctggatatcgtgctcggttgggatcctgcgcgtttgagcagttggggacgcagcctgattcagggcccggacggcattgccgcgacctcgcgccgtgcgcgggtgttc

SEQ ID NO: 39363 - DNA, 1872 bp, Xanthomonas campestris
  unsure (1)..(1872): unsure at all n locations
aagcagacgctgggcttccagaccgaggtcaagcagctgctgcagctgatgatccactcgctgtattccaacaaggaaatcttcctgcgcgagctggtgtccaatgccgccgacgccgccgacaagctgcgcttcgaagccttggtcaagcccgacctgctggaaggcagcggcgagctgcgcatccgcgtcgacttcgacaaggacgcgcgcaccgtcaccatcgacgacaatggcatcggcatgagccgcgaggacgcggtgtcccacctgggcaccatcgccaagtccggcaccgccgacttcctcaagcatctgagcggcgaccagaaaaaggacgccaacctcattggccagttcggcgtaggcttctacagcgccttcatcgttgccgaccaggtcgacgtgtattcgcgccgcgccggcctgcccgccagcgacggcgtgcattggtcctcgcgcggtgagggcgagttcgaagtcgccagcgtcgacaagcccgagcgcggcacccgcatcgtgttgcagctgaaggaaggcgaagagtcctttgccgatggctggaccctgcgcaacatcctcaagaagtattccgatcacatcggcctgccgatcgagatgcgcaaggagcactacggcgaagacgccgacaaacccgccgaacccgagtgggaagtggtcaaccgcgccagcgcgctgtggacccgccccaagtccgagatcaaggacgaggagtaccaggagttctacaagcacgttgcgcacgatgccggtaatccgctggcgtggagccataacaaggtcgaaggcaagctggattacacctcgctgctgttcgtgcccggccgcgcnccgttcgacctgtaccaccgcgattcggccaagggcctgaagctgtacgtgcagcgcgttttcatcatggaccaggccgaacagttcctgccgctgtatctgcgtttcatcaagggcgtggtggattcggccgacctgtcgctcaacgtctcgcgcgagatcctgcagtctggcccggtggtggactcgatgaagtccgcgctgaccaagcgtgcgctggacatgctggaaaaactggccaaggacaagccggatgactacgccaccttctggcgcaacttcggccaggcgctgaaggaaggccccgccgaggactacgccaaccgcgaaaaggtcgccggcctgctgcgtttctcgtccacccacgacaccaccggcgcgcaaagcgtggcgctggccgattacgtgggccgcatgaccgagggtcaggacaagctgtactacctcaccggcgagagctacgcgcagatcaaggacagcccgcacctggaggtgttccgcaagaagggcatcgaagtgctgctgctcaccgaccgcatcgacgaatggctgatgagctacctcaccgaattcgacggcaagtcgttcgtggacgtggcacgcggcgacctcgacctgggcaagctggattcggaagaagacaagaaggcgcaggaagaagtggccaaatccaaggagggcctggcctcgcgcatcaaggcagcgctcggcgacgacgtggccgaagtacgtgtctcgcaccgcctgaccgactcgcccgcaattctggcgatcggccaaggcgacctgggcctgcagatgcgtcagctgctcgaagccagcggccaggccgtaccggaaaccaagccagtgttcgaattcaacccggcccacccgctgatcgaaaagctggatgcggaacaggatatggaccggtttggtgacctgagccgggtgctgttcgaccaggctgcgctggcggcgggcgacagcctcaaggacccggccgggtatgtgcggcggttgaataagttgttgttg

SEQ ID NO: 39364 - DNA, 663 bp, Xanthomonas campestris; identical to SEQ ID NO: 38998

SEQ ID NO: 39365 - DNA, 728 bp, Xanthomonas campestris; identical to SEQ ID NO: 38999

SEQ ID NO: 39366 - DNA, 1125 bp, Xanthomonas campestris
gtggatttcagctttaccgaagaacaactgatgatccaggacgtggcccgccggatcgcgcaggaaaagatcgcccccagcgccgagcagttcgaccgcagcggcgagtttccgctggagaacatccagttgctgggcgagaacggcctgatgggcatcgaggtgccggccgagtacggcggcgccggcatggacccgatcagctatgcgctggcgatgatcgagattgccgccgccgatggcgcgcactccaccatcatgtcggtcaacaattcgctgttctgcaccggcatcctgaagaacggcaccgaggcgcagaagcagctgtacgtgcgcgcaatcgccgaaggcacgcacatcggcgcatttgcgctgaccgaaccgcagtccggctcggatgcctcggccatgcgttgccgtgcgatcaagcagggcgatggcagcttcgtcatcaatggcaagaagagctggatcacctccggcccggtggccaagtacatcgtgttgttcgcggtgaccgagccggacaagggctcgcgcggcattactgctttcatggttgatacggcgcgcgccggcttccatcgcggcaagaccgagcccaagctcggcatccgcgcctcggccacctgcgagattgagttcgccgattacgtagcgcagccggacgaggtgctgggcgcggaaggcgagggcttcaagactgcgatgagcgtgctcgatgcaggccggatcggcattgcctcgcaggcagtgggcgttgcgcgcgcggcctatgaggccacgctggcctatgtgaaggagcgcaaggcgtttggcgcggcgatcggcaccttccagatgacccaggccaagatcgccgacatgaagtgcaagctcgacgcagccttgctgctcaccttgcgcgcggcctggctcaaggggcagggccagaagttcggcaccgaagcagcggtggccaagctcatcgcctcggaagcggcgatgtggatcacccatcaggccgtgcaaatccacggcggcatgggctattccaaggaaatgccgctggagcgctacttccgcgatgccaagatcaccgagatctacgaaggcacctcggagattcaacgcctggtgatcgcg

SEQ ID NO: 39367 - DNA, 933 bp, Xanthomonas campestris; identical to SEQ ID NO: 39001

SEQ ID NO: 39368 - DNA, 579 bp, Xanthomonas campestris
gatgcgctggactggaacaagggcgacggcttgctgcctgtgatcgtgcaggacgccgacaacctgcgcgtgctgatgctgggctacatgaacgccgaggcgcttgcggtgacgcgtgcgcgtggcgaggtcacttttttcagccgcagcaagcagcgcctctggaccaaaggcgagagctcgggaaatgtgctgcgcgtggtcgcgatcgaaaccgattgcgatgcggacaccttgctggtgcaggcacgtccgcacggcccgacctgccacctgggccgcaccagttgcttccccaccgcgcccagccagttcctcggcagcctggacgccttgatcgccgagcgcgagcacgagcgcccgcatggcagctacaccaccaagctgtttgagcaaggcatccgccgcattgcgcagaaggtgggcgaggagggcgtggaaaccgcgctggccggggtggtgcagggcgatgccgagttgctgggcgaatccgctgacctgctgtaccacctgatcgtgctgctgcgcgcacgcgggctgggcctgggcgatgcagtggcgctgctggaatcgcggcac

SEQ ID NO: 39369 - DNA, 765 bp, Xanthomonas campestris
atgctgagccgtcgcatcattccctgcctggacgtgcgcgatggccgcgtggtcaagggcgtcaagttccgcgaccacatcgacatgggcgacatcgtcgagttggcgatgcgctaccgcgaccagggcgcggacgagttagtgttctacgacattggcgccagcccggaagggcgttcggtggactatgcgtgggtcgagcgcgttgcgcgcctgatcgacatcccgttctgcgtggccggcggcatccgcgatgtagaaaccgcgcgtgcggtgctgcatgccggcgccgacaagatctccatcaactcgccggcattggggcggccgcagctgatctccgagctggccgacgcctttggcgtgcaatgcgtggtggtcggcatcgactcgatccgcgaagaggacgggcagtggcgcgtccgccgctacaccggcgacccaagcaagacccaggcgctgccgatgcgcacgctggactgggtggccgaggcgcagcgactgggtgcgggcgagatcgtgctcaattgcatggataacgacggggtccggcatggctacgatattgcgcagctgcgccaggtgcgcgcgttgtgccgggtaccgctgattgcctccggcggcgctggcgagatgcagcacttcgccgacgtgttcgaccaggccgacgccgatggtgcgctggcggccagtgtcttccatagcggcgcgattccgattccggaactcaagcgcttcctgcgtgcgcaacagatcgaggtacgt

SEQ ID NO: 39370 - DNA, 1113 bp, Xanthomonas campestris
cttttcgtcgaccgtgatggcacgctgatcactgagccggccgatttccagatcgacgcctacgaaaagctgcgctttgtcgacggcgtgattccggccatgctcaagctgcgcgatgccggctaccagttcgtcatcgtcagcaaccaggacggcctgggcagcgagagctacccgcaggcatccttcgacggccccaacaacctgatgctgcagatcttcgccagccagggcatcgtgttccgcgaagtgctgatcgactgcagctggccggccgacaacgcgccgacgcgcaagccgggcgttggcctgatggtgccatacctgcaggaccgcacgatcgactggagccgttcggcgatggtgggcgaccgcatcaccgacatccagttcgcgcagaacctcaacatccgcgggttccagctgcgcaccgagcagttcggcggcgattgggactgggccggcatcgcacacgaactggccgatgccccgcgccgcgcggtggtccagcgcaataccaaggaaacccgcatccgcgtggagctcgacctggatcgcgtggccgaaccgcacaccgccaccgggctgccgttcttcgatcacatgctcgagcagatcggcaagcacggcgggtttgcgctggatatccgcgccgaaggcgacctgcacatcgatgagcaccacaccatcgaagacaccggcttggcgctggggcaggccttgcgcgaagccttgggcgacaagcgcggtattggccgctatggctttgatccggacgacagcccatggcgcgtagcgggcgacaccacacagcacggctttaccttgccgatggacgaaaccatcgccagtgctgcgctggatttcagcggccggccatacttcgtgttcgacggcgacttcaaacgcgagcgcgttggcgacatgcccaccgagctggtgccgcacttcttccgttcggtgtgcgatgcatccggattgaatctgcatctgcacgtgcgcggcgagaacgatcaccacaaggtggaaggctgcttcaaggcattggcgcgtgcactgcgccaggcgatccgccgcgagggcaccgcgttgccatccaccaagggggcgcta

SEQ ID NO: 39371 - DNA, 1077 bp, Xanthomonas campestris
atgagcacggcatcggtaatggatctggtgcgtgacgatctgcgcgcatttgcaggctatgcgtcggcgcgcacgagtgcattgcaaggcgatgtgtggctcaacgctaacgagtcggcctggggaaatccggccgatcccgacgccagcacgcgtcgctatcctgatccgcagcccaagggcctgcgtgcggcgctggcgcagctgtatgggtgtgcgcccgagcaattgctgatcggccgtggcagcgacgaggccatcgatctgctggtgcgtggcctgtgcgtgcccgagcgcgatgcggtggtggtcacaccgccggtgttcggcatgtatgcggtgtgcgcgcgcctgcagagcgcgccgctggtcgaagtgccgttggtggatggggcggacggtttgcatgccgatgtgccggcgatcgtgcaggccgcgctggacgccaaggccaagctggtgttcctgtgctcgccgtccaatccggccggctcggcgatcccgctggccgagatcgaagctgccttgcaggcgctgcagggcaaggcgctggtggtggtggatgaagcctatggcgagttctccgatgtgccctcggccattggcctgcttgcgcgctacgacaatctggcggtgttgcgcaccttgtccaaggcgcacgcgctggcggctgcgcgcatcggcagcctgatcgccaacgctgagttgatcgcgctgttgcgccgttgccaggcgccgtatccggtgcccacgccatgcgcggtgatggccgagcaggccttgtctgcacctgcgctggcagtgacgcagcggcgggtgaccgagatccgtgccgagcgcgcacgcctgcatgccgcgctggtgcaggtggccggcgtgcgccaggtctacccctcgcagggcaatttcctgctggtgcgtttcgacgacgccgaagcagcgttccaggcgctgctcgaagcgggtgtggtggtgcgtgatcaacgcgcggtgccgcgtctgtccgatgcactgcgcatcaccatcggcacgcccgaccagaacgaccgtgtgttgggcgcgttgcagcgcaagcag

SEQ ID NO: 39372 - DNA, 1272 bp, Xanthomonas campestris
cttgattggacccaactcactgcagacgcacgcacccaggcgttgacgcgcccggtgcagaccgtcgccacgcagacacgcgaggcggtcgccaccctgatcgccgatgtgcgtgcacgtggcgatgtggcgctgcgcgagatcaccgcacgcttcgacggcgtcacgctggagagctttgcggtcagcgatgccgaatttgccgcggcagatgccgccatcgcgccggaactgcgccaggcgatgcaggacgccgtggcgcgcatcgacacctttcaccgcgccggcatgagcgaaggctatgcggtggaaaccgcacctggcgtggtctgcgaaaagatcgtgcgcccgatcggccgcgtgggcctatacgtgccggccggcagcgcgccgttgccgtccaccgccttgatgctgggcgtgccggcgcggctggctggctgccgcgaagtggtgctgtgcacgccgccgcgcaaggatggcagtgtcgacccggcggtgctggtggccgcgcaactcaccggcgtgcgccgagtattcaagctcggtggcgcgcaggcgattgcggcaatggcctatggcaccgactccattcccagctgcgacaaattgttcggcccgggcaacagcttcgttaccgaagccaagcagcaggtggcgcaatccggcgcggccgcgatcgacatgccggccggcccgtccgaggtgctggtgattgccgatgccggcgcgcaaccggcatttgtcgcggccgatctgttgtcgcaggccgaacatggcccggattcgcaagtactgctgttgtccgacagcgatgcattgattaccgcagtgcaggagcaactggacctgcaactggcgcaactctcgcgcgccgacatcgcgcgccaggcgttggcgcagtcgcggttgatcaaggtggcgacgctgcaggacgcgttcgagatcagcaaccgctatgcaccggagcacctgatcctggccttgcgcgagccgcgtgcgtggttggcgcaggtggaggccgccggctcggtatttctcggcgactacacgcccgaagcactgggcgattactgcagcggcaccaaccacgtgttgccgaccagcggtgcggcgcgtgcctatagcggcgtgagcgtggccagcttccagaacatggtgagcgtgcaggcggcgagcaaggccggtatcgatggaatcggcgcatgcgcagtgattctggcgcgcgccgagggcctggatgcgcacgccaacgcggtggcgctgcgcatg

SEQ ID NO: 39373 - DNA, 876 bp, Xanthomonas campestris
cggttgcgcattgccatccagaaaaacggccgcctggccgagccggcgcgcagcctgctggccgcttgcgggctgagctggcggcagagccgcgacaaattgttctgctacggcgaatcgctgccggtggacctgctgctggtgcgcgacgacgacatcccgggcctgatcgccgatggcgtctgcgacctgggcatcgtcggccagaacgagttggacgagcaggcatcggcgcgtcgtcgcgctggcctgccggccgcgtatcacgccgtgcgcggggtcggtttcggccagtgccggctgatgctggcggtaccggaagagtgggactggcagggcgtggcgcagttggcgggcaagcgcatcgccaccagctacccggcgatcctggccgactggctggagcgccagggcatcgacgcatcggtggtcgagctctccggctcggtggaaatcgcgccgcgcctgggcaccgccgatctgatctgcgacctggtctccagcggcgcgacgctagccgccaaccaactcaagccggtcgagctggtgatggaaagcgaggcggtgctggccggtgccgtgcgcgagccagccgatgcgcgcgcggcgctgctggcgatgctgctgcggcgcatggatggcgtgctcaagctgcgcgacagcaagctgctgatgttccgcgccgagcaaggcaacgtggatgcgctgcgccgcttgctgcccgatgccgacccgctggtgcagttgcccgacgacggcaatggcgccttgcgcctgcagaccatgtgccacggcgcggtgacctggcaacgcctggaagaattggaacgcgcaggtgcgcaaggcttgatggtattgacggtggagcgctcgctc

SEQ ID NO: 39374 - DNA, 1332 bp, Xanthomonas campestris
cggcaacgcgatcttgcggtggtgtggcacccctgcacccagatgcgcgagcacccgcacacactacccctggtgccgatcgcacgtggcgacggcgcctggctgatcggccacgatggccgccactatctggatgcggtcagcagctggtggaccaacctgtttggacacgccgaaccgcgcatcggcgcggccatcgcgcagcaggccggcaggttggaacaggtgatgctggccggcttcacgcatgcgcccgccgtgcaactggccgagcggctgttggccatcgcgccgcgccagcccgaccgcgcgccactggccaaggtgttctacgccgacaatggctcggccggggtggaagtcgccttgaagatggccttccactatttccacaaccgtgacgagcaccgccgcacgcgtttcatcgcgctggagaacggttaccacggcgagaccatcggtgcgctgtcggtgggcgacattccgctgtaccgccgcgtgtacgcgccgctgttgctggaatcgatcttcgcgccttcgcccgatgcgtacctggccgagccgggacagagcgccgaggactacgcgttgcaggcggccgatgcactgcagcatctgctggagcaatccccgggcgaaatctgcgccttgatcctggagccgcgggtgcagtgcgccggcggcatgcgcatgtatcacccggcctacctgcgccgcgcgcgcgaactgtgcgatgcgcatggcgtgttcctgatcgccgacgagatcgccaccggctttggccgcaccggcaccttgttcgcctgcgaacaggccggcgtgatgccggatctgttgtgcctgtcgaaaggactcaccggtggcttcctgcccctgtcggcggtactggccacgcagcagctgtatgacgcgtttctggatgactcgcgcgagcgcgccttcctgcattcgcacagctacaccggcaacccgctggcgtgtgcggcggcgctggcgacgctgcagatcttcgccgacgacgacatcattgcgcgtaaccaacgtaccgctgcacacatgacccagctcgctgcgcagatcggcgagcacagcgcggtggccgacgtgcgccaggccggcatgatcgtggccttcgagctcacccagggcggcgacaagcgcacgcccttccccgccgccgcgcgcgtgggcctgcaggcctaccgcgctgcattggcacgtggcgtggtgctgcgcccgttgggcgacgtgctgtactggatgccgccgtattgcgtggacgacgcacagcttgcgctgcttgccgacaccacccgccacgccatcgccaag

SEQ ID NO: 39375 - DNA, 561 bp, Xanthomonas campestris
tcgggcaactgctacaaggtgcgtctgctgctggagcagctcggcagccgctaccactgggtcgaggtcgatagcgtttccggcgagacccgcacgcccgagtacctggccaagaatcccaacggcaaggtgccgatggtggaacgcgacgacggccgcgtgctgaccgaatccaacgccatcctgttctggctggccgaaggcacgccgtacctgcccaccgatacctggcaacgcgcgcaggcgctgagctggatgttcttcgaacagtacagccatgagccctatgtggcggtagcgcgcttcatcagcctgtggacgccgcgcgatgccgcacgccgtgccgagctgccgcagctgcgcgcgcgcggcgagcaggcgctgacggtgatggaacagcacctgcgccagcacgcctggttcaccggcgccgactacggcatcgccgacatcgcgttgttcgcctatacccattgcgccgaagacggcggcttcgatctggagcgctggccggcgattgacggctggttgcagcgcgtgcgcgcgctgccgggcttcgtg

SEQ ID NO: 39376 - DNA, 936 bp, Xanthomonas campestris
aatctgctggtgttctccggcaatgccaataaaccgcttgcccaaagcatctgcaaggagctgggcgtgcgcatgggcaaggcgctggtcacgcgcttctccgatggcgaagtgcaggtcgagatcgaagagagcgtgcgccggcaggaagtgttcgtcatccagccgacctgcgcgcccagcgccgagaacctgatggaactgctggtgctgatcgacgcgctcaagcgcgccagcgccgcgtccgtcaccgcagtgatcccgtatttcgggtattcgcgccaggatcgccgcatgcgctcctcgcgcgtgccgatcaccgccaaggtcgccgccaagatgatctgcgctatggaggccgaccgggtgttgacggtcgacctgcatgccgaccagatccagggcttcttcgatgtgccggtcgacaacgtgtacgcctcgccgctgttgctggccgacatctggcgcgcctacggcaccgacaacctgattgtggtctcgccggacgtgggcggtgtggtgcgcgcgcgcgcagtcgcaaagcgcctggacgatgcggacctggccatcatcgacaagcgtcgcccgcgcgccaacgtcgccacggtgatgaacatcatcggtgacgtgcagggcaagacctgcgtgctggtggacgacctggtcgataccgccggcaccctgtgcgcggctgctgctgcactcaagcagcgtggtgcgctcaaggtcgtggcctacatcacccacccggtgctgtccggcccggcggtggacaatatcaacaattcgcagctcgacgagctggtggtcactgacacgatcccgctgagcgcggcggcacgcacgtgccccaagattcgccagctgagcgtggccgaactgctggccgagaccatccgccgcatcgcctttggcgagtcggtcagctcgctctac

SEQ ID NO: 39377 - DNA, 828 bp, Xanthomonas campestris
tcggcctggcctgcgccggccaagctcaacttgttcctgcaaatcgtcgggcgccgcgccgatggctatcacctgctgcagaccgtgttccgcctgctcgactggggggacaccgttcatgttcgtttgcgcaccgacggccagatccagcgcattggcgccagcctgccgggcgtcgccgaagacgacgatctcatggtgcgtgcggcgcgcgcgctacaaattcatgccggcaccgcgctcggggctgagttgcgggtcgacaagcgcatccccgccggcggtggcttcggtggcggctcctcggatgccgccaccgtgctggtggccctgaatgccttgtggggcctgggcttgccggtcgacaccctggccgaactgggcctgcgcctcggcgccgatgtgccggtattcgtgcgtgggcacaacgcctgggccgaaggtgtgggcgaaaaattgaccccgatcagcctgccgcaggcggcctacgtgctggtcgaccccggtattcacgtgcccacgccggtcctgtttcaatcacaggaattgacgcgggatgctgcgcccgcgaaaatagcggacttcgcttccggttctctgctcgacaatgcgttcgagccggtcctgcggcgccgggaacctgccatcgaggccgtgttccaggcgctttccaggatcggaacgccacgtttgacagggtcggggagcggttgtttcgtcgaattcgccacgcgcgctgctgcagagcaggccatggcgcatttgccgggcaacctgcgggcgtgggtcgtggagggtgcagcgcactcgccattgctcgacgcactg

SEQ ID NO: 39378 - DNA, 1277 bp, Xanthomonas campestris
atgacgttgtgggtgctcggactgaatcaccagaccgcacccgtggacctgcgcgaacgcgcggcgttcgcgggtgacgcgttaccgcgcgcgctcgattcgttgcgcatcctgccgcaggtgcgcgaggccgcgctgctgtccacctgcaaccgcaccgagctgtatgcgatggccgacgacccgcagacgctggtggcctggctggacatgcacgcgcccgggctgagcggttatctgtaccagcaccgcgatgccgaggcggtgcgccacctgttccgcgtggccaccgggctggactccatggtgctcggcgagccgcagatcctgggccaggtgaaggacgcctgggcggtggcacgcgcgcacggcgcgctgggcagtggcctggaccggctgttccagcagaccttttcggtggccaagcgcgcacgcaccgacacccgcgtgggcgccaacccggtgtcggtggcatccaccgcggtgcggctggcgcaggaatcgttcgcacgcctgaatgaatcgacggtgctgctggtgggcgccggcgagaccatcgaactggcggccaagcatctgagcgaaggccgcgtgcggcggctgttgatcgccaatcgcaccctggcccacgcacagacgctggcgacccagcatggcggcgtggcgctgccgctaaccgagctggatcgccacctggccgaggccgatgtggtgttttccgccaccgccgcgcgcgagccggtggtgacccgggtgcaggtggaacaggcgctgcgcacgcgcaagcgcaagccgatgctgctgttcgacctggcggtgccgcgcgatatcgaggcctcggtggccgagctgagcgacgcctacctgtacacggtggacgacctggaacgcgcggtggaagacaaccgccgcagccgccgcgaggcggccgaccaggccgaagccatcatcgacctgcaggtggcgcgctatgtggaaacgctgcaggccaatgagcgccaggcgccactgaaacggctgcgtgccttcggcgacagcacccgcgacgaactgctggccaaggcgcggcagcaattgagcaacggcaagccggccgatgaagtgctggaacagttggcgcatgcgctgaccaaccgcctgctgcatccgccaaccgccgcactgcgcgatgccgcgctcaacaacgacctcgacctgaccagcgcggccgaccggctattccccgagaaacccggttaccgccatccccctgtagctaccccgatcgtgaggactga

SEQ ID NO: 39379 - DNA, 1008 bp, Xanthomonas campestris
tcgatgtcactgaagcacttcttgaacacccaggactggagccgcgccgaactggatgcgctgttgacccaggccgcgttgttcaaacgcaacaagctgggaagcgagctgaagggcaagtcgatcgcgctggtgttcttcaacccgtccatgcggacccgcaccagcttcgagctgggcgcgttccagctggctgggcatgcggtggtgctgcagccgggcaaggatgcgtggccgatcgaattcaacctgggcacggtgatggacggcgataccgaggagcacatcgccgaggtggcgcgcgtgctgggccggtatgtcgacctgatcggcgtgcgtgcgttcccgaagttcgtcgactggtccaaggaccgcgaagaccaggtgctcaagagctttgccaagtattcgccggtgccggtgatcaacatggagaccatcacccacccatgtcaggagctggcgcacgcgctggcgctgcaggagcattttggcacccaggacctgcgcggcaagaagtacgtgttgacctggacctaccatcccaagccgttgaacaccgcggtagccaattcggcactgaccatcgccacgcgcatgggcatggacgtgaccctgctgtgcccgaccccggactacatcctggacgagcgttacatggactgggcggcgcagaacgttgcagagagcggtggctcgctgcaggtcagccacgacatcgacagtgcctatgccggcgccgacgtggtgtacgccaagagctggggcgcattgccgttcttcggcaactgggagccggaaaagccgatccgcgaccagtatcagcatttcatcgtcgacgaacgcaagatggcactgaccaacaacggcgtgttttcgcactgcctgccgctgcgtcgcaacgtcaaagccaccgatgcggtgatggatttgcccaattgcatcgccatcgacgaggccgaaaaccgcctgcatgtgcagaaggcgatcatggcagcgctggtgggt

SEQ ID NO: 39380 - DNA, 1158 bp, Xanthomonas campestris
gtcctcgctttctccggtggcctcgacaccagcttttgcattccgtacctgcaggagcgcggctatgccgtgcacaccgtgttcgccgataccggcggtgtggatgccgaagaacgcgatttcatcgagaagcgcgccgccgagctgggcgcagccagccatgtcaccgtcgatggcggcccggcgatctgggaaggcttcgtcaagccgttcgtgtgggccggcgagggctaccagggccagtacccgttgctggtgtccgaccgttacctgatcgtcgatgctgcgctcaagcgcgccgaagaactgggcacgcggatcatcgcgcacggctgcaccggcatgggcaacgatcaggtgcgtttcgacctggcggtaaaggcgctgggcgactaccagattgtggcgccgattcgcgagatccagaaagaacacacccagacccgcgcctacgagcaaaagtacctggaagagcgcggcttcggcgtgcgtgccaagcagaaggcctacaccatcaacgagaacctgttgggcgtgaccatgtccggcggcgagatcgatcgctgggaagcaccgggcgaaggcgcacgcggctggtgtgcaccgcgtagcgcgtggccgaccgaagcgttgacggtgacgctgaagtttgtcgaaggcgaggccgtggcgctggacggcaaggccctgccaggtgcgcagatcctggccaagctcaacaccttgttcgcgcagtacggcgtgggccgtggcgtgtacaccggcgacaccgtgatcggcctgaagggccgcatcgtgttcgaagcgccgggcctgatctcgctgctcaccgcgcaccgtgcgctggaagacgcggtgctgaccaaacagcagaaccgcttcaagccggacgtggcgcgcaagtgggtggagctggtgtacgagggcttctatcacgacccgctcaagaccgacatcgaggcgttcctgaagtcgtcgcagtccaaggtcaatggcgaagtgacgctggaaacccgcggcggccgcgtcgatgcggtggcggtgcgttcgccgcacctgctcaacgccaagggcgcgacctacgcccagtcggccgactggggcgtggaagaggccgaggggttcatcaagctgttcggcatgagctctacgctgtac

SEQ ID NO: 39381 - DNA, 2893 bp, Xanthomonas campestris
gcacagccccacaaacagacccgccagaccatcgtgcgcctgctttcgagcatggccagcgcgaaagagatcagccagtacctgaagcgtttctcgcagctggacgccaagcgctttgcggtggtcaaggtgggcggcgcggtgttgcgcgacgacctggaggcgctgacctcgtcgttgtcgttcctgcaggaagtagggctcaccccgatcgtgctgcacggcgcgggcccgcagctggatgccgagctatcggccgccggcatcgaaaagcagaccgtcaacggcctgcgcgtgacctcgccgcatgcccttgcgatcgtgcgcaaggtgtttcaggcctccaacctcaagctggtggaagcgctgcagcagaacggcgcgcgtgcgacttcgatcaccggcggcgtttttgaagccgaatatctggatcgcgacacctacggcctggtcggcgaggtcaaggcagtgaatctggcgccgatcgaggccagcctgcaggccggttcgatcccggtgatcaccagcctgggcgagaccccgagcgggcagatcctcaacgtcaacgccgattttgccgccaacgaattggtgcaggaactgcagccgtacaagatcatcttcctcaccggcaccggcggtctgctggatgccgaaggcaagctgatcgactcgatcaacctgtccaccgaatacgaccatctgatgcagcagccgtggatcaacggcggcatgcgggtgaagatcgaacagatcaaggatctgctcgatcggctgccgctggagtcgtcggtgtcgatcacccggccggcggatctggccaaggaactgttcacccacaagggttccggcacgttggtgcggcgtggcgagcgcgtactgcgcgcgacctcgtgggacgaactggatctgccgcggctcacctcgctgatcgaatccagcttcggccgtacgctggtgcccgattacttcagcaacaccaagttgctgcgtgcctatgtcagcgagaactatcgcgcgggggagagcctcaccgatgagggcatgctgggtgcaagcgcgctgatctatctggacaagtgtgccgtgctcgacgatgcgcatggcgagggcctgagccgtgcgctctgtaacgtgatgcgcgaagaaaccccgcagctgttctggcgctcgcgtgacaacaaccaggtcaacatcttctactacgccgaatccgacggctgcatcaagcaggaaaagtggaaggtgttctggtacgggctggacaacttcgagcagatccagcactgcgtggcgcattgcgcgacgcgtcaacccaccttgctggggtgagtgcaatgacggccgccgcatcgcaaacgctctggcgcgaggtgcccaccttgcgcggccagcacgtcacgctggagccattgcgcgctgcccacgccgatggcttgcgtgcggcagtggccgatggcgcgttgtcgcgcctgtggtacaccagcgtgcccagtgctgcgcaagtcgatgactacatcgccgccgcgttggcagcgcaggcggacggcactgcgctgccgttcgtggtgcgcgatgcggcgggcgagatcgccggcagcacgcgctactacgcactggatgcgtcggtgccgaagctgtcgatcggctacacctggtacgcgccgcgggtgcagcgcaccggcctcaataccgaggcaaaacgtctgctgcttgggcatgcctttgaaacgctcggctgcctgagcgtggtgttcgagaccagctggttcaatcacacctcgcgcgcggccatcgcgcggctgggtgcaaagcaggacggggtgctgcgcaatcacacgcgccacgccgacggcacgccacgcgacaccgtggtgttttccatcatcaatgcggaatgggccggggtgaaacgccacctgcagttccgcctggacgcacacgcatgactgttcaaccaaccaccatcggcattgtgggcgcacgcggccataccggcgcggagctgatcaagctgattgccgcacacccgcagttgcagctggtgttcgtgtcctcgcgcgagctcgccggccagcgcgtggccgagcacagcgatggctatcagggcgagctgcgctatgaaagcctggacgccgacgcggtggctgccaaggccgcggatgtggtgatcctggcattgcccaacggcaaggccgagcccttcgttgcggccatcgatgccagccggccgcagacgctgctgatcgacctgtcggccgactaccgcttcgatccggcctggtattacggcttgccggagcttacccgccacacctacgccgggcagcgccgcatcagcaatcccggctgctatgccacggccatgcagctggcgatcacgccgctgcgcgagcaactggcagggccgccgcagtgctttggcgtctccggctattccggtgcgggcaccacgccttcagacaagaacaatcccgcgttgctggccgacaacctgatgccgtacgcgctgaccaaccacatgcacgagcgcgaagtctccgcgcagctcggcgtgccggtggaattcatgccgcatgtggcgccgcatttccgcggcatcaccatgaccgtgaacctgtggctgcagcagccgttgacgcgcgagcagatccacgcacgctacctggagcggtatgcgcatgagcccttgatcgagatcgtggacgaggcgccgtgggtgagccgtatcgccggcacccagggcgtgcagatcggtgggttcaccatggcgccgggcaacaagcgcgtggtggtggtggcaacgctggacaacctgctcaagggtgcggccacgcaggccatgcagaacctcaacctggcgctgggctgggacgaattgaccgcaattggc

SEQ ID NO: 39382 - DNA, 1104 bp, Xanthomonas campestris
gatgacgtcatcctggaccgcgagttcttcctgtatgacatcgcggccagcaaggcgcatgcgcaggggctgcagcacatcggcatcctgtcgctggaggaactgggcgggctgagcgagcagctggatctgctagccgacgacttccgtagcggcgcgttcgtgctcgatgcgcattacgaggattgccattcggccatcgaagcgcggctgaccgaacgcctgggcgatgccggccgcaagatccacaccgggcgcagccgcaacgaccagatcctggtggccacgcggctatggttgaaggacaagctgcagcgcgtggccgcgctcagcaccgaggtggccaaggtggcgctggaccgcgcacaggccgaagccgagctaccggtgcccggctacacgcacatccagcgagcggtggtgtcctcggccggcatgtggtgggcggggtgggccgaggccttcatcgacaacgccgtgcgcgccaacgacaccttcaagctggtcgacaccaacccgctgggcaccgcggccggttacggcgtcaatctgccgctggaccgagcgcacaccaccgccgaacttggcttcgcgcgcctgcaggtctcgcccatctacgcacagctctcgcgtggcaagttcgagctggctgcactggaagcgctgggtggcgcaacgctggacctgcgccggattgcctgggatctgtcgttgttcaccagcggcgagttcgcctttgtcgcgctgccggcgcagtacaccaccggcagttcgatcatgccgaacaagcgcaaccccgatgtcatcgaactgatgcgcgccacccacgccagcgtggcagcggcgcgcaccgagatcgaacagctgctgtcgctgccgtccggctaccaccgcgatctgcagagcagtaaaggcgcgatcgtgcatggttttgcgcgcggcctggccgcgctggagctgttgccggccttgctggccaacctggaatggcggccggacaagctgcgcgcggcgatcgattcgggcatgtacgccaccgatgtcgcggtggaagccgccgtggccggggtgccgttccgcgacgcctacaaggcggccgccgcc

SEQ ID NO: 39383 - DNA, 1485 bp, Xanthomonas campestris
ccgccgtgcatcatcgtggtgttcggtgcgcgcggtgatctgacccggcgcctggtgatgccggcgctgtacaacctgcgccgcgccggtgcacttggcgaggaattcgccattgtcggcatggaccatggcgatatcaccgagcgtgcctggcgcaccaacatgggcaaggcgatgaccgagctgctgagcagccgcgatgccgagttccaggccgatggattcgataccgatacctgggactggttgcgcgagcgcatgcattacgtgcgcggcgacttcaccgacctgcgtgcctatcaggcgctcgacggcgtgctggaaaaactgcacaagcgctatggcacccgcggcaatgtgctgttctatctggccaccgctgcgcgcttcttcgagccggtgctgctgaatctgggcgaggccgggctggtcaagcagcacgagggcgccggctggcgccgggtgatcgtggaaaagccgttcggccacgacctgcccagtgccaagcatctcaatgccaccgttgcgcgcgtgctgcacgaagaccaggtgttccgcatcgaccatttcctgggcaaggaaaccgtgcagaacatcctggcgttccgcttcgccaatggcctgttcgagccggtgtggaaccgcgaccgcatcgaccacgtgcagatcaccgccgccgaaaccatcggcgtggaagggcgcgggcgtttctacgatcccaccggctgcctgcgcgacatggtgcccaaccatctgttccagctgctggcgatgattgcgatggagccgccggccgcgttcaccaccgaggcgatgcatcgccgccgcgccgaagtgatcgaagcggtgcgcccgatcaaacccgaagacgtggtgcgtgggcagtacgcgtccggtgcggtcaatcgcagcgccgtgccgggataccgcgaggaagacacggtaccggacgagtcggaaaccgaaaccttcgtggcgatgaagttgcaggtcgacacctggcgctgggccggcgtgccgttctatctgcgcaccggcaagcgcctgcgcgaacgcaccaccgagattgcgatccgcttcaagcccgcaccgctggcgccatttcgtagcaccgaagtgggcggctacggccccgactggctggtgctgcatatccagcccgacgaaggcatctcgctgcagttcgacgtcaagcgcccgggcgcgcaagtggcgttggcgccggtgcggatggacttccgctaccgcgactggttcccgaaggaatacaccgttggctacgagcgcttgctgcaggactgcatgaatggcgaggccggtctgttccaggatgcagcgatggtggaaggcgcgtggcgcatcgtgcagccgatcctggatgcgtggaaacaaccgcccagtgactttcccaattacgcggctggcagtgccggcccgtcggcggccgatgcgttgctggcgatgaacggcgggcacgcctggcgt

SEQ ID NO: 39384 - DNA, 1653 bp, Xanthomonas campestris
atggcgatccggcaattgcccgagatcctgatcaaccagatcgctgccggcgaggtggtcgagcgcccggcatcggtcgtcaaggaactggtcgaaaacgccctcgatgccggcgccacccgcgtggatatcgatctggaagagggcggcgtgcggctgatccgcatccgcgacaatggcggcggcattgcgccggaagagctgccgctggcggtgtcgcgtcatgccaccagcaagatcgcctcgctggatgatctggaaaccgtcgccacgctgggcttccgcggcgaagcgttgccgtccatcgcctcggtcagccgctttacgctggcctcgcgtcgcccggatgccgagcacggctccgcgctgcagatcgaaggcgggcgcctgggcgaggtgatgccgcgtgcgcatgcgccgggcaccaccgttgaggtgcgcgagctgttcttcaacgtgccggcacggcgcaagttcctgcgcgccgagcgcaccgagttgggccatatcgaagagtggctgcgttcgctggcactggcgcgcccggacgtggaattgcgcgtctcgcataacggcaaaccgtcgcggcgctacaagccgggcgatctgtattcggacgcgcggctgggcgagaccttgggcgaggatttcgcgcgccaggcgctgcgcgtggaccacagcggtgccggcctgcgcctgcacggctgggtggcgcagccgcattactcgcgcgccagtaccgatcagcagtatctctacgtcaacggccgctcggtgcgggatcgcagcgtggcccatgcggtgaagatggcctacggcgatgtgctgttccacgggcgccagccggcgtatgtgctgtttctcgagctggaccctgcgcgcgtcgacgtcaacgtgcatccggccaaacacgaggtgcgcttccgcgaggcgcggctgatccacgacttcgtctatcgcactctgcaggacgcactagcgcaaactcgcgccggcgcgttgcccgctgatgttggcctcggcgggtcggcagccctcggtatcggcgccggtgcggcgcagggcgacggaagctacgttgctgacgccggtgcagggcatccgggcgctggcagtggctccggctatgcaagctgggcgccgtcgcaggcaccgctgggtttgcgcgtagacgaggcgcgcgccgcctacgccgcgttgtatgcccctgcggccggcagcgcgttgcgcgacgacgggcaaccggtgctgtccggcaccggcttgccggcgaccgcgcacgacagcggagtcccgccattgggctacgcggtggcgcagttgcacggcatctatatcctcgcggaaaacgccgaaggcctgatcgtggtcgacatgcatgccgcgcatgagcgtatcggctacgaacgcctcaagcaggcgcacgacagcattggcctgcatgcgcagccgctgctggtaccgatgacgctggcagtgggcgagcgcgaggccgacaccgccgagcgcgaggccgatacgcttgccagcctgggcttcgaaatcacccgcagcggtccgcaatcgctgcacgtgcgcagcattccggcgctgctcgccaatgccgacccggaggcgttgttacgcgatgtgctcggcgatctgcgtgagcac

SEQ ID NO: 39385 - DNA, 1333 bp, Xanthomonas campestris; identical to SEQ ID NO: 39018

SEQ ID NO: 39386 - DNA, 759 bp, Xanthomonas campestris; identical to SEQ ID NO: 39019

SEQ ID NO: 39387 - DNA, 1335 bp, Xanthomonas campestris; identical to SEQ ID NO: 39020

SEQ ID NO: 39388 - DNA, 1359 bp, Xanthomonas campestris
atcctgttcggcgccaccggcgatctcgcccagcgctatctctttccatccctgctgcgcctgtttgtcgacggcctgttgccggaggacttccgcatccgtgcgttggccctgtcgcagcacgacaccgacgccttccgcgaggtactgcgcccgcgcctggcccaggcgctgccgattgccaccgccgcgcagatcgatgcgctgctgcagcgcatcgactaccgctcggcggacctgcgcaatgccgaatcggtggccgaggccgtgcgcgaactggccagccgccagtgcgtaagctatctggcgattccaccgggcctgtacatcagtacctgccagggcctggccctgggcggcgcgctggctgcaccgcaccggttgatgctggaaaaaccgatcggccacgattcggacagcgcccgcgagatcctgcagtcgatcggcgcactgatcgacgaagaccgcgtgttccgtctcgaccactacctgggcaaggccgcggtgcagaacctggtggcgctgcgcttcggcaacaccttgctggaagcggtgtggaaccggacctacatcgaatcggtacagatcctggtggccgagagcgaaggcgtggacggccgcgatgcctactacgcccgctccggcgcgctgcgcgacatggtgcagagccatatcctgcagttgctgtgcctggtggccatggagccgccggcctcgctggaagccgaccgcatccgcgacgagaaggtcaaggtgctgcgcgccttgcgcccgatgaccgccgagcacgccgcgcaagacagcgtgcgtggccgctacaccgccggcagcatcaacggcgagccggcgcaggcctaccacccgccggaaggcagcgatgtggaaaccttcgtcgcggtcaccgcgcacatcgacaactggcgctgggctggcgtgccgttccacctgtgcaccggcaagcgcctggctgagcgctccacgcgcatcgtggtcacgctcaagccggtgacgcattggttgttcgagcgtccggaccgccagaacgcggtgcccaaccgcctgaccttccagctgcagccgctggaaaacatcgagctgggcctgatgagcagcctggccggcccggaatggggtgcgatcgaactgcagccgctggaactggagctgtccgtgcccaccggcctgcaccgccgtatcgcgtatgaacgcttgttcgtggatgccttcaacggcaacccggcgctgttcgtgcgcgatgacgaggtcaaggccgcctgggcctggatcgacagcgtcagcgatgcctggtcggacgcacagctgccgctgcagccgtatccggccggtagctggggcccc

SEQ ID NO: 39389 - DNA, 1800 bp, Xanthomonas campestris; identical to SEQ ID NO: 39022

SEQ ID NO: 39390 - DNA, 747 bp, Xanthomonas campestris
aagatcggcaagggcaagcattaccctgcacaaggcgccaagaacaagcgcaccttcaaggtctaccgctgggatccggatggcgacgccaatccgcgcaccgacagctatgaaatcgatctggacaagtgcgggccgatggtcctggacgcgctgatcaagatcaagaacgagatcgacccgaccctgaccttccgccgttcctgccgcgaaggcatctgcggttcgtgcgcgatgaacatcgacggcaccaatacgctggcctgcaccaaggcgattgccgcgtgtggcaaggccgaggtgccgatctatccgctgccgcacatgagagtgatcaaggatctggtgccggacctgacgcatttctatgcgcagtacgcctcgatcaaaccgtggatccgtacccagaccccgccgccgccggaccgcgagcgcctgcagtcgccggaagaccgcaagaagcttgacggcctgtacgagtgcatcctgtgcgcgtgctgctccaccagctgcccgagctactggtggaacggcgaacgctacctgggcccggcgatcctgctgcaggcctaccgctggatcatcgactcgcgcgatgaagacaccggtgcgcgcctggacgatctggaggatccgttcaagctgtatcgctgccacaccatcatgaactgcgcccgcacctgcccgaaggggctgaacccggcgctggcgatcgccgagatcaagaagctgatgatggcgcgccgc

SEQ ID NO: 39391 - DNA, 1291 bp, Xanthomonas campestris
atgaccactatcgccaagattctcgcccgtgaaatcctcgactcccgcggcaatcccacgctggaggcggaagtcacgctggcagacggctcgttcggccgcgccgccgtgccctcgggcgcctcgaccggcaccaaggaagcggtggaactgcgcgacggcgacaagacccgctacctgggcaagggcgtgcgcaaggccgtggaaaacgtcaacggcaccatcgccgagacgctcaaggacttcgatgccgccgaccagcagggtctggaccgtcgcctgatcgacctcgacggcaccgagaacaagggccgcctgggcgccaacgcgttgctgggtgtgtcgctggccgccgcgcatgcggtcgccgcctcgcgcaagcagccgctgtggcagtacctgtccaccatcaccgaatccgatgtcgccctgccggtgccgatgatgaacatcatcaacggcggcgcgcatgccgacaacaatgtcgacttccaggaattcatggtgctgccggtgggctgcagctcgttttccgaagcgctgcgcgcaggcaccgaaatcttccattcgctgaagtccgtgctcaagggccacggcctcagcacggcggtgggtgacgagggcggcttcgccccggacttccgcagcaatgtcgaagcgctggacaccatcctcgaggcgatcggcaaggccggttacaccgctggcgaagacatcctgctgggcctggacgtggcctcgtcggagttcttcgccagcggcaagtacaacctggtgggcgaaaacaagcgcctgaccagcgagcagttcgtcgacttcctggccgactgggtggcgcagtacccgatcatcagcatcgaagacggcctggcccgaagacgactgggccggctggaagctgctgaccgatcgcgtcggcaagaaggtgcagctggtgggcgacgatctgttcgtcaccaacccgaagatattcaaggaaggcatcgacagcggcaccgccaacgcgatcctgatcaaggtcaaccagatcggcacgctgactgagacgctggaagccattgccatggcgcatgcggccaactacgcctcgatcgtgtcgcaccgttcgggcgagaccgaagacaccaccatcgccgatatcgccgtggccaccaccgccacccagatcaagactggctcgctgtgccgcagcgaccgcgtcgccaagtacaaccagttgctgcgcatcgagcaggcactggggtccggcgcgcgttacgccggccgcgacgcgttcgtttcgctcaagcga

SEQ ID NO: 39392 - DNA, 1265 bp, Xanthomonas campestris
atcctgacgcggggcgagggggtgtatgtgtgggatgcggatggcaacaagttgctggatgcgtttgccgggctgtggtgcgtcaacgtgggctatgggcgggccgagcttgcgcaggcggcggcgcggcagatggagcagttggcgtactacaacagcttctttcaatgcaccaccgagcccaccgtgcacctggctgccaagttggcggagctggcgccgggcgatttgaatcatgcgttctttgccaattccggctcggaggccaacgacaccatcctgcggctggtgcggcatttctgggcggtgcaggggcagccgcagaagcacatcttcatcggccgccacgatggctaccacggcaccaccatgggcggggccagtctgggcgggatgcgcgggatgcatcggcaaggcgggttgcccaattccggggatcgagcacatcgccgccacccaatcattttggcgagggtggcgagtatggacccggacgacatacggtctgctcgctgcgcgccgtctggaagagaagatcctgcagttggggcccgacaccgtggcggcctttatcggtgagccgatcatgggcgcgatcggggtctacatatccaccgcgcagctactggccggaaatcgaacgcatctgtcggcgctacgacgtactgctggtggccgacgaggtgatctgcgggttcggccgcaccggtgcctggttcggcgcggagtatttcggtttccagcccgatgtgatgaccctggccaagggcatcacatccggctacatcccgctggctgcggcgatgttcaacgaccgcgtggccggtgtgctcaagcgtcagggcggtgaactggcgcacggcggtacctatgccgggcatccggtctgcgctgcggtggcgctggaaaacctgcggctactgcaggacgagggcatcgtggacaccgcacgcacgcagattgcgccgtacctggcgcagcgctgggccgaactgggcgcgcaccgtctggtgggcgaggcgcgcatcgccgggctggtcggtgcgctggagctggtgcccgacaagcgccgccgtggtgtgtacttcccggagcgcgggcgcgtaggcgcgctgtgccgcgactttgccctgcggcgcgggctgatcctgcgggccacttacgacgccatgctgctgtcgccgccgttgatcatcacctgggaacaggtcgatgagctgttcgacaaaacctgggccgcgctggacgacaccgcgcaggcgctg

SEQ ID NO: 39393 - DNA, 2035 bp, Xanthomonas campestris; identical to SEQ ID NO: 39026

SEQ ID NO: 39394 - DNA, 678 bp, Xanthomonas campestris
tactacctgccggtgtaccgcccgcgtcaggtggtgctggagcgtggccagggcagtcgcgtgtgggacgaccagggccgcgaatatctggatctgtcctccggcatcgcggtcagcgggctggggcacaacgatccggacctgatggccgcgctcaccgagcaggccggcaagctgtggcacaccagcaacgtgttcttcagcgcgcccccgctgaagctggccgaagagctggtcaccgcctcgcgctttgcgcagaaggtgttcctgtgcaactccggcaccgaggccaacgaggcggcgatcaagctggtgcgcaagtgggccagcagccagggccggccggccgacaagcgggtgatcgtcaccttccgcggcagtttccacggccgcacgctggcctcggtcaccgccaccgcacagcccaaataccaggaaggctacgagccgttgccgggcggattccgctacgtggatttcaacgatgtgccggcgctggaaagcgcgatggccagcggcgatgtggcggcggtgatgctggagccgatccagggcgagggcggggtgatgccggccgcaccgggctttttggcgcgcgtgcgcgcgctgtgcgaccagcacgacgcactgctggtgctggacgagatccagtgcggcatgggccgcaccgacagcctg

SEQ ID NO: 39395 - DNA, 2138 bp, Xanthomonas campestris
ccctcgcccatgacctaccgtgacgcgggcgtcgacatcgatgccggcaatgcgttggtcgaacgcatcaaacccctggtcaagcgcagctttcgaccggaggtgatgggcggcctgggcggcttcggtgccttgttcgacctgtccggcaagtacaaggagccggtgctggtctccggcaccgacggggtgggcaccaagctcaaactcgcccagcaactcggccgccacgacaccatcggcatcgacctggtcggcatgtgcgtcaacgacgtgctggtgcaaggcgccgaaccactgttctttctggactacttcgccaccggcaagctggatatcgacaccgccgcggcggtggtcggcggcatcgcgcgtggctgcgagctctccggctgcgcgctgatcggtggcgaaaccgcggagatgcccgacatgtacccgccgggcgaatacgacctggccggcttcaccgttggcgcggtggaaaaatcgcagctgctggacggcgcgcaggtgcgcgagggtgacgtgctgatcggcatcgcgtcctccggtccgcattccaatgggtattcgctgatccgcaagatctacgagcgtgccggggcgccggccgatctggtgctggacgacggcgtggcgctgatcgatgcgctgatggcgccgaccgcgctgtacgtcaagccgatcctggcgctgctcaagtcgcacggcgaggcgatccacgccatggcgcatgtcaccggtggcgggctgaccgagaacatcatccgggtgatcccggacggcctgggcctggacatcgatgccacggcatggatcttgccgccggtgttcgcctggctgcagcgcgaaggcgcggtggccgatgccgaaatgtggcgcaccttcaattgcggcatcggcttcgtgctggtcgccgcaccagcgcaggccgccgcgctggaacaggcgctggacgcgcagtcgctggcgcattggcgcattggccaggtggtgacggcacagggcgacgaacgcgtccggattggttgacccaaggagcacccgcatggaagccgcgcccgtttacgtctctacaactgccaccgccgaggatctgcagcagctgaagttgctgtcgatcttccattacgtgctggccggcatcaccgggctgttttcgttattcccgttgatccacctgttcatggggctggcgatcgtcaccggccacctgccgatgaccacgaccaatgccgacgcgccagagatggatccccgctggttcggctggttcttcgtggtgttcgcggcaggcttcatcgcctgcggcctgacattggccggcttcatggcgtatgcgggtcgctgcatcgcccagcgcagacggcatctgctttgcctgatcgtcgccggcatttcctgctcgttcatgccgttcggcaccgtggtcggcgtgtttacgctggtggttctgctgcggccgcaggtcaaggcgttgtttgtcaccaacgcggcagccgcttgagctgcgtctccgatataacgatgggcgtgattgtatgagcctgcgccttgcagtcctggcctccgggcgcggcagtaatctgcaggccatcctcgatgcgattgccgccgggcagttggcggccgaggtggccggtgtgttttccgaccgggaacaggcgccggccttgcagaaagtggatgcgtcgcgacgctggagcgccagcccacgcgcgttcgccgaccgcgcggcgttcgacagtgcattgggcgacgccatcgccgcagtgcagccggattgggtgatctgcgccggctacatgcgcatcctgggcgagcctctggtgcgccgcttcaccggccgcatgctcaacatccatccctcgctgctgcccaaataccgcggcttgcacacgcatgcgcgggcgctggaggccggcgatgccgagcacggtgccagcgtgcatctggtggtgccggaactggatgccggcccggtgatcgcccaggcccatgtgccggtgttgccggacgacaccgccgagtcactggcggcgcgggtgctggaccgcgaacacccgctgctgctggccacgctgcggttactggccagcggccgggtcaccacgcccgacgggcgcgtgcatatc

SEQ ID NO: 39396 - DNA, 2355 bp, Xanthomonas campestris
atcctgtggttgcatgagctacgcctggtcgatctggcccgcgtaggcggtaaaaattcctcgctcggcgagatgatcggcaacctggccgggttgggtgtttcggttcccggtggatatgcgaccactgccgaagcattcaaggacttcatcgcgcacaacgatctgtccaaacgcattttcgacaagctggagacgctggacgttgaagacgtcaccgcgctcacggtcgccggcaaggagatccgcggctgggtgatcgacgccccgctgcagccggagctggaccgcgacatccgcagcgcctacgaaaaactctgcgccgagaacggcggcggcgaagtggccgtggcagtgcgttcgtcggcaaccgccgaagacctgcccgatgcctcgttcgccggccagcaggaaaccttcctcaatgtgaccggcgccgacgacgtggtgcacaaggtcaaggaagtgttagccagcctctacaacgaccgcgcgattgcctaccgcgtgcaccacggcttcaagcacgaagatgtgttcctgtcggccggtgtgcagttgatggtgcgctccggcgtgggttcgtccggtgtgttgttcaccctggacaccgagtccggcttccgcgacgtggtgttcgtgacctccagctttggcctgggcgaaatggtcgtgcaaggcgcggtcaatccggacgaattctacgtctacaagcccacgctcactgcgggcaagccggcaatcctgcgccgctcgctcggcagcaaggcgatccgcatggtgtattcggatgtgcccggtgaacgcgtgcgcatcgaagacacgccggtggagttgcgcaacactttctcgatcagcgacgaagatgtgcaggagctctccaagcaggcgctggtgatcgaaaagcattacggccgcccgatggatatcgagtgggccaaggacggcgtgagcggcaagctgttcatcgtgcaggcacgcccggaaacggtgaagtcgcgcagccatgccacccagatcgagcgtttctcgctggaagccaaggatgccaagatcctggtcgaaggccgtgcggtgggcgccaagatcggcagcggcgtggcacgtgtagtgcgctcgctggaagacatgaaccgcgtgcaggcgggcgacgtgctgattgccgacatgaccgaccccgattgggagccggtgatgaagcgtgcctcggccatcgtcaccaaccgcggtggccgcacctgccacgcggcgatcatcgcgcgcgaactgggcgtgccggcggtggtgggttcgggcaatgcgaccgacgtgatcagcgacggccaggaagtcaccgtgagctgcgccgagggcgacaccggcttcatctatgaaggcttgctgccgttcgagcgcaccaccaccgacttgggcaacatgccgcctgccccgctcaagatcatgatgaacgtggccaacccggagcgcgcattcgatttcggccagctgcccaacgccggtatcggcttggcgcgtctggagatgatcatcgccgcgcacatcggcatccatcccaacgcactgctggaatacgacaagcaggacgccgacgtccgcaagaagatcgacgccaagattgccggctacggcgacccggtgagcttctacatcaaccgtctggccgagggcatcgcgacactgaccgcgtcggtggcgccgaacacggtgatcgtgcggttgtcggacttcaagtccaacgagtacgccaacctgatcggtggctcgcgttatgagccgcatgaagagaacccgatgatcggcttccgcggcgccagccgttatgtcgatccgtccttcaccaaggcgttctcgctggagtgcaaggcggtgttgaaggtgcgcaacgagatgggcctggacaacctttgggtcatgattccgttcgtacgcacgctggaggaaggccgcaaggtgatcgaggtgctggagcagaacgggctcaagcaaggcgagaatgggctgaagatcatcatgatgtgcgagctgccgtccaacgcgctgctggccgatgagttcctggagatcttcgacggcttctcgattggctccaacgacctgacccagctcaccctgggtctggaccgcgattcctcgatcgtggcgcacctgttcgacgagcggaacccggcggtgaagaagctgctgtcgatggcgatcaagtcggcgcgcgccaagggcaagtacgtgggcatctgcggccaggggccgtcggatcacccggaactggccgagtggttgatgcaggaaggcatcgagtcggtgtcgctgaatcctgacaccgtggtcgatacctggctgcgcctggccaagctcaag

SEQ ID NO: 39397 - DNA, 753 bp, Xanthomonas campestris; identical to SEQ ID NO: 39030

SEQ ID NO: 39398 - DNA, 603 bp, Xanthomonas campestris; identical to SEQ ID NO: 39031

SEQ ID NO: 39399 - DNA, 2562 bp, Xanthomonas campestris; identical to SEQ ID NO: 39032

SEQ ID NO: 39400 - DNA, 1290 bp, Xanthomonas campestris
atgggtcagtcagttgtcgtgctcggtgcccagtggggcgatgaaggcaaaggcaagatcgtcgatctgcttaccgaggagatcggtgccgtcgtgcgtttccagggcggccacaatgccggccacaccttggtcatcaacgggaagaagaccgtcctgcacctgatcccgtccggcatcctgcgcgacgacgcgctgtgcctgatcggcaatggcgtggtgatctccccggccgcgttgatcaaggagatcggcgagctggaatcggccggcgtggaagtgcgttcgcgcctgaagatcagtccggccgcgccgctgatcatgccgtaccacatcgcgctggatcaggcccgcgagaaggctgctggcggcaaggccatcggcaccaccggccgcggcatcggcccggcatatgaagacaaggtggcgcgccgcggtatccgcatcgccgacctgcattacccggcgcagctggaagaactgctgcgcaccgcgctggattaccacaacttcgtgctgaccaagtacctgggcgtggaagcggtggatttccagaagaccttcgacgaagcactggcgttcggcgagtacgtgcagccgatgaagtccgacgtggccggcatcctgcacgacctgcgcaagcagggcaagcgcgtgctgttcgaaggcgcgcagggcgcactgctggacatcgaccacggcacctatccgtacgtcaccagctccaacaccactgtgggcggcgcactggccggcaccggcgtgggcgcggatgcaatcgactacgtgctgggcattgccaaggcctacgcaacgcgcgttggcggcggcccgttcccgaccgagctggatgacgaagtgggccagggcatccgcgaccgtggtgccgagtacggcgcctccaccggccgcccgcgtcgctgcggctggatggatatcgtcgcgctcaagcgtgcggtggccatcaacggcatctccggcctgtgcatcaccaagctcgacgtgctcgacggcatggaaaagctcaaggtctgtatcgcgtacgaataccgcggcaagcgcaccgaatacgccccgctggatgcgcagggctgggaagagtgcacaccggtgtacctggaattcccgggctggaccgagaacacccacggcatcaccgagtgggacaagctgcccgtcgccgcacgcgcctacctgcgcgcgctggaagaactggccggctgcccgatctcgatcgtctccaccggcccggatcgcgaccacaccatggtgctgcaggacccgttcgcc

SEQ ID NO: 39401 - DNA, 867 bp, Xanthomonas campestris
aaggattactacgcgacgctgggcgtcgaaccgagcgctggcgaggcggaaatcaagaccgcctaccgccggcttgcgcgcaaatatcaccccgatgtcagcaaggaggctggcgcggaagacaagttcaaggcgatcaacgaagcctacgaggcactgcgcgacccgcaaaagcgcgccgcctacgaccaactcaaggcgcagggctaccgcccgggcgacgagttccagaccccgcccaacttcaacggcgggcagggcttcgactatgaggaagtgttcggcaacggcggcgccggcggcggcttcagcgatttcttcgaaagcctgtttgccggccagcgcggcggccgcccacgcggcccgggcgccggtgccggcccgggcgcacagacccgcggcgacacccgcgccaagttggcggtgccgctggaagcggtgtattccggcgacagcgtgcgcatcaccattaccggcaagcagctggacgtgcgcgtgcccaagggcatccagcccggccaggtgatccgcctgagcgggcagggcaacggcggcggcaacctgctgctggaaattgaacacgccgcgcacccgcagttcgaagtggatgggcgcaacatcctgtacacgctgcaggtgatgccgtggcaggccgcgctgggcaccaccatcagcgtgcctacgctgggcggtgcggtggagctgaaggtgccggccgattccgaggctgggcgcaagttgcgcctgcgcggccgcggcttgccgggcgccaccccgggcgaccagatcgtggagctggaaatcctggccccggcgcccaccgacgaggcgcagaagaaggcgtatcggacgctggccaaggccttc

SEQ ID NO: 39402 - DNA, 2522 bp, Xanthomonas campestris; identical to SEQ ID NO: 39035

SEQ ID NO: 39403 - DNA, 1395 bp, Xanthomonas campestris
atgacctgccgcacccgttttgcccccagccccaccggttacctgcacatcggcggcgcacgcaccgccctgtactgctggctggaggcacgtcaccgcggcgggcagttcgtgctgcgcatcgaagacaccgaccgtgagcgcagcacccaggtcgccatcgacgccatcctggaagccatggagtggctgggcctgggctacgacgaaggcccgatctaccagacccagcgcatcgcccgttaccaggaggtggccgagcagctgctggcgcagggcaaggcctattacgcctacgagacccgtgaggagctcgacgcgatgcgcgaggccgcgatggccaagcaggaaaagccgcgctacaacggcgccgcgcgcgagcagcagctgccgtatcgcgacgacccgaaccgggtgatccgcttcaagaacccgctcgcgggcacggtggtgttcgacgacctgatcaagggccgcatcgagatcgccaacagcgagctcgacgacatggtgatcttccgcccggatggctaccccacctacaacttcgcggtggtggtggacgactgggacatgggcatcaccgaggtgatccgcggcgacgaccacatcaacaacaccccgcgccagatcaacatctacgaaagcgctgggccgcaccggtacccaagttcggcgcacatgccgatgatcctggacgagcagggcgccaagctctccaagcgcactggcgcggccgatgtcatgcagtacaaggacgccggctacctgccgcatgcgctgatcaattacctggcccgcctaggttggtcgcatggcgaccaggagctgttcagccagcaggagttgctggacctgttcgacgtcaaggacgtcaattccaaggccgcgcgcctggacatggccaagctcggctgggtgaatcagcattacttgaagaccgacgacccggccagcatcgcgccgcagctggaataccagctccgcaagctgggcattgatgtggccgccggcccggccgctgccgatgtggtggtggcgctgcgcgagcgcgtgcagacgctcaaggaaatggccgaaaaagccgtggtctggtaccagccgctggaaacctacgacgaagccgcggtgatcaagcacctgaaactgggcgcggaagtgccgctgggcaaggcgcgcgagatgctcgctgcgctgaacgagtggagcgtggagaacgtatcggcggcgctgcatgccgctgccgcggcgctggaactgggcatgggcaaggtggcccagccgctgcgggtggccatcaccggcacccaggtcagcccggacatttcgcagacggtgtacctggccgggcgcgagggtgccttgaaacgcatcgatgcggcactcatcaagatt

SEQ ID NO: 39404 - DNA, 762 bp, Xanthomonas campestris
cgctggcggctggatggacagaccgccctgatcaccggcgccagtgccggcattggcctggccatcgcacgcgaattgctcggcttcggcgccgacctgctgatggtggcgcgcgatgccgatgcgctggcgcaggcccgcgacgagctggccgaagagtttcccgagcgcgaactgcacggcctggccgcggatgtttccgacgacgaggagcgccgcgcgattctggattgggtcgaagatcacgccgatggcttacacctgctgatcaacaatgccggtggcaacatcacccgcgcggccatcgactacaccgaagacgaatggcgcggcatcttcgaaaccaacgtgttttccgcgttcgaactctcgcgctatgcgcacccattgctgacccggcacgccgcctcggcgatcgtcaacgtgggcagcgtgtcggggatcacgcatgtgcgcagcggcgcgccgtatggcatgaccaaggccgcgctgcagcagatgacgcgcaacctggcggtggaatgggccgaagacggcatccgcgtcaacgcggtggcgccgtggtacatccgcacccggcgcacctccggcccgttgtccgatccggactactatgagcaggtgatcgaacgcacgccgatgcgccgcatcggcgagccggaagaagtcgccgccgcagtgggtttcctgtgcctgccggcggccagctacatcaccggtgaatgcatcgcggtggatggcggcttcctgcgtcatgggttc

SEQ ID NO: 39405 - DNA, 1688 bp, Xanthomonas campestris
atctcgctcaacggcggcgcagcgcgccacgtgcaggtgggcgatctgatcatcgtggccgcgtttgccggcatgagcgaagacgaagccaagaccttcaagcccaatctggtatatgtggacgcgcacagcgcgatctcccacaccaaccacagcatccccactcaggccgcatgacacataccaacggattcgacgcgcttcacgcccacgcccagcgcctgcgcggcgttgccatccccacattgcttgccgcagagccccagcggcccacgcagtacgcccggcaagtcggtccgttgtatttcaacttcgcgcggcagaaatacgatcgcgccgcgctcgatgcgctgtttgcaatcgcacgcgagcgtgacctggcaggcgcattccagcggctgttccgtggcgagcaggtcaatgtcaccgaaaagcgcgccgccctgcacaccgcgctgcgtggtgatctcaccgatgcaccggtcgcatccgatgcatacgccaccgctgctgaggtccggcatcgcatgggcgcgctgatccagcagctggaaggcaccgacgtcaccgacattgtcagcgtcggcatcggtggttcggatctgggcccgcgtctggtggccgatgcattgcgtgcaccgtccggcgcgcgtttccgggtgcatttcgtttccaatgtcgatggcgcggccatgcagcgcaccctggcaacgctggacccggcacggaccgccggcatcctgatttccaagactttcggcacccaggaaaccctgctcaacggcagcatcctgcatgcgtggctgggtggcagtgagcgcctgtacgcagtgagtgccaatcccgaacgtgccgccaaggcgttcgacattgcacctggccgcgtgctgccgatgtgggactgggtgggcggccgctattcgctgtggtcggcggtcggtttcccgattgcactggcgatcgggttcgagcgcttcgagcaattgctcgacggtgccgcgcagttcgacgcgcatgcgctcaacacgccgctggaagaaaacgtggcggtgctgcacgggctgaccgcggtgtggaaccgcaacctgctcggtagcgccacgcatgcggtgatgacttacgaccagcgcctggccttgctgcccgcgtatctgcagcagctggtgatggagagcctgggcaagcgcgtcaagctggacggctcggccgtggacagcgacaccgtggcggtgtggtggggcggtgccggcaccgacgtgcagcacagcttcttccaggcgctgcatcagggcaccagcgtggtgccggccgatttcatcggcaccgtgcacaacgacgacccgtacgcagaaaaccatgtcgcgctgatggccaacgtgctggcccagaccgaggccctggccaatggccaggacagcagcgatccgcaccgcagttatcccggcggtcgcccgagcacagtgatcctgctcgatgcactcaccccgcaggcgctgggtgcgctgatttcgatgtacgagcacagcgtgtacgtgcagtcggtgatgtggggcatcaacgcgttcgaccaattcggtgtcgagttgggcaagcagttggccagccaattgctgccagccctgaagggcgaggccgccgatgtggccgacccggtcacgcgcgagctgttggccaagctgcgcggctaa

SEQ ID NO: 39406 - DNA, 2103 bp, Xanthomonas campestris; identical to SEQ ID NO: 39039

SEQ ID NO: 39407 - DNA, 798 bp, Xanthomonas campestris
agcgtgcctgcgctgggcatgggctcctggaacctgggccagggacggcatgcgccgcagcaggagatcgaagcactgcagaccggccaggcgctggggatgcgcttgatcgataccgccgagatgtacggcaatggccgctcggaacagttgatcagccaggtgatcgcacgcgggcagccgccgtatctggtgtccaaggtgctgcccagcaacgccagcgcgcgcggcattgcgcgtgcctgcgaagccagtctgcaacgcctgggcgtgcgcacgctggatctgtatctgctgcattggcgcggaggcagcgatctggcggaggtggtcgctgcattcgaaacactgcgcgatgcgggcaagatccgtgactggggcgtgtccaatttcgatgtcgacgacatgcaggagctctggcagatcgatggcgggcagcactgcctggtgaatcaggtgctgtatcgcgccggcagccgcggcatcgagttcgatctgttgccgtggtgcgcgcaacatgcggtgacggtgatggcgtattcgccgctcggcagccgtgcgttgctcgatcacccggtgctgcatgccatcggtgcgcgacgcggcgtagcggctaccgcggtggcgctggcgtgggccatccgcagtggccaagtgatcgccattcccgaatccggtacgccagcgcatgtccgcgccaatgcagatgcatgcacgctgcaactcgatgcgcgggatctggcagacctggacaacgcattcccaccgcccacgcgcaagcagccactggatctgctg

SEQ ID NO: 39408 - DNA, 1104 bp, Xanthomonas campestris
gaattctccgcgctgccgctctcgccagccttggcccccggcatcgatgccctgggctacaccaccctcacgccgatccaggcgcagagcctgccgccgatcctccaggggctggatgtgattgcccaagcgcccaccggcagcggcaagaccgccgcgttcgggctgggcctgctgcaaaagctcgacccggcactgacccgtgcgcaagcgctggtgctgtgccccacgcgcgaactggcagaccaggtcggcaagcaactgcgcaagctggccaccggcattcccaacatgaagttgctggtgctcaccggcggcatgccgcttggtccgcagctggcatcgctcgaagcgcacgacccgcaggtcgtggtcggcacgcccggccgcatccaggaactggcgcgcaaacgcgccctgcatctgggcggcgtgcgcacgctggtgctggacgaggccgaccgtatgctcgacatgggctttgaagaacccatccgcgagatcgccagccgctgcgacaaacactgccagagcctgctgttctcggcgaccttccccgacatcatccgcacgctggcgcgcgagctgttgaaggacccggtggaaatcaccgtggaaggtgcggacaacgcaccggagatcgaccagcagttcttcgaagtggaccccacttatcggcagaaggcggtggccgggctgctgctgcgcttcaatcccgaatccagcgtggtgttctgcaatacccgcaaggaagtggacgaagtcgccggctcgctgcaggagttcgggttctccgcgctggcattgcatggcgacatggagcaacgcgaccgcgacgaggtgctggtgcgcttcgtcaatcgcagctgcaacgtactggttgccagtgacgtggccgcgcgcggcctggatgtggaagacctcgcggcagtggtgaattacgagcttcccaccgacaccgaaacctatcgccaccgcatcggccggactgcgcgcgccggcaagcacggcttggcactcagcctggtggcgccgcgcgaaagcgctcgtgcgcaggcgctggaggccgagcacggccagccgctcaagtggtcacgcgcaccg

SEQ ID NO: 39409 - DNA, 456 bp, Xanthomonas campestris
atccgcgacatcgccgattttcccaagccgggcatcgtgttcaaggacatcacgccactgttgtccgatggcccggatttcgcttctgcgctagatgaaatggcgcaaccctggcgcaccaccccgctggatgcggtgctgggtatcgaggcgcggggcttcattctgggcgcggcgttggcgcgcgaactgcgcaccggcttcgtgccggtgcgtaaaccgggcaaattgcccgggcgcacgttgattcaggagtacgcgctggaatacggcaccgaccgcatcgagatgcatgaggatgcgctgccgcgtggcgcacgggtcttgattgtcgacgacgtgctcgccaccggcggcaccctgcgtgcggccttgggcctggccgcgcagctggagctggaaatcgtcggcgcggcagtgctggtcgagctgctggccctgcagggccgcagcaaa

SEQ ID NO: 39410 - DNA, 867 bp, Xanthomonas campestris
atgtcctcactcccttaccgcggccgcttcgcgccctcgcccaccggccccctgcacttcggctcgctcctggctgcgttgggcagctggctgctcgcgcgccatgccggtggcgaatggcatgtgcgaatcgaagacatcgacccgccgcgtgccgagccaggcgcctcagagcgtcaattgcatacgctggctgcgttcgggctgcaccctgacgggccagtgctatatcagtccgaccgtgatgcgcattacgaggcggcactgtcgcggctgctgcgcaccggtgcggcgttcgaatgcagttgcagccgcgcagagctggccgtgatgggtggcatccaccacgtctgcgtggcgccactgggcatccgccgggccgtgcgcctgcgggtgccgccgaacacccaggcaagcttccaggacgcgctgcaggggcgcatcacccaggatgtgtacgccgaggtgggcgatgtcgtgctgcgccgtgccgacggctactgggcctaccagctggcggtggtggtcgacgatgcggcgcagggcatcaccgatgtggtgcgcggggcggacctgctcgactccaccccgcgccaattggtgctgcagcaggccctgggcgtggcaccgccgcgctatctgcatctgccgctgatcctgggcgccgacgggcgcaagctttccaagtcgcatgcggcgcaaccagtggatgacagcgacccgctgccagcgctgcgcgcggcctggcgggcgctgggccaggcaccggcggccctgcccgcgcgcgcatcggtggccggtgtgctgcagcatgctgtgcagcatttttcgccgcagcggctgccgcgcgttgccagcctggacgct

SEQ ID NO: 39411 - DNA, 663 bp, Xanthomonas campestris
tctcgcgtcgcgttggtcaccggcggcaccggcggtatcggtaccgccatctgcaagcgcctggccgaccagggtcaccgggtcgccagcaatttccgcaacgaagaaaaagcacgcgagtggcagcagcgcatgcaggtccaaggctacgaattcgccctgtttcgtggggatgtggcctcgtccgaccatgcgcgcgcgctggtggacgatgtggaagccgcgctcgggccgatcgaagtgctggtcaacaacgccggcattacccgcgacaccacgttccatcgcatgaccgccgagcagtggcacgacgtcatcaacaccaatctcaattcggtgtttaacgtgacccgcccggtgatcgaaggcatgcgcaagcgcggctggggccgggtgatccagatcagctccatcaacgggctcaaaggccagtacggccaagccaattacgccgccgccaaggccggcatgcatggtttcaccatctcgctggcgcgcgaaaatgcggccttcggcatcaccgtcaacacggtgtcgccgggctacgtggccaccgacatggtgatggctgtgccggaagaagtgcgcgccaagatcgtcgccgatatccccaccggccggcttgggcggccggaggaaattgcgtatgcagtggcgtttctg

SEQ ID NO: 39412 - DNA, 1530 bp, Xanthomonas campestris; identical to SEQ ID NO: 39045

SEQ ID NO: 39413 - DNA, 942 bp, Xanthomonas campestris
ggcggattgaagtacgtgggcgtcaacatctccggcgccgagttcaactcgcgcaagaagcccggcacgctctacaaggactacacctacccggcggcggcggatttcagctatttcgccagcaagggcatgaacaccattcgcttgccgttcctgtgggagcgcctgcagccaaccctcaatggcgagctggatgcggcgcaactggcgttgatcaaaaaatccgtggccgccgccaaggccaacaagcagttcctgatcctggacctgcacaactacgccaagtacaacggaaagcgcatcggcaccgacgaggtgccgcctgcagcactggccgatctgtggcgccgcctggcgctggagttcaaagacgacaagcaggtgatcttcgggctgatgaacgagcccaatggcatctcctccaccgactgggccgcggccgcacaagcggcgatcaacaccatccgcaagaccggcgcgaacaatttgattctggtgcctggcacggcctacaccggcgcgcacagctggcgcagcaccagctacggcgtctccaatgccaaggccctgcagattctcaaggaccccggcaacaatctggccttcgaagcgcatcaatacctggacggcgactacagcggcaccaagcccgaatgcaccagtgccacggtgggcgcagacaagttgcgcggctttaccgactggctgcgcgagaacaagcagaaaggcttcctgggcgagttcggcacggccaacaatgcggtctgcaacgacgcgctgaaaggcatgctgagctacatggaaaagaacagcgacgtgtggctgggctggacctggtgggcggccggcgcgtggtggaagccggactacccgttcaatgtgcagccgggcaaggacggcagcgagaagccgcagatgtcgatcctgagcgagcacgcgcgt

SEQ ID NO: 39414 - DNA, 1038 bp, Xanthomonas campestris
aaagcccacgcctacgccgcccaaaccgccgaccagccgctggcgccgttcgtcttcgaacgtcgcgcgcccggtcccgacgatgtgcagatcgacatcgcctactgcggtgtgtgccactcggacctgcacaccgcacgcaacgaatggcacaacacggtgtatccctcggtgccgggccacgagatcgtgggccgcgtcactgccgtcggcagcgccgtgaccaacttcaaggtcggtgacctggccggtgtgggttgcatggtcgacagctgccgcagctgctcctcctgccaggaaggcgaggagcaatattgcgaacagggcttcaccggcacctacaacggcccgatgtttggcggcggcgagaacacctatggcgggtactccgaccatatcgtggtggaccagaagtacgtgctgcacatttcccacagcgacaacctggccgccgtggccccgttgttgtgcgcgggcatcaccacctattcgccactggcgcattggaaggttggccccgggcagaaggtgggcgtggtcggcctgggtggcctgggccacatggcggtgaagatcgccaaggccatgggcgccaccgtggtgctgttcaccacctccgaaagcaagcgcgccgatgcgctgcgcctgggcgccagtgaagtggtcatttccaaggacgaggcgcagatggccgcgcagtacaacaccctggatttcatcctcaacaccgtggccgcgccgcacaacctggacccgttcctcaatgcgctcaagcgcgacggcgcgatggtgctggtgggcgtgcccgaacattcgcatccgtcaccggcggtgttcaacctggtaatgaagcgccgcacgctggccggttcgttgatcggcggcatccgccagacccaggaaatgctcgatttctgcgccaagcacaacatcgtctccgacatcgaaaccatccgcgccgaccagatcaacgaggcctacgagcgcatgctcaagggcgacgtgaagtaccgcttcgtaattgatatggacacgctg

SEQ ID NO: 39415 - DNA, 1605 bp, Xanthomonas campestris; identical to SEQ ID NO: 39048

SEQ ID NO: 39416 - DNA, 1136 bp, Xanthomonas campestris; identical to SEQ ID NO: 39049

SEQ ID NO: 39417 - DNA, 738 bp, Xanthomonas campestris
aaactcgtactgctgcgccatggccagagccaatggaacctggacaaccgtttcaccggctgggtggacgtggatctcaccgagcagggccgccaggaagccgccgcggccggcaagctgatgaaggacgaagggctgcagttcgatgtggcgtacacctcggtgctcaagcgcgccatccacacgctgcagggcgcgttgaaggagctcgaccaggattggttgccagtgcacaagagctggcgcctcaacgagcgtcactacggtggcctgcagggcctggacaaggcagaaaccgcggccaagcacggcgaggaacaggtcaagatctggcgccgttcctacgacatcccgccgccggccatggacgtcaccgatccgggccaccccgggcatgaccgccgctatgccacgctggaccgcaatgcattgccgggcaccgagtcgctggcaactacgctggtgcgcgtgctgccttactggcacgacgcgatcgcgccgcagttgaaggccggccagaccgtgctggtcaccgcgcacggcaactcgttgcgcgcgctgtacaagtacctcaacgacatctccaacgcgcagatcctggagctcaacatccccaccggcatcccgctgttgttcgagctggacgacaacctgcgggtgcagagctaccgctacctgggcgacccggaggcggccaagcgcgccgccgaagccgtggctaaccagggcaaggccaag

SEQ ID NO: 39418 - DNA, 1989 bp, Xanthomonas campestris
gcagcgccgacgcgcgtggatgtgtccaagctggatgcgccgatcgtggccttcggcagcggcgatctggatccggccattgccgcatgccaggacctcaacgggttcgtcaacgccaagtggctcaaggccaacccggtgccgtccgaccgcaccagctggggcagtttcgaagtgctggccgagcgctcgttgaccatccagcacgcgctggtggaacaactggcgcgcggcaatctgtccgcaggttcggtggatgccaagatcgccgacctgtggcggaccggctcggacgaggcggcgatcgacaaggccggcatcaccccgctgcagccgcagctaaaggcgattgatgtgcttagcgatgcgccggcgattgccgcctggttgcgcgacagctatgccaagggccagggctttttgttctcgttcggcgccaatgccgactacaagaattccgagcagatgattgcgtatgcggggcagggcggtctgggcctgccggagaagggctattacaccgatccggcccaggccaagatccgcgaacagtacgtggcctatatcgcccgcgtgctggagctgtccggcattccggcagcgcaggcggccgaacaagccaaggcggtgatggcattcgagacgcagctggccaatgcctcgctctcgcgcatcgagctgcgtgacccagccaagcgctacaacccggtcgatgtggcgggcgccaatgccatcacgccgcacttcgattggcaggcgttcttcaatgcactgaaggtgccggccggcaccttctcgctgagccagccggagtatttccgcgcgctggacggcatgctcgtcaacacgccggcggatacgtggaaggcatatctgcgcttccacagcatcgatgaggcagcgccgtacctggccaagccgttcgagcaggccaacttcgatttctatgccaagacgttgcgcgggcagcaggacatgctgccgcgctggaagcgcaccttgaacgcggtcaacgaggccatgggcgaggcactgggccagctctacgtgcaatcggcattcccggccgagtcaaaagcgcagatgcagcagctggtgcagaacctctccaacgcgctgaaggcgcggctggagaagctggactggatgagcgcgcagaccaagcagcgtgcactggaaaagtgggccagcttcacgcccaagatcggctacccggaccagtggcgcgattggagcgggctggaaacgcgcggcgacgggttcctggccaatatgcaggccgcgcaggcgttcaattaccgctacatgctcgacaagatcggcaagccggtggacaagcgcgagtggcatatgacgccgcagaccgtcaacgcgtactacaacgccacccgcaacgagatcgtgttcccggcggcgattctgcagccgccgttcttcgatcccaaggccgacccggcgctcaattacggcggcatcggtgcggtgatcgggcacgagatgatgcatggctatgacgactccggcagccagttcgatgccaagggcaacttcgacacgtggtggaccgacgccgaccgcaagctgttcacccagcgcaccgatcagctggtggcgcagttcgatggctatgaggcgatccccggcgtgcacgtcaaaggcaagctgaccctgggcgaaaacatcggcgacctgggcggcctcaccgtggcctacgacgcgctgcagatggcgttgcaggaacagccggccgccaacaaggagatcgacggccatagccaggaccagcgcttcttcatgaactgggccacggtgtggcgccgcaacttcaccgacggcgagctgcgcgtgcgcctcaacaccgacccgcatgcgccggccaacttccgtgccaacggcgcgccgtccaacatgccggcgttcgcacaggccttccagtgcaagccgggcgatgcgatggtgcgcggcgacaaggaccgcgtagcgatctgg

SEQ ID NO: 39419 - DNA, 840 bp, Xanthomonas campestris
tgcacgcatggcgaaggcgtgctgtggtgcgagcagcgtgaagcgctgtattgggtggacatcagcgaaaaacgcctgtggcggcatcatccgggcagcgcgcagacgcgcttctggacactgcccgaccgcccgggctgcatcggcctgatggacgatggccgcctgctgatcgcgctggccaaggccatctgcatcgccgacccggacaatgccgacggcgacacgctgccgctcgaccatctggccgatgtcgaagccgacaacccgctcacgcgcagcaatgacggccgcgccgatcgccatggcaacttcgtgttcggcaccatggacgagcacgaagacaaggccgggcgcggggcgatgtaccagttctcgctgcgccacgggctgcgtcgtctgccgttgccgggcgtgtccattcccaactcgatctgcttcagcccggatggccgcacgctgtactactgcgattcggtgcgcccgcagatcctgcgctgcgattaccacccggacaccgggcaaaccaccaacacgcgcgtgtataccacgctggatcgcgacgacgcccagccggatggctccatcatcaacaacgccggccacctgtggaacgcgcactggccctcctggcgcgtgctgcggtatcacccggacagcagcgtgaagcgcatcgtgcacatgccagtgaagcaccccacctgcagtgccttcggcggtcccgcactggaccgtctgcacgtgatcagctcgcgcctggaccatagcgatgccgagctggcacagaccccgcaggccggcggcctgtacctctgcgacctgccggtgcgcggcctgccc

SEQ ID NO: 39420 - DNA, 1059 bp, Xanthomonas campestris
atcgcgctcgcaacgctcatcccggtcaccgcgccggcgatgcaggtcagtacgcaagctccccttgtcgatgcaacaggtcagacgctgcacattcgcggggtcacctggcccggcttcgatcgcgccgggttggcggccgtcggcatgcgcaacaacacactggcgcaactgctggatcggatgcaggcgtcagacatcaatgccgtacgtgtgccggtctgcgccgctgttctgcaacgcgcccctgtggcagctgcagaagttgccggcgattccacgctgcgcggattagattccttgcaactgctcgacgcagtggtgcatgccgcaagccagcgcgggatgcaggtgatgttcgcgtttgcagatggaggctgcgatgaccgcgcaccgctcctgggcgcacagcagcaagcatggacgcgcggcctggttacgctggcacgccgctatggcggcaacgccaatgtcctgggcattgaccttggcagcagcggctatcgcaatgccagctgggcaggaaacgcggcggatcaggattggaaccgggtagcgtcgcgcgcagttgcaagggtgctggcgcaggcaccgcgctgggtcgtcggtgtggaaggtgtgggcagcaatgcggtgtgcagtgacccagagcgcaaggcgcctggcagcaatcttcagccgttcgcgtgcgtgccgctggacatcgctcgccgacacttggtgttgatgccgaagttggcgggcccggatcgcgatacgaccgatgctttcgccgcacccggatttgcgcaggcactgcccgccatgtggcaacgcgacttcggccaattcgcaatcgaccatgcagtggtacccgtcagcctcggcggtggactgggcgatggcgacccgcgtgacccggcatggcaaaccgcattgagcggttatttggcaaacgcaggaatacgcagcgcatttctcggcagttgggaaacgggcaatgccaacaacggcggcctgttggcgccggatggcagcccccgcgcagacaaactgctgatcttgcgtcatgcctggggc

SEQ ID NO: 39421 - DNA, 1344 bp, Xanthomonas campestris; identical to SEQ ID NO: 39054

SEQ ID NO: 39422 - DNA, 1605 bp, Xanthomonas campestris
atgagcgctgctgcgcccccgtgctgcacctcgttgcttggtctgtcgctgagcatgttcgttgcgccctgcgccctggcggccacgccgctggaaggtgcggtggtcagcgcgcccgcgcccacgccgcccacgcccgatctggcgtatccggagctgttccaggccgtgcagcgcggcgagctgttcgacgaccagaagcacttcgtcgactttctgccgctgcgcgacccggccctgatcaacgccgactatctggcgcagcacgagcatgccggctttgacctgcgcaagttcgtggatgccaacttcgaggaatcgccgccggtacagaccgatgcgatccgccaggacaccgcgctgcgcgagcacatcgacgcgctgtggcccaagctggtacgcagccagaccaacgtgcccgcacacagcagcctgctggcgttgccgcacccgtacgtggtgccgggcggacgcttccgcgaggtgtattactgggattcgtacttcaccatgctggggctggtgaaaagtggcgaaaccacgctgagccggcagatgctggacaacttcgcctacctgatcgacacctacgggcacatccccaacggcaaccgcacctactacctgagccgctcgcagccgccgttattctcctacatggtggaactgcaggccggcgtggaaggcgaggcggtgtaccagcgctacctgccgcagctgcagaaggaatacgcgtactggatgcagggcggcgacgatctgcaacccggccaggccgcacgccatgtggtgcgcctggccgatggcagcgtgctcaatcgctattgggacgagcgcgataccccgcgcccggaagcctggctgcacgacacccgcaccgctgccgaggcgcatgaccgcccggccgccgatgtctaccgcgacctgcgcgccggcgccgaaagtggctgggactacaccagccgctggctggccgacggcaagacgctgagcaccatccgcaccaccgcgattgtgccgatcgatctcaacagcctgctgtatcacctggaacgcaccctggcgcaggcctgcgcgcacaccggcaccgcctgcagccaggactacgctgcgctcgcacagcagcgcaagcaggccatcgacgcgcacctgtggaatgcagccggctactacgccgactacgactggcagacccgcacgctgagcaaccaggtcaccgcggcggcgctgtacccgctgttcgccggcctggcttcggatgaccacgccaagcgcactgccaccagcgtgcgcgcccgcctgctgcgtcccggcggcctggccaccaccgcgttgaagaccggccagcagtgggacgaacccaacggctgggcgccattgcaatgggtggccgtggacggcctgcgtcgctacggcgaagacggcctggcccgcaccatcggcgagcgcttcctcacccaggtgcaggcgctattcgcgcgcgagcacaagctggtcgaaaaatacggcctggacgccgatgcagccggcggcggcggtggcgaatatgcattgcaggacggctttggctggaccaatggcgtcacgttgatgctgttgaacctg

SEQ ID NO: 39423 - DNA, 912 bp, Xanthomonas campestris; identical to SEQ ID NO: 39056

SEQ ID NO: 39424 - DNA, 738 bp, Xanthomonas campestris; identical to SEQ ID NO: 39057

SEQ ID NO: 39425 - DNA, 903 bp, Xanthomonas campestris
ctgcgcatcgccacccgtaagagcccgcttgccctctggcaaagcgaacacgtcgccaccgcgctgcgccagcaccaccccgggctggaggtcgtgctggtgccgatgagcacccgcggcgatgaagtgctggaccgctcgctggccgccatcggcggcaagggcctgttcctcaaggaactggagctggccatgctgcgcggcgaggccgattgcgccgtgcactcgctcaaggacgtgcccatggagctggacgcgccgttcgtgctgccggccatcctggaacgcggtgacccagccgatgcgctggtgtccaacctctacgccaccttgcaggccctgccgctgggcgcacgcgtgggcacctcgtcgttgcgccgccaggcgcagctgcgcgccgcgcgcccggacctggaattgattgacctgcgcggcaacgtcaacacccgcctggccaagctcgacaacggcggctacgacgccatcgtgctggcctgcgccggcctgcagcggctgggcctggaagcccgcatcaccgcgcggctggacgcaccggagtggctgcccgccccggcgcaaggcgcggtggcggtggaatgccgcggcgacgatgcccgcatccacgacctgctggcagtgctggatgctggccgcacgcgcgcctgcgtggaggccgagcgcgcgatgaatcgcgccctgcacggcagttgccacgtgccggtggccgccttcgcgcgctgggaaggcgaggacctgttcctgcagggcatggtgggcagtgccagcgacggccgcctgatccatgccgaggcacacggcagccccgatgccaccgaagacctcggccgccgcgtcgccgacggcctgttcgaaaagggcgccgcacagctgctggcggagctg

SEQ ID NO: 39426 - DNA, 591 bp, Xanthomonas campestris
gtgatctggctgcatggcctgggtgcggacggcagcgacttcgcgccgatggtgccggaactggtgcgcgcgcagtggccggcgctgcgcttcgtgttcccgcatgcgccaatccgcccgatcaccatcaacaacggcgtgcgcatgcgcggctggtacgacatcgtcggcatggactttgcccagcgcgcggacaaggtcggcatcgccgagtcggtggcccaggtcgaggccttgattgccaacgaacaggcgcgcggcattgcgcccgagcgcatcctgctggccggcttctcgcaaggcggcgccgtcaccctggcggtgggcctgcagcgtcgcgtgccgttggccgggttgatcgccatgtccacctatctgcccgatccggccgccgccgccagccaactgcagccgggcgcgctggcgcaaccactgttcatggcgcatggcagcgccgacccggtggtgccttaccgcgccggcgagcagagtgcgcaggccctgcaggcactggggttcatgctggaatggcatagctacccgatgggccaccaggtctgcgtggaagagatcgacgccctgcgcgactgg

SEQ ID NO: 39427 - DNA, 1511 bp, Xanthomonas campestris
atgtccatattcaggaccgcaagcacgctcgctttggccaccgccctcgcactggccgccgggccggccttcagctattccatcaacaacagcaggcagatcgtcgacgacagcggcaaggtcgtgcagctcaagggtgtgaacgtgttcggcttcgaaaccggcaaccacgtgatgcatggcctgtgggcacgcaactggaaggacatgatcgtgcagatgcagggcctgggcttcaacgccgtgcgcctgccgttctgcccggccacgctgcgtagcgacaccatgccggccagcatcgactacagccgcaacgccgacctgcagggcctgacctcgctgcagatcctcgacaaggtgatcgccgaattcaatgcgcgcggcatgtatgtgctgctggatcaccacacccccgattgcgccggcatttccgagctctggtacaccggctcctataccgaggcacagtggctggccgacctgcgctttgtggccaaccgctacaagaacgtgccgtatgtactcggcctggatctgaagaacgaaccgcacggcgccgccacctggggtaccggcaacgccgccaccgattggaacaaggctgccgagcgcggctcggccgcggtgttggcggtcgcgccgaaatggctgatcgcggtggaaggcatcaccgacaacccggtgtgctccaccaacggcggcatcttctggggcggcaacctgcagccgctggcctgcaccccgctcaacatcccggccaaccgcctgctgctggccccgcacgtgtacggcccggacgtgttcgtgcagtcgtacttcaacgacagcaacttccccaacaacatgcccgccatctgggaacgccatttcggtcagttcgccggcacgcatgcgctgttgctgggcgagttcgatggcaagtacggcgaaggcgacgcacgcgacaagacctggcaggacgcgctggtgaagtacctgcgcagcaagggcatcaaccagggcttctactggtcgtggaatcccaacagcggcgacaccggcggcatcctgcgcgatgactggaccagcgtgcgccaggacaagatgaccctgctgcgcacgctgtggggcaccgccggcaataccacgccgacgccgactcccacacctacgcccacaccgacaccgacgcctacccccacgccgacgcccaccccgggcaccagcaccttcagcaccaaggtgatcgtggacaacagctggaacggcggctattgcaaccgcgtgcaggtgaccaacaccggcaccgccagcggcacctggtcgatcgcggtgccggtcaccggtacggtcaacaacgcctggaatgcgacctggtcgcagagcggcagcacgctcagagccagcggcgtggacttcaaccgcaccctggcagccggcgccaccgccgagttcggcttctgcgccgcgagctgagtgcactgtggcgggtacggctcccgtgtccgctacctttgcaacatgcagtggca

SEQ ID NO: 39428 - DNA, 1146 bp, Xanthomonas campestris; identical to SEQ ID NO: 39061

SEQ ID NO: 39429 - DNA, 933 bp, Xanthomonas campestris; identical to SEQ ID NO: 39062

SEQ ID NO: 39430 - DNA, 550 bp, Xanthomonas campestris
ctctactttgtccgccatggggaatcgctcgccaacgaacagaactacttcgctggttcccagaattcgccgctgacccggctcggccggcatcaggcgcagcaggccgcgctacgtgcagcaacgcgcactgcacttcgaccaggtgcatgtctccacgctggagcgcgcgcaggcaacggcagccatcatcctgcatgacgttgcgcccatgcccgaggtcgtttccagcgcggcactggtggaacgcaacttcggcatcttcgccggcaagaacaagaccttgatcaagaagtcggtcggccatgcggtgtttgaacgctacttccatgatgccgatggcgcgccaccggacggcgaacactggatggatatgtacgcccgctgcaagacctactacgagaccgtgctggcgccgctggatcagcaagccaagcacgtgctggtcgtcgcgcacaaatacatcgtggaagtcttagcgctgatcgcatccgggctgccgccagcggagtacatcgacttccgcttgcccaactcgcgcccgctgtca

SEQ ID NO: 39431 - DNA, 1425 bp, Xanthomonas campestris; identical to SEQ ID NO: 39063

SEQ ID NO: 39432 - DNA, 1407 bp, Xanthomonas campestris
gattacaagatcgccgacatctccctggccgattggggccgcaaggagctggacatcgccgagcacgagatgccgggcctgatgtcgatccgccgcaagcatgcgcagaccaagccgctgaaagacgtccgcatcaccggctcgctgcacatgaccatccagaccgccgtgctgatcgaaacgctcaaggacatcggcgccaatgtgcgctgggcctcgtgcaacatcttctccacccaggaccacgcggccgccgcgattgccgccaccggcacgccggtgttcgcctggaagggcgagacgctggaagagtattgggactgcaccctggacgcgctgaccttcaccctgcccgacggcaccctgaccggcccggagctggtggtggacgacggcggcgacgtcaccttgctgatccacaagggctatgagctcgaaaacggcagcacctgggtcgacgagccggcctcctcgcacgaagaaggcgtcatcaaggcactgctcaagcgcgtggctgtcgagcgtccggggtactgggcgcgtgtggtcaaggactggaagggcgtctctgaagagaccaccaccggcgtgcaccgcctgtaccagattgccgaagccggcaaactgctgatcccggccatcaacgtcaacgactccgtcaccaagagcaagttcgacaacctctacggctgccgcgagtcgctggccgatggcctcaagcgcgcgatggacgtgatgctggccggcaaggtcgcggtggtctgcggttacggcgatgtcggcaagggcagcgccgcctcgctgcgtgcctacggtgcccgcgtcatcgtcaccgagatcgacccgatctgcgccctgcaggcgtcgatggaaggcttcgaggtcaacaccatcgaatccaccctgggccgcggcgacatctatgtcaccaccaccggcaacaaggacatcatcaccgtcgagcacctgcaggcgatgaaagaccaggccatcgtctgcaacatcggccacttcgacaacgagatccaggtcgatgcgctgaatgcacttaagggcgtggagaagatcaacatcaagccgcaggtcgacaagtatgtgttcggcaacggtaacgcgatcttcctgctggccgacggccgcctggtgaacctgggctgcgccaccggccacccgagcttcgtgatgtccaactcgttcgccaaccagaccctggcgcagatcgacctgtgggaaaagcgcgacagctacgagaagaaggtctacatcctgcccaagcacctggatgaagaagtggcccgcctgcacctggagaagatcggcgtcaagctgaccaccctcaccaaggaccaggccgactacctcggcgtggacgtggctggcccgtacaagccggatcattaccgctac

SEQ ID NO: 39433 - DNA, 518 bp, Xanthomonas campestris; identical to SEQ ID NO: 39065

SEQ ID NO: 39434 - DNA, 1515 bp, Xanthomonas campestris; identical to SEQ ID NO: 39066

SEQ ID NO: 39435 - DNA, 1005 bp, Xanthomonas campestris
tattcgctcgcccgccccttcctgttcgccttcgacgccgagcgcgcccacgcgctggccctgcgcgccatcgacaccgcctaccgcaccggcaccacggcgctggtggccacccggccggtgcccctgcccacgcctgccttcgggctgatgttccccaacccggtgggcctgggcgccgggctggacaagaacggcgagcacatcgatgcgctgctggcattgggcttcgggtttgtcgagatcggcacggtgacgccgaagccacaggagggcaatcccaagccgcgcatgttccggttgcccgaataccaggcggtgatcaaccgcatgggcttcaacaacctgggcgtggatgtgctggtgaagaacgtgcagcgtgcgcgccggcgcggtggcctgctcggcatcaacatcggcaagaacaaggacacgcccaacgaggaagcgaccagcgattaccgctattgcatggagcgcgtgtatccgctggccgactacatcaccgtcaacatttcctcgcccaataccgccggtttacgcgagctgcaggaagaacaggcgctgcgccggctgatcgccgatctgcgcgaaacccaggaagccctggccgcccaacacggcaagcgcgtgccgatgctggtgaaggtggcaccggacctcaacgaccgcgacatcgatgcggccgcacgcgtgttggctgacctggcggtggatggcgtgatcgccaccaacaccacggtgacgcgcaccctggtggccagccatccgatggccgagcaggccggcggcctgtcgggcgcaccgctgctggggcaatccacgctggtgctgcgtcgcctgcgtgcacgcctgcccgagtccattccgttgatcggcgtgggcggcatcacgtccggcgccgatgcggtggccaagatggccgccggtgccagcctggtgcagtgctacagcggcctggtctatcgcgggccgcgcttgatcggcgagtgcgtggatgcaatc

SEQ ID NO: 39436 - DNA, 603 bp, Xanthomonas campestris; identical to SEQ ID NO: 39068

SEQ ID NO: 39437 - DNA, 1254 bp, Xanthomonas campestris; identical to SEQ ID NO: 39069

SEQ ID NO: 39438 - DNA, 1224 bp, Xanthomonas campestris
ctgcagggcagcctgaccattcccggcgacaagtcggtttcgcaccgcgcggtgatgttcgccgcactggcggatggcacctcaaagatcgacggctttctggaaggcgaagacacgcgttccaccgcggcgatctttgcccagctgggcgtgcgcattgaaacgccgtcggcgtcgcagcgcatcgtgcatggcgtcggtgtggacggcctacagccgccgcaggggccgctggattgtggcaacgccggcaccggcatgcgcttgctggccggcgtgctcgcggcgcagcggttcgatagcgtactggtgggcgatgcgtcgttgtccaagcggcccatgcgccgcgtcaccggcccgctggcgcagatgggtgcacgcatcgaaaccgaatcggatggcacgccgccgctgcgtgtccacggcggccagccgctgcaaggcattacgtttgcctcgccggtggctagtgcgcaggtcaaatcggccgtgctgctggccgggttgtacgcagcgggtgagacctcggtgagtgagccgcatcctacgcgcgactacaccgaacgcatgctctccgcattcggcgtggacatcgcgttttctcctggccaggcgcgtctgcgtggcggccagcgtttgcgtgcgaccgatatcgcggtgccggcagatttttcatcggcggcgttcttcatcgtggccgccagcatcattcccggctcggacgtgactttgcgtgcggtaggtctgaatccgcggcgcaccggccttttggccgccctgcggctgatgggcgccgatatcgtggaagacaatcacgccgaacacggcggtgagccggtggcggacctgcgcgtgcgctacgcaccgctgcagggcgcgcagattcccgaagcgctggtgccggacatgatcgatgagttcccggcgctattcgtcgccgcagctgcggcgcgcggcgacacggtcgtcagtggtgcggcggaattgcgcgtcaaggaatccgatcgtctcgccgcgatggccaccggcctgcgggcgctcggcattgtggtggacgaaacgccggacggtgccaccattcacggcggcacgctgggcagcggcgtcatcgaaagccacggcgatcaccgcattgcaatggcgtttgccatcgcaggccagctgtcgaccgggacggtacaggtcaacgacgtggcgaacgtggccacctcgttcccaggcttc

SEQ ID NO: 39439 - DNA, 795 bp, Xanthomonas campestris
cttatgcgcatcatcagtttcaacgccaatggcctgcggtcggccgccagtaaggggttcttcgagtggttcgccacccaggacgcggatgtgctgtgcatccaggagaccaaggcgcaggaacatcagctggccgggccggaattcctgcccgccggctacaaggcctggtttcgcgatgccagcaccaagaagggctacagcggcgtggcgatctacgccaagcgtgaacccgacgaggtgcgcaccgcgctcggttggccggagttcgacgaagaaggccgctacatcgaggcccgcttcggcaacctcagcgtggtctctttctatatcccgtccggctcctcgggcgagttgcgccagggctacaaattccaggtcatggaatggctgcgcccgatcctgagcgaatggctggccagcggccggcagtacgtgctgtgcggcgactggaacatcgtgcgctcggcgctggacatcaagaactggaagtccaaccagaagaactccggctgcctgccgcccgagcgcgactggctcaacggcctgtgcgccgacctgctggacgaggccgatgccagcaacgggcgcggctgggtggacagctaccgcgtgctgcatccgcagggcgaggactacacctggtggagcaaccgcggcgctgcccgcgccaataacgtgggttggcgcatcgactaccaactggtcacccccgggctgcgcgataaggtgcaggcttgttcgatctaccgcgagcagcgtttctccgaccacgccccttacatcgtggattac

SEQ ID NO: 39440 - DNA, 1401 bp, Xanthomonas campestris
gtcccggctgtgcaggtcgccgcagaaatgttccgcgcgtacgacatccgtggcgtggtgggcaaggatctcaaccccggcatcgccgcgctgatcggccaggccatcggcagcgtgatgcaggcgcaaggcctgcgcgacatcgtggttggccgcgatggccgtttgtctggcccggaattgaccaacggcctgatcgaaggcctgcgccgcgccggttgcaacgtcaccgacatcggcctggcgccgacgccggtggtgtacttcggcgcctacgaattgcgcgccggcagctgcgtggcggtgaccggcagccacaatccgcccgactacaacggcttcaagatcgtgatcggcggcgagacgctctccggtgcggcgatcaccgagctgcaccagcgcatcaccgaaggccgcctgcataccgcagccagccccggcgaactggagcagcgcgacatcagcgatgcctacatccagcgcattgccgacgacgtgcagctggaccgcccgatcaaggtggtggtggacgccggtaatggcgcggccggcgagatcgcgccgcgcttgttggaggccatcggtgcggaagtggtgccgctgtattgcgaaatcgacggcacttttcccaatcaccatccagacccgagcgagccgcacaatctcggcgatctggtgcagatggtgcagcgcttcgatgcggatatcggcgtggccttcgatggcgatgccgaccgcctgggcgtggtcaccaaggaaggcgccatcgtcttccccgaccgcctgctgatgctgtttgccgccgatgtgctgcaacgcaatcccggcgcgctggtgatctacgacgtgaagtgcaccggcaagctgtccgactacgtgttgcgcaatggcggcagcccgttgatgtggaagaccgggcattcgctgatcaaggcgaagatgcgcgaaaccgatgccgagctggccggtgaaatgagcgggcacttcttcttcaaggagcgctggtacggcttcgacgatggcatctatgccgccgcgcgcctgctggaaatcctcgcccagcgcgaagagaccccgtccgacgtgctcggcgagctgcccgaaagcgtgtccacgccggagatcaaggtaccgttggacggcgatgcgcatgcgctggtggcccggttcgtggagcgtgcccaggccggcgaggagtcgccgttcgaggccgcgcggttgtccaccatcgatgggctgcgcgcggatttcggcgacggctggggcctggtacgtgcgtccaacaccaccccgatcctggtgctgcgcttcgaagccgacaccgctgtggcgctggaacgcatccgcgcgctgttccgcagcgaactgcaggcgctgctgccggatcacccgctcgcattc

SEQ ID NO: 39441 - DNA, 1635 bp, Xanthomonas campestris; identical to SEQ ID NO: 39073

SEQ ID NO: 39442 - DNA, 1677 bp, Xanthomonas campestris; identical to SEQ ID NO: 39074

SEQ ID NO: 39443 - DNA, 2919 bp, Xanthomonas campestris; identical to SEQ ID NO: 39075

SEQ ID NO: 39444 - DNA, 2370 bp, Xanthomonas campestris
gagcgccccatggcccagtcccaaccagaaattctcgatctgccagtgttgccgctgcgcgacgtggtggtgtttccgcacatggtgattccgctgttcgtcggccgtgacaagtcgatgcgcgcgctggaaaaagccatggaggcggacaagcgcatcctgttggttgcgcagaagtcggccgagaccgacgacccggcagcgggcgatctgtacacggtcggcacgctcgcccaggtgctgcaactgctcaagctgcccgatggcacgatcaaggtgctggtcgaagggttgtcgcgcgtcaccgtcgacaaggtggcggaacaggacggcgccttgcagggccgcggcaccgaagtggaagccagcgatgcacgcgagccgcgtgagctggaggcgattgcgcgttcgctgatgtcgctgttcgaacagtacgtcaagaccaaccgcaagctgccgccggaattgctgcagaccctggccggcatcgatgagcccggacgtctggccgacaccattgccgcgcacatcggcgtgcgtttggctgataagcaacgcctgctcgaaatcaccgagatcggcgaccggctggagctgctggttggtctggtcgatggcgagatcgacgtgcagcagctggaaaagcgcatccgcggccgcgtcaagtcgcagatggaaaagagccagcgcgagtactacctcaacgaacagatgaaggcgatccagaaggaactgggcgatctggacgacgcgcccggcgaactggaagaactcgcccgcaagatcgccgaggccggcatgcccaagccggtcgagaccaaggccaaggccgaactcaacaagctcaagcagatgtcgccgatgtctgccgaagctgcggtcgtgcgcaactatctggattggttgctcggcgtgccgtggaagaagcgcaccaaggtccgcaaggatctcaaggttgcgcaggatacgctggatgccgatcactacggtctggacaaggtcaaggaacgcatccttgagtacttggccgtgcagtcgcgcgtgaagcagatgaagggcccgatcctgtgcctggtcggcccgccgggtgtgggtaagacgtcgctgggtcagtcgatcgccaaggcgaccaaccgtaagttcgtgcggatgagcctgggcggcgtgcgcgacgaggccgagatccgtggtcatcgccggacctatgtcggttcgatgccgggccgcctggtgcagaacctcaataaggtcggcagcaagaacccgctgttcctgctggatgagatcgacaagatgtcgatggacttccgtggcgatccgtcatcggcgctgctggaagtgctcgacccggagcagaaccacaccttcaacgaccactatcttgaagtggatctggacctgtcggaggtgatgttcgttgctacctccaactcgctcaatatccccggcccgctgctggaccgcatggaagtgatccgcatccccggctataccgaggatgaaaagctcaacatcgccatgcgctacctggtgcccaagcagatcaaggccaacggcttgaagccggaagagatcgagatcggcagcgatgccatccaggacgtggtgcgttactacacgcgtgagtcgggcgtgcgtaaccttgagcgcgaagtggccaagatctgccgcaaggtggtcaaggaaatcgcattggctggcccgcagccggcggccaagaaggcggtcgcaaagaaggccaagcccaaggcgctggtgacggtgacctccaggaacctggacaagtatctgggcgtgcgtcgcttcgatttcggtcgtgcagaagaagagaacgagattggcttggtgacgggtctggcttggaccgaggtcggtggcgaactgctgcagatcgagtccacgctggtgccgggcaagggcaacctgatcctcaccggtcagctgggcaacgtgatgaaggagtcggcatcggcggccttgtcggtggtgcgctcgcgcgcagagcggctgggcatcgatgtggatttcctgcagaagcaggacgtgcacgtgcatgtgcccgacggtgccacgccgaaggatggccccagcgcaggtatcgcgatggtgacctcgctggtgtcgatcctgaccaaggtgccgatccgtgcggacgtggcgatgaccggcgaaatcaccttgcgcggccgcgtctctgcgatcggcggcttgaaggagaaattgctggcggcactgcgcggcggtatccgtaccgtgttgatccccgatgagaaccgcaaggacctggcggacatcccggccaacgtcacgcgcgatctgaagatcgtgccggtgaagtggatcgacgaagtgctggatctggccctggag

SEQ ID NO: 39445 - DNA, 990 bp, Xanthomonas campestris
acggtcatccgcggcgacggtattggcccggagatcatggatgccacgctgttcgtgctcgacgcgctgcaggctggcctgacctacgagtacgccgatgccggcctggtcgcgctggaaaagcacggcgatctgctgcctgagtccaccctggcctcgatcaccaagaacaaggtggcgctgaagagcccgctgaccacgccggtcggtgagggtttcagctcgatcaacgtcgccatgcgtcgcaagttcgacctgtacgccaacgtgcgtccggccaagtcgttccccaacaccaagtcgcgtttcgccgatggcgtggacctgatcacggtgcgtgagaacaccgaaggcgcctacctgagcgaaggccaggaagtctcggccgacggcgaagtggccgtttccggtgcccgcgtcacccgcaagggctccgagcgcatcgtgcgctacgccttcgacctggcgcgcgccaccggccgcaagaaggtcaccgcggtgcacaaggccaacatcatcaagtcgacctcgggcctgttcctgaaagtcgcccgcgatgtcgccacgcagtacccggaaatcgaattccaggaaatgatcgtcgacaacacctgcatgcagctggtgatgcgtccggaacagttcgacatcatcgtgaccaccaacctgttcggcgacatcatctccgacctgtgcgccggtctggtcggcggcctgggcctggcgccgggcgccaacatcggtgtggacgcggcgattttcgaggccgtgcacggctcggcgccggatatcgcagggcagggcaaggccaacccgtgcgcgctgctgctgggcgctgcgcagatgctggaccacattggccagccgcagaacgccgaacgcctgcgcgaagcgatcgtcgccacgctggaagccaaggactcgctgacccccgacctgggtggcaccggcaacaccatgggcttcgccaaggccatcgccagccgcctc

SEQ ID NO: 39446 - DNA, 2064 bp, Xanthomonas campestris; identical to SEQ ID NO: 39078

SEQ ID NO: 39447 - DNA, 1020 bp, Xanthomonas campestris; identical to SEQ ID NO: 39079

SEQ ID NO: 39448 - DNA, 1158 bp, Xanthomonas campestris
gaactggaatcaatccagtcccaggggctgttcaagtccgagcgcatcatcaccggcccgcagtcggcacagatcacgctggccgacggccgccgcgtgctgaacttctgcgccaacaattatcttggcctggccgaccacccggacatcatccaggccgccaaggatgcactggacacgcacggcttcggcatggcctcggtgcgtttcatctgcggtacccaggacctgcacaagcagctcgaacgcaccatcgccgacttcttcggcaccgaagacaccatcctctacgccgcctgcttcgatgccaacggcggcctgttcgagccgttgctcggcgagcacgacgccatcatttccgatgcgctcaaccacgcctccatcatcgatggcgtgcgcctgtgcaaggccaagcgcttccgctacgccaactgcgacatggccgatctggaaacacagctgcaggccgccgacgccgccggctgcaagaccaagctgatcaccagtgacggcgtgttctcgatggacggcttcatcgccccgctggatgaaatcaccgcgctggcccgcaagtacaacgcgctggtgcacatcgacgaatgccacgccaccggctttttgggcgcgaccgggcgcggctcggccgaggtcaagggcgtgatggaccagatcgatatcttcaccggcacgctgggcaaggcaatgggcggcgcgttgggcggcttcaccaccgccaagcgcgaagtcatcgaactgctgcgccagcgctcgcggccgtacctgttctccaactcgctgccgccgcacgtggtggctgccggcatcaaggccttcgagatgctggacgcggccggcgagctgcgcacgcagctggtggaaaacacccgctacttccgcgagcgcatgaccgctgccggcttcgacgtgaagcccggcgtgcatccgatcagcccggtcatgctgtacgacgcaccgctggcgcagcgctttgccgagcgcctgctcgaagaaggcatctacgccatcggcttcttcttcccggtggtgcccaaggggcaggcgcgcatccgcacccagatcagcgccgcgcacacccgcgagcagttggatcaggcaatcgacgccttcacccggatcggtcacgagctcaaggtcatc

SEQ ID NO: 39449 - DNA, 738 bp, Xanthomonas campestris
acagacagttccaaggtggtcctgatcaccggtgccgcccgccgcatcggtgcgcagatcgccaccaccctgcacggcgccggctaccgcgtggccctgcacgcgcaccgctctggcgatgcattggctgcacgcgtggcggcgctatgcgcccagcgcgcgggcagcgcctgtgcactgcaggccgacctgcgcacgcccgaggcaccggcccagctggtggatgcctgtgtggctgcattcggccgcctggatgcggtggtcaacaatgccagcgcgttttatcccaccgtgctgggcgaggccacgccggcgcaatgggacgagttgttcgcggtgaacgcacgcgctccgttcttcattgcacaggccgctgcggcgcagttgcgcgcgcaccacggcgccatcgtcaacctcaccgatctgcatgccgaacaacccatgcgccagcacccgctgtatggcgcctccaagagcgcgctggaaatgctgacccgctcgctggcgctggagctggcgccgcaggtccgcgtcaatgccgtcgcaccgggcgcgatcctgtggccggaagacggcaaggccgacgccgccaagcaggcactgctcgcgcgcacgccgctggcgcgcatcggcacgcccgaagaagtggccgaggccgtgcgctggttgctggacgatgccagcttcatcaccggccataccttgcgcgtggacggcggccgccggctcagctgagcg

SEQ ID NO: 39450 - DNA, 918 bp, Xanthomonas campestris
gtgactatggaactgggtatggtgggactgggccgcatgggcgccaacatggccgagcggctggtgcgcggcggacatcgcgtgcatgggttcgatctgggcgctgccgcacgcaccagtgcgcaatccaaggggatccagacaaccgacgcgctggccacgctggtctccgcactgccgagtccgcgcgtggtgtggctgatggtgccggccggcaagatcgtcgacgacacgctggcgcagctgctgccgttgctgcaggccggcgacatcgtcatcgatggcggaaattcgtactacaaggattcgcagcgccgcgctgcgcagctgcagtccagcggcattgcatttgtcgattgcggcaccagcggtggcgtgtggggcctgcaggaaggctacagcctgatggtgggcggcgacgaagcggccgtgaccacgttgcatccggtgctggccacgttggcaccggcgccggacaagggctggggacgggtgggcccgagcggtgccggccacttcaccaagatggtccacaacggcatcgagtacggaatgatgcaggcctatgccgaaggcttcgcgctgctgcagcacaagaccgatttcgcactggacctgcaccaggttgccgagatctggcgcgatggcagcgtggtgcgttcgtggctgctggacctcaccgccgatgcgctggcgcacaacccgaccatgggcggcattgcgccgtatgtggccgattccggcgaaggccgttggacggtggcagaggccatcgacctggaagtctccgcgccggtgatcaccttgtcgctgatggagcggttgcggtcgcgcgacaaggattcgttcaccgataaattgctggcggcgatgcgcaatcagttcggtgggcatgcggtgctgaccaccacgccaacc

SEQ ID NO: 39451 - DNA, 897 bp, Xanthomonas campestris
ctggacatcacccgtttcgacagcgaccgcgaggcctttgtcgccgagctcggtgccgcttatcggcaatggggctttgccggtatccgcaatcacggcattgcgcagtccgacatcgacgccgcctacgaggtgttcaaggcatttttcgcgctgcccgacgaggtcaagcgcagctaccacgtgcccggcagtggcggcgcgcgcggctataccgcgttcggtgtggaaaccgccaaggactccaagcatttcgatttgaaagagttctggcacatcggccgcgagatcccggacgattcgccgtaccgcgcggtgatggcgcccaatctgtggccgaccgaagtgccgggcttccgcgaacgtggctaccacctgtatcagcagttggatcagctgggctcgcgcgtgttgtcggcgctggcgctgcacatcggcctgccgcaggactacttcgccgacaagaccgatcacggcaattcgatcctgcgcccgatccattacccgccgatcaccagcgacgacatcccgaatgtacgcgccggtgcgcacggcgacatcaatttcatcaccttgctggtgggcgccagcgccgccggcctggaagtgcgttccaacgaaggcgagtgggtgccgttcactgcggacgccgacaccatcgtggtcaatatcggcgacatgctgcagcgcctgactaaccatgtgtacccgtccaccatccaccgcgtggtcaatccgccgggagaggaagcgcgcaagccgcgctattcggtgccgttcttcctgcacccgaacccggatttcctgatcgacgtgttgccgtcctgcatcagcgccgacaaccccagccgctatcccgagccgatcaccgcacacgggtttctggaagagcgcctg

SEQ ID NO: 39452 - DNA, 750 bp, Xanthomonas campestris; identical to SEQ ID NO: 39084

SEQ ID NO: 39453 - DNA, 1785 bp, Xanthomonas campestris
gtcaccgtcgagatcgacgggcagtcgctggtggtgccgaagggctcgatgatcatccaggccgccgacaaggccggcatcccgatcccgcgcttctgttaccacgagaagctgccgattgcggccaactgccgcatgtgcctggtcgatgttgaaaagtcgcccaagccgtcgcctgcctgcgccacgccggtgatggacggcatgaaggtcaccacgcgcagcgaaaaagcgctgaaatgacagcgaagcgtgatggaattcctgctgatcaaccacccgctggactgcccgatctgcgatcagggcggcgagtgcgaattgcaggacgtctcgcttggctacggccgttcggtgagccgcttcaatgagcgcaagcgcgtggtgccggacgaagacatcggcccgctggtggcgaccgagatgacccgctgcatccagtgcacgcgctgcgtgcgcttcaccgccgatatcgccggaacctacgagctgggcggtatgtatcgcggtgagaacctgcagatcggcacctacgacggcaagccgctgaccactgaaatttccggcaacgtcatcgacgtttgcccggtgggcgcgctgaccaacaaggtgttccagttccgtgcgcgtccgtgggaactgatggcacgtgaatcgctcggttatcacgatgcgatgggctccaacctgttcctgcacgtgcgtcgcggcgaagtgctgcgcaccgtgccgcgcgagaacgaagccgtcaacgagtgctggctgtccgatcgcgaccgttattcgcatcagggcctgtacgccgaagaccgtgcggtgaagccgctcaagaaggtcaacggtgaatggaccgaagtgagctgggccgaaggcctggccgctgcgacgcagatcctgcgcgataacgccggtgatcagctcggcgtgctggtgcacccggccacctcgaacgaagaaggcgccttgctggcgcgtctggccgagggcctgggcagcggcaacctggatcaccgcctgctcaaccgcgatttctccgacgccgctgttgccgaagcctttgccacgccgctggccgagatcgaacaggccgatgtcgtggtgctgttcggcaccaacgtgcgccatgagctgccgctgctgcatgcccgcctgcgcaaggcgagcatccagaaccgcacccagatccattcggtcaacccggtcgatttcgatttcgccttcacccaggccagccggacggtggtctcgccgactcagctggctggcgcgctggacgacgccacgctgcgtgatgcggtcaagggcgcaagccgcgccgtgatcgtggtcggcgcattggcagaaaatcatccgcaggcggcgacgctgcgtgcagcggcacgtgcctttgcagcggcaaccggtgcgtcgctgtgccggatcccgcagggcgccaacgcggtcggcctggtctcgcagggcgtgttgccgactgcgcggacagtcgccggcatgtttgccgagccgcgtcaggcgtatgtggtgtacggcatcgaacccggtctggattttgccgatgcggccgctgcgcgcagcgcgctggccggcgcgaaagtcgtggctttcagccagttcgcctgtgcatccacacgcgacgtggccgatgtgattttgccgatcggcgcactgccggaaatcgatgcgtcgctgaccaatctcgatggccgcgtgcagaccgcacgtgctgcgggtcggttgccggtcgaggcgcgtgagggctggcgcgtgctgcgcgcactgggtggt

SEQ ID NO: 39454 - DNA, 1122 bp, Xanthomonas campestris; identical to SEQ ID NO: 39086

SEQ ID NO: 39455 - DNA, 2487 bp, Xanthomonas campestris
gccacgctgccgtacaccgcgcgtgtgcatgccgaaaacctggtgcgccgcgccgatccgcaacacgtggacgcttatctgcggcagttgatcgagcgcaagcgcgacctggatttcccgtggttcccggcgcgcgtggtgtgtcacgacatccttgggcagaccgcattggtggatctagccggtttgcgtgatgccattgccgagcagggtggtgacccggcgcaggtcaatccggtggtgccggtgcagttgatcgtggatcactcgctggcggtggaatatgccggcttcgacaagcaggcctttgccaagaatcgtggcgtggaagaccgccgcaacgcagaccggtttcacttcatcgaatggaccaagcgggcattcgagaatgtggaagtgatcccgccgggcaacgggatcatgcatcagatcaatctggaaaaaatgtcgccggtgatctacgtgcaggacggcgtggcgtttccagatacctgcgtgggcaccgacagccacaccccgcacgtggatgcgttgggcgtgattgccgtaggcgttggtggcctggaagcggagaacgtgatgctcggccgcgcttcgtggatgcggctgccggacatcattggcgtggagttgctggggcggccggcgccgggtatcaccgccaccgatatcgtgctggcgctcaccgaattcctgcgccagcagcgcgtggtgggcgcgtacctggagttctacggtgcgggtgccagtgcgctgaccatcggcgaccgcgccaccatttccaacatgacgccggagttcggcgccaccgcggcgatgttctacatcgaccagcagacgctggactacctgcgcctgaccgggcgcgaagacacgcagattgcgctggtggaaacatatgcccgccagaccggcttgtgggccgacgatctggtcaccgcgcagtacgagcgcatgctgcagttcgatctgtccagcgtggtgcgcaacatggccggcccgtcgaacccgcacaagcgtgtggcgaccagcgagctggccagccgtggcattgccgctgcgtgggagcaggtgcccgggcagatgcccgatggtgcggtcatcatcgcggcgattacctcgtgcaccaatacctccaatccgcgcaacgtcatcgccgctggcttgctggcgcgcaatgcgaatgcgcgcggtcttacgcgcaaaccatgggtgaaaagttcgctggcacctggctccaaggcggtgcagctgtacctggaagaggccggcttgcttggcgagctggagcagctgggcttcggcatcgtggcgttcgcttgcaccacctgcaacggcatgagcggcgcgctggacccggtgatccagcaggaaatcatcgagcgcgacctgtatgccaccgcggtgttgtcgggcaaccgcaatttcgatggacggatccacccgtacgcgaagcaggcttttctcgcatcgccgccgttggtgattgcctatgccatcgccggcacggtgcgcttcgatatcgagaaggatgtcctgggcgtggatgccgagggtgtgccggtcacgctcaaggacctgtggcccagcgatgcggagatcgatgcggtggtcgcgcgcagcgtgaagccggagcatttccgcagcgtgtacgagccgatgttcaggcgcagtggcctgcagggtgcacgcgtcagcccgttgtacgactggcgcgcgcagagtacctacatccgccgcccgccgtattgggagggcgcgctggcaggtgcgcgcaccttgcagggcatgcgcccgctggcggtgttgggcgacaacatcaccaccgatcatctgtcgccgtccaatgcgattcttgccagcagtgcggccggtgaatacctcacccagatgggcgtgccggaagaagacttcaattcctacgccacccaccgcggcgaccatctcaccgcgcagcgggcgacctttgccaaccccaagctggtgaacgaaatggcagtggtcgatggccaggtcacggccggttcgctggcgcggctggagccggaagggcaggtgctgcgcatgtgggaggcgatcgaaacctacatgcagcgcaagcagccgctgatcatcattgccggtgccgattacgggcaaggctcgtcgcgcgattgggcggccaagggcgtgcggctggccggtgtggaggcgatcgtggccgaaggcttcgagcggattcaccgtaccaacctgatcggcatgggcgtgttgccgctggagttcaagccggggaccgaccgcaagatgctgggtatcgatggcagcgagacgttcgatgtggtcggcgaacgcaccccgggcgcaacgctgacgctgtcggtgcatcgacgcgacggcgagcagctgcaggtgccggtgacctgccgcctggataccgcagaagaagtgtcgatctacgaggcgggcggcgtgctgcagcggtttgcacaggattttctggaagca

SEQ ID NO: 39456 - DNA, 834 bp, Xanthomonas campestris
gcccgcctccttgatggtcgccgcattgccgaggaattgctcgacggtctgaagctgcgcgtggatgcgcgcttggcggcgggcaagacccggcccgggctggcggtggtgctggtgggcggcgatccggcctcgtcggtgtatgtgcgcaacaagcgccgtgcggccgaaaaagtgggcatcgaggccttcgactacgacctgccacaaggcaccaccgaagccgagctggccgcgttgatcgaccaactcaacaccgatcccaagatccacggcatcctgatccagttgccgctgccgggcattcccgatgccaaccggttgatccagcgcatcgacccgcgcaaggacgtggacgggttccatccgcagaacgtcgggcatctggcgctgcgcgaattcggtttgcggccgtgtaccccgcgcggcatcgtgaccttgctggcgcataccgaccagccggtgcgcgggcgcaacgccaccatcgtcggggtgagttaccatgtgggccgcccgatggggctggagctgctgattgccgggtgcacggtgaccagctgccacaagttcaccccgccggatgtgctggaagccagcgtgcgcaacgccgacatcctggtggtggcggtgggccggccggggctgattccgggcgaatgggtcaagcctggcgcggtggtcatcgacgtgggcatcaaccgcctggacgatggacgcctggtcggcgatgtggggttcgaggccgcagcgcagcgcgccggctggatcaccccggtgccgggcggggtggggccgatgacggtggccacgctgatgcagaacacgctcgaggcg

SEQ ID NO: 39457 - DNA, 990 bp, Xanthomonas campestris; identical to SEQ ID NO: 39089

SEQ ID NO: 39458 - DNA, 828 bp, Xanthomonas campestris
agtcttgtcacttccctgacctacgtgctgccgcatcggctgctgtcctcgctggcacgcgccctggcgtattccaagacgccggcgaccaaacagtggttgatcgacacggtcacgcgcaagtttggcgtggatctgagcgaagcccaggagccggatccgcacgcctaccccaccttcaatgcatttttcacccgcgcgctgaagcccggcgcgcgcgtgcccgacgccgacccgcaggcgctgttgatgccggcggacgggcgcatcagccagctcgggccgatcgagaacgggcgcatcttccaggccaagggccaatcgttcacggctgcggaactgctcggcgatgagtccgccgccgtgcccttccacaatggcctgttcgccacggtgtatctgtcgcccaaggactatcaccgcgtgcacatgccgtggagcggcaccttgcgcgaaaccgtgcatgtgcctggccggcttttcagtgttggccccgatgcagtgcgcaacgtgccgcggctgttcgcccgcaacgaacgcctggtgtgccacttcgataccgacttcggcccgatggcctcggtgatggtgggcgcgctgctggtgtccggcgtggaaaccgtctggagcggtgtggagatcccgcgctacggcgaccgcatcacgcgcaaggattaccgcggcaaggggatcacgctggagcgctttgcggagatggcgcgcttcaattatggatcgacggtcatcgtcttgctgccgccgggcgttgccgcgcttgaaggcgggctggctgcggaatcgtcggtgcggctgggacaggcgctggca

SEQ ID NO: 39459 - DNA, 1096 bp, Xanthomonas campestris
gatgccgtcatgggcagtaacagttttggccgcttgttcacggtcaccactttcggcgaatcacatgggccggcgatcggctgcatcatcgacggttgccctcccggcctggagatcgcgccggaagagttcacccacgacctgcagcggcgtgccaccggcaagagccggcatacctccgcgcgccgcgaggccgacgagatcgagatcctctccggcgtctacgagggccgcaccaccggcacgccgatcgggctgctgatccgcaacaccgatcagcgcagcaaggactacaccaacatcgcccagcagttccgccccgggcatgccgattacacctattggcagaaatacggcatccgcgacccgcgcggtggcgggcgctcgtccgcgcgcgaaaccaccatgcgcgtggccgccggcgtgatcgccaagaagtggctcaagcagcgctacggcgtgctggtgcgcggtttcctgtcgcagctgggcgagatccgcccgaccgggttcgattgggatgcggtggaagacaacccgttcttctggccgcatgcggcgcaggtgccggagctggaaacctatatggatgcgctgcgcaagtccggtgactcggtcggtgcgcgcgtggacgtggtggccggtggcgtgccgccgggctggggcgagccgatctacggcaagctggattccgaactggccgccgcgctgatgagcatcaatgcggtcaagggcgtggagattggcgatggcttctgccagtgccgcgcagaagggcaccgaacaccgcgacctgatcacccccgaaggcttcctcagcaatcacgccggcggcattcttggcggcatctccaccgggcaggcggtcaccgcctcgatggtgctcaagccgacctccagcctgcggctgcccggtgccaccgtggatgccgacggtgccgtggtggatgtcatcaccaccgggcgccacgacccgtgcgtgggcatccgtgccacgccgatcgccgaggccatgatggcgctggtattgatggaccaggccttgcgccaccgcgcccaatgcggcgacgtgggcgaggtgtcgccgctgattccc

SEQ ID NO: 39460 - DNA, 1008 bp, Xanthomonas campestris
acccgtcgtttcaacgtcgccgtcgtgggcgccaccggcgctgtcggtgaaaccatgttgagcatcctggccgaacgtcagttcccggtcgccaccttgtatgcactggcatcggcgcgctcggcgggcgggcaggtcgagttcaacggcggcaaggtcgacgtgctggacctggccgagttcgaccccaccggtgtggatatcgcgctgttttccgcaggcggcagtgtctccaaggaatacggccccaagttcgctgcggccggtgcggtggtgatcgataattcctcggcgttccgctacgacgacgatgtgccgctggtggtgtccgaggtcaaccccgaagcgctgaagcagcgcccgcgcgggatcattgccaaccccaattgctcgaccatgcagatgctggtggcgctgggcccgatccaccgcaagtacggcatcgagcgcatcaatgtggcgacctatcagtcggtgtccggcggcggccgttcggcgatggaggagctgggcaagcagaccagcgaattgctgagcttccagcagatcgacccgcagcgcttcccggtgcagatcgccttcaacctgattccgcacatcgacgatttccaggacaacggttacaccaaggaagagatgaagctggtctgggagacccgcaagatcctcggcgacgaaaacatccaggtgaatcccactgcggtgcgcgtaccggtgttctacgggcattcggaagcggtggccatcgagacccgcgaaaagatcaccgtggccgaagcccgcgccttgctggcagcctcgccgggcgtggaagtggtggacgagcacaaggccggcggctacccgaccccggtgacgcatgcctccggccaggatgcggtattcgttggccgcatccgcgaggatctctcgcacccgtgcggcctgaatctgtggatcgtctccgacaatatccgcaagggcgccgcactcaatgccgtgcagctggccgaattggtcgcacaggaa

SEQ ID NO: 39461 - DNA, 618 bp, Xanthomonas campestris
cgcatcaagttctgtggcatgacccgcgccggcgacatccggctcgccggcgagctgggtgtggacgcggtgggtttcatcttcgcccatggcagcccgcgccgcgtggccccggccgaggcgcgcgccatgcgccaggccaccgcgccgatggtcgatgtggtggcgttgttccgcaacaactccaaggaagaagtgcgcgaagtggtgcgcaccgtgcgtcccaccttgctgcagttccatggcgaagaagacgacgccttctgccgcagcttcaatctgccgtatctcaaggcggtgccgatgggcgcttccggcgtgaatggcgaagacgccaacgcgcggaccctgcagctcgcctatcccaatacggccggcttcctgttcgacagccatgcgccgggcgagggcggcgggaccggcaagaccttcgactggtcgcgcctgcccaccggcctgcatcgcccgttcctgctggctggcggcatcaccgccgacaacgtcttcgacgcgatcgtggcgaccctgccgtggggcgtggacgtgtccagcggcgtggagcttgcgccgggcatcaaggacggccacaagatgcgcaagttcgtcgaagaagtgcgc

SEQ ID NO: 39462 - DNA, 1458 bp, Xanthomonas campestris
atgcacaactacgtggtgcgccagagtctggcgttcttccacaacgattttgccgggcgtatcgccaaccgcgtgatgcagaccggcacctcgctgcgcgaatcggcggtgcagatggtcgatgcactctggtacatcgtggtctataccggcagcgcactgtggttgttcgcgcaggccgacccgtggttgatggtgccgctgctgtgttggctggtggtgtatgtggggttgatggcgttcttcgtgccgcgcatgaaggcgcgtgcgtgggtggcatcggacgcgcgctccaaggccaccggccgcatcgtggacggctacaccaatatcgccacgctcaagctgttttcgcatgcgcgccgcgaagaggcctacgtgcgcgatgcgatcgacgagctggcggtcaagcatcgcctgcagacgcgcgtgaccaccgcaatggacaccgccatcgccatcgccaacggcttcctgatcgtgggcacctgtgggctggcgttgtggctgtggagccgcggccagatcagcgtgggcgccattacgctggccaccgggctggtgatccgcatccacaacatgtccggctggatcatgtggacggtgaacggcattttcgaagacatcggtagcgtgcaggacggcatgcagaccattgcccagcccctgacggtgcaggaccagcccaccgcgctgccgctgcaggtgacacgcggcgccgtgcatttcgaccagatccacttccattatggcaagcgcggcggtgtgatcgccgggctcgacctgcgggtgcgcgccggcgaaaagatcggtctggtggggccctccggcgcaggcaagtcgacgctggtcaacgtgctgctgcgcctgtacgacctggagcaggggcgcatcctgatcgatggccaggacatcgcccaggtcacgcaggaaagcctgcgcgggcagatcggcctggtcacgcaggacacctcgctgctgcaccgttccattcgcgacaacctgctgtacggccgcccgcaggccaccgaggcgcaactgctggacgcagtgcacaaggcgcgtgcggatggctttatcgacacgctggtggatggcgaaggccgccgcggtttcgatgcacatgtgggcgaacgcggggtcaagttgtcgggtggccagcgccagcgcatcgccatcgcacgcgtgctgctgaaagacgcgccgatcctgatcctggacgaagccacctcggcgctggattcggaagtggaagcggccatccaggacagcctggatgcgttgatgagtgacaagaccgtcattgcgatcgcgcatcggctctccaccatcgcgcgcatggatcgcctggtggtgatggatggtgggcgcatcgtcgagacaggcacgcatgcggaactgatcgcgcacggcggcctgtacgcccggctatgggcgcggcagaccggtgggtttgtt

SEQ ID NO: 39463 - DNA, 1032 bp, Xanthomonas campestris
gatgacctgcgtatccgcaagatcgaaccgttgaccccgccctcgcagctgctgtcgctgctgccctgcgatgagcgcgcctccgagaccgtcaccaacgcacgtgccgccttgcacgagattctgcacgggcgcgacgaccgcctggcggtggtgatcggcccctgttcgatccacgaacccgtggccgcgatggagtacgcgcagcgtctgcgccccttgcgtgagcagtttggggatgcgctggaaatcgtgatgcgcgtgtacttcgaaaagccgcgcaccaccatcggctggaagggcctgatcaacgacccggacctggatggcagtttccagatcaacaagggcctgcgcgtggcgcgtggcttgctgcgcgatatcaataacctcggcctgccggctggcgtggaatttctcgacatcatctcgccgcagtacatcgccgacctggtggcctggggcgcgatcggcgcgcggaccaccgaaagccaggtgcatcgcgaaatggcctccggcctgtcgtgcccagtggggttcaagaacggcaccggtggcgacgtcaagattgccgtggacgcggtgggtgcggcctcgcacccgcaccatttcctggcggtgaccaaggatggccacaccgcggtggcggccaccgcgggcaacccggattgccatgtgattttgcgcggcggcaagcagcccaacttcgacgcggctaatgtggaagcatccagccaggtgctcaacaaggccgggttgccggcgcggctgatgatcgacgccagccacgccaacagcggcaagaacccggacaaccagccgaaggtcatcgacgacattgccacgcagttggagggcggcgagacgcgcatcgttggcgtgatggtggaaagccacctggtcggcggccggcaggaactggtgccgggcggcacgctgacctacggccagagcatcaccgacggttgcctggattgggacacctcgcttcaggtgctggagcgcctggcgagtgcggtgcgtgcacgtcgt

SEQ ID NO: 39464 - DNA, 810 bp, Xanthomonas campestris
ggcgatgcgcgcctgctcaccctgtacgaccaggccacctggagcgaaggccccacctggtgggaggcccagcgcacgctggtgtggagcgacctggttggccgccgcgtgctggggtggcgcgaagacggcgccgtggatgtgttgctggatgccaccgccttcaccaatggcaacgcggtggatgcgcagcagcgcctggtgcactgcgaacacggccggcgcgccatcacccgcagcgatgccgatggccaggcccacctgctggtgggccgttatgccggcaagcggctcaactcgcccaatgacctgatcgtggcgcgcgatggcgcgatctggttcaccgacccgccgttcggcctgcgcaagcccagccagggctgcccggccgatccggagctcgcccaccacagcgtgtaccggctgccgccggacggcggcccgctgcagcgcatggccgacctggaccaccccaacgggctggcgttctcgcccgacgagcagaccttgtacgtctcgcagacgccggagcagggacacggcagcgtggaaatcaccgcgtttgcctggcgcgatggcgcgctgcacgaccgccgccacttcgccagcgtcccggacgggctgccggatggcttctgtgtggatcgcggcggctggctatggagcagctccggcaccggcgtgtgcgtattcgacagcgacgggcaactgctcgggcacatccccaccccgggcaccgcctccaactgcaccttcgaccaggcacagcagcggctgttcatcaccggcgggccgtgtctgtggatgctg

SEQ ID NO: 39465 - DNA, 1323 bp, Xanthomonas campestris
ctggatgcacgcaatctgcgcctggccacccgtctgggcgggctgggactggacccggccgccggccgcaccctgatccgcgaaggcatcctgcgccgcgcggtgggcctgaccctggaagccaccggttgcgaagcgccgatgggcgccacctgcaaggtggaagtcgatggcggctgggtcgacgccgaagtggtcggtttttccggcgaacgcacctatctgatgcccagcgccgaactgcacggcctgctgcccaacgcccgtgtggtgccctcgcggcgccgcggcggcgtggaagtgggcgaaggcctgcttggccgcgtcatcgacagcgacggcaccccgctggatggcaagggcccgatccgcgccgaaggcagcgtgggcatggccggcgtgtcgatcaacccgctggcgcgcgaacccatcaccacctcgctggacgtgggcgtgcgcgccatcaacgcgatgctgccgatcggccgcggccagcgcgtgggtctgttcgccggctccggcgtcggtaaatcgacgctgctcggcatgatgacccgcttcacctccgccgacgtcatcgtggtggggctgatcggcgaacgtggccgcgaagtgcgcgacttcgtcgaaaccaccctgggcgaggaaggtctgcgccgtgccgtggtcgtggccgccccggccgaccgcccgccgctggcccgcctgcacggcgcctaccgcgccaccgcgattgccgaatggttccgcgaccagggcctgaacgtgctgctgctgatggattcgctgacccgttttgcgcaggcccagcgcgagatcggcctgtcggtcggcgagccgcccaccacccgcggctacccaccgtcggtgttcgccaaattgccggcgctggtggaacgtgccggcaacggcgccaagggccgcggctcgatcaccgccttctacaccgtactgaccgagggcgacgacccgcaggacccgatcgccgacgccgcgcgcgccattctcgacggccacatcctgctctcgcgccgggttgccgacagcggcctgtacccggccatcgacctggaatcctcggtcagccgcgtggtgcaggacattgccgacgacacctggcgcctgcgcatccgcaagctcaagcgcctgctgtcggcctacaccgccaaccgcgacctgatcgccatcggcgcctaccagcgcggcagcgacccggccaccgacgaagcgttggcgcgttggccggaaattgtcgacttccttggccaggacgtgcacaaggcgtccgatctgaccgacagcctgtccgcgctgcagcggctg

SEQ ID NO: 39466 - DNA, 3480 bp, Xanthomonas campestris
atgggtctttccacgatcaagctgtccggttccaagtcgtttggtcgaacccgaccacgttgcacctgccccaccaacatgaccggcatcgtcggccccaatggctgcggcaagtccaacatcatcgatccggtgcgctgggtgatggcccaaagctcggccagccgtctgcgcggcgactcgctgaccgacgtgatcttctccggctcctcggcgcgcaagccggtgtcgcaggcgacggtggagctgatcttcgataactccgatcacaccatctccggcgagttcgcctcgttcaacgagatctcggtcaagcgcctggtcagccgcgacggcaccagcgcctattacctcaacggcaccaagtgccggcgccgcgacatcaccgacctgttcctgggcactggtctggggccacgcagctactcgatcatcgagcagggcatgatcagccagatcatcgaggcgcgcccggaagatctgcgcgtctacttggaagaagccgccggcatttccaagtacaaggaacgccgcaaggaaaccgaaacgcgcatccgccatacgcgcgaaaacctcgatcgcctgggtgacctgcgcgaggaaatcaccaagcagctggcgcatctgcagcgccaggcgcggcaggccgagcagtaccaggcgttacaggaagaacgccgcatcaaggatgcggagtggaaggcgctggaataccgcggcctggatggccggctgcaaggcctgcgtgaaaagttgaatcaggaagaaacccgcctgcagcagttgatcgccgagcagcgcgatgccgaagcgcgcatcgaaaccggccgtgtgcgccgcgaagaggccgccgaagcggtggccaaggcgcaggccgatgtctaccaggtcggtggcgcactggcgcgtatcgagcagcagatccagcaccagcgcgaactctcgcatcgcctgcacaaggcgcgcgacgaagcgcagagccagctgcaggagctcacccagcacatcagcggcgactccgccaagctggcggtgttgcgcgaggcggtggccgatgccgaaccgcagctggagcaattgcgcgaagatcacgaattccgccaggacgcactgcgcgaggccgaagcccgcctggccgactggcagcagcgctgggaaacccataaccgcgacaccggcgaagcctcgcgcgccggcgaagtggagcgcacccgcgtcgattatctggaccggcaatcgctggaagccgaccgtcgccgcgaggcgctggtcaacgaacgcgccgggctggatctggatgcgttagccgaagcgttcgaacagatcgaactgcggcatgaaacgcaaaaggcctcgctggacgggctgaccgagcaggtcgaagcgcgcaagcacgcgctgggtggcttgcaggaacagcaacgcgccagccagggcgaactggccgaagtccgcaagcaggcgcaggccgcacgcggccggctgtcgtcattggaaacgctgcagcaggcagcgctgggtcaggagcagggcgccgccgtggcctggctcaaggcgcgcgggctggattcggccgtgcgtgtgggcgagcgcatcagcgtggaaagcggctgggaaaacgcggtggaaggcgcgttgggccagctgatcgaaggcgtgctggtggaggcgccggaacaactggtcgacgcgctgggtgagttgggcgacgggcgcatcgcgctggtgtcgtcggctaccgacaacgtgcagttcgcgccgacctcgcttgccgccaaggtgcaggggccgattgcgatccgccgcttgctggcgcgcctgcatgccgccgaagacctggatgccgcgcgcagcctgcagtgcaacctgccggacggcgattcggtgatcacccgcagcggcgagcggctgggcgagggctgggtgcgcgtgtcgcgctccggcgcggccaagcagggcgcgttgctgcgcgagcgcgagatccaggagctgcgctcgcagatcgacacgctgcaggagcgggagggcgacctggaagaacaactggccagcttccgcgagcaactgctggccgccgaacaacagcgcgaagacgcgcagcgccagctgtacatggcgcaccgcagcgtgtccgaactggccggccagctgcagagccagcagggcaaggtggacgcggcacgtgggcgcatcgagcggatcgaggccgaattagggcagttgctggaaaccctggacaccagccgcgagcaggcccgcgaagcgcgcgccaaactcgaggacgcggtggtgcgcatgggcgacctgcaaggcacccgcgaagcgctggaaagcgaacgccgccagcttaccgatgcacgcgaccaggcccgcgatgccgcgcgcggcgtacgcgatgcgatgcacgccttggcactcacgctggaatcccagcgcacccagatcacctcgctgagccagaccctggagcgcatggacagccagcgtggccagctcgacacgcgcctggaagatctggtggcgcagctgagcgaaggcgattctccggtcgaaacgcttgaacacgaacatcaggcagccttgagcgagcgcgtgcgcaccgagcgcgtgctcggcgaggcgcgcaccatgctggacagcatcgacggcgaactgcgcagcttcgaacagacccgccagcagcgcgacgagcaggctctggcgcagcgcgagcgcatctcccagcgcaagctcgaccagcaggcgctggtgctcaacgccgaacaactggccgccgcggtggtcaaggccggcttcgtgctcgaagacgtggtcaatgggttggaggaggccgccaacccggccgagtgggacgcggcggtggggcagatcgatgcccgcatgcgccggctggagccggtcaacctggccgcgatccaggaatacggcgaagccgctcagcgttccgagtatctggacgcgcagaacgtggacctgacgaccgcactggaaacgctcgaagaagcgatccgcaagatcgaccgcgaaacccgtggccgcttcaaggacactttcgaccgcgtcaactcgggtgtgcaggccttgtatccgcgcttgttcggcggtgggcacgcgtatctggagctcaccggcgaagatctgctcgacaccggcgtgaccatcatggcgcgcccgccgggcaagcgcgtgtcgagcatttcgctgctgtccggtggcgaaaaggcgatgaccgcggtggcgctggtatttgcgatcttccagctcaacccggcgccgttctgcctgctcgatgaggtggacgcaccgctggacgaggccaacgtcggccgcctggccaacatggtcaaggagatgagcgagaaggtgcagttcctgttcgtcagccacaacaaggcgaccatggaagcagcgcgtcagctctccggcgtgaccatgcgcgaacccggcgtcagtcgcctggtgagcgtggacctggaagag

SEQ ID NO: 39467 - DNA, 933 bp, Xanthomonas campestris
gtgtacctcaacttcaacgagcatcccaccgggctgtcgccggctgcactggatgcggcaagccgctcgctggcgcgctcgggccgctatctgttcgaaatggaacaggacctgcgcaacctgatggccggcgaactgcagctgccgcacgaccaccttgcgttctttcccggctccagcgacccgctcaaccgcgccggcaccttgttcacgtcaccgcgcgccggcttggtcatggccgacccgaccttcgaagcactggccgacctggccgccgcgcaaggcgtgccggtccgcaaagtgccgctgcgtgccgacggcgcgcatgacgtcaaggccatggccaaggccgacccgagcgccgggctgatctatctgtgcaaccccaacaacccgaccggctcgattaccccgcgcgcggagatcgaatggctgctcgccaacaaacccgccagcgccgtgctggtggtggacgaagcctacatccactacagcaccgagccatcggtggccgatctggtgcgccagcgccaggacctgatcgtgttgcgcacgttttccaagctctacggcatggccggcatgcggctgggtgccgcactcgcccccccgggtctgctgaccaagctggccagcctgggtggcaacccgctgcccgtcccggcgatggccgcgggcattgccagcctgcgcgatccgatgctggtgcccagccgccgcgccgacaacgcccgtgtccgcgacgacaccatcgcctggctgaaatccaagggctacacctgcctgccatcgcaggccaattgcttcatggtcgacgtcaagcgcgacggcaaggtgttcgccgactcgatgcagaagcagggcgtcatcgtcggccgcagctggccgatctggcccaagcgggtgcgtgtcaccgtgggcagcgaggcagaa

SEQ ID NO: 39468 - DNA, 2394 bp, Xanthomonas campestris; identical to SEQ ID NO: 39100

SEQ ID NO: 39469 - DNA, 1521 bp, Xanthomonas campestris; identical to SEQ ID NO: 39101

SEQ ID NO: 39470 - DNA, 1083 bp, Xanthomonas campestris
atgacacgcgcgttcaatttcagtgccggccctgcgacattgccggaatcggtcctgcggcaagcgcaggaagagatggtcgagtggaacggcgtgggtgcctcgatcgtggaaataagccaccgcagcgccgacttcatggcggtggccgccgccgccgaggcggacttgcgcacgctgttgtcaattcccgacgactacgcggtgctgttcacctccggtggtgcgaccaccatccaggcgctgttgccgctgaatttcgccgcgcctggccaggcagtcgattacgtagtcagtggccattggggcaagaccgcgatcaagcaggccacgccgtatgtggacgtgcgcgtggccgccgatggccagcccggcggttatgtcgacatcccgccggtcgcgagctggacgctgtcgccgcacgccgcgtacgtgcacatcactgccaacgaaaccattcacggggtcgagttccgcgacacgccggacgtgggcaccttgccgctgttcgccgacttcagttcgtcgatcgcctccgagccgctggacatcaggcgctatggcctgatctatgccggggcgcagaagaatctgggcccggtgggtatttcggtggtgatcgtgcgccgcgaattgctcgagcgtgccggccaaccgcgtgcagacatcttcaattacgcctcgcacgtggcgcgcgattcgatgctcaacacgccgcccacctggaactggtatctgctcgggctcaccgtcaaatggatgctcgagcagggtggggtggccgcattcgcgcagcgcaatgccgaaaaggccgcgttggtgtatggcgcaatcgatggctccggtggcttctatcgcaaccaggtgatgccgacggtgcgttcgcgcatgaatatcccgtttttcctgggcgatgagcagctcgatgcgttgttcgtcagcgagtccaaagcggccggcttgctcgcgctgaaggggcacaaggccgtgggcggtatccgcgcttcgctgtacaacgccatgccggtggccggtgcacaggcactggtggccttcatgcacgatttccagcagcgccacggc

SEQ ID NO: 39471 - DNA, 345 bp, Xanthomonas campestris
atcttcaaagtatttacgctcgaggccgcccaccggctgcccaacgttccgccgggccataagtgcgcacggctgcatgggcattcgttccgggtcgagctgcatgtcagcggcgaaccgggtgccgagaccggctggatcatggacttcggcgacatcaaggctgccttccagccgatctacgaccggctcgatcaccactacctcaatgacatcgaggggcttgaaaaccccaccagcgaacgcctggccatctggatctggcagcagctcaagccggccttgccgcagttgagcgaaatcgtggtgcacgagacctgcacttccggctgccgctatcgcggt

SEQ ID NO: 39472 - DNA, 1203 bp, Xanthomonas campestris
atgcgccgtgttgtcgtcaccggaatgggcatcaattcgtgcctgggcaatgacctggacacggtctccagcgcgctgcgcgaaagccgctcgggcatcaccgcattacccgaccatgccgaagcgggtctgcgcagccaggtgggcggcgcggtggacatcgacctggacggattgatcgaccgcaagctcaagcgcttcatgggcgatgcctcggcctacgcctacctggcgatgcgcgatgccattgccgatgccggcctgtcgcccgagcaggtcagcgacctgcgcaccggcgtgattgccggctccggcggcggctccagccagtggcaggtggaaacggccgatctgctgcgcgcacgcggcgtgcgcaaggtaggcccgtacatggtgccgcgcacgatgtgttcggcagtctcggcctcgctggccactgccttcaagatccgcggcctgagctattcgttgtcggccgcctgcgcgacctcggcgcattgcattggcgcggctgcggatctgatccggcatggtgcgcaggatgtgatgtttgccggcggcggcgaagaactgcactggaccatgagcgtgatgttcgatgcgatgggcgcgttgtccaccggcttcaacgatcgcccggcggtggcctcgcgtccctacgatgcgcaacgcgatgggttcgtcatcggcagcggcggtggcatgttggtgctggaagactacgaccacgccatcgcgcgcggcgcccgcatccatgccgaactgctgggctacggcgtgacctccgatggcgcggacatggtcgcgcccagtggcgagggcgcggtgcgctgcatgcacatggcgatgcaagggctggatcgcccgatcgactatctcaacacgcacggcacctccaccccgctgggcgatgccaccgagctgggcgcggtgcgcgaggtgttcggcgacaacgtgccaccgctgtcctcgaccaaggcgttgtccggtcattcgctgggtgcggcaagcgtgcacgaggcgatctacagcatgctgatgctgcgcgatggcttcatggccggctcggcgcatatcgacgaactcgacccgcgcgcggaaggcttcccgatcctgcgcgctacacgcgaggcgacgttgaacacggtgatgtccaacagcttcggcttcggcggcaccaacggcgtgctggtgttcggccgg

SEQ ID NO: 39473 - DNA, 2022 bp, Xanthomonas campestris
atgaccaacccgctgctcgatttttccggactgccgtccttcgatacgatccgccccgaccatgtgggcccggcgatcgatcagctgctggccgatgccgaggcagcggtgaaggcggccgaacaggtcagcccggtcagctgggacagtttcgtggtgccgctggatgatgccaccgagcgcctgtggcgcgcctggggccaggtcggccacctgcaggcggtgatgaatactcccgagctgcgcgaggcctacaatagcaatctgcccaaggtcagccgcttcggcagtgcactggcgcagaacctggccctgtacgcgcaatacaaggcgctggccgcctcgccggaagctgcgcactacgacgaagcccggcgcaaggtgctcgacaacgcgctgcgcgatttccgcctgggcggcgccgaactggacgacgcctccaaggcgcgctttgcacagatccaggaagagttgtccggcctggccgccaagttttcgcagaacgtgctcgacgccaccgacgcgtgggcacacgtgacgcaggacgagacccagttgtcgggcttgccgtccgaagtggttgccgccgcacgcgcggcagcggaaaaggatggggctgccggctggaaattcaccttgcagatgccgtgctacctgccggtgcagagcgatgccgacagccgcgaactgcgcgcgcggttgtaccgcgccaatgccgagcgcgcctccgaattcggcgatgtcgcgctggacaacagcgccaccatccagcgcatcctggcgctgcgcgccgagctggcacagctgctgggctttgccagctacgcggactattccatcgccaccaagatggcgcaaagcccggatgaagtgatgggctttctgcgtgatctggccgtgcgtgccaagccgtatgcacaacaggatcgtgccgaactggaagcctttgcgcgcgacgaactcggcctggagcagctggaagcctgggacctggcgtatgccggcgaaaagctcaagcaggcgcgctacagcttctccgagcaggaagtgaagcagtacttcaccgagcccaaggtgctggctggcctgttcgatgtgatccatagcctgtacggcctgactgtcaaacccgatagcgcgccggtctggcacccggacgtgcgcttctatcggctggaagatgcgcagggcgcactggtggggcagttctatctggatctgtacgcgcgcgagggcaagcgcggtggtgcatggatggacgactgccgcaatcgccgcgagaccagtcagggtgtgcagacgccgctggtgtatctggtgtgcaatttcggccgtggcagcggcgatgcgccggccacattccggcacggcgaagtcaccacgctgttccatgaaatgggccacggcctgcatcagttgctcacccgtatcggcgagctcggggtggccggcatcaacggcgtggaatgggatgcagtggagctgcccagccagttcatggagaacttctgctgggaatgggagcgcgtgcaggcgatgaccgcgcacgtgcaaaccggcgagccgctgccgcgcaatctgttcgaccggctgctggccgcgcgcaatttccagagcggcatgttcaccgtgcgtcagctggaattcgcgttgttcgacatgcaattgcacagcagtttcgatccggcccaggacagcgtgctggagttgatcgagcgcgtgcgcgacgaagtggcggtgaatcgcccgccgacgtggaatcgcttcccgcatcagttcagccacatttttgcgggcggctacgcggccgggtattacagctacaagtgggccgaggtcctcagcgccgatgcctacgcggcgttcgaagaagcgcccgagcaggtggccgacaccggcgcgcggttccggcatgaagtgctggcgcgtggtggcagccgcagcgcagcggacaacttccgcgccttccgtggacgcgcgcccaagatcgacgcgctgctgcggcacaacggcatggcgggc

SEQ ID NO: 39474 - DNA, 1875 bp, Xanthomonas campestris
atgagcgattggtccctcgaccaagcccgcaagacctactcgatcccgcattgggccgatgggtatttcgatgtgaacgacgccggccatgtggtggtcaaaccgaccgccgacggccctgcggtgtcgctgcccgaagtggtggatgccgcgcgtgcggccggcgccaagctgccgctgctggtgcgcttcccggacatcctgggccagcgcctgggcaagctgcaggcggcgttcgcccaggcccaggccgattgggattacgccggtggttacaccgcggtgtacccgatcaaggtcaaccagcaccgtggcgtggccggcacgctggccagccaccacggcgagggcttcggcctggaagcgggcagcaagcccgagctgatggcggtgctggcactgtcgcgtccgggtgggctgatcgtctgcaacggctacaaggatcgcgagtacatccgcctggcgctgatcgggcgcaagctcggcctgcagaccttcatcgtcatcgaaaagccctccgagctgaacctggtgctggaagaggcgcgcgcgctggacgtcaagccgggcctgggcgtgcgcatgcggctggcgtcgctgggcgcgggcaagtggcagaacagcggtggcgacaaggccaagttcgggctgtcgccgcgccaggtgctggacctgtggaagtcgctgcgcgacaccgaatacgccgatagcctgaacctgctgcatttccatatgggctcgcagatttccaacgtgcgcgacatcgccaacggcatgcgcgaggccacccggtatttcgtggaactctcgcgcctgggcgcgaagatcagccatgtggatgtcggcggcggcttgggcatcgactacgaaggcacgcgttcgcgcagctattgctcgatcaattacggcctgcattcgtacgccagcaacatcgtgcagccgctggccagtgcctgcgaagagcacggcctgccgccgccgcgcatcgtcaccgaatgcggccgcgcgatgactgcgcaccacgcggtgctgatcgccaacgtctcggaagtggagcaggcgccggaaggccgtgtgccggatgcgcacgacgacgagccggcggcgatccgtcacctgcgcgagatccacgacgagctcgatgtgcgcccggcggtggaactgttccaggaagcgcagcacttccatgccgaagggctgagcgcctacgcgctgggccagatcgacctgacccaccgtgcgcgcatcgacgacctgttctacgccatcgcccacggcgtgcgtgcgcgcctgagcttcgacgaaaagagccatcgcccggtgctggacgagctcaacgagcggctggtggacaaatacttcgtcaacttcagcgtgttcgaatcgattccggatgtgtgggcgatcgatcaggtcttcccgatcgtgccgatcgagcgcctgaacgaggccccgcagcggcgcggcatcatcgccgacatgacctgcgattccgacggcatggtcaagacctacgtcgagaacgaaagcctggacagctcgctgccattgcatggcttgaaccccggcgagagctatcgcattggcttcttcctggtgggtgcctaccaggaaatcctgggcgacatccataacctgttcggcgacaccgatgcggtggaagttgcggtggatggcaccggctaccgcatcgcgcagcagcgtcgcggcgataccaccgacgtgatgctcgactacgtgggctatcagctggacactctgcgtgccacctatgccgaacgtatcgccgcggcacagctgccgcccgagcgcgcgcaggaagtgcacgacgcgctggaagccggcctgaccggctacacctatctgtccgacgaa

SEQ ID NO: 39475 - DNA, 1827 bp, Xanthomonas campestris; identical to SEQ ID NO: 39107

SEQ ID NO: 39476 - DNA, 1533 bp, Xanthomonas campestris; identical to SEQ ID NO: 39108

SEQ ID NO: 39477 - DNA, 861 bp, Xanthomonas campestris; identical to SEQ ID NO: 39109

SEQ ID NO: 39478 - DNA, 1392 bp, Xanthomonas campestris; identical to SEQ ID NO: 39110

SEQ ID NO: 39479 - DNA, 1827 bp, Xanthomonas campestris; identical to SEQ ID NO: 39111

SEQ ID NO: 39480 - DNA, 1173 bp, Xanthomonas campestris
gtcgccatcaccgccttcaccgccaccaccgcgctcggcgccggattggacgcccaggccagcgcgctgcgcgagcgccgcagcggcatgcgccgcaacgacttcggcccacagccgctggaatgctggatcggccgggttgccggcgtagaagacgtggtgctaccagacgcgctgcaaggctgggactgccgcaacaaccagctggcctggctggccctacaacaggacggcatggccgccgccgtgcaggccgccgcgcagcgctatggcgccgagcgcgtggcggtggtgatgggcacgtccacctccagcgtgggcgccagcgaagaggcctacacgcgcctggtcgaagacgcccacggcctgcgcttcccggacgacctgcagcgcccgatcgtgcataccccgcattcgctgggcgatttcgtgcagcacgccaccggcctgcgcgggccggcgatcaccgtggccacggcgtgttcgtccagcgccaaggtgttcgcccaggccgcgcggttgatggcggccggcgtggtcgacgcggccgtggtcggcggcgtggataccttgtgcggcagcgtgttgttcggcttcaactcgttgcaagtggtggcaccgcagctgtgccagccgttcgacgcacgccgggtcggcctgagcctgggcgaggccggcggctttgccctgctcgaacgccccgccgccgcgccggacgccgcgcagtggctgtacggctatggcgaatccagcgatgcccaccacatgtccgccccgcacccgcagggcctgggcgcgcagttggcgatgcgtggcgcgctggacaccgccgggctggatgccgcggcggtgggctatctcaacctgcacggcaccgccacgccggccaacgacagcgtcgaggcggccgcggtggcggcgatcttccccgacaccttgcatgccagttcgaccaaggcctggatgggccacacgctgggtgcggccggcattgtggagtcggtgattgcgctgctcgcgctgcgcgacggcctgctgccgggcacgctcaacagtgcggtgcccgaccccgcctgcggcccgcagatccgcttcgataacgcccattcccggattcagtacgcaatgaacaactcctttggcttcggcggcaacaactgctcgctgctgttc

SEQ ID NO: 39481 - DNA, 714 bp, Xanthomonas campestris
cagcgccgtgcgctggtcaccggcggtagcggcgatcttggcggtgcgatctgccgtcagctggccgcgcagggccggcacgtcattgtgcatgccaatcgcaatctcgcccgggccgaagaggtggtggcgtccatcgtggccgcgggcggcagtgccgaagcggtcgccttcgatgtggccgatgcgcaggccagtgcggatgcattggcggcgttgctggaggccgggccgatccacatcgtggtcaacaacgccggcatccacgacgatgcgccgatggccggcatgaacgcgcaacagtggcatcgggtcatcgatgtgtcgctgcacggcttcttcaatgtcacccaaccgctgctgctgccgatggcgcgcgcgcgctggggccgcatcgtcagcgtgtcgtcggtggcggcggtgctgggcaatcgcggccagaccaattacgccgctgccaaggccgcgctgcacggcgccagtaaatcgctcgcgcgcgagatggccagccgcggcatcgccgtcaacgtggtcgcaccgggcgtgatcgaaagcgagatggtcggcgacagcttcgcgccggaactgatcaagcagatggtgccggctggccgcgttggcacacccgacgaagttgccgcgctggtggcgttcctgtgctcggatgttgctggttacatcaacggccaggtgattggcatcaacggcggcatg

SEQ ID NO: 39482 - DNA, 2679 bp, Xanthomonas campestris
acccccgacgttcccttgcgcgacgatgtccgtcggctcggtgccctggtcggtgacctgctcgccgagcaggtgtctgcggactttcttgaagaaatcgaacgcatccgcaccaccgcgatcgcacgccgcgaaagcgatacgccgcccgccggcttgctgtcgctgctggaaggccgcgaaccgcgcgccgccgaggccttggtgcgtgccttcagtacctatttccaggtggtcaacatcgccgagcgcgtgcaccgcatccggcgccggcgcgactaccagcgcagcggtaccgacaccccgcagccggaaggcctgcacgatgcgctgcgccggctcaaggcgcagggcgtgacgttggacgagttgagcgaatggctgccgcgcatcgacgtggagccggtgttcaccgcgcatcccaccgaggcggtgcgccgcgccttgctcgaaaaagaacagctgatggtcgccagcctggtcgacaacctggatggcatgcgcacgcccaatgagcgcgccaccgatgcggcgcggttccgcatggcgttgaccgcgtcctggcagaccgccgattcctcgccggtgcgccccaccgtggaagacgagcgcgagcacgtgggcttctatctcacccaggtgctctaccgcgtcatcccggtgatgtacgaaaccctggaacacgccatcgaagaaacctacggcagcacgctggcgttgccgcgcctgctgcgcttcggcacctgggtcggtggcgacatggacggcaatcccaacgtggatgcgcacaccattgccggcaccctggacgcgcaacggcgcgcggtgctggaccgttatctcaacgagttgtggcagctggcgagcctgctcagccaatccaccacgctggtggcggtgagcccggcgctgagcgcgcagctggaacgctaccaggcgctgctgcccgacgccgccgcacgctcgcggccgcgccacggcgacatgccgtaccgcctgctcaacgacctgatgcgcgcgcgcctgcaggccaccctggacgatgccgacggcgcctacgccgcgcctgccgagctggaacacgacctgcaactgatcctggacagcctggaggtcaacaagggcttgcacgcgggctggttcgcagtgcgccgcctgctgtggcgcgtgcgcagcttcggtttccatctggcgcggctggatgtgcgccaggaatccagcgtgcatgcgcgcgcggtggccgatgcattggggcaagccgattgggacagccaggacgccacccaccgtgccggtctgctcggcccatatgcctcgggtgagcaggcgttgccgcaggtggacgacgaaggcaacgcgcggctggatgcggtgttcgccgcgctcgccgatgcacgcacgcggcatggtgccgatgcgctgggcagctacatcatttcgatggcgcacaatcgcgccgacgtgctcaccgtgctagcgctggcgcggcgtggtggcctggtcgatgacgccggtgcggtgccgctggacatcgtgccgctgttcgaaaccgtggacgatctgcgcggcggcaccggcaccgtgcaggacctgctggccgacccggtgtatcgccagcacctgcgcgcgcgcggcgacacccagatggtgatgctggggtattcggacagtggcaaggacggcggcattgcggcctcgcgctggggcctgcaacgcgcccaggtggagctgctggaggccgccgccgaactcggcgtgcgcctgaccttcttccacggccgcggtggttcgatcgtgcggggcggtgacaagaccacccgcgcgctggatgcagcgccgcgcggcagcgtggatggacgcctgcgcgtgaccgagcagggcgaggtgatccatcgcaagtacggcatccgcgcgctggcgttacgctcgctggagcagatgaccggcgcggtgttgttgtccagcctgcgcccgcgcgcgccggagccgcgcgaagacgcctggcggccagtgatggatctggtggccgagcgcagcacggtggcgtatcgcggttttgtcggcgcgccggatttcatgcagtacttccgcctggccacgccgatcgatgtgatcgaacgcatgacgctgggctcgcgcccctcgcgccggctgggccaggacgcggcgttgtcgaacctgcgcgcgattccctgggtgtttgcctggagccaggcgcgtgcggtgatccccggctggtacggcgtgggcagtggcctgcaggccgcggtggaggccgggcacgaagacagcctgcgcgagatggcgcaggactggccgttcttccgcaccttcctggacgacatcgccatggtgctatccaagggcgatctcaatatcgccgagctgttctcgcgcctggctggcccgctgcacgcgcgtttcttcccgcgcattcgcgacgaactcgcgctgaccaagcactgggtcaagaccttgctcgggcagcgctcgttgctgcagcacgacccgcgcctggcgttgtcgatccggctgcgcaacccgtacatcgacccgatcagcgtgttgcaggtggatctgctgcagcgctggcgtgccaccgatggcgaagacgaagaactgctgcgtgcgctggtggcatgcgtcaacggagtggcgcagggcgtgcagaacaccggc

SEQ ID NO: 39483 - DNA, 1209 bp, Xanthomonas campestris
atgtccagctacctgttcacctccgaatcggtctccgaaggccatccggacaagatcgccgaccagatctccgacgcagtgctggatgccatcctggcccaggacaagcgtgcccgcgtggcgtgcgagacgatggtcaagaccggtgtggcgatcgttgccggcgaagtgaccaccagtgcctggatcgacctggaagcgctgacccgcaaggtgatcctggatatcggctacaacagctccgatgtcggcttcgacggcgagacctgcggtgtgctgaacctgatcggcaagcagtccccggacatcaaccagggcgtggaccgaaagaacccagaacagcagggtgccggcgaccagggcctgatgttcggctatgccaccaacgagaccgacagctacatgccggcggcgatccacctgtcgcaccgcctggtcgagcagcaggccaagatccgcaagaagaagaactcggcgctgtcctggctgcgtccggatgccaagtcgcaggtcaccctgcgctatgaagacggcgttgcgaccgcgatcgatgcggtggtgctgtcgacccagcacgatccgggcgtcaagcagaaggacctgatcgaagcggtgcgcgaggaaatcctcaagccggtgctgccggccaagtggctgcacaagggcaccaagttccacatcaacccgaccggcaagttcgtgatcggcggcccggtgggcgattgtggcctgaccggtcgcaagatcatcgtggacacctacggcggctgggcccgtcacggcggcggcgcgttctcgggcaaggatccgtccaaggtcgaccgttcggcagcctatgcggcgcgctatgtggccaagaacgtcgtggcggccggcctggccgaccgttgcgaagtgcaggtttcctacgccatcggcgtggccgagcccacctcgatttcggtcaccacctttggcaccggcaagatcgccgacgagctgatcgagaagctgatccgcaagcacttcgacctgcgtccgttcggcatcatccagatgctcgacctgattcacccgatgtaccagcagaccgcctcctacggtcacttcggccgcaagccgaaggacttcacctacaccgacggcaccggcgcgcagcacagcgcaacgtcgttctcgtgggaaaagaccgaccgtgcagaagcgctgcgcgctgctgcaaagctgaag

SEQ ID NO: 39484 - DNA, 2184 bp, Xanthomonas campestris; identical to SEQ ID NO: 39116

SEQ ID NO: 39485 - DNA, 888 bp, Xanthomonas campestris
gtacgtgactatctgaccgatctgcaggaccgcatctgcgccgccgtggaagccatcgatggcaaggcgcggtttgctgaggacctgtggcagcgcgcggaaggcggcggtgggcgcacccgcatcctgcgcgacggtgcggtgttcgaacaggccggcatcggcttctccgacgtgtccggcgcgcggctgccgccctcggccagcgcgcatcggcccgagctggccggcgccacctggcgtgcctgcggggtgtcgctggtgttccacccacacaatccgcacattccgaccacacacgccaacgtgcgctatttccgcgccgagcgcgatggcgagatggtggcggcctggttcggcggcggcttcgacctgaccccgttctacccggtcgacgaagacgtcatgcactggcaccgcaccgcacaggcgctatgcgcgccgtttggcgaggagcgttacgccgcgcacaagcgttggtgcgacgagtacttcttcctgcgccaccgcaacgagacccgcggcgtgggcgggctgttcttcgacgacctgggccaggacttcgaacgcgacttcgcctaccagcgcgcggtcggggacggcttcctggacgcctacctgccgatcgtcgaacgccgcaaggacacgccctacggcgaggctgagcgcgccttccagctgtaccggcgtggccgctacgtggagttcaacctggtctacgaccgcggcaccctgttcggactgcagagcggtggccgcgccgagagcatcctgatgagcctgccgccgcaggtgcgctgggaatatggattccagccgcaaccgggaagcgccgaggcacgcttggccgattatttgattccgcgtgattggctcggctgatttcca

SEQ ID NO: 39486 - DNA, 627 bp, Xanthomonas campestris
atgacctcgcagcgggtgcgcgaccgtctggtcgagcgtctgcgcgagtccggtatccaggacgaagccacgctcaacgccgtgcgcaccgtgccgcgtcacctgttcatcgatgaagcgctggcctcgcgcgcttacgaagacactgcgctgccgatcggccatggccagaccatttcccagccatgggtggtcgcgcgcatgaccgaggcggtgctgcaggtggcgccgaagaaagtgctcgaagtgggcaccggctctggctaccagggcgcgatcctggcggcactgggcctggaggtctataccgtcgagcgcatcggcgatctgctgcgccaggcgcgcaagcgctttcgccatctgggcatgaacgtgcgcagcaagcacgacgatggccggatcggctggccggagcacggaccctatgatgcgatcgtggtcaccgcggccgcgccggcgctggtcgatgccttggtcgatcagctggcggtcggtggccggttggtggccccggtcggtggtgcctcgtcgcaatcactggtgcagctgacgcgcggcgccgatggcgagatcgcgcaagaggttctggcgccggtcacgttcgtccctctgttgtcgggcatgctg

SEQ ID NO: 39487 - DNA, 1896 bp, Xanthomonas campestris; identical to SEQ ID NO: 39118

SEQ ID NO: 39488 - DNA, 816 bp, Xanthomonas campestris
ctttccggcatcatcaccgcgctggcgacccctttcgggccggacggcgcactcgacctggatgcctggcggcggctgctggagcagcagttgcacggcggtgtccagggaatcgtggttgccggctcgaccggcgaagcggcggcactgagcgacgacgagtacgacacgctagtgcgtgcggccgtggcacaggtggccggtcgtgtgccggtactggctggcaccgggctctccggtaccgcaaaaaccatcgcgcagacccgccgtgccgccacgctgggcgcgcagtacgcgctggtggtgacgccgccttacgtgcggcccacccaggccggcctgctggcgcacttccaggcggttgccgacaacggcggcctgccggtgttgctgtacaacgtgccgggccgtaccggctgcgacctgctgccggaaacggtcgccgcgctggtgagccacccgaacatcgtcggcatcaaggaagcgcgcagcgaaccggagcgggttgccgcgctggtggccatgcgcagcgacagcttcgtggtgctcagcggtgacgacggcagcgccgcccagtcaatgctggccggcgccgacggcctggtgtcggtggcgtccaacgcgctgccgtcggcctaccgccggctctgcgatctggcccgcactggtcagcacgaggccgccaacgcctgggacacgcgtctgagcgagtaccacagcttctgcggcatcgaatccaatcccatccccgtcaaggcgctgctgcagcgcgccgggatcggccacggcctgcgcttgccgttgctgccactttcc

SEQ ID NO: 39489 - DNA, 1783 bp, Xanthomonas campestris; identical to SEQ ID NO: 39121

SEQ ID NO: 39490 - DNA, 1857 bp, Xanthomonas campestris
cgattgccgtcgcgcctgcttgtctgctgcgttgcagtcagcgccctgcttggatgtggtcaacgcgaggccggcaccgcaccggccgttgctagtgccggcgcccccgcggcagctgccgccaacacaccgctgcccctgattccggcaccggcgcaggtcacacgcggcagtggcagtttccacatcggtgccggcacggtgatttcgatcgtcggtggcgatgccgatgcacgccgcagcgccgaatatctcgccgagctgctcaagcgcacgcgcggcctctcgctggaagtgcgcaacgaaaccagcgcatcgccgggcagcatccgcctggaacgcagcgcgcaggcaccggtagcgcagaaggaaggctatagcctggatagcgacgcgaagggcctccgcatccaggcgcgtgatggcgccgggttgttctacggcaccgtgagcgcgtggcagttgatgaccccggatgcgcgcaagggcgatgtcgaggtaccagcggtggccatccgcgactggccgcgtttcagctggcgcggccagcatctggatgtggcgcgccacttccacgacgtggcaacggtcaagcacgtgctcgacacgatggccgtgcacaagctcaacgtgctgcactggcatctcaccgatgaccagggctggcggatcgagatcaagcgctaccccaagctcaccgaggtgggtgcatggcgcacgccgccgggcgcgggccagcacggcacaccggagcgctatggcggcttctacacgcaggaacagatcagcgaagtggtggcctacgcggcgcgcctgcacatcaccgtgctgcccgagctggatatgcccgggcatgcgcaggcggccgttgccgcctaccccgaagaggtgggcgtccccggtgtgcgcacccaggtgggtgtggactggggcgtcaacccgtacctgttcaacaccagcgaacgcagcctgaccttcatcaccaatgtgctggatgaagtgctcacgctgttcccgtcgacctacatccacatcggcggcgatgaggcagtcaaggaccaatgggaagcctcgccggccgttcgcgcacagatgcgcaagctcggcgtcaaggacgcacacgcgatgcaaggctggttcaacgaacagctggcccagtacctcacccagcatggccggcgcatgatcggctgggacgaaatcctcgaaggcggcgtgccggccagcgcggccgtgatgtcctggcgtggcatcgaaggcgcggtgaccgccgccaagcaaggccacgacgtggtgctggcaccgggcgattcgctgtatctggacaacctgcagaccacgcgcagcgatgaacccaacggccgcctgaccacgctgccgctctcgaaggtctacgcgttcaacccggtgccggccgcgctcaatgccgagcaggccaggcatgtgctcggcgcgcagggcgcgttgtgggccgaatacattccctcgcgctggcacgtcgaccacgcgctgttcccgcgcctggcagcggtagccgaagtgacgtggtcgccgatggccgcgcgcgactggaagaatttcctggcgcggatgccggcgcagctgcagcgttatcaggcgctgggcatcgattacagcgatggcgcgtttgccgccgacatcgatctggacggcgacgtcaacgcggtactggccggtggcccggccaaggtatcgcttggcaaccagagcggcgccggcagcctgcactacaccgtggatggcagcgaccccacgccggatgcaccgcgctacacggcgccgttcgcgattcagctgcccaccaccgtcaaggccacagccttcaccgacgatggc

SEQ ID NO: 39491 - DNA, 798 bp, Xanthomonas campestris
ccggtggttgcctttgtcggtggcggcaacatggcgcgcagcctgatcgccgggctgctgcgccagggcgcgccggccagcgccatccgcgtcgccgagccggtcgccgaactgcgtcaggcgctgtccgctgacttcggcgtgcaagtgttcgacgacgcgcgcagcgccgtggagggcgccgcactctgggtactggcggtcaagccgcaggtcatgtccaccgtgtgcacgcagctggccgatctcgcgcagcaacagcatccgctgctgctgtcgatcgccgcgggcatcaccgcaacgcaactggagcgctggtgcggcggcacggccgccgtggtgcgcgccatgcccaacacgccggccctgctcggcgccggcgtgaccggcctgtacgccaatgcacgcgtcagcgcggcgcagcgcacacaggcaacccggctgctggaaagcgctggcgtcaccgtctggctcgacgacgaggcacagatggatgcggtcaccgcggtgtccggcagcggcccggcctatgtctttctgctggccgaagcgatggaggccgcggcgcgcgcgcaaggcctgcccgccgagaccgcccgcacgctggtgctgcataccctgctcggcgctgcacgcatgctgaccgaatccggcgaagcaccggaggtattgcgccggcgcgtgacctcccccaacggcaccacgcaggccgcgatcgaggaattccaggccggcggtttcgaagcgttgaccgccaccgcgattgccgcggcgaccgaacgcggccgcagtttgtcg

SEQ ID NO: 39492 - DNA, 933 bp, Xanthomonas campestris
gcgatgaccaccatgcaactcgattcggacggacgcctgcgccacctgctcaccctggaaggactgccgcgcgccaccttgctgcagctgctcgatcgcgccggccagatccgcgatgcggcggtggggcgcgtgggcaagcgcagcgtgctcgcgggcaccgcggtgtgcacgctgttcttcgaaccctccacgcgcacccgcagttcgttccacctggccgcgcagcggctgggcgcagacgtgctcaatttcgacgcgtccacctcgtccacccgcaagggcgaaaccgcacgcgataccttgaagaatctcgaggcgatgggcgtgcgcggcttcgtggtgcgtcatcccgaagacggcgcggtggagcgactggccgaagctgccggcgagggtaccgcgctgatcaatgccggcgatgggcgcagtgcgcatcccactcagggcctgctggacatgctcaccctgcgtcaggccaagggcacggatttctccaagctcaaggtggtgatcgtcggtgacgtgaagcactcgcgcgtggcccgctcggacctgcacgccttgcgtacgctgggtgccggcgagatccgcgtgtgcggcccggccagcctgctgcccgacgacgacatgctggacggctgcgtggtcggcgaggacttcgatgcgatgctggaaggcgccgatgcgctgatgatgctgcgcctgcagcgcgagcgcatggaagaaggcctggtgccatcgctggagcagtaccacgccgactacggcctgacccgcgagcgcctggcacgcgcgggacgcgacgcggcagtgctgcatccgggcccgatcaatcgcggcgtggagatcaccgacgaggtggccgatggcgcgcagtcctgcgtgctgcgccaggtggccaacggcgtggccgtgcgcatggcggtcctg

SEQ ID NO: 39493 - DNA, 900 bp, Xanthomonas campestris; identical to SEQ ID NO: 39125

SEQ ID NO: 39494 - DNA, 1353 bp, Xanthomonas campestris
atcgtcctcaagttcggcggcacctcggtgtcgcgtcgtcatcgctgggacacgattggaaaactggcgagcaaacgggcgaacgaaaccggcggccgcgtgctggtggtggtgtctgcgttgtcgggcgtcaccaacgagctcactgccatcgccgatggtgctgccgacagcgcgcagcgcgtggcggcactggaactgcggcatcgcgaattccttgccgagcttgagctcgatgccgacgcagtgctgggcgcgcggcttgccgcgttgcacgcgttggtgggcgatgcacgcgctgccagccgcacgctcgactggcaggccgaggtgctggggcaaggcgaattgctgtcttccaccatcggtgcggcctatctgcatgccaatggcctggacatgggctggctggatgcgcgggagtggttgtcggcgttgccgccgcagcccaaccagagcgagtggtccaagcgcttgtcggtgtcgtgccagtggcaatccgatgccgcatggcgggcgcgtttcgatgcgcagcccacgcggctgctgatcacgcagggctttatctcgcggcacgccgatggcggcaccgcgatcctgggccgtggcggctcggacacctcggcggcgtatttcggtgcattgctcggcgccagccgggtggaaatctggaccgacgtgcccggcatgttcagcgccaacccgaaggaagtgccggatgcgcgtctgctgacccgcctggactattacgaagcgcaggaaatcgccaccaccggcgccaaggtgctgcatccgcgctcgatcaagccctgccgcgattccggcgtgccgatggcgatcctggataccgaacgcccggatctgccaggcaccagcatcgatggcagcgccgaaccagtactcggcgtcaaggcgatcagccgccgcaacggcatcgtgctggtgtcgatggaaggcatcggcatgtggcagcaggtcggcttcctggccgatgtgttcacgctgttcaagaagcatggcttgtcggtggatctgatcggctcggccgaaaccaacgtcaccgtctcgctggacccgtccgaaaacctggtcaacaccgatgtgctggcggcgttgtcggcagacctgtcgcagatctgcaaggtcaagatcatcgtgccgtgcgcggcgatcacgctggtcgggcgcggcatgcgctcgctgctgcacaagctgtccgacgtgtgggccacgttcggtcaggagcgcgtgcacatgatttcgcagtcgtccaacgacttgaacctgaccttcgtcatcgacgaatccgatgccgacggcctgttgccgattttgcatgcggaattgatcgat

SEQ ID NO: 39495 - DNA, 1077 bp, Xanthomonas campestris
ggcacgccgcgttacgtgtaccacctgcccacggtgcgcgcgcgcgcgcaagcgctggcgcagattgccgcagtggatcagcgctattacgcgatcaaggccaactcgcatccggccatcctgatggcgctggaacaggctggattcggcctggaatgcgtctcgcacggcgaattgcgccgcgtgttcgacacgttgcctgagctgtcgccacgccgcgtgttgttcacgccgagcttcgcgccgcgtagcgaatacgaggccgcgtttgcgctgggcgtaaccgtcaccgtggacaacgtcgaagcgctcaagcgctggccggagttgttccgcggccgcaacgtgtggctgcgcatcgacctgggccacggcgatggccaccacgagaaggtcaacaccggtggcaaggcgtccaagttcgggctgtcgtccacgcgcgtggatgagttcgtcgagttggcacgcacgctggaagtcaccatcaccggcgtgcatgcgcatctgggcagcggcgtggagaccggcgaacactggcggatgatgtacgacgaactggccggcttcgcgcgccgcatcggcaccgtggagaccatcgacatcggcggtgggctgccgattccctacagcgccgaagacgagccgttcgacctggagctgtgggccaagggcctggccgaggtcaaggccgtgcatccgggcttccgcctggcgatcgagcctggccgttatctggtggccgaggccggcgtgttgctggcccaggcgacccaggtgatcgaaaaggacggcgtccatcgcgttggcctggatgccggcatgaatagcctgatccgcccggcgctgtacgacgcctggcacgacatcgaaaacctcagccagctcggtgcgcctgccgatggcagcttcgatgtggtggggccgatctgcgaatcctccgatgtgttcggcaagcgccgccgcctgcccgcggcgaccgcaccgggcaatgtgatgctgatcgctgatgccggcgcgtatgggtattccatggccagcacctacaaccagcgggagttgccgcgcgaagaggtgatc

SEQ ID NO: 39496 - DNA, 960 bp, Xanthomonas campestris
ctgggcctgccccagatccagtccctcgccgcgcccgacatggcggcggtcgatgccttgatccgccgccgtctggcgtcggacgtcgtgctgatcaaccagattgccgatcacatcatctccgccggcggcaaacgcctgcgcccgatgctggtgatgctggccggccacgccgcgggcggctccgggccggagcaccaccagctcgcggcgatcatcgagttcatccatacctccacgctgctgcatgacgacgtggtggacgaatcagacctgcgccgcggccgcagcaccgccaatgcgctatggggcaacgcgcccagcgtgctggtgggcgatttcctgtattcgcgcagcttccaactgatggtcgaactggaccgcatggaagtaatgcagatcctggccgacaccaccaaccgcatcgccgaaggcgaagtgctgcagctcttgcatgtacacaaccccgacaccgatgaagccgcgtacctgcgcgtgatcgagcgcaagaccgcggtgctgtttgccgccggcacgcgcctgggcgcactggcctcgggcgcggatgcgcaggtgcagcagtgcctgtacgactacggcatgcagctgggctttgcgttccagatcgccgacgacgtgctcgactacgccgcagatgccaccgacctgggcaagaacctgggcgacgacctggccgagggcaaggccaccctgccgctgatccacgccattgcgcattccgatgccgccacccagcagcgcctgcggcagatcgtcgaacagggcgatgccgaggcgatgccggaggtgttgacggccatccgcgcaaccggcgggctcgattacagccgccagcgcgccgccgaatacgccgccgccgccgaacaggccctggacggcttgccgccgagcccggcagtggccgcattacgcggtctggcgcgttatgcggtggaacgg

SEQ ID NO: 39497 - DNA, 804 bp, Xanthomonas campestris; identical to SEQ ID NO: 39128

SEQ ID NO: 39498 - DNA, 648 bp, Xanthomonas campestris
tacgagctactgatcagtgactgcgatggggttcttgtcgacagcgaaatcctggccgaccgtgtgatgcgtgagacgctggcagcgttcgtgccggccgagccgttggaacatctgctggaaaccacgttcgggcagaccacgcgcgaggtattgcggcgggtggaagaacactttgcgctgcagttgccggaaaccctgctggcgcagatccaggcgcgcagcgaggccttgattgccgccgaggtgcagccgattgcgggcgtgcgacaggcgctggagcagatcccgctgccgctggcggtggcctccaatagccgccgccacaacgtgattgcatcggtggagcgggccgggctcacggagcgtgcggcagggcggatcttcagcgccgacatggtggagcggcccaagccggcgccagatgtgtacctgctggctgcacgcacggccggtgtagtgccggagcgttgcctggtgatcgaagacagccccaccggtgcgaccgccgcgctggcggccggcatgcaggtgctgggctttaccggtgccagccatatcccgcaagggcacggcgacaccctgcgacggatcggcgtgctggaggtgttcgacgatatgcgcgatttgcccgcgttgttcgagcgg

SEQ ID NO: 39499 - DNA, 765 bp, Xanthomonas campestris; identical to SEQ ID NO: 39131

SEQ ID NO: 39500 - DNA, 1908 bp, Xanthomonas campestris
gacctcaacggcttcgtcaattccaagtggcttgccaagacaaccattcctcccgacgaaacggaagtcggcagctacccaacgctgcaggacgaaagcgatgctgcccagcgcgagatcgtggaggcgctgggccgatcgaaacctgtggagggttccgttgagcaactggtgggcacgttctacgcgtccggtatggacgaagccacgatccagcgcctgggcgatgcacccattcgcccgcggctcgcgcagattgaagcgctgaaaacgccgcaggacgttgccaatttcattgctgcacgcaatacccaaggtgccgggctggtcttcaagttcggcgcctacccggatttccaggatgcgtcgaaggtgatcgcttatgccgaagagaacggcatgacgctgccatcgaaggcgtattacaccgacccgcgctatgccgacattcgcaaagcgtatctggattacatcacccagtccttcgtcctggccggcgcgacgcccgaggctgcaacagtgcaggccaagcaggtcttgcaggttgaaacggcgctcgcagcggcatcgctgagtccggtcgaagcgcgcgacccaaagacccaataccatctggtcagcgttgcacaggccgacgcagtgacgccgcatttctcgtggaaggcgtatctggccgcgcaggggttgagcacagatcagcgtttctccctctcgcagccgcgcttctttgcaggcttcgatcacttgttgaagaccttgcccgtctcgcaatggcaggcctatttacgcttccgtgcgattgacgatgcggcgttcgccctgagcaagccgtttgtcgataaccgcttcgcgttccgctacaagaccatggacgggcagcaggcgcagcggccgcgctggaagcgcgtgctgtttgcgaccgatgaagccatcggcgagggtcttggccagctgtatgtggcaaagatgttcacccccgaagccaagcagcgcgcaacagagctgatcgagaacatccgccaggcactcaagctgcggatccagcaggcagactggatgacagcggagaccaagtccgctgcattgaagaagtgggcaggattcgtcgtcaaggttggctacccggatcattggcgtagctggtcgggcctgcacttcgagcgcgacgcctatttacgcaatgtggaaacagccgcggcgttcaactatcgctatgagcttgccaaggtcggcaagccagcggaccggaccgcgtggttcaccacgccgcaaaccgtcaacgcgttctatttttcgctggacaacagcatcaatttcccggcggcggtgttgcgtcctcccttctttgatgtgaccgcggacgacgcgctaaattacggcgccattggtgccgtgatggggcacgaggcgacccacgggttcgacgatcaaggcagcaagttcaatgcggttggcaccaacgtcaactggtgggcccccgccgatctggccgctttcactgcgcgcgccagcaagctggtcacccagttcaacgcctacaccccgctgccgaacaagccggacgtgcacgtcaacggcgaactgacgctgggagagaacattgccgacctgggtggcatcaatatcgcgttcgatgcgttgcaggccaatctgcagcggcatcccgagcgtggtgcggatatcgatggatttacgccgcaacagcgcttcttcctcggctgggcaagactgtggcgcggcaccatgcgcgaggagaagcagctcagcttgctcagctcggatggtcatgcgccctacgcggtccgcacgaatgcatcgccgtcgaatatgccgcagttcgccaccgcgtttggatgcaagccgggcgacgcgatggtccgatcggaacaggaccgcgttgtgatctgg

SEQ ID NO: 39501 - DNA, 1407 bp, Xanthomonas campestris; identical to SEQ ID NO: 39133

SEQ ID NO: 39502 - DNA, 1218 bp, Xanthomonas campestris
ccctgcaagcgagaccgcatgaaactgcacacgctgtatctgtcgttgttgctggccgccaccacctcggcacacgcgatggagttttccgatgccgagctggcccgcgccagcgcactgcaaaagcgactggtcacgctggattcgcacctggacacgccggccaatctggagcgcggcgatttcgatgtgatgcagggccatgccggcaatcggctgtcgcaggtggactacccgcgcatgctcgaaggcgcgctcgatggcggcttctgggcggtctataccgggcaaggcaatcgcagcgcagccgcgcatctcgatgaccgcgacgccggcctgcagcggctgatgaagatccacaacctgctggccgcgcagccgcaacgcttcgcgctggccaccacgcccgccgatgccgcccgcatcaaggccgccggcaaacgcgtggtgtacatcagcatggaaaacgccagcccgctggtggccgacccgtcgctgttgcgcttttattacgcgcagggcctgcggctgatgagcacggtgcattttctcaacaacgagttcgccgattcggccaccgacccgaaaggggccgagtggaaaggcctgagcccggccggcaagcagctggtgcagcaggcactgggcatcgtgatcgatcaatcgcatgcctccgatgcggtgttcgaccagttgatcgcgctgtcgccggtgccgatcgtgctctcgcacagcggcgcgcgggcggtctacaaccacccgcgcaacatcgacgacgcacgcctgaaggtgctggccgcgcacggcggggtgatccaggtgaattcgtatggcggctatctcatcgacagcggcgccagccccgagcgcaaggccgccgagaaggcgctggccgaccaatacggcggctgggagcatctgaagatgtccgacggcaccgccctgagtgaagcgctcaaggcgctggatgcgcgctacccggtcaagcgcgcgaccgaagaggatttcttcgcgcatctggagcacgtgctcgccgtcgccgggcccgcgcatgtgggaatcggcatggactgggatggcggcggtggcgtggtcgggctggaagacgtctccgacctgccgcgcatcaccgcctggctgctgcgcaagggctatagcgagccgcagatcgccggcatctggggtgggaatctgctgcgggtgatggagcaggcgcag

SEQ ID NO: 39503 - DNA, 1338 bp, Xanthomonas campestris
gccgcgcgcatcgaccgcctgcccgccagcgccacgctgtggcggctggtcgggctgctggcgctgggcggtttcttcgagttgtacgaccttttccagaccgcctatatcagcccggggctcattcgcgacggcatctttgccagcggcaatgacggcgccttcggcatgtccgatcaagccgcgtttgccgcggcgacctttcttggtctgttcgtcggggccgccctgctcagcccctttgccgatcgcttcggccgccgcctggtgttcaccgtggcgttggtctggtacaccgccgccacggtggccatgggcctgcagagcactgccacggcagtgatcgtgctgcgctttgtggtggggatcgggctgggcatcgaactggtgaccatcgatacctacctgtccgaactggtaccgcgtcacatgcgcggggccgcatttgcgttcgcgtttttcctgcagttcctggcggtgcccagcgtggcgctgagcgcctggctgctggtgccgcacgcgccgctgggtgtcagcggctggcgctgggtggtgttgctgagcggtgtgtttgcgctggcgatctggtggctgcgcagccggctgccggagtccgcacgctggctggcggcgcaagggcggcatgccgaggccgaagcggtgatggcccagctcgaagctgcctgcagccgcgatcttggccgggcgttgccgccgccggaaccggtgcaacgggtcgccgcacccgacagccgtctatccgcattgtggcggcagccctaccgcgggcgtatcggcatgctggtggtgttccagatcttccaggccatcggcttcttcggttttggcaactggctgcctgcgctcatcaacgcgcaaggcgccggggtgaccaagagcctggcgtatgcgtttgcgatttcgctcgcttacccattggcgccgctgttgctgctgcgtgttgcgcatcgctgggaaaacaaatggcagatcagtgcatcggctctgggtgcagtggtatttggcgtgctcttcgcgctacagcacgcgccgctgggcatgattgcctgcggggcgatgattgccttttgcaatgcgtggatgagctttgcctaccacggctaccaggccgaactgttccccacggcactgcgcgcacgtgcggtgggtttttgctattccttcagccggttgtctacggccggcagcagcgtgttgatcggttggctgctggcgcagaccggcagccacggcgtgctggccttcatcgtgatcagcatgactatcgtggccagcgtgattgctgcgttcggcccacgcacgcgcaatcgtgctttg

SEQ ID NO: 39504 - DNA, 852 bp, Xanthomonas campestris
tttgagcgctgggttgctcgcaccgaacggcagctggacgcctgccttcccagccccgccctcgccccgcagcgtctgcacgcggccatgcgccacgccgtgctcggtggcggcaagcgcatgcgtccgctgttggtctatgcaagcggtgccttgttcggcgccgaagaaggcagcctggatgcgccggcggtggcggtggaactgatccacgcgtattcgctggtgcacgatgacctacccgcgatggacgatgacgcgctgcgtcgcggccaccctacggtgcacatcgccttcgacgaagccactgcgatcctggccggcgatgccttgcaggcacgcgcattcgaactgctggccgaggcaccggcagatgcggcactgcgggtgggctggttgcagagcctggcatctgccgccggtgcggccggcatgtgtggcgggcaggcgctggatatcgacgccaccgggcaggtgcaggcgctggaggcactgcagcgcatgcatgcactcaagaccggtgcgctgatccgcgccgcggtgcgcatgggcgtgctgacaggcggcgcgggtattgccgaccagcagcgcctggatgcgtttgccgacgcgctggggctcgcgttccaggtgcgtgacgacatcctggatgtggaatcaagctccgcccagctcggcaagactgccggcaaggatgcggcgcagtccaagtccacctaccccgccttgctgggcatggacggcgccaaaaccaagctggcggaactggccagccatatgcatgcgctgttgctgccctacggcgaatccggcgccaccttggccagcctcggccgcttcgcggtcgaccgc

SEQ ID NO: 39505 - DNA, 1284 bp, Xanthomonas campestris
gtggtggccggcttcgtgctgggcgcgatcgcgggcgcagccatgggcccggccgccgaggtgtggtttgggccgctgggcgatctgtacgtcaccctgatcaagatgatcgcggtgccgctggtgttctttgcggtgatcaacgcgatctcgtccttgcacgggcaaaaatccgttgcggccttgggcgggcgcaccttcctgtggttcgtcatcaccgccgcactggcagtgggcgtgggcctggcggtgggcacgatcatgcagcccggcgccggccatttcagcctgagcgtggactcggcgtggaagccgcgcgatgtgcccagcccgatcaaggtgctgctggatgtggtgccctccaacccgttctacgcgctgaccgggatcggcaccaagaccaatgccgccggcgaaaccgtgctggccgccgggcgtggctcgatcctgccggtgatcttctttgccgcgctgctcggctttgcgatggtcaagctgggtgaccgcgtggccgaggcacgcaagctcaccgggcagatgagcgacatcatgattcaggtcacccgcttcgtgctggagatgaccccgctgggcaccttcggcctgattgccggtttggtgggcagctacggctttgcgaagctgctgccgttcggcaatttcgtgctggcgctgtatgtggcctgcgcgcttcacatcgtggtggtctacagcagcctgttgctgctgcacgggctgaacccgtggaagttcttccgcggtgcggcgcctggcatgcaagtggcgttcgtgagctcgtcaagcttcgccgcgatgccagtggcgatgcgctcgatcacccacaacctcggcgtgaacaaggactacgccgccttcgccgtgccgctgggcgcgagcatcaagatggacggctgtggcgcgatcttcccggcgttgtgcgccgtgttcatcgcgcaatacaccggcgtgccgttgaccgccaaccagtatttcgtggtgctgatcgcctcggtgctgggcagcttcggtaccgctggcgtgccgggcaccgcggtggtgatggccacggtggtgcttagcgccgccaacctgccgctggaagtgatcggctatctgtacgccatcgaccggatcctcgacatgatgcgcaccatgaccaacgtcaccgggcagatgctggtgccggtgctggtggccaaggagaccggtctgctggacaagacgatctacgagtctgcgtccaccaatgtggggcttgaggatccgcccaccgatcgcgccgcg

SEQ ID NO: 39506 - DNA, 1875 bp, Xanthomonas campestris
gatttctacgattacgccaatgccggttggctcaagagcaacccggtgccgcaggctggcgcggtcaccgcgctgggccagctgtccgaccgcgccctgcagcagcagcgcgagctgctggatgcggcgatgaacagcccgcagggcaatgtgcagaagctgctcggcgatttctgggccagcggcctggatgaggccgccgtggaaaaggatggctccaatcccatcgccccgttgctgtcgcgcatcgatgcgatcaagaaggccaaggatgtgcccgcttcgatcgctgcgctgcaccaggtcggtatcccggtcggcttcaacttcggcccggacgtggacctgaaggcgctcgaccgccacatcggttacttcatgcagggcggcatgggcatgccggatccggcgttctacacccgcaccgacgccgacacccaggcgctgatgggccgctaccgcgcctacgtcaagcagatcctggcgctgaccggcaccccggccgacaagctcgacgccgatgcggcctcggtgttgcagatcgaaaccgcactggcacgcagcgcgcagtccgtgcagggcatcaacaacccgttcaacaactacgcgccgatcgccaccaaggagctgaccaagcagtacaagaacctgcgcctgggcgacttcctcgaggcccagggcgtcaaggacgacctggtgtcgatggccgacccggcgatgttcaagcagctcgacagcatgatcgtcagcatcaagcccgagcagtggaaggcctacctgcgctggcgtgtgggcgatgccatggcgccgtatctttccaagagcttccatgacgccgaataccagttccgcggacgcttgctgcgtggcgacgcgttgccgccgcagcgctggcagcaggtgctcgatgccatcaacgtggccgccggcccgatgctcggccgcgagtacgtgagccgttacctcagcagcgacacccgccgccaggccgaagccatcgccgaccagatccgcgatgcgcagctggccgcgctggagcgcaccggctggggcaatggcgaggtcatcgccgaagccaaggccaagctgagcgccatgaagatcgaagtgggcgcaccgcgccgcgacctcgactacaccgtgcagccgatgggccgtggcagcttcggcggcaacatgctgatcgcctccacctggcgtcaccgcgaagaaatgaagcgcatcggcaagggcaacgccgaccgccgttgggatgtgctgccgcagcagccggccctggcctacgacatcgcacagaaccgcctgatcatcaccgctgcggtgctgcagccgccggtcttgagcaccggcgccacgccagctgcacaatacggtgcctacggcgcgctggtggcgcatgaaatgacgcgtgccatcgatgccaagggtgcgctggtcgatgccaagggcgaactgcgcagctggtggacgcccgccgaaaagagcagctggacgctgctgactggcaaggtagccaaccagtacggtgcctacgcctacccgggcgtgcccaatgccaaggtcaatggcgcacagaccgccgaagaaaacctggccgatctggccggcgtggagttggcgtggcaggccttcagcaaggcgcagccggcggcaacccaggccgacaagcaggccttcttcaccgcctgggccggcctgtgggcgcagcagctgtcaccgaacgaagcggtgcagcgtgccagtgctgacatccgtgcacctggccagtggcgcaccaacggcccgctgtccaacctgccggagttcggtgccaccttcagctgcaagccgggccagccgatgcagcgtgtggatgcagaccagttgaagatctgg

SEQ ID NO: 39507 - DNA, 1959 bp, Xanthomonas campestris
cccgcattcgatatcagcgagctgggccctgcagccagcgcgtgccaaaacctggacgagttcgtcaatggcgcctgggccaaggccaatccgattccggccgaccacaccagctggggcatcgacgaactcctgactgaaaaaagcctgctgatccaacgcgagctgcttgaagccgcggcgaaacaggccggtacacaggccccatcgctggaacaaaagatcggcgcgctgtatgcgtccggcatggacgaggccgcaatcgaagccgccggtgccaagccgatccagccgcagctggataagatcgccgcattgcactccggcaaagatgtcgctgcctacatcatcagccggcatggcgaaggcgacgcacaggtctttgcgttcggtgccggtgcagatttccacaatgccgaccagcagattgcgtttacacaggaaggtggccttggcctgccaaccaaggactactacaccggtgcggagcacgcgccaatccgcgcagcctaccttgcctacatcgccaaatcgttcgaactcaccggcacccctgccgcgctggccaagacacaggcaaacgacgtgcttgcgctcgaaacgcgcctggctgccgcatcgctggcccccgtggacgcgcgtgaaccaaagaaccaataccgcctggtcaccctcgccgaggcggacaagctcactccgcactttccgtgggaggattttttcgccacccaaggcgtaccggtcggcagcggcttctcgctcgcgcagccacggttttttgccgcgttcgatcaggcattggctagcgcgcccattgcgcagtggcaggcctacctacgcttccatgcgatcgatgacgcatccacgcgcttgagcaaggcatttgccgataatcgctttgcgttctatggcaagacgctgtccgggcagccagagcagctgccgcgctggaagcgcgtgctgcgttcggtcaacggcgcaatgggcgaaggcgttgggcagctctatgtggccaaggtgttcacgccagatgccaagcaacgcgccagcgaactggtcgacaacgttcgcgcggcgctcaagacacgtatcgaacaggtcgactggatgagtgccgagaccaaggccaaagccttggccaagtggcagaccttcctgcccaagatcggctatccggacacctggcgtgactggtcggggttgcagatcacacccggcgactattacggcaacctgcaggcggctgacacgttcaattatcgctacgacattgcgcagatcggcaaacccaccgatcgcggccgttggtcgatgacgccgcagacggtcaacgcgtattacgacccgatgaccaattcgatcaactttcctgcggcgatcctgcagcctccgtatttcgatgccactgccgacgatgcgttgaactacggcggtatcggcgcggtgatcggtcacgaggccacccatgggttcgacgatcagggcagccaattcgatggtgcaggcaacaacgtcaactggtggacggcagaggatcggcgcaagttcgaccaacgtagcaaccagttggtcaaacagttcgatgcgtatgcgcccctgcccagccatccgaccctgcacgtcaacggcaaactcacccttggcgagaacatcgccgacctgggcggcaccaacgttgcctatgacgcgttgcagaccgccttgcagcagcatccggaacgggccaaggccatcgacggctacagccccgaccagcgctttttccttgccttcgcccgcagctggcgtcaacgcgtccgtgatcaacaacagatggtctatctggcgtcggacccgcacgcgccagccaagctacgcgccatcgcatctccctcaaacatgccgcagttcgccaccgccttcgcctgcaagccgggcgatgcaatggtgcgcccggagaaagaccgcgtggtgatctgg

SEQ ID NO: 39508 - DNA, 1929 bp, Xanthomonas campestris
ctggatcccaacggcaatgcctgtaccgatctgaacgcctacgccaatgccaagttcctggccgccaacccggtgccgggcgaccgcaccagctggggcgcgttcgaaatgctcgacgagcgctccaacgcgatccagcagcagctggccgaacaggccgctgcagacaccggtgctaccggcgtcgaaaagatcgtcggcgacctgtggtccaccggcatggacgaagccaagatcaatgcccagggcatcgagccgctgaagccggaactggccgccatcgacgccatcagcgaccaggccaagctggtcgactatctgcgcagcagcgcggccaagggcaacaacgagctcttcagcttcggcgcggaagcggacttcaagaagtccagccagaacattgcctatgcgatgcagggcggcctgggtctgcccgacccggagtactacaccagcgccggtaacaaggccaagctggacgcctaccaggcgcacgtcgccaaggtgctggaactgtctggcgttgccgccgccgatgccaccgcgcaggccaagcaggtcgtcgcgttcgaaacccgcctggccaaggtttccaagaccagcacgcagatgtcgcgcgatgcctcgctggcctataacccgatctcgcccgccgatgccgacaagctgacccccaactggtcgtggaccgagttcttcaagtcgcagggcgtagccacgccggagatgttctcgctggcaatcccggcctttcatcaggaagtgagcaagatgatcgccgacaccgacccggccatctggcgcgcctacctgcgcttccacaccgtcgacggtgcctcgccgtacctgagccagccgttcgtggatgagagcttcgcgttctacaacaagaccatgcgcggccagaaggaaatcaagccgcgctggaagcgcgtgctggccaccatcaacagccaggccggcgaaacgttgggccagatgtacgtcaaggtcgccttcccgggcgattccaaggccaagatggaaaccctggtgaccaacctgcgcaccgcactgaaggcgcgcatcgaaaagctcgactggatgagcccggagaccaaggccaaggcgatcgccaagtgggaaagcttcacgcccaagatcggctacccggaaaagtggcgtgaatggaacggcctgagcaccagccgtgacagctacctgggcaacgtgatggcggcatccgagttcaactacaagtggaatctgtccaagatcggcaagccggtggacaagaccgaatggggcatgagcccgcagaccgtcaacgcgtactacaacccgctgcagaacgagatcgtgttcccggccgctatcctgcagccgccgttcttcgacccgaatgcgccggaggaaatgaactacggcggcatcggtgcggtgatcgggcatgagatgacccacggctacgacgaccagggcagccgcttcggtgccgatggcaacttcatcgccgatccgggttggtggacgcagaaggatctggacgcgttcaaggcacgcaccggcaagctggtggcacagttcgacagctaccgcacgccggcaggcgacaaggtcaagggcgacctgaccctgggcgagaacatcgccgacctgggcggcctcaacaccgcctatgacgcgatgaagaccgccaccgccggcaaggacgaccccaagagcgacggcatcacccgcgaccagcgcttcttcctcaactgggcgacggtgtggcgtcgcaacttcaccccggaagaattggtggtgcgcctgaagaccgacccgcacgcgccggccaacttccgcgccatcggcgcgccgtcgaacatgccggcatttgccgccgcattctcgtgcaaggcgggcgatgcgatggtgcgtcaaggcgatcagcaggtggtgatctgg

SEQ ID NO: 39509 - DNA, 873 bp, Xanthomonas campestris; identical to SEQ ID NO: 39141

SEQ ID NO: 39510 - DNA, 1158 bp, Xanthomonas campestris
atgaatttccacgaataccagtcaaaacagctgcttgccgagtacggcatccccgtcccggccggtaaggtcgcgtccacgccggacgaagcggttgaagtcgccaactccttgggcaagggcccctggatggtcaaggcgcagatccacgcgggcggccgcggcaaggctggcggcgtcaagttctgcaagaccaccgacgacgtgaaggccgcagcagacaagatgctcggcaccaagatgtccacctaccagaccgcaggcgtcgagttgccggtcaacctggtgctggtgaccaccgccggcgagatcgtcaaggagctgtacctgtcgatcctggtcgaccgcggcaccaagaccatcacctatatcgcttcttcggaaggcggcgtggaaatcgagcaggttgctgccgaaaccccgtaactgatccactcgctcaacgtcgatttcgtcgaaggcgtgcagggctaccacggccgcgatttcggcttcaagctcggcctcaatgccaagcaggccggccagttcgccagcatcatggtgaacctgtatcgcctattcaacgacaaggacctggcgctggttgaaatcaacccgctggcgatcctggacgacggcaacctgtacgcgctggacggcaagttcgacagcgacgacaacgccgccttccgtcagaaggcgctggtcgccatgcgcgacaagacccaggaagacgagaccgaagtgaccgcttcggagctggacatcaactacgtcaccatggacggcaacatcggttgcatggtcaacggcgccggtctggccatggccaccatggacgtcatcaagctcaacggcggcgagccggcgaacttcctggacgtgggcggcggtgccaacaagcagcgcgtcatcgaagcgttcaagctgatcctgtcctcggacaaggtcgaaggcatcttcgtcaacatcttcggcggcatcgtccgctgcgacatgatcgccgaaggcatcattgccgcggtcaaggaagtgggcgtcaaggtgccggtcgtggtgcgcctggaaggcaccaatgtggaagaaggcaagcagctgctgcgtgacagcggcatggccatcatcccggccgacaacatcaacgacggcgccaagaaggtcgttgaagctgtcaag

SEQ ID NO: 39511 - DNA, 2115 bp, Xanthomonas campestris
atccgccaaggccgcccgttcccacgcggcgccatcttcgatggcaagggcaccaactttgcgctgttttccgcgcacgccacgcgtgtggagctgtgcctgttcgacgaacagggcaacgagagccgtgtcgacctgcccgagtacaccaacgagatctggcatggctatctgcccgacgtaaagcccggccagcgctacggctaccgcgtgcacggtccctatgcacccaccgagggacaccggttcaaccacaacaagctgttgctggatccgtatgcgcgcgaactcgatggcgacctggtgtgggccgatgaattgtatggctacacggtcgggcatcctgatggcgacctgagcttcgacgagcgcgacagcgcgccgttcatgcccaagtgcgtggtggttgaagacacctacgactgggaagacgacgcgcgcctgctcaagccgtggaacgagactgtgatctacgagacccacgtacgtggctacaccatgcgcaacgcgcaggtgccggaagccgtgcgcggcaccttcgccggcctggcgcagccatcggtgctgcagtacatcaaggacctgggcattacggcggtggaactgctgccggtgcatgcgtatctggatgatcagcacctgctggacaagggcctgcgcaactactggggctacaacaccatcagcttcttcgcgctgaagtcgcgccacctttccagcggccatcgcgacgagttccgcgacatggtcaaggcgatgcacaagcaaggcctggaagtgattctggacgtggtctacaaccacactgccgaaggcagcgaactggggccgacgctctcgttcaagggcatcgacaacgccagctattaccgtctcgccgaagacaagcgctactacatcaacgacaccggcaccggcaatacgctcaacctgagcaactcgcgggtgatccagttcgtcaacgattcgctgcgctactgggccggcgaaatgcacgtggacgggttccgcttcgacttggccacgatcctgggccgcgagccgagcgggttcgatcaacgcggtggcttcctggatgcctgcaaccaggatccgctgctgtcggaagtcaagctcattgccgaaccatgggattgcggcccgggcggctatcaggtggggcatttcccgccaggttggtcggaatggaacgacaaattccgcgacaacgcgcgcgagttctggaagggcgaggacggcaagctggcagagtttgctactcgcttcaccggctctgcggacctgttcgaccgccgcggtcgccgcccctgggcatcggtgaacttcatcaccgcgcacgacggttttacgctgcgcgatctggtgagctacaacgagaagcacaacatcgacaacggcgaggacaaccgcgacggttcctccaacgatggctcgtgcaactacggcgaagaaggcgaaaccgacaacgccgacatcctgcaacttcgcgagcggcagatgaagaacctgctcgccacgctactgctctcgcaaggcacgccgatgatgctggccggcgacgagcgggcgcagtcgcagggcggcaacaacaacacctattgccaggacaacgagatcacctggctcgactgggagaacgaccccaccgacggccgcctgaccgacttcgtcaaatcactgaccgcgctacgtaaacgttacccgatcctgtcgcgtggccgcttcctcaacgggcagtacaacgaagaagctggcctgcgtgatctgacctggctcaatccgggcggcaccgagatggacgacgcgcactggaccgatgccggcgcgcgctcggtgggactgctgctggaaggcaaggcgcagacctccggcgtcaaggaacgcggcaacgacgctaccttgctgatcgtgatcaatgcctaccacgagggcgtgaccttcaccctgccctcttccgacgaaccggtgcactggaagcttgcgctctccaccgacgaagcgctggaagtggacagcatgccggccggcgccagcgagttcctggcaccgccgcgcagcatcacggtgttcgagtgcaaggtaggctgattgcctgagcatgcgttagcgagcccg

SEQ ID NO: 39512 - DNA, 2025 bp, Xanthomonas campestris
aagcgccgtgtgccgcatatccgtcagacggagtcgagcgagtgcggcctggcctgcattgcgatgctgctctcctactacggccatgaaacgagccttggggagcttcgcaaccgctttacggtgtcaaccagtggggcaacgctcgcctcgctgattgaaatcgctgacgccaacggactcacgacgcgtccgcttcgcttggagctttacgaactgcccaagctgtcgttgccttgcatggtccacctacaccacgggcactttgtcgtgctgacggctgtgaggggagggcatgttcacatcagcgatcccgcaacgggcgtcaaaaaaatcaagctcgatgagttcgatgagctttttagcggcattgcgttggaggcgcatccgggtccggccttcaagaagatcaagagcgtgccatcggtgtcgcttcgcgatctggcaggctcgcttcggtccctggtgcccgcgttctggggtgtgggcatcttggcgctcttcttggaaggctgtgcgctgattgcgccgcaatatctgagactgaccatggatcaggtgctcagcgtcaaggacgatggtctggtcaccacattggctatcggcttttcgatcgtgctcctggtccagctcgtcttgaccgttgccaggaagtggaccttgctgtggatctcttcgaccactggcttacggtggagcagcaacttgttccgtcacctcgtgtcgctaccccagtcgtatttcgtaaagcggcacaccggggatatttcaagccgcttccagtcgatctactccatccagcagtcactcacgacgaagatgatggaagcggtcatcgatggggtgatgtcttttctcatgttgttgctcttgatgagctacgacgcgccgcttgccttcgccttgttggctttcaccattgcctatgtgggttcgcgctacgcctactacgccaaactgaaagaagccaaccttgatcagatcaacattgatgcacgccggcaaagcttgctctacgaaacggtccgaagcatccagcccatcaagctgttcaacaagtcagcgctctgggcgtcgcgcttcacgaactacagcgcgaaagccaccaatgcaaccatcggggccgagcgtatccgcattgggttcgattctgtccagcttctcatccaaggcctgtgccgcattttcgtgatctgggagggcacacggctggtgctcagtggcgatatgacgatcggggtgctgacggtctttttgatctacgcgacccagttcagccaacgcagcatcaatttggccgactacttgatgcagctccggctgcttcgcttgcacaccgagcgcatttcagacatcacgcacagcgagcctgagtcgtttctgcatggcaacggcgcgctggaggatgctgcgccagctattgccattgccaacggctacttccgctactcgtctacggacaagtggatcatgagcgctttgcagctcagggccccggcaggccaagtgattgcaattgtcgggaactcaggcgtgggtaagaccacactcatccgcgttctggcggggcttgaagatcttcaagttggggacttcttagtcaatggagaggatctgcgcaaagtcggtaagtcgagctaccggagcaaggtcagcatcgtcatgcagggagacaatctgttgtccgggacgttgtcggaaaacatctccatgttcgatgagcacattgatcaagagcgtcttgtgcaggctgcgaaattggcatgcatccacgacgatattcagcgcatgccaatgggcttcaacaccagagtcggcgacttgggaaacacgctgtcaggcggtcaaaaacaacggatcttcttggcgagagccttttacaggcgcaccaagttgttgctgatggatgagccaacgactggggttgatgagcagatgggcatccagttgatgaagaacatcaagagcatcggcgcgaccacggtcgtcgtgacgcacgacaagaatatctctcggatgtgcgat

SEQ ID NO: 39513 - DNA, 759 bp, Xanthomonas campestris; identical to SEQ ID NO: 39145

SEQ ID NO: 39514 - DNA, 1485 bp, Xanthomonas campestris; identical to SEQ ID NO: 39146

SEQ ID NO: 39515 - DNA, 1191 bp, Xanthomonas campestris
gtgtccttctttgcaaatgtagaacaggttccaggcgaccccatcctgggcctgaccgaggcctacaacgccgacagccgccccaacaaggtcaatctgggtgttggcatctattacgacgaaaacgggcgcatcccgctgttgcgtgccgtgcagaagatcgagcagcagctcgcgctggatgccaaaccgcgcggctacctgcccatcgacggcctggccgcctacgacaaggccacccaggagctgctgttcggcgccgagtcggcgctggtggcctccggccgcgtggcgacctcgcagaccgttggcggcagcggtgcgctgcgcgtgggcgcggacctgctcaagaagctgctgcccacctccaccatcgccatcagcaaccccagctgggaaaaccaccgcgcggtgttcggcgcggccggcttcgaggtggtggattacacctatttcgatgccgccagccacgggctgaacttcgacggcatgctggccgacctggccaagctggagccgggcacggtggtgctgctgcatgcctgttgccacaaccccaccggtgccgacctcagccgcgagcagtggaagcagctggccggcctgttgaaagaacgcaacctgttcccgttcgtggacatcgcctaccagggcttcgacaagggcattgaagccgacgcctacgcagtgcgcctgctggcggccgaaggcatcgacacctacgtggtggcgagctcgtactccaagtcgttctcgctgtatggcgagcgcgtgggcgcgctgtcggtggtctcggccacggccgccgaagccaaggcggtgcagtcgcaggtcaagcgcatcatccgcacgatctactccagcccatccacgcacggcgccgccctggtggccggcgtgctgaccagcccggagctgcgcgatgtgtgggagcaggaactcaccgaaatgcgcgagcgcatccacgcgttgcgtgccggcctggtcgccaagctggccgcgctgggcgcaccggagttcgagttcatccagcgccaggccggcatgttctcgtactcgggcctgaccaagtcgcaggtggaccgcctgcgggacgagttcgcaatctatgcggtcggcaccggccgtatctgcgtggccgcgctgagccagcgcaatctggactacgtggcccaggccgtggccacggtc

SEQ ID NO: 39516 - DNA, 990 bp, Xanthomonas campestris
atgtcgcgtccctcgctgacccgcttcctgatcgaagagcaacacgccggccgtatcgacccggaattgcgccagctgatcaccatcgtctcgcgcgcctgcaagcgcatctccatcgccgtcagcaagggcgccctgggcggcgtgctgggcgatgccggcaccggcaacgtgcagggcgaggcgcagaagaagctcgacgtgctgagcaacgacatcctgctcgaagccaatgcctggggcggccacctcgccgcctgcgcatcggaagagatggaccacagccagccagtgcccgaccaataccccagcggcgatttcctgctgttgttcgacccgctcgatggcagctccaacatcgacgtcaacgtctcggtcggcaccatcttctcggtgctgcgcgcgcccaagggcaccgaaaagcccggcgacgaacacttcctgcagccgggcacgcaacaggtggccgccggctattgcatctacggccccagcaccatgctggtactcacgctgggccacggcacccacgcgttcaccctggagcgtgaggaaggcagcttcctgctgacccaggccgacatgcgcgtgcccgaagacactgccgaattcgccatcaacatgtccaaccagcgccactgggaaccggccatgcaggcctatgtgggcgacctgctggccggcaaggacggcgcgcgcggcaaggatttcaacatgcgctggatcgccagcatggtggccgacgtgcaccgcatcctgacccgcggcggcatcttcatctacccctgggacaagaaggacgcggccaagcccggcaagctgcgcctgatgtacgaagccaacccgatgggcatgctggtggaacaggctggcggcgccgcgaccacggggcgcgagcgcatcctggatattcaaccgacgcaactgcatcagcgcgtgccggtgtttttgggctcgaagaatgaggtggccgaggcgacgcggtatcac

SEQ ID NO: 39517 - DNA, 4000 bp, Xanthomonas campestris
gcaaggcaagcccggcaacccgcagctgcgccaggccttcgaacaggcgctggccgcctcacaggcgcaacggcaggcgcgtgccgcgcagcagccggcgatcacgctggatacgcaactgccgatcgcgcgcgaagccgatcgcatcatcgcgctcatccgcgaccatccggtggtggtgattgccggtgagaccggttcgggcaagaccacccagttgcccaagctgtgcctggcagccgggcggggtgcggccggcatgatcggctgcacgcagccgcggcgtatcgctgcgcgcgcggtggccgcgcgcgtggctgaagaactcaacaccccattgggcaccacggtggggttccaggtgcgcttcaccgatcgcgtgggtgaggactcgcgcatcaagttcatgaccgacggcattttgctggcggagatcgccagcgaccggtggttgtccgcctacgacaccatcatcgtggacgaagcgcacgagcgcagcctcaacatcgacttcctgctgggctatctcaaacagctgctgcgcaagcgtcccgacctcaagttgatcgtcacttcggccaccatcgacaccgagcggttctcgcggcatttcgatgacgcgccggtgatcaacgtggaaggccgcactttcccggtggaggtgcgctaccgcccgctcgaaggcgaatctggcgacggcgacaccggcgatgttgggcgcgatggcgaacgcaccgtcaacgacgccatcgtggcggcgatcgacgagatcacccgcatcgacccgcgtggcgatgtgctgatgttcctgccgggcgagcgtgagattcgcgatgcgcaccagtcgctggagcggcgcaaataccgtgagaccgaagtggtgccgctgtacgcgcggctgtcggcggccgaccaggaccgcgtgttcaacccgggcccgcgccggcgcctggtgctggcgaccaacgtggccgaaacctcgctgacggtgccgcgcatccgctacgtggtggatccgggctatgcgcgcgtcaagcgctacagcccgcggcagaagctggaccggctgcatatcgagccgatttcgcaggccagcgccaaccagcgcatgggccgctgcgggcgtatcgccgagggcatctgttaccggctgtacgcggaggcggatttcgccgcgcgcccggccttcaccgacccggagatccggcgcgcgtcgttgtcgggcgtgatcctgcgcatgctgcagttggggctggggcgcatcgaggagtttccgttcctggaagcgccggacgaacgcgccgtggccgatggctggcagcagctgctggagctcggtgcgatcgatgcggagcggcggctgacgtcgatcggccggcagatggcgcgcctgccggtggacgtcaaactggcgcgcatgctggtggccgcgcaacagcacggttgcctgcgcgagatgatcatcatcgccgcgttcctgggtatccaggatccgcgcgagcgcccgccggaagcgcgcgaggccgccgataacgcgcatgcgctgtttgccgatgcgcgctcggagttcgtcggcatcctgcgcctgtgggacgcctaccggcaggtacacgaagacctcacccagtccaagttgcgcgattggtgcggacggcattttctcggcttcctgcgcatgcgcgagtggcgtgaactgcaccgccagttgcgcttgctgtgcgaagaactgggctggagcgaagagccggccggcgcgatgctggcgccactgctggccggtgccagcgcgccggtgcgcgaggacgggcaggcgcaccgtgccacccgtgggcagctgcaccgtgccgcgcggctggcgcgcgaaggcaagccggatccggcggcgccacccgcgcaggcgaaggccgcggctgcaaagagctcacctgccgatgccaccgacgcggcggtgcgcactaccgagcgcgaacgtgctgccgcctaccaggccttgcaccgcgcactgctggcgggcctgccgacgcagattggccaccgcactgaaaaaggcgatttcctggctgcgcggcaacgccggttcgtgccgtttccgggctccgcgttggcacgcaagccgccaccgtggattcttgcggcgaccttgctcgacacccagaaagtgtggggcatgaccaatgcggcgatcgagccggactgggccattgccgagttgccgcacctgctggcacgcaagcatttcgacccgcactggtcgcgtgcacaagggcaggtggtggcctccgagcagatcagtctgttcggcctggtgctggcgcccaagaagccggtgcacttcggcaagatcgaccccgccacctcgcacgacctgttcgtgcggcagggcctggtgccgggcgaaatcaacacgcgtgcggcgtttgtcgccgataacctcaaggtgctggaacaggcgcgcgaagaggaagccaagctgcgccgcgccggcatcgtggccgacgaggactggcaggcgcgctggtatctggatcgcattccggccgaactgcattcggccagtggcctggatgcgtggtggaagaccttgcctgccgacaagcgccgcagcctgcattggtcgttgaacgatctgctgcccggcgaaggcagcgaggcggaccggttcccgaagtatttcgcgctgggcgatgcgcggttgccgttgcagtaccgcttcgagccgggggccatcgacgatggcgtgacgctcgaggtgccgttgcatttgctcaatgcgcttgatccgtcgcgcttgtcgtggctggcgcccggatttgtggccgacaaggcgtcggcactgatccgcagcctgcccaaggcgcagcgccgcaattacgtgccggctccggattacggccgcgcgttctacgaggccttcagcacgccatcggcggacgatatgcgcggcgagctggcgcgctttttgagcaaggccaccggtgcgccggtggcggcgctggatttcgacgaagaagcgctggacacgcacttgctgatgaacctgcggctgcgcgacgaggacggcagggtgctcgccgaatcgcgcgatctggtgggattacgtgcgcgctttggcgagcgtgccgggcaggcctttgccgcgcgtgccggacgcgcgctggcggcggaagggctgcgcgatttcccggccacgccgatccccgaacaggtggccggcgaagcgggcgtgcccgcctatccggccttggtggatcagggcgaggatgccgcgctacggatctttgccgaccgcaacgaagcgctgcgggcgcatccgcgtggtgtgcgccggctgctggaaattgccttggccgacaagatcaagcaggcgcgcaagcagctgccggtgtcgcccaagacggggctgttgtatgcagcgatcgaatcgcaggagcgcctgcgcggcgatctggtcgatgcggcgctcaatgcggtgctggccgaggggctgggcgcgatccgcgaccctgccgcgttcgcacagcgccgcgaggatgcggtcaagcggctgtttggcgaagcgatggcacggttgacgctggcagagagcattctcggcgcggtggccgaactcaagcctttactggaagcaccgttgatgggctgggcgcgtggcaatctggatgacatggaacagcagctacgcgcgctggtgcatgccgggttcctgcgcgacacgccggccgatgcgctggccaattatccgcgctatctcaaggcgatgatcctgcgcaccgaacgcgccaagcgcgaccccgcgcgcgaccaggcacgcatgctcgagctcaagccgttcgtggatgcactcaacgacgccgcggcgcgtgggctgcaacagcacccggattggcaggcgctgcgctgggatctggaagaactgcgggtgtcggtatttgcgcaggagctgggcgccaaatccggcgtctcggcgaaaaagttgtcgcaacgcgtggcggccttgcga

SEQ ID NO: 39518 - DNA, 1290 bp, Xanthomonas campestris; identical to SEQ ID NO: 39149

SEQ ID NO: 39519 - DNA, 1677 bp, Xanthomonas campestris; identical to SEQ ID NO: 39150

SEQ ID NO: 39520 - DNA, 1269 bp, Xanthomonas campestris; identical to SEQ ID NO: 39151

SEQ ID NO: 39521 - DNA, 825 bp, Xanthomonas campestris; identical to SEQ ID NO: 39152

SEQ ID NO: 39522 - DNA, 753 bp, Xanthomonas campestris
gcgccggtgaaggtggccgcacgcaatctggacttctattacgacaagtaccacgcgctcaagggcatcaatatcgaaatcccggaaaagcgcgtcaccgcgctgatcgggccatccggttgcggcaagtccacgctgctgcgcatcttcaaccgcatctatgcgctgtacccgaagctggaagcgcgtggcgaagtgctgctggatggcgaaaatatcctctcgccgaaatatccgatgaaccgcctgcgcagcaaggtcggcatggtgttccagaagccggtgccatttccgatgaccatcttcgagaacgtggcctacggcatccgtcaccacgagaaactgtccaaggccgacatgcagaaccgcgtcgagcacgcgctgcgccagggcgcgctatgggacgaggtcaaggacaagcttggccaaagcgcactgggtctgtccggtggccagcagcagcgcctgtgtatcgcgcgtgcggtggcgctgcggccggacgtgctattgctggacgaaccgacctccgcgctggatccgatttccaccagccgtatcgagcagctggtggaagaactcaagcgcgattacaccatcgtgatcgtgacccacaacatgcagcaggccgcgcgcgtgtccgattacaccgccttcatgtatctgggcgacctgatcgaacacgatcgcaccgaaaccattttctcgcagccgtccaagcagcagaccgaggactacatcaccggccgcttcggc

SEQ ID NO: 39523 - DNA, 1332 bp, Xanthomonas campestris
atgctcgataaagtcgtcattgccaaccgaggtgaaatcgcgctgcgcatcctgcgcgcgtgccacacgctcggcatccgcacggtcgcggtgcactccacggtcgaccgtaacctcaagcacgtggccatggccgacgagtcggtgtgtatcggcccggccgcgtccagcgacagttacctcaacatcccggcgctgatcgccgcggccgaggtcaccgacgcgcaggccatccaccccggctacgggtttctctcggaaaacgccgattttgccgagcgggtggaagaatccggcttcatcttcatcggccccaaggccgacaccatccgcctgatgggcgacaaggtcgaggcgatccgcgcgatgaaggccgccggcgtaccgtgcgtgcccggctcgggcggcccgctgggcgatgacatcgtggccaacaccaagatcgcgcgcgaaatcggctacccggtgatcatcaaggccgccggtggcggcggtggacgcggcatgcgcgtggtgcattcggaggccgcgctgaaggcggcgatcgaaaccaccaagtccgaagcaaaggccgctttcagcaacgatcaggtctacatggagaagttcctggagaacccacgccatgtggaaatccaggtgcttgccgatggccagggcaacgccatccatctgggcgagcgcgattgctcgatgcagcgccgtcaccagaaagtggtggaagaagcgccggcaccgggcatcagcgaagaactgcgcgctgagatcggcaaggtctgcgtggatgcgtgcatccgcatcggttaccgcggcgcgggcaccttcgaattcctgttcgaaggcggccggttctacttcatcgaaatgaacacgcgtatccaggtggaacacccggtgaccgagcgcatcaccggcatcgacctggtgtgcgagcagctgcgcatcgccgccggccacaagctgagcatcaagcagagcgacatcgtgctgcgcgggcatgcgatcgagtgccgcatcaacgccgaagacccggaaaccttcatgcccaacccgggcctgatcaccgccttccatccgccgggtggcccgggcgtgcgcgtggatacgcacatctatgccggctacaaggtgccgccgaactacgactcgatgatcggcaagctgatcgtgcacggcccggaccgcgagaccgcgatcgcgcgcatgcgcgtggcgctgagcgagatggtggtggacggcatcaagaccaacatcccgctgcagcagcgcatcatgcgcgacaagggcttccaggccggtgggcagaacatccactacctggaaaagcgactg

SEQ ID NO: 39524 - DNA, 438 bp, Xanthomonas campestris
atggcccacctgctgctgttgcacggccccaacctcaacctgctcggcacccgcgagccggaggtctacgggcgcaccacgctggcgcagatcgatgcggcgctggtggaccgtgcgcaggcggccgggcacacgctggactgcctgcagtccaatgccgagcacgtgctggtggagcgcatccacgccgcgcgcgaagacggcaccgccttcatcctgatcaacccggccgccttcacccacacctcggtgtcgctgcgcgatgcgctgctgggtgttggcctgccgttcgtggaaatccatctgtccaacccgcacacccgtgagccgttccggcaccacagctatctgagcgacaaggccgccggcgtgatctgcggcttcggcgccgacagctaccggctggcgctggaagcggtgatcgcgcgcctggagcgc

SEQ ID NO: 39525 - DNA, 1620 bp, Xanthomonas campestris
atggctgctaaagacattcgtttcggtgaagatgcgcgtacccgtatggtgcgtggcgtcaacgttctcgccaatgccgtgaaggcaaccctgggcccgaagggccgcaacgtcgtgctcgagaagagcttcggcgcgccgaccatcaccaaggacggcgtctctgtcgccaaggaaatcgaactggctgacaagttcgagaacatgggcgcgcagatggtcaaggaagttgcttccaggaccaacgacaacgctggcgacggcaccaccaccgccaccgtgctggcccaggccctgatccgcgaaggcgccaaggctgtggccgccggcatgaacccgatggatctgaagcgcggtatcgaccaggccgtcaaggccgccgtcatcgagctgaagaacatctccaagcccaccaccgacgacaaggcgattgcccaggtcggcaccatctcggccaactcggacgaatcgatcggcaacatcattgccgaagcgatgcagaaggtcggcaaggaaggcgtgatcaccgttgaagaaggctcgggcctggaaaacgagctggacgtggtcgagggcatgcagttcgatcgcggctacctctccccgtacttcatcaacaaccagcagagccagtcggccgatctggacgacccgttcatcctgctgcacgacaagaagatctccaacgtgcgtgacctgctgcccgtgctggaaggcgtggccaaggccggcaagccgctgctgatcgtcgctgaagaagtcgaaggcgaagccctggcgacgctggtggtcaacaccatccgcggcatcgtcaaggtcgtggccgtcaaggcaccgggcttcggcgaccgtcgcaaggcgatgctggaagacatggccgtgctgaccggcggcaccgtgatctccgaggaagtgggtctggccctggaaaaggccacgatcaaggatctcggccgcgcgaagaaggtgcaggtctccaaggagaacaccaccatcatcgacggcgccggcgattcggccacgatcgaagcccgcgtgggccagatcaagacccagatcgaagacacctcgtccgattacgaccgtgagaagctgcaggaacgcgtggccaagctggccggtggcgttgcagtgatcaaggtcggcgcgtcgaccgaaatcgaaatgaaggaaaagaaggcccgcgtcgaagacgccctgcacgccacccgtgcagccgtcgaagaaggcgtggtcccgggcggcggtgtggccctggtgcgtgcgctggtggccgtcggtaacctgaccggtgccaacgaagaccagacccacggcatccagatcgccctgcgcgccatggaagccccgctgcgcgaaatcgtggccaatgccggcgaagagccgtccgtgatcctgaacaaggtcaaggaaggcaccggcaactacggctacaacgcggccaacggcgagttcggcgacatggtcgagttcggcatcctggacccgaccaaggtcacccgttcggcgctgcagaacgcagcctcgatcgccggcctgatgatcaccaccgaagccatggtggccgatgcaccgaagaaggacgagccggcgatgccggccggcggtggcatgggcggc

SEQ ID NO: 39526 - DNA, 1761 bp, Xanthomonas campestris
atggccgaaatcaaggaagcacttgtccccgatatcggtgactacagcgatgtcccggtgatcgaagtgctggtgtcggtcggcgatacggtcagcaaggaccagagcctggtcacgctggaatcggacaaggccacgatggaagtcccctcgtcggtggccggcgtggtcaaggagatcaaggtcaaggtcggtgacagcctgtcgcagggcgcgctggtcgcgctgatcgaagtagccgatgccgatgccggtgccgagacggctgcggcgccagcgcctgccgctgcgcccgccaaggccgcacctgctgccgctcctgcgccggctgccaaggccgcgcctgccgcagcgtccgacggcggtcaggtcgaggcccgtgtgccggacatcggcgactacagcggcgtgccggtgatcgaagtgctggtggcggtgggcgacaccgtcgccaaggaccagagcctggtcacgctggaatcggacaaggccacgatggaagtgccctcgtctgtggccggcgtgatcaaggagctcaaggtcaaggtcggcgacagcctgtcgcagggcgatctggtggcgatcatcgctgccagcgatggcggcgccggtgcggcgcagtccccggccaagcccaccaccgacaccgctgaaaccgccggcaaggtcgagccggtggccgtcccggccgagccggacaagctggcccagcgcgagatcgcgcaggtgcagtcggcacggtccaccgcggcatcgcagccggcccaggcagcgcccggcaccccgagcagcccgccggtgaccttcgatgccgacagcgtgctgccgtccaaggtgccgtatgccagcccggtggtgcgcgtgttcgcgcgcgagctcggcgtggatctgaaccagatcaagggcagcgagaagggcggccggatcacccgtgaagacgtgcagcgcttcgtcaaggccgcactcagcggcggcgcgccggccgcagccggtgccgcaccggccggtggtggcaacggcctgaacctgctggcctggccgaaggtggacttcagcaagttcggcgaaaccgaaacccagccgctgtcgcgcatcaagaagatttccggtgcgaacctggcgcgcaactgggccatgatcccgcacgtcacccagttcgaatcggccgacatcaccgacctggaagccctgcgcgtggcgctgaacaaggaaaacgagaaggccggcatcaagctgaccatgctcgctttcctcatcaaggccagtgccgcggcgctgaagaagttccccgagttcaacgcctcgctcgatgcggccggcgaaaacctcacgctgaagaagtacatcaacatcggctttgccgctgacaccccgaacggcctggtcgtgccggtgatccgcgacgtcgacaagaagggcgtgctgcagatcgcgcaggaaagtggcgagctggccaagaaggcacgcgacggcaagctgggcccggccgacatgagcggcggctgcttctcgatcagctcgctcggtggcattggcggcaccgcgttcacgccgatcatcaatgcaccggaagtggcgatcctgggcgtgtccaagtcggcgatgcagccggtctggaacggcaaggacttcgcaccgaagctgatgctgccattgtcgttgagctacgaccaccgcgtcatcgacggcgcgctggccgcgcgcttcaccacctatctcagccaggtgctcgccgacatgcgacgcgtcctgctgtgagag

SEQ ID NO: 39527 - DNA, 759 bp, Xanthomonas campestris
ttgcaggaccgcgtggtgatcatcaccggtggtgcgcaagggattggccgcggcattgcgcaggctgtgctcggtgccggcggcagcgtggtgattggcgatctggatgccgatgcgggcaaggcctgcctgcaggactgggcactgccgcgccgcagcgccttcgtgcgtgccgacgctgcgcgcgaaccacatgccgcgcgcctggtcgccaccgcgctcaaacgtttcgggcggctcgacggcctggtcaataacgccggcgttccggacccgcatatcgctgcgctggcacaactggaatggcaggaatggcagcgccggctctcgagcctgcatggcgcgttcctgtgcagcaagcatgccctgcccgcgctcgcaaaggccgccgatggcggcgccatcgtcaacatcgcctccacgcgcgcctggcaatccgaaccccatagtgaagcgtatgccgccgccaaaggtggcctggtggcgatgacgcatgcattggcgctgagcgaaggcccgcaggtgcgcgtcaacagcatcagccctggctggatcagtaccgatgcctggcgtgcaccggcgcgccgacgcgcacccaagctctcgcggcgcgatcatgcacagcatccggttggccgcgtcggcacgccggaggacatcgcgcaattggctgtgtatctgctggcgccgcagctgtcgggctttgtgaccgggcaggacttcattgtcgacggcggcatgtcgcgcaagatgcagtac

SEQ ID NO: 39528 - DNA, 582 bp, Xanthomonas campestris
atgaccgccgccacgccgctgccgttctggccgcaggcggtgatcttcgacatggatggcctgatgctcgacagcgagcgcgccatcaccgcctgcctgtcacaggccgccgacgagcatgggctgcagatcgagcccgcattctggttgcgcatggtcggcaccggtgatgccgcgtgccggcgcctgcttggcgagcgcatcggcaccacggccatggagcacgtgctggcgcgctgccaaggcttgtacgacgccgcggtcagcgcgggtattgcgcatcggcccggcatcatcgcgttgctcgagttcctcattgcgcacggcatgccgcgtgcggtggccacctccacccagcgcccgctcgcgttgcgcaagctggctgcctccgatctgttgtggcgtttcgatgcggtgtgcaccgccagcgatgtcgcgcacccaaagccggcgccggatatctacctgctggccgcgcgcacgctgggcgtggaccctgcgcagtgcctggtgctggaagattcacccaccggggtgcgtgctgcactcgctgcgggcatgaccccgatccaggtgccggac

SEQ ID NO: 39529 - DNA, 1309 bp, Xanthomonas campestris
gacctggagcactacggccgtgactggacgcgccgctggacgcccaatccgctggccatcgcgctgccggggtcggtggaagaagtgcaggcggtggtgcgctgggccaacacgcatgcggtggcggtggtgccctcgggcgggcgtaccggtttgtctggtggcgcggtcgcggccaatggcgagctggtgctgagcctggagcggttgaacaagccgctggccttcgatgcggtggatcgcacgctcaccgtgcaggccggcatgccgctggaagcggtgcacaacgccgcgcgcgagcacggcctggtgtacccggtggatttcgcagcgcgtggttcgtgctcgatcggcggcaacatcgccaccaatgccggcggcatccgcgtgatccgctacggcaacaccccgcgaatgggtggccgggctcagcgtggtcaccggcaccggcgagctgctgcatctcaacaatgcgttggtgaaaaattccagcggctacgacttccggcatctgatgatcggctcggaaggcacgctgggtatcgtggtcgaagcaaccctgcggctgaccgacctgccgccgccgagcaacgtgatgctgctggcgctgccgtcgttcgatgtgttgatgcaggtgttcgcggcgtttcgcgcacagctgcggctggaagcgttcgaattcttcaccgaccgcgcgctggagcacgtgctggcgcacggcgcgcaggcgccgtttgcgcaggtgcacccgtactacgtggtgaccgaattcgctgccggcgatgaggcgcaggaagcggcggcgatggcggcgttcgaggcctgcatggagcagggctgggtgagcgacggggtgatcagccagagcgatgcgcaggcggcgcagctgtggcgcctgcgcgaaggcatcaccgaggcgctggcgcgttacaccccttacaagaacgatgtgtcggtgcggatctcggcgatgccggcgttcctggccgagacgcaggcactgctgcacgatgcttacccgcatttcgatgtggtgtggtttggccatatcggcgacggcaacctgcatatcaacgtgctcaagcccgatgccaccagccaggcagatttcatcactgcctgcgagcaggtcaccaagttgctggcgcagagcctgcagcgtttcgacggcagcatctcggccgagcacggcattggcctggtcaagaaaccgtacctgtggagtacgcgctcggcggcagaaatcgcgctgatgcgcggcatcaaacaggtgctcgacccccatcttttgctgaatccaggcaagctg

SEQ ID NO: 39530 - DNA, 711 bp, Xanthomonas campestris
atgacaacttctcccgtgaaagttctgatccacggtgcctccgggcgcatgggcaaggcattgctgcgattggccgccgaagacgacgccttgcacgtcgtcggtgcggtggtggggcggtcgccctcccagcgcgtggtggacggcgtgccgtacttcgccgccaacgaactgggcggtgcgccggcgttcgatgtggcgatcgacttcagcctgccgcagggctttgcgccgatcctggcgttgtgcgtgcagcgcggcaaaccgctggtctcgggcaccaccgggctggacgaggcgcagcgggccggcttgctgcaggcagcgggccagattccgctggtgtgggcgtccaatttcagcctgggcgtggcggtgctcaccgaactggtggagcgcgccgccggcagcctgccgggctgggactgcgacatcatcgaagcccatcacgtgcacaagcaggacgccccctcgggcaccgcgctgacgctgggtgaggctgccactggcagcggggcacagccgcggtttgccagcgtgcgtgccggtgacatcgtcggcgagcacagcgtgcagttcaccgggctgggtgaacgcgtcgagctgatccaccgcgccaccaaccgcgacatcttcgcgcgcggtgcgttgcatgcggccaagcgcctgctcggcaagccgccgggcagctaccgggtgcgcgatctggtg

SEQ ID NO: 39531 - DNA, 1122 bp, Xanthomonas campestris
gtgacccaacccgcaatccttgtcctcgaagacggcaccgtgttcgagggcgaatccgtaggcgccaacgggctatccgtcggcgaagtggtgttcaacaccgccatgaccggttaccaggaagtcctgaccgatccgtcctacgcccgccagatggtcacgctgacctatccgcatatcggcaacaccggtttcaacgatcaggacgacgaggccaagcaggtgtgggccgccggcctgatcgtgcgcgatgtgccgcgccgccccagcagctggcgcaaccaggtggcgctgccggattggttgcagacccgcggtgtggtggccatctccggcatcgacacccgcaagctgacccgtctgctgcgtgagaaaggtgcgcagaacggtgcactgatggccggcgagatcgatgtcgaaaaggcattggaagccgcgcgcaagttccccggcctgaagggcatggacctggccaaggtggtctccaccgaaaccacctatcagtggcaggaaggtcagctggacctaaacgcgaacgccttcttgcaggccgagctgaagttcaaggtcgtggcctacgactacggcgtcaagatcaacatcctgcgcatgctggccgagcgcggttgcgaggtcaccgtggtaccggcgcagacgccggtggccgaggtgctggcgctgcagcccgatggcgtgttcctgtccaatggccccggcgacccggagccgtgcgattacgcgatcaccgcgatccaggaattgatcgccaagaaggtgcccaccttcggcatctgcctgggccaccagttgctggcgctcgccgccggcgccaagacggtcaagatggccaccggccaccacggcgcgaatcaccccgtgcaggatctggagggtggccgggtgatgatcacctcgcagaaccatggctttgcggtggacgaaaccacgctaccggccaacgtgcgggtgacccatcgctcgctgttcgatggcaccaaccagggcatcgccctgaccgacgcgccggcgttctcgttccagggccacccggaagcctcgccgggcccgcgcgatgtcgggccgttgttcgatcggtttgtcgcatcgatggccgaggcgaag

SEQ ID NO: 39532 - DNA, 3240 bp, Xanthomonas campestris
atgccaaagcgcaccgaccttaaaaccatcctgatcatcggcgctggcccgatcgtcatcggccaggcctgcgagttcgactactccggcgcgcaggcgtgcaaggcgctgcgcgacgagggttatcgcgtggtgctggtcaacagcaacccggccacgatcatgaccgacccgaacatggccgacgccgtgtacatcgagccgatcaactggcagacggtcgagaagatcatcgccaaggaaaagcccgatgccctgctgccgacaatgggcggccagaccgcgctgaactgcgcgctggacctggccgaccacggcgtgctggagaagtacaacgtcgagctgatcggtgccaagcgcgaagcgatccgcatggccgaagaccgcgagctgttccgcgtggcgatgggcgagatcggcctggattgcccccgggccgaagtggcgcacacgctggaagaagcgctggatatccagacccgcgtcggctacccgaccatcatccgccccagcttcacgctgggtggcagcggcggcggcattgcgtacaaccgcgaagagctgatcgacatcgtcggccgcggcctggaactgtcgccgaccaccgaggtgctggtggaagaatcggtgctgggctggaaggaattcgagatggaagttgtgcgcgatactgcggacaactgcatcatcgtctgcgcaatcgaaaacctcgacccgatgggcgtgcacaccggcgactcgatcaccgtggcgccggcgcagacgctcaccgacaaggaatatcagcgcctgcgcgatgcctcgatcgcggtgctgcgcaagatcggcgtggataccggcggctccaacgtgcagttcggcatcagcccgaccaccggccgggtggtggtgatcgaaatgaacccgcgcgtgtcgcgttcgtcggcgctggcgtccaaggccaccggcttcccgatcgccaaggtcgccgccaagctggcggtgggctacacgctggacgaattgaagaacgagatcaccggtggcctgaccccggcctcgttcgaaccgtcgatcgactacgtggtcaccaagattccgcgctttgcctttgaaaaattcccgcaggccgatgcacgcctgaccacgcagatgaagtcggtcggcgaagtcatggcgatgggccgcaccttccaggaatcgctgcagaaagcgctgcgtggcctggaaaccggcaagatcggcctggacccgaccggcctggatctgggcagcgaagacgacatggccgcgctcaagcgcgagctcaaggctccgggcccggagcgtctgttctacgtgggcgatgcgttccgcgccggcatgagcgtggccgacgtgtatgcgctgtcgttcatcgacccctggttcctggaccagatcgaagagttgatcagcctcgagcagcagctggccgacgatggcatggcggcactggatgccccacgcctgcgcctgctcaagcgcgccggtttctccgacgcacgcctgggcgagctcatcggcaccaacgaagaagccgtgcgcacgctgcgccgcgcgctcaaggtgcgcccggtgtacaagcgcgttgactcgtgcgcggctgaattcgccaccagcactgcgtacctgtattcgacctacgaggacgagtgcgaagcgctgccgagcaaccgcgacaagatcatgatcctgggcggtggccccaaccgcatcgggcagggcatcgagttcgactactgctgcgtgcacgcggcactggcgctgcgcgatgacggcttcgagaccatcatggtcaactgcaacccggaaaccgtctccaccgactacgacacctccgaccgcctgtacttcgagccgctgacgctggaagacgtgctggagatcgtcgagctggagcagcccaagggcgtgatcgtgcagtacggcggccagaccccgctgaagctggcgcgtgcgctggaagccaacggcgtgccggtgatcggcacctcgccggactcgatcgatctggccgaagaccgcgagcgcttccagcagctggtcgacaagctgggcctgaagcagccgccgaaccgcattgcccgcaatgccgacgaggccttggtgctggcgcgcgaaatcggctacccgttggtggtgcgcccgagctatgtgctgggcggccgcgcgatggaaattgtgtacggcgaatccgacctggcgcgctatgtgcgcgatgcggtgaaggtctccaacgattcgcccgtgttgctggaccgcttcctcgacaacgcggtggaagtggacgtggacatcattgccgacaaggacggcaacgtgctgattggcggggtgatggagcatatcgaagaagccggcgtgcattcgggcgattcgtcctgctcgctgccgccgtattcgctgtcggccgaaacccaggccgagctgcgtcgccaggtggtgatgctggccgaaggcttgaatgtggtcggcctgatgaacacccagttcgcggtgcaggtcaacgacgccggcgatgacatcgtgtacctgctggaagtgaacccgcgtgcctcgcgcaccgtgccgttcgtgtccaaggccaccggcatgccgctggccaagatcgctgcacgctgcatggccggcaagacgctggccgagcagggcgccaccaaggaaatcgtgccggactactactcggtgaaggaggcgatcttcccgttcgccaagttccagggcgtggacccgatcctcgggccggagatgcgctccaccggtgaggtgatgggcgtgggccgcagcttcggcgccgcgtttgcgcgcgcgcaggaagccggcggcatcaaggcgccgccgctgggcaaggccttcgtgtcggtgcgcgatccggacaagcagcgcgtgttgccggtggcccaggccctggtggagcgcggcttcaccctggtggccacgcgtggcaccggtgcgtggttgcagcagcacggcctgagctgcgagatcgtcaacaaggtggccgaagggcggccgcatatcgtcgactcgatcaagaacggcgagatcgtctacatcgtcaacaccaccgaagggcgcgcggcgatctccgattcgttctcgatccgccgtgaagcgctgcagcatcgcgtgacctattcgaccaccgtcgccggcgccaaggcgctggtgcattcactggaattccgcggcaccggccccgtctggtcgctgcaggaactgcacaaggagctggaagca

SEQ ID NO: 39533 - DNA, 2031 bp, Xanthomonas campestris; identical to SEQ ID NO: 39163

SEQ ID NO: 39534 - DNA, 1659 bp, Xanthomonas campestris
tggttgcaaagttatccggccggagtggccgcggagatcgatctggagcagttccgcaccgtggcggaggttttcgccacatcggtggcgcgcttcgctgatcgccccgcgtatcacagcttcggcaagaccattacctaccgcgaagcagatcagctggtcgaccagttcgcggcctatctgctcggcgagttgcagctgaaaaaaggcgaccgcgtcgccttgatgatgcccaactgcctgcaatacccgattgccaccttcggcatcctgcgcgccggtctgaccgtggtgaacgtcaacccgctctacaccccgcgcgagctcaagcaccagttgatcgactcgggcgccagcgtgctggtggtcatcgacaacttcggcaccaccgtgcagcaggtgatcgccgacacgcaggtcaagcaggtcatcaccaccggcctgggcgacatgctcgggttcccgaaggctgcactggtcaactttgtcgtcaagtacgtcaagaagctggtgccggagtaccgcatcaacggcgcgatccgcttccgcgacgcgctggcactgggccgcaagcaccgcgtcccgaccctgcagatcgagccggacgacatcgcctttttgcagtacaccggcggcaccaccggcgtagccaagggcgcgatgctgacccaccgcaacctggtcgccaacatgcagcaggcgcaccagtggctggccggtaccggcaagctggaagaaggccacgaggtggtgatcaccgcgttgccgctgtatcacatcttcgcgttgacggcgaacggcctggtcttcatgaagatcggcggctgcaatcacctgatcagcaacccgcgcgacatgccgggcttcatcaaggaactcaagaagacccgcttcaccgcgtttaccggcgtcaatacgctgttcaatggcttgctcaatacgcccggcttcgatcagatcgacttttcgtcgttgaagatgaccctcggcggcggcatggcagtccagcgctcggtcgccgaacgctggaagcaggtgaccggcctgactctggtcgaggcttacggcctgaccgagacctcgcccgccgcctgcatcaacccgatggatctggtcgactacaacggctcgatcggcctgccgattccgtccaccgatgcctgcatcaaggacgacgatggcaaggtgctggcgctgggcgagatcggcgagctgtgcatcaagggcccgcaggtgatgaagggctattggaagaaggccgacgagaccgccaaggtcatggacgccgaaggctggctgcacaccggcgacatcgcacgtatggacgaacgtggcttcgtctatatcgtcgaccgcaagaaggacatgatcctggtgtccggcttcaacgtgtaccccaacgagatcgaagacgtcatcgcgacgatgccgggcgtgctcgaagtggccgcagtcggcgtgccggatgaaaagtccggcgaaatcgtcaaggtggtgatcgtcaagaaagaccaggccctgaccgccgaggatgtaaaggcgcactgccgcaccaacctgaccggctacaagcagccgcgcgtgatcgagttccgcaaggaattgccgaaaaccaacgtcggcaagatcctgcgtcgcgaattgcgggatgcggccaag

SEQ ID NO: 39535 - DNA, 2745 bp, Xanthomonas campestris
agcgattccttttccacccgcacctcgctagaggtcaacggccagcgctacgattactacagcctgcccaaactgggcgagcgcttcgatgtcgcccgcctgccctactcgatgaagatcctgctggagaacctgctccggcatgaagacggtggcgtcaccgtcggcaaggaccacatcgaagcggtcgccaagtgggacccggccgccgaacccgatatcgaaatcgccttcatgccggcgcgcgtggtgctgcaggacttcaccggcgtgccctgcgtggtcgacctggccgcgatgcgcgatgcggtggtcaagctcggtggcaatgccgaccagatcaatccgcagattccctccgaactggtcatcgaccactcggtgcaggtggacgtgttcggcaagcctgaagcgctggacctcaacggcaagatcgaattccagcgtaaccaggagcgctacggcttcctgcgctggggccagaaggccttcgacaacttcaaggtggtgccgcccaacactggcatcgtccaccaggtgaacctggaaaacctggcacgcgtggtgatgagcgcggacaaggacggcacccagatcgcctatccggacaccgtgttcggcaccgacagccataccaccatgatcaacggtatcggcgtgctgggctggggcgtgggcggcatcgaagcggaagcggcgatgctcggccagccctcttccatgctgattccgcaggtagtgggcttcaagctcaccggcaagctgcccgaaggcgccaccgccaccgacctggtactcaccgtcacccagatgctgcgcaagcacggggtggtgggcaagttcgtggagttctacggtgaaggcctgcagcacctgccgctggccgaccgcgctaccatcggcaacatggcgccggaatacggtgccacctgcggcatcttcccggtcgacaatgaatcgctgacctacctgcgcctgtccggccgcagcgaggaacagattgcactggtagagacctacgccaaggcacagggcctgtggcatgacgccgacaccccgcatgcgcagtacagcgccacgctggagctggacatgggcgacgtcaaaccgtcgctggccggccccaagcgcccgcaggaccgcgtgctgctggaagacatgcagtccaactaccgcgaaagcctcaagccgttcgccgaggcgcgcagcaagcgtctggccgataccaagcaggaagaccggctcaagaacgaaggcggcggcggtaccgcagtgggcgccaaggcctcgcaggccgaaagcgctggcgacagcggtgcgggctggcagctgcgcgatggctcggtggtgatcgctgcgattacctcgtgcaccaacacctccaacccggcagtgatgctgggcgccggtctgctcgcccgcaatgccgcagccaagggcttgaaggcgcagccctggatcaagacctcgcttgggccgggctcgcgcgtggtcaccgactatctgaccaaggccggcgtgctggccgacctggaaaaactcggcttctacgtggtgggctacggctgcacgacctgcatcggcaactccggcccgctgccggaagacgtctcggcggcaatagccaaggatgacctggtggtgacttcggtgttgtcgggcaaccgcaacttcgaaggccgcgtgcatcccgaggtcaagatgaactatctcgcctcgccgccgctggtggtggcgtatgcgatcgccggcaccaccgacatcgacctcacccgcgacccgctcggcaccggcagcgacggtcagcctgtgtacttgcgcgacatctggccgagcaacaaggaaatcggcgacaccatcgccgccaccgtcggcccggaaatgttcaagcagaactacgccgatgtgttcaagggcgatacgcgctggaacaccatcgcctcgccggatggcgcgctgtacgagtgggatgccgcatccacctacatcaagaacccgccctatttcgaaggcatgacgatgcaggtgggccacgtcgacgacgtgcatggcgcgcgcatcatgggattgttcggcgactcgatcaccaccgaccacatctccccggcgggcaacatcaagaaggattcgcccgcgggccggttcctgcaggagcgcggcgtacagccggccgacttcaacagttacggcagccggcgcggcaacgatgatgtgatggtgcgcggcaccttcgccaatatccgcatcaagaacctgatgttcggtggcgaggaaggcggcaacacgctgtacttcggaaaggacggcgccgcgcccgagaagctggccatctacgacgcggcaatgaagtacaaggccgatggcgtgccgctggtggtgctggccggcaaggaatacggcaccggctcctcgcgtgactgggccgcaaagggcaccaacctgctgggcgtcaaggccgtggtcgccgaaagcttcgagcgcatccaccgctccaacctggtcggcatgggcgtgctgccactgcagttcctggaaggcgaaaatgcgcagacactgggcctggatggctcggaagtgctggacatcaccggcttgcaggacggtgccagccgtcgcgccaccatcgatgcgaaaaaatccgatggcagcgtcaagcagttccaggtcaaggtgctgctgctgacgccgaaggaagtggagtacttcaagcacggcggcctgctgcagtacgtgctgcgccaactg

SEQ ID NO: 39536 - DNA, 2134 bp, Xanthomonas campestris
actgcaaagaccctgtacgacaagttgtgggagatgcacgaggtcacgcgccgtgacgatggctcgtcgctgatctacatcgaccgccacatcctgcacgaagtgacctcgccgcaagccttcgaaggcctgcgtcttgccgggcgcaagccgtggcgcatcgatgccaacatcgccacgcccgaccacaacgtgcccaccacccgtgccgagcgccagggcgggctggagtccatctccgatgaagtctcgcgtctgcaggtgcagacattggacgagaactgcgacgacttcggcatccttgagttcaagatgaacgacacgcgccagggcatcgtgcacgtggtcggccccgagcagggcgccacgctgccgggcatgacggtggtctgcggcgattcccacacctccacgcatggcgccttcggtgcgttggcgcatggcatcggtacttccgaggtcgagcatgtgctggccacgcagtgcctgatcgccaagaagatgaagaacatgcaggtgcgcgtggaaggcacgctgccgttcggggtcaccgccaaggacatcgtgctggcagtgatcggcaagatcggcacggccggtggtaacgggcatgcgctggaatttgccggcagtgcgatccgcgcgctgtcgatggaaggccgcatgaccatctgcaacatgtccatcgaagccggtgcgcgcgtgggcatggtggcggtggacgaaaagaccatcgcctacgtcaagggtcgcccgttcgcgccgaagggcgcggattgggacgcggccgtggcgctgtggcgcacgctggtgtccgacgccgatgcgtccttcgacaccgtggtggaactgcgtgccgaagacatcaagccgcaggtcagctggggtacctcaccggagatggtggtggcaatcgaccagcaggtgcccgacccggcggccgagcaggacccgaccaaacgcgattcgatccagcgcgcactcaaatacatgggcttgcgggcaaaccagccgatcaccgagatccatctggaccgcgtgttcatcggctcatgcaccaactcgcgcatcgaagacctgcgcgctgccgcggcggttgccaaaggccgcaaggtggcctccaccatcaagcaggccctggtggtgccgggctcgggactggttaaggcacaggccgaggccgaagggctggacaagatttttctggatgccggtttcgagtggcgcgagcccgggtgctcgatgtgtctggcgatgaacccggacaagttgggcagcggtgaacattgcgcgtccacgtccaatcgcaactttgaagggcgccagggcgccggtgggcgcacgcatctggtcagcccggcgatggccgcggctgcggcggtgagcgggcactttgtcgatgtgcgtgagttgcagggaatcgagactcgggaatagggaatcgccacctcccgcctccaccctgccacaccattctctactcccaattcccggtattcccatgaccccttttacccaacacaccggactggtcgcgccgctggatcgtgccaacgtcgataccgaccagatcattcccaagcaattcctcaagtcgatcaagcgcaccggtttcggcccaaatctgtttgatgagtggcgctatttggacatcggcgagccgggccgcgacaacagcacgcgccccctcaaccaggagttcgtgctcaattttccgcgttaccagggcgccagcgtgctgctggcacgcgagaacttcggctgcggttcttcgcgcgaacatgcgccgtgggcactggacgaatacggcttccgcgcagtgattgcgccgagttttgcagacatcttctacaacaacagtttcaagaacggcctgctgccgatcgtgctggcagaggcggaaatggatgccttgttcgagcagtgcctggggaacgaaggctaccaactcaccgtcgatctggccgcgcagcgcgtgcgccggcccgatggtgtggagtacgcgttcgagatcgatgcattccgcaagcactgcctgctcaatgggctcgacgatatcggcctgaccttgcaggacgccgacgcgattggccgcttcgagcaagggcatcgcgcgcaacagccgtggttgttc

SEQ ID NO: 39537 - DNA, 1242 bp, Xanthomonas campestris
cccttctaccgccagttgtatttccaggtggtggtggcgatcgttcttggcgccctgctgggccatttcgagccggccttcgccgaaagcctcaagccactcggcgatgccttcatcaagctggtgaagatgatcatcgcgccggtgatcttcctgaccatcgtcaccggcatcgccggcatgacccacctcaagacggtgggccgggtcttcgccaagtcgatgacctacttcctgttcttctccacgctggcgttgatcgtcggcatggtggtggcgcacgcggtgcagccgggcgccggcatgaacatcaacccggccgagctggaccagagcgcggtcaacacctacgtgcagaagtcgcacgagctgagcctggtcggctttttgatggacatcatcccggccacgctgatcagcgcgttcgtcgatggcaacatcctgcaggtgctgttcgtggcggtgctgttcggcatcgcgctggccctggtgggcgagcgtggccgcccggtgctgagcttcctggaagcgctcaccgccccggtgttccgcctggtgcacatgctgatgaaggccgcgccgatcggtgcattcggtgcaatcgctttcaccatcggcaagtacggtgtggaatcgctggtcaatctggcctggctggtgggctcgttttacctgacctcgctgttcttcgtgctggtgatcctgggcatcgtgtgccggttgtgcggcttttcggtgctcaagctgatccgctacctcaaggccgagctgctgctggtgctgggcacctcctcgtcggaatcggcattgccgtcgctgatggagaagatggaaaaggccggctgtgagaagtcggtggtgggcctggtcgtgccgaccggctactcgttcaacctggacggcaccaacatctacatgaccctggcggcgctgttcatcgcccaggccaccaatgtggacctgaccctgggccagcagatcaccttgctggcggtggcgatgctcagctccaagggcgcggccggcgtgaccggcgccggcttcattacgcttgcggccacgctgtcggtggtgccggatgtgccggtggccggcatggcgctgatcctgggtgtggaccgcttcatgagcgagtgccgctcgctgaccaacttcatcggcaatgcagtggccacggtggtggtgtcgcgttgggaaaatgcgctggaccgcgaccagttgagcctggcattggacggccgt

SEQ ID NO: 39538 - DNA, 942 bp, Xanthomonas campestris
agcatcgccgccagcgccgtgttggcgatgagcgcactgggcagtaccgcggccttcgctgcagacccggtctataccgtggccaagcagggcaacgctggttaccgcaccgtgcaggccgcggtggacgccgccgtgcagggcggcaagcgcgcgcagatcagcgtcggcgcgggcgtgtatcaagagctgctggtggtgccggccaacgcaccggcattgaagatggttggcgctggcaccacgcaaaccgtcatcacctacgacaactacgccgcgcgcatcaatccggccaccggtaaggagtacggtacctccggctcgtccagcgtcatcatcgccggcaacgacttcaccgccgagcaactgagcttcggcaaccacgcgggcccggtgggccaggcggtggcggtgcgcgtggatggcgaccgcgcggcgttccgcaatgtgcgtttcctcggctaccaagacacgctgtacctgcgcggcgccaagctctcgtattttctcgactgctatgtcgaaggcaccgtggatttcgtcttcggcgccggcactgccctgttcgaaaacgtgcagctgcattcgctgggcgatggctatctcaccgctgcttccacgccgcaggagagcgcacgcggcttcgtgtttcgcaatgcacgcatcaccgccgccagcggtgtctcgcgcgtgttcctgggccggccgtggcggccgtacgccagcgtgagtttcatcactagccagctcggcgcgcacatcgtgcccgagggctggaacaactggggcaacgcggccaacgaggccaccgcccgctacagcgaataccagaacaccggcgccggggccaacccgtcgcgccgcgtgaaatggtcacgccagctcaccgccgcacaggccgctgcgctggaccgctccaccgtgctgggctcctggaggccg

SEQ ID NO: 39539 - DNA, 969 bp, Xanthomonas campestris
aagaaccaggtggtgtgtttcggcgaagcgctgatcgacatgctggcgctgccgccggccggcccggacgaggcccgcaccttcgcccaatatgcgggtggcgctccggccaacgtggctgttgcggtggcacgcctgggcggcgcggcgcattttgtaggcatgctcgggcgcgacatgtttggcgattttctgctggagagcctgcagcaggccggtgtcgtgaccgatggcatcgtgcgcaccgatgaggccaagacggcgctggcattcgtcgcgctggatgcggccggcgaacgcagtttcagcttctatcgcccgccggcggccgacctgttgttccgtgccgaacatttcgccgccgatggctttgcgcaggcggccgtgttgcacgtgtgctccaacagcatgaccgagccggccatcgcgcggtgcacgctcgacggcatgcgccgcgcgcgtgccgatggcgccatcgtcagcctggatctcaatctgcgcccgatgctgtggccgcaggatgtcgacccggcaccgctgttgtgggaagcgctcgcgcttgccgacgtggtgaaactgtcgcgcgaagagctcgactatctcgccggcacgctcgacagcgatgccagcgcggtgacgcagaagctgtggcaaggccacgcccgttggttgcttgtcaccgatggcggcgggccggtgcattggcagacgcgtgtggattccgggcaggtgcccgcgttccatgtgcaggtgcgcgacagcacggcggccggcgatgccttcgtgggcggcctgttgttccagctggcggcgcgcgcgagcccgcttgagcagctgtgtgccgacccggcggccattgccgaggtgattcgcttcgccgccgccgttggtgcgctggcagtgacacgcaagggcgcgtttgccgcgatgcccagcgttgacgaggtccattctttgatccaggaacaa

SEQ ID NO: 39540 - DNA, 1326 bp, Xanthomonas campestris
atgcgagttgcgatctttggtaccggctatgttggtcttgtcaccggtacctgtctggcggaagtaggtcatcacgttatctgcgtggatatcgaccaggcgaaagttgatggtctcaatcgtggggtgattcccatctatgaacctggcctggagccgatggtgaaagccaaccacgcctctggccggttgcgcttcactaccgacgcggccgaggcgattgcgcacggcgaaatcaccttcatcgccgtgggcacgccgccggacgaggacggcagcgccgacctgcagtacgtgctggcggttgcgcgcaccgtgggtcgtcatatcgacgggccgtcggtgatcgtcaataagtccacggtgccggtcggtaccgccgacaaggtgcgcgcggccatccaggaagaactggatgcacgcggcgtggaccatgagttcgacgtggtttccaaccctgagttcctcaaggaaggtgacgcggtggccgactgcatgcgcccggaccggatcgtgatcggtgccaagaagccggcagcgattgcacgcatgcgccgtctgtatgcaccgttcaaccgcaaccgcgatcgcatcgtggaaatggatgtgcgttcggccgagctgaccaagtacgcggccaacgcgatgctggcgaccaagattagtttcatgaatgaaatcgccaacattgccgagcgtgtcggtgcggacgtcgagcacgtgcgtaacggtatcggttcggatccgcgcattggctggcacttcatctatcccggcgccggttacggcggctcgtgcttcccgaaggatgtgcaggcgctggccaagaccgcgcagcagtacggcatgcagccgaccctgctcaatgcggtggaaagcgtcaacaacgcgcagaagggtcatttgttcgaactggtgcagcgtcactatgccgatggcaacggcagcatcgccggcaagacctttgcggtgtggggcatggcgttcaagcccaataccgatgacatgcgtgcagcctccagccgtcgcctgatggcgcagttgtgggaagccggtgccaaggtgcgcgcgtacgaccccgaagccacgcacgaagccaagcgcatcttcggcgagcgcgacgacctggcgttctgcgacgacgccttcgccgcactggaaggcgccgacgcgctggtcgtggtcaccgagtggaagcagttccgcagcccggatttcggcaagatcaagcaggctctgaaggacgacgtcgtgttcgacggccgcaacctgtacgacccgcaggagatcgaagccgcaggtctggcgtactacgccatcggacga

SEQ ID NO: 39541 - DNA, 1377 bp, Xanthomonas campestris
atgagcgagagtttcaggatcgaacacgacagcatgggcgaattgcaggtgcctgccgatgcgttgtggggtgcgcagacccagcgcgccgtgcagaacttcccgatttccggccagccgatgccgcgcggtttcattcgcgcgctggggttgatcaaggccgcggccgcaggcgtcaacgccgatctcgggctgctgtccaaatcggtggccaaggtggtgcaggaagccgccttgcaggtggcgcagggcacgcacgatgcacatttcccgatcgatgtgtatcagaccggctctggtacgtcgtcgaacatgaatgccaacgaggtgattgccacgttggccacccgcgccggaaaggatgcggtgcaccccaatgaccacgttaatctcgggcagagttccaacgatgtggtgcccaccgcgattcgcgtctcggcattgctggcggtgcaggagcagctgcagccggcgctcaagcacctacgcaagaccatcgacaagcgcgccaagggtctggacaagatcgtcaagaccggccgcacgcatctgatggatgcgatgccgctgacctttggtcaggagttcggcgcgtggtctgcgcagctcagttcagcgcaggagcgcatcgacgacagcctgaagcggctgcgccggttgccgctgggcggcactgcgattggtaccggcatcaacgccgatgcgcgcttcggcggcaaggtggccaaggccttgtccacgttgagcggcgtcaagttcgaaagtgccgagaacaagttcgaaggcctggcggcgcaggatgatgcggtggaattgtcgggccagctcaatgcgctggcggtggccttgatcaagatcgccaatgacctgcgctggatgaatgccgggccgctggcagggctgggcgagatcgaattgccggcgctgcagccaggcagttcgatcatgccgggcaaggtgaatccggtgattcccgaagcgaccgtgatggtgtgcgcgcaggtcatcgggcaccacaccgcgatcacggtggccgggcagaccggtaattttcagttgaatgtggcgttgccgctgatcgccgcgaacctgctggattcgatcaacctgctcagcaacgtctcgcgcctgctcgccgataccgccattgccggattgaaggtgcgccaggagcgcgtgcgcgaggccctggaccgtaacccgatcctggtgaccgcgctcaacccgatcatcggctacgaaaaggccgccgcgattgccaagcgcgcctacaaggagcagcgcccggtgctggatgtggccaaggaagacagcggtctgagcgaggcagagctgcgccgtttgctggatccggcggcgttgacgcgcggcggcatc

SEQ ID NO: 39542 - DNA, 2793 bp, Xanthomonas campestris
gataatctcctaaagcagttcgcgcagtcatcgcagctcgccggcggcaatgccgcctatatcgaggatctgtacgagcagtacctcgtcgcccccgacagtgtcgatccgaagtggaaggcgtatttcgacggcttcaacggtcgcgatgccggtgatgtgccgcactcggcggcaattgcccacattctcagcgcctccaaacaggctgccaatgccggtaccggcgtgggcgccagcgacgagcgcgagcgcaatgtcggtcgtctgatcaccgcctaccgttcgcgtggtcatctcggcgcgcagctcgatccgctgggcctgaccccgccggtcaacccgcccgacctggacctgccgttccacagcctctcgcaggctgatctggacagcgagttcagcaccggtggtgtcggcgggcagccgcggatgaagctgaaggatctgctggcgcgcctgaaggcgacctacgccagcacgatcggcgccgaattcatgcatatccccgaattcgaccagcgccagtggatctacaagcgcctggaagatgccggcggcaagatcgctgccgacgcggccagccgcaagcgcacgctggagcggctcaccgccgccgaaggcctggagcgctacctgcacaccaagtacgtcggccagaagcgcttctcgctggaaggcggcgacgcattgatcccgatgatggacaccatcattcgccagtccggcaatgaccaggtcaaggacatcgtgatcggcatggcccaccgcggccgcctcaacgtgctggtcaatacgctgggcaagaacccgcgcaagctgttcgacgagttcgaaggcaagttcgagcacgcccacgacgaccgcgcgcacaccggcgatgtcaagtatcacatgggcttctcggcggacatcgcggtcggcgacgacaagcaggtccacctggcgctggcgttcaacccctcgcacctggaaatcgtcgacccggtcgtggtcggcagcgtgcggtcgcgtcaggagcgtttcggtgatgcggaccgcaagaccgtgctgccgatcctgatccatggcgacgccgcattcgccggccagggcgtggtgatggagctgttccagatgtcgcaggcgcgcggtttcgcggtcggcggcaccgtgcatatcgtggtgaacaaccagatcggcttcaccaccagcgcacgcgacgatgcccgctccaccctgtactgcaccgacgtggccaagatgatcggcgcgccggtcttccacgtgaacggcgacgacccggacgcggtgatgttcgtgtccaagctggcctatgagttccgccagcagttcaagaaggacgtggtcatcgacctggtctgctaccgccgttggggccataacgaggccgacgagccggccgccacccagccggtgatgtaccagaccatccgcaagcacaagaccacccgcgagctctacgccaccaagctggaaagcgatggcgtgctgagcgccgacgaggccaaggcgctggtggatggctaccgcaacaagctggattcgggcgaatacaccaccgaattggccaagcgcaagccggacgaattcgccatcgactggtccaagtatctggtcggcactgcggccgatccggtcgatacgcgcgtcaagcggaatgagctggaccgtctggccaagctgatcaccaccatcccggccggtgtggaactgcacgcccgcgtggcgaagatctacgaagaccgcgtcaagatggccgccggcaatcaggacggtgactggggctttgccgagaatctggcctacgccaccttgctggccgaaggccacaagctgcgcctggtcggccaggatgcgggccgcggtacgttcttccaccgtcacgcgatcctgcatgaccagaagaccgacagctattacctgccgctgcgccagctggtggaaaacccggaagacgccaccatcatcgattcgctgctgagcgaagaagcagtgatgggtttcgagtacggctactccaccaccgacccgaacgcgctgtgcgtctgggaagcgcagttcggcgacttcgccaatggcgcgcaggtggtgatcgaccagttcatcgctgccggcgaggccaagtggggccgcatcgcgggcctgtcgctgttcctgccgcatggctacgaaggccagggcccggagcacagctccgcacgtcttgagcgtttcctgcagctgtgcgcgctggagaacatgctggtctgcgtgccgacgaccccggcgcagtgcttccacatgatccgtcgccagatgcgcatgaccacccgcaagccgctggtggtgatgaccccgaagtcgttgctgcgccacaagcttgcggtgtcgacgctggaagaactggccgatgggcagttccagcatctgatccccgacgccaaggccgacgcgagcaaggttaagcgcgtggtgctgtgctcgggcaaggtctattacgacctgctcgaagaccagaccaagcgtggccaggacgacgttgccatcctgcgtgtggagcagctgtacccgttcccgcgtgcgcagctggccgcagaactcaagcgcttcggcaatgccgccgacgtggtgtggtgtcaggaagagccgcagaaccagggtgcgtggtatcagattcgccatcacctgaatttctgcctggccagcggtcagagcctgcattacgccggccgtgcccgttcgccctcgcctgctgccggccacatggccgaccacatcgccgaacagcagaagctggtcgccgatgcgctg

SEQ ID NO: 39543 - DNA, 1203 bp, Xanthomonas campestris
gaagtcaaagttccggtactgcccgaatccgtttccgacgccaccatcgccagctggcacaagaaggccggtgaagcggtcaagcgcgacgagaatctggtcgatctggaaaccgacaaggtcgtgttggaagttccttcgccggtcgacggcgtactgaaggaaatcaagttcgaagccggcagcacggtcaccagcaaccagatcctggcgatcatcgaagaaggcgccgtggccgcagctgcaccggccgaagagaagaaggccgatgccacggcggccgccgctgcgcctgctgctgcgccggcaccggctgccgctgccgctgccgcgccggttgcatcgaagtcgtctgctgacagcctgccgccgggtgcgcgtttttccgccatcacccagggcgtggatccgtcgcaggtcgacggccccggccgtcgtggcgcggtgaccaaggaagatatcgtcaacttcgccaaggccggcggcgtgggcaaggcgtctggcgcccgtcctgaagagcgcgtggcgatgacccgcgtgcgcaagacgatcgccaagcgcctgatggagtccaagaactccaccgcgatgctgaccaccttcaacgaggtcaacctcgccaaggtgtcggccgcgcgcaaggaactgcaggacgaattccagaaggcgcacggcatcaagctcggtttcatgagcttcttcgtcaaggccgcggccaacgcactgcagcgcttcccactggtcaacgcctcgatcgacggcgacgacatcatctatcacggctacagcgacatctcgatcgccgtctccaccgagaagggcctggtgacgccggtgctgcgtaacgtcgagcgccagtcatttgccgaagtcgaacagggcatcgccgactacgccgccaaggcgcgcgccggcaagctgggcctggacgacctgcagggtggcaccttcaccatcaccaatggcggcaccttcggctcgctgttgtcgaccccgatcatcaacccgccgcagagcgccatcctgggcatgcacgcgatcaaggaacgtccgatcgccgagaacggccaggtcgtgatcgcgccgatgatgtacctggcgctgtcctacgaccaccgcatcatcgacggcaaggattcggtgcagttcctggtcgacatcaagaatcagctggaaaacccgggccggatgctgtttggcctc

SEQ ID NO: 39544 - DNA, 1438 bp, Xanthomonas campestris; identical to SEQ ID NO: 39173

SEQ ID NO: 39545 - DNA, 1496 bp, Xanthomonas campestris
gcttttatttcgtggcgctgctgggcgaaaaagtggtcgccgatctgcgcggccgcctgtatgcccatctgattggcctggatgccggcttccacgatcgcagccgcagtggcgagctggtgtcgcgcctatcggccgacagcgaactgctgcgcggcgtggtcggcaccaccatgtcggtggccttgcgcagttcggtcacggtgatcggcagcctggtgatgctgttcgtcaccagcccgcggctggccggcttcaccttgatcggcattccgctggcggtgctgccgatcgtgctcggcgcgcgacgcctgcagaagatctcgcgggccagccaggaccgcgtggccgatgccaacacgcttgccgccgaaacactaggggcggtgcgcacggtgcaggcacatgcgcgcgagggctacgagagcaaccgcttcagccaggccttgcaggcagccatcgggaccgcgcgcgtacgcatccgcacccaggccaccgtcaccgcagtggcgatcatgctgatcttcggggccatcgtcgcggtgctgtggttgggcgcgcacgatgtcatcgccgggcagatgacgccgggcacgctgggccagttcgtgctgtatgcactgattggcggtggttcggtgggtgcgctggccgaagtgtggaacgagctgcaacgcgctgccggtggcatggggcggatcggcgagttgctcgacgagcagtcggcaattgtcgcgcccgcgaccccgcagccgttgccggtgccggtgcgtggcgcgatccatttcgaccaggtggtcttccactacccgcagcgcccggacatgccggcgctggatggcttcgacctgcatgtgcagccgggcgaaaccgtggcgctggtcggcccctccggcgccggcaagagcacggtgctggcgatgctgttgcgcttccacgacccgctgagcggcagcgtgcggatcgatgacgtagatctgcgccagaccgatccagtgctgctgcgcgagcagatcgcactagtcccgcagcagccgaccttgttcgccgccagtgccgccgacaacatccggtatggccgcctggacgccagcgacgcgcaggtggaagccgccgccacggctgccgaggccgacatcttcttgcgcgcattgccgcagggctatgccagcgaactgggcgagcgcggcacgcgcctgtccggcggccagcagcagcgcgtggcaatcgcacgggcgctgctcaaggatgctccgatcctgttgctggacgaggccaccagtgcgctggatgcacaaagcgagcgcgcggtgcagcaggcgctggaccgcttgatgcagggccgcaccacgctggtcatcgcgcatcgcctggcaacggtgctcaaggcagatcgcattgtggtgatggacgccggccgcatcgtggcgcagggcacgcatgcacaactggtggccgaaggcgggctgtacgcggagttggcgaagctgcagttc

SEQ ID NO: 39546 - DNA, 1125 bp, Xanthomonas campestris
atgagcaaacgcgattactacgaagttctgggcgtggcccgtggcgccagcgacgaggagctgaagaaggcttatcggcgttgtgccatgaagtaccacccggaccgcaatcctggcgacgctgctgcagaggcaacgttcaaggaatgcaaggaagcctatgaagtgctgtcggacggcaacaagcgccgtgcctacgacgcgcacggccatgcggcgttcgagcacggcatgggcggcggcggtggcgggcctggtggtccggacatgggagatatctttggcgatatcttcggcaatatttttggcggtggcgccgccggtccgcgcgctgcgcgacgtggtgccgacgtcggctacgtgttggaactggatctggaagaagccgtcgccggcatcgagcggcgcatcgagatccccacgctgatcgagtgcgaaccctgccacggcagcggctcggaagacggcaaggtggaagtctgcgcaacctgccatgggcgcggccaggtccgcatccagcgcggcatcttcgccatgcagcagagctgcccgcattgcgacggccgcggcacgctgatccagaacccgtgcaagacctgccatggcgcaggtcgcgtggaagaggacaaggtactgtcgatcaaggtgccggcaggcgtggacaccggcgaccgcatccgtttggcaggcgagggcgaagctggcccggccggtacgccgccgggcgatctgtatgtggaagtgcgcgtgcgcgagcatgcgatcttccagcgcgatggcgacgacctgcattgcgaggtgccgatccgcatttcgcaggccgcgctcggcgacaccgtgcgggtggccacgctgggcggcgaagcggaaatccgcatcccggccgaaacgcagaccggcaagctgttccggctgcgtggcaagggcgtgcgctcggtgcgcagccgcagcgagggcgatctgtactgccgcgtggtggtggaaacgccggtcaacctcacggccgatcagcgcgaattgctcaagcagtttgaggccacgttcaccggtgaggacgcgcgcaagcattcgcccaagtcggcgaccttcatcgatggagtgaagggtttctgggatcggatgacc

SEQ ID NO: 39547 - DNA, 1923 bp, Xanthomonas campestris; identical to SEQ ID NO: 39175

SEQ ID NO: 39548 - DNA, 1292 bp, Xanthomonas campestris
atgtcttttgaatccttgggcctggcgcccttcctgctgcgcgcattggccgagcagggctatgaaacccccaccgccatccagcagcaggcgatcccgctcgtgctggccggccatgacctgctggctggcgcacagaccggtaccggcaagaccgccgcgttcggcctgccgctgctgcagcacctgggcaccaccccgcagccggtcaacggcccgcgcaagccgcgcgcgctgatcctgacccccacccgcgagctggccacccaggtgcacgacagcctgcgcggctacagcaagtacctgcgcattccgagcgcggtgatctacggcggcgtgggcatgggcaaccagctcgatgcgctgcgtcgtggcgtggacctgctgatcgcctgcccgggccggctgatcgaccatatcgagcgccgcagcgtggacctgtccggcatcgaagtactgatcctggacgaagccgaccgcatgctcgacatgggcttcttgccgtcgatcaagcgcatcctgaccaagctgccgcgccaggaccgccagaccctgctgttctcggccacgttcgaagagaacatcaagcagctggcgctggagttcatgcgcaacccgatgcagatccaggtcaccccgagcaacaccgtggccgagagcatcacccaccgcgtgcacccggtcgatggcgcgcgcaagcgcgacctgctgctgcacctgctggcgcaggacagccgcgagcagaccctggtcttcgcacgcaccaagcacggcagcgacaagctggcgctgttcctggagaagtccggcatcaagaccgcggcgatccacggcaacaagagccagggccagcgtatgcgtgcactgagcgacttcaaggccggccgcgtgaccgtgctggtggccaccgacatcgccgcgcgtggtatcgatatcgaccagttgccgaaggtcatcaactatgacctgccgatggtggccgaggactacgtgcaccgcatcggccggactggccgtaacggttcgaccggcgaggcgatctcgttggtggcacaggacgaagccaagctgctgcgtcagatcgtgcgcatgctgggccgcgacgtggaaatccgcgacgtgccgggctacgagccgcagaccccgatccgctggggcaacagcgccccgggccgtgccgagcagccgggtggcgatcgcgccctgcgcaagagccacgcccgtcgcccgcatggcgatgcaccgcgtcaggcgcacgcccatgccggccccgaagaagccgggtggggcag

SEQ ID NO: 39549 - DNA, 645 bp, Xanthomonas campestris
ctggagctgttttcgtactggcgctccagcgccgcctatcgcgtacgcatcgggctgcagctgaaggcgctggcctatgtcgcgcacccggtgcatctggtgcgcgatggcggcgagcaacacgccgccgcttacgcgcaactcaacccgcaggagctggtgccgacgctgcggcacgggcaggtggtgatcccgcagtccctggccatcctcgaatacctggacgaggcatttgcggacagcgcgccgctgttgccgaccggccccgccgcgcgtgcgcgggtgcgggcgctggcacaggtgatcgcttgcgatgtgcacccgctcaacaacctgcgcgttacccaattcctggagcacacctgggacgtctcgccagcgcagcgccatcactggactgcgcactggatgcagcaagggttggcagcgctggaaacccatttggctggcgacgcacaaaccgggcagttctgccacggcgacacgccgggcctggccgattgcgagctggtgccgcagctctacaacgcgcgccggttcgccgtggagttggcgccgtatccgacgctgcagcggatcgaacaggcctgcctggcactgccggcgttcgatgcggcacggccggaaacgcagcctgacgcggca

SEQ ID NO: 39550 - DNA, 1008 bp, Xanthomonas campestris
aaaactgcgttgattaccggaatctccggccaggatggcgcctacctcgcccagttgttgttggacaaaggttaccgcgtgttcggcacgtatcgccgtacgagttcggtcaatttctggcggatcgaagagcttggaatcgcagctcacccgaatcttaatttgatcgaatacgatctgaccgatcttggctcgagcatccgtatgcttgagagcaccggcgcgacagaggtctacaatctggcagctcagagttttgtcggtgtgtcttttgatcagccgaccacaacggcacaaatcactggtataggtccggtccacctgctggaggcaattcgccaggtcaaccgagatatccgcttttaccaggcttcgacgtctgagatgttcggcaaggtgcaggcggtccctcagatcgaaagcacgccgttctatccacgcagcccctacggggttgctaagctttacgcgcactggatgacggtgaactaccgtgagagttacgacatcttcggatgcagcggaattctgttcaatcacgaaagtccattgcgtgggcgtgaattcgtgacgcgcaagatcaccgactcggtggccaagatcaagctaggccagctggactgcatggaattgggcaacctggacgccaagcgtgactggggcttcgctcgcgaatatgtcgaaggaatgtggcgcatgttgcaggccgacgagcctgacaccttcgttcttgccaccaaccgtaccgagactgtgcgtgatttcgtgagcatggcattcaagggtgcgggcatcgacgtcgagttccgtgggaaggacgctgaagaaactgcggtggacactgccaccggcaaggtggtcatgcgtatcaacccgaagttccaccgccctgcagaagtggagctgttgatcggcgatcccgagaaggcggcacgtatcctcggctggaagcctgaaaccacactggagcagctatgccagatgatggtcgaggccgatctcaagagg

SEQ ID NO: 39551 - DNA, 1044 bp, Xanthomonas campestris; identical to SEQ ID NO: 39180

SEQ ID NO: 39552 - DNA, 870 bp, Xanthomonas campestris
atgacacaacgtaaaggcatcatcctggcgggcggctccggcacccgcctgtaccccatcaccaagggcgtcagcaaacagctgctgccggtgtacgacaagccgatgatctactacccgctgagcgtgctgatgctcgcgggtatccgggacatcttgatcatcaacacgccgcacgagcaggcgctgttccagtcgctgttgggcgatggcgcgcagtggggcgtcaatatccagtacgccgtgcaacccagcccggacgggttggcgcaggcctatctgatcggacgcgacttcgtaggcggcaagccgagttgcctggtattgggcgacaatattttccatggccacggtttgaccgataccttgcgccgcgccgacgcgcgcgagcagggtgcgacggtgttcggctactgggtcaacgatccggagcgctacggtgttgccgaattcgatcagcacggcaaggtcatcgacattgccgaaaagccggaaaagccacgctccaactatgcggtcaccggtttgtatttctatgatggcaaggccagcgattatgcggctgccttgaagccgtcgccgcgcggcgagctggaaatcaccgatctcaatcgttgctatctcgatgctggcgacttgcatctggagccgctgggtcgcgggtatgcgtggctggataccggcacgcatcagtctttgcacgaagcggcgaatttcatcgagaccatccagatgcgacagggcttgcaggtgtgctgtccggaggagattgcattcggtcaaggctggatcgatgccgagcagctggagcgtctggcggcgccgttgttgaagaatgactatggcaagtatttgactgcattagccaag

SEQ ID NO: 39553 - DNA, 1344 bp, Xanthomonas campestris
atgacgctacccgccttcaaggcctacgatattcgcggccgcgtgccggatgaactcaacgaggacttggcccgccgcatcggcgtggcactggcggcgcagctggatcaagggcccgtggtcctgggccacgatgtgcggctggcgagcccggcactgcaggaagccctgtctgccggcctgcgtgccagcggccgcgaggtgatcgacgttggcctgtgtggcaccgaggaggtctatttccagaccgatcacctcaaggccgccggcggcgtgatggtcaccgccagccacaacccgatggactacaatggcatgaagctggtgcgtgaacaggcgcggccgatcagctccgataccggcctgttcgccatccgcgacacggtcgcggccgacactgccgctgcaggcgagcccaccgctgccgagcacagccgcaccgacaagaccgcgtatctggagcacctgctcagctacgtggaccgcagcacactcaagccgctcaagctggtggtcaacgccggcaacggcggcgccggcctgatcgtcgacctgctggcagcgcatctgccattcgaattcgtgcgcgtcttccacgagcccgatggcaacttccccaacggcatccccaacccgctgctgccggaaaaccgcgacgccaccgccaaggcggtcaaggaacacggcgccgacttcgggattgcctgggatggcgacttcgatcgttgcttcttcttcgatcacactggccgcttcatcgagggttattacctggtcggcctgctggcgcaagccatcctggccaagcagcccggcggcaaggtcgtgcacgacccgcgcctgacctggaacacggtggagatggtggaagacgccggcggcattccggtgctgtgcaagagtggccacgccttcattaaggaaaagatgcgcagcgagaacgccgtctatggtggcgaaatgagcgcgcaccattacttccgcgaattcgcctacgccgactcgggcatgattccatggctgctgatcgccgagctggtctcgcaatcgggccgttcgctggcggacctggtcgaagcgcgcatgcagaagttcccatgcagcggcgagatcaacttcaaggtcgacgacgccaaggctgcggtcgcacgcgtcatggcgcattacggtgatcagtcaccggagctggattacaccgacggcatcagcgccgacttcgggcaatggcgcttcaacctgcgcagctcgaacaccgagccgctgctgcgtctgaacgtggaaacgcgcggcgatgctgcactgctggagacgcgtacgcaggaaatttccaacctgttacgcggc

SEQ ID NO: 39554 - DNA, 1509 bp, Xanthomonas campestris
tggctgggttgccgcaccgtggtggccagcgtggtggatatccgggtggacctattccgccatctcaccggccacccgatgcgctatttcaccgagcattttgccggtgcgctgggcaaccgcatcaccgcattgggcaccgccgccgggcagatctatggcggcctggcgtggaagatcctgccgcccatcgtcgacttcatcggcgccatcgtggtgctgttcaccgtggactggcgcatggccgccaccttgattgggtttgtggcggtggtggccgcgatcatcaccggcttcggcatccgcggccgtgccaagcaccagagctttgccgcgcaggccgcacgcgtgggcggcgagctggtggatgcggtgtccaacgtgtggacgatcaaggcctttgctgcacgcgaccgcgagagcgcacgcctggcgcaggaaatcggccacgaggcggtcgcgcaccggcgcagctggatgtatgtggaaaaggcccgcgtcatccacgacatctgcctgtcgatcatggcgggcggcatgctgatctgggcgatcagcgcctggcgcggcggcgcggtgagtgccggcgatgtggtgctggtcagcgccttgacgttccgcatcctgcacggctcgcgcgacctggcattgaccctggtcgacaccacgcagcagctgggcgccatcgccgataccttgcagatcatcctgcagccgcacgccctgcccgatgccgatgcaccactggcgctggccgaaggcgacgtgcgttttgaaggcgtgcgctttgcctacccggaccgccctgcggtgatcgaggcactggacctgcacattcctgccgggcagaaggtgggcatcgttggcccatccggcgccggcaagtccacgctgatcgccttgatccagcggctggacgatgtggaatcgggccgcgtgttgatcgacggccaggacatccgcagcgtgagccaggacagtctgcgcgaccgcattgccgtggtgccgcaggaaaccgcgctattcaaccgcagcatcgccgacaacatccgctacggccgcccggaagccagcgatgccgaggtccacaccgcggcacggcacgccttctgcgatggcttcatccgcgacctgccgcagggctacaacacgctggttggcgagcgcggcgtgatgctgtcgggcggccagcggcaacgcctgggcattgcgcgtgcgttcctcaaggatgcgccgatcctgatcctggacgaagccacctccgcgctggacaccgaatccgaggcagagatccagtccgcactggaccacctgatgcgcggccgcacggtgctggcggtggcccaccgcttgtccacggtgatcggcttcgaccgcatcgtggtgctgcaggacgggcgcatcgtcgaagacggcagcccggccgaactacgcggacgcggcggcgtgttcgacagcctatggcaacgccaggcggcgggcttcgaacagccggtggcggaggatgcg

SEQ ID NO: 39555 - DNA, 870 bp, Xanthomonas campestris
caggagatcaccatgcccgtgcccaactacccgcgcccgccattcaagccgcagcaacagggcttccccggcaagactgacaagatggacccgcgcccggatcacggcgaagacagctacgtgggccacgggcaactgaaaggcaagcgcgcgttgatcaccggtggcgacagcggcattggcgctgccgtggccatcgcttacgcacgcgaaggcgcggatgtggccatcgccttcctgccggatgagcaggaagacgcatcacgcatcggtgcgttgatcgaaaaagccggcgtgcgcgcactgctggtgggctgcgacatcagcgaccccaaccaggctgcgtccttgatcgacaaggtcaacagcgagttcggcgggctggacatcctggtcaacaacgccggctaccagaagtacttcgaaaacttcgaagaaatcaccctggacgagtggcgcaagaccttcgataccaatgtgcacgcagtgttcaacctggtgcgcttgtcggtgccgttgatgaaggacggcggttccatcatcaacaccgcttcggtgcaatctaaaaagcccacgccgaacatccttccctatggcgcaaccaagggtgcgctggccaatctcaccatcgggttggccggcgtgttggccgaaaagcagatccgcgtcaatgcggtgctgccgggcccgatctggacaccgttcattcccgccggcatggacgaagactcggtggaaagcttcggctcgcaaacgccgatgggccgccccggccaaccggtggagcttgcatcggcctacgtgatgctggcctccgataccgccagctacacctccggcaccttgctcaccatctccggtggcgcggtc

SEQ ID NO: 39556 - DNA, 1554 bp, Xanthomonas campestris; identical to SEQ ID NO: 39185

SEQ ID NO: 39557 - DNA, 1959 bp, Xanthomonas campestris; identical to SEQ ID NO: 39186

SEQ ID NO: 39558 - DNA, 1059 bp, Xanthomonas campestris
ctcaagaacgaccgtctgttgcgtgccctgcgccgccagcccgtggaccgcacccccgtctggctgatgcgccaggcaggccgctatttgccggaataccgcgccacccgcgcgcgcgccggcagtttcctgggcatggccaagaacccggacatcgcctgcgaagtcaccctgcaaccgctggaacgctttccgctggatgcggcgatcctgttctccgacatcctgaccatccccgatgcgatggggctggagctgtatttcgtcgaaggcgaaggccccaagttccgccacccggtgcgcgacgccgacgccatccatcgcctcggcgtgccggacatggaaaccgagctgcgctacgtgatggacgcggtgcgcttgatccgccgcgagctggatggcgcggtaccgctgatcggcttctccggcagcccgtggacgctggcctgctacatgatcgaaggcggcggcagcaaggaatatgcgcgcatcaaggccatggccttcaacgcgccgcagctgctgcaccacctgctcagcaccgtcaccgatgcggtgatcgcctacctgtccgcacagcgcgcggccggtgcgcaggcgctgcaggtgttcgatacctggggcggcgtgttgtcgccggcgatgtaccgcgaattctcgttgccctacctcacccgcatcgcccaggaactggagcgcggcagcggcgaagagcgcaccccgctggtgctgttcggcaagggcaatggcgcctatgtgtccgagctggccgccagcggtgccgaagcggtgggcgtggactggacgatctcgctggccgacgccgctgaacgcgccggcggccgtgtcgccctgcaaggcaacctggacccggccacgctgtacggctcgcccgacgcaatccgcagcgaagtcggcaagaccctggacagctacgcgtacggcaacggcggctcgcgcgaaggccacgtcttcaacctcggccacggcatgtcgccggacatgaatccggatcacgttggcgtgctggtggaagcggtgcagacgctgagcaagcgg

SEQ ID NO: 39559 - DNA, 1167 bp, Xanthomonas campestris
aacgcctggcagctggccgtgcacaagcaggagctggccgagcaggcgtcgctggccaagacacgcttcctggctacgctcggccatgaggtccgcacgccgatgaccggtgtgctgggcatgagcgagctgttgctgaagacccagctggaccacaagcagcgcagctataccgaatcgatccggcgcgccggctcgcatctgctgcggctggtcaacgatgcgctggatctggcgcgcatcgagtccggtcgtctggagctggatctgcagccgttctcggtgcgccagctggtggccgaagtggaagcgctgatggcgccgctggcgcaggagcgcgggctgcgtttcagcctggaagtcggcttgcttggcgacatcaccgccagcggtgaccctacccgtattcgccagatcctgctcaacctgctcagcaacgcgatcaagttcaccgagcgcggcgtggtcgggctcaagctcagcacgcttggttcctaccaggggctgcgcttcgaggtggccgataccgggccgggcatcaatgccgaccagaaggtgcgcctgttccagcgcttcgagcagggcgatggcgccaagaccacctcgcgctacggcggcagcggcctgggcctggccatctgccaggagttggcgatggcgatgggcgggcatatcgaagtgatcagccgcctgggcgcaggtacgcgctttgtcgtcgacctgccgctgcgctgggttgcctccaatgccgtgctggccggcgaggtggcacgcgacagcgcaaacgtggcgcccttgcgcatcctgctggtggaagacgaacccaccatcgccgaggtcatcgtgggcctgctgcgcgcgcaagggcactcggtggtgcacgcaccgcacgggttggccgcactcaccgaggccgcggataacgcattcgatctggcactgctggatctggatctgcccgggctggacgggttcgcactggcgcggcagttgcgcgtctttggctatgacatgccgctgatcgcggtgaccgcgcgctccgacgaagccgccgaacccaccgcgcagcaggcaggcttcgacagtttcctgcgcaagccacttaccggcgacatgctggccgatacgattgccgaggcgttacggcgagtgcgtccgcgcgaggag

SEQ ID NO: 39560 - DNA, 1014 bp, Xanthomonas campestris
ctcgccctgttgggcaccggcacggtgggacgtgccttcgtgacgcgctataccgccttgcagcaacgtcagttgcgcctgccgcgctttgactggctggccaactcgcgcatcgcccacgactgtggtgccggcgcggagcaggcactgcagctggtcaatgcggcgccgcgtggccgtgcggagctgcagccgtgggcagaaaccactgcgctgcgcgccggcgatgtgctggtggatgccaccgccagcgacgtggtggcggattggcatgttgagtggctaacccgcggcgtgcatgtagtgaccgccaacaagctgggccagggcacggcactgtcgcgtgcgcaggacctgtatgccgcgcgtcacgccagcggcgcgtattacggcgacagtgccaccgtgggtgctggcttgcccttgctcagcagcgtgcgtgcactggtggccggcggcgaccagattcattcgatcgaaggggtgttgtcggggtcgttggcatggctgtttcatcgctatgacggcagtgcgccgttctcggcgtgcgtccgcgaggcgatggcggccggctacaccgagcccgatccgcgcatcgatctctccggtgaggacgtgcggcgcaaattgctgatcctggcgcgtgcggccgggcaaccgctggaagccgagcaggtgcatgtggaatcgctggtgcctgccgcgctggcgtccgtggcgccggaagcggtggatgcgcacctggaaacactcgacgcgctggtgcggacacgttggcagcaggcccgcgccgccggccgctgcttgcggttcgtgggccgcgtggacgagcatggcgcaagcgtgggcttgcgcgaattggccctggaccacccgctggcgggcggcgcgggcaccgacaaccgtgtcgccatcagcagcgatcgctaccgcgaccagccgctgttgattcaagggcccggcgcgggggcggaagtgaccgcggcggcgttgctggacgatgtgttgcggatc

SEQ ID NO: 39561 - DNA, 1134 bp, Xanthomonas campestris
gccaccgccgccgtccgtgccggaatcgaccgggacaccgcctacggcgcggtgacgccgccgatcgtgctgtcgtcgaacttctccttcgacggcttcggcaacaagcgccagtacgactacacccgcagcggcaaccccacccgcgacctgctcggcgaagctttggccgaactggaaggcggcgccggcggcgtgatcacctccaccggcatgggcgcgatcaacctggtgctcaacgccttgctgcagcccggcgacaccctggtggtgccgcacgatgcctacggcggcagctggcggttgttcaacgcgctggccaagaagggccatttcgccctgatcaccgccgacctcaccgacccgcgctcgctggccgatgcactggcgcagtcgcccaagctggtgctgatcgaaaccccgtccaacccgttgctgcgcatcactgatctgcgctttgtcatcgaggccgcgcacaaggtgggcgcgctgaccgtggtggacaacacgttcctgtcgccggcgctgcaaaagccgctggaatttggcgccgatgtggtgctgcattccaccaccaagtacgtcaacggccacagcgatgtggtgggcggcgcagtgatcgcgcgcgatgcggagctgcaccagcagttggtgtggtgggccaacgccctgggcctgaccggttcgccgttcgatgcgtttttgaccttgcgcgggctgcgcacgctcgatgcccgcctgcgcgtgcaccaggaaaacgccgatgcgatcgcggtgctgctggacgaacacgcggcagtgaaccaggtgtatttccccgggctggcatcgcatcctggccatgcgttggcggcacgccagcagaagggcttcggcgcgatgatcagcttcgagctcaatggcggtgaggcggcggtgcgtgcgttcgtcgacgggctgcgttatttcaccctggccgaatcgctgggcggcgtggagagcctgatcgcgcatccggcctcgatgacgcacgcggcgatgaccgccgaagcgcgcgctgcggccggtatttccgatggcttgttgcgtctgtcggtgggcattgaatccgctgaggatctgctgatcgatctgcgcgccggcctggcgcgtgcg

SEQ ID NO: 39562 - DNA, 387 bp, Xanthomonas campestris
atgagcgagatccctggcgacctcaagttcctcaaatcccacgagtgggcccgcgtcgaaggcaatggccgcgtcaccgtcggtatctccgaccacgcgcaaggcttgctgggtgacctggtctacgtcgaactgccagccgttggcgacaccgtccaggctggcaacggcgctgcggtggtggagtcggtcaaggccgcctccgacgtctacagcccggtcaccggcacggtcgtcgaggtcaatgcctcgctgagcgacaagccggaaaccatcaatgaagacgcgtacggcgaaggctggatcttcgtggtggagatcgacgacaaggaacagctcaacgaactgctggccccggacgattacgccgagctgctggaagacgac

SEQ ID NO: 39563 - DNA, 1569 bp, Xanthomonas campestris; identical to SEQ ID NO: 39191

SEQ ID NO: 39564 - DNA, 976 bp, Xanthomonas campestris
gtgatgatcggctccaacgagtttcctgatggcccgtgtgccgcggcgatcaaggcaatcacgcagattgcgccgcagggtgggcggtatctgcgtgagctgcagatggaactgatgaccaccctggccgctgagctcaagctgccggtgaaccacctgatggcctatgccggttctaccgagccgctcgactacacgatgctggccttcacctcgcccagtgccgcgctggtcaccgccgaccccacctacgaatccggctggcgcgctgcgtcccgcaacggcgccaagctggtcaaggtgccgttgcgcaaggacttctcgcacgacgtgcaggcgatgtgcgcagccgataccaacgccggcgtgatctacatctgcaatcccaataatcccaccggctcggtgaccgcacgcaaggatctggactacccgctggcgcacaagcccaagggcagcattttggtggtggacgaggcctacatacatttcgcgcagagcacccgcagcgtggtggacatgagtgtccgcggtagaagacgtggtggcactgttcaccttttccaagctctacggcatggccggcatccgcctgggctatgcggcagcacgcccggacctgctggccaagctgatgttctacagcgtcaacagcctgccggtgaccgcggccgcggcgggcctggccagcctgcgcgatgccacgctggtgccgcaacggcgcgcacgcactgcggccacccgcgccgatgtcatcgacttcctcaccaagcagggctatgcctgcaccgcttcggaaagcaactgcttcatggtcgatgtaaaacagcccgcggccggcttcaaggacgccatggccaccttcggtgtattcatcggccgcagctggccggtgtggcccacctggtcgcggatcacggtgggcacgcccgaggagatggcgcgcttcaagcaggccttcgtgcaggtcatggcc

SEQ ID NO: 39565 - DNA, 1287 bp, Xanthomonas campestris; identical to SEQ ID NO: 39193

SEQ ID NO: 39566 - DNA, 1323 bp, Xanthomonas campestris
ctcaccggcattggcgcggccgagtacgcgcgccgacgcaagcagctcatgcagatggccggcgagcaggccatcctgatcctgccggcggcaccggagcgggtgcgcagccacgacacccattacccgtaccggcaggattcggatttctggtacctgagcgggtttccggaaccggaggcggtgctggtgctggtgccagggcgcaagcacggtgaggcaatcctgttctgccgcgagcgcgatgccgagcgcgaagcctgggacggcccgcgcgcgggccaggaaggcgcggtggcgcagtacggcatggacgatgcgtaccccatcgacgatgtcgacgagatcctgcccggcctgctggaaggacgcagccgcgtctactaccacttcggccgcgatgtggatttcgatctcaagctgatcggctggctcaagcgggtgcgcgagcaggtgcgccatggcgcgcaaccgccgcatgagttcctggagttgggccatctgctgcacgagcagcgcctgttcaagtcgcgcgacgagatcgcattgatgcagcaggccgccgacatcagcgtgcgtgcgcatcgcgcggcgatgcagttggcacgcccgggcgtgcacgagtatcaactgcaggccgagatcgaacgcgaattccgcgccgccgatgcgtggccggcgtacggcagcatcgtcggcaccggcagcaatgcctgcgtgctgcattaccgcgccaacaacgcgcgcagccgcgatggcgagctggtgctggtggacgccggcgccgaataccgcggctatgcggccgacatcacccgcacatttccggtcaacggccgcttcagcgcggcgcaacgtgccctgcacgatctggtcggcgccgcgcaggcggccgccctggcgcaggcacaacctggcattgcctacgaggccggtcacctggcggcggtgcagacactgaccgaagggttgctgcgcctggggctgctcaaaggcacgctggagcgcaacctcgccgaagggcactacaagcggttttatcggcacaagaccggccactggcttggcctggatgtgcatgacgttggcgagtatcgcctcgcgggcgagtcacgccttctggagcccggcatggtgttcaccatcgagcctgggttgtatgtctcggccgacgatacgagcgtggacgccaagtggcgcggcatcggtatccgcaccgaagacaacgtgctgatcaccgccgacggccaccgcgtgctgaccgatgccttggcgcgcagcgccgacgaaatccagggggcgatggctggaggaaaccgggaa

SEQ ID NO: 39567 - DNA, 1309 bp, Xanthomonas campestris; identical to SEQ ID NO: 39195

SEQ ID NO: 39568 - DNA, 885 bp, Xanthomonas campestris
ccttcggaaatggcccaagcgcttggtgccgggctcctgtcattcccggtgacgcacttcgatgcggacatggctttcgacgagcccgcctaccgcagcaatctggactggctgtcctcgcacccggccgccgggttgtttgctgccggcggcaccggcgagctgttttcgctgaccctggacgaagtggaccgcgcagtgcgcgcggccgtgacccagaccgccgggcgcatgccggtgattgcgccggccggctacggcaccgcgattgccgtggccatggcgcaggcggcagagcgtaacgacgccgatggcatcttgctgtttccgccgtatctcaccgaatgcgatgccgacggcgtggccgagcatgtcgagcgcgtctgcaaggcgacctcgctgggcgtgattgtctacggccgcgccaatgcccggctcgatgacgtggcgctggcgcgggtggccgagcgctgccccaacctggtgggctacaaggacggcatcggcgatgtggagcgcatgacgcgtatctacgcgcggctgggcgatcgcctgctctacgtcggcggcctgccgacggccgaaacctttgcgctgccgtacctggaaatgggggtgaccacgtattcgtcggccatcttcaatttcctgccggaatgggcgctgtcgttctatgcggcagtgcgcgcgcgcgatcacgcaaccatctaccgcgagctcaacgacttcgtgctgccgtacaccgtgctgcgcaatcgccgcgccggctatgcggtgtcgatcgtcaaggccggcatgcgtgccgtgggtcgcccggccggcccggtacgtacgccgctggccgatctgaccgaagacgaattcgcccagctcacgcagctcatc

SEQ ID NO: 39569 - DNA, 1296 bp, Xanthomonas campestris; identical to SEQ ID NO: 39197

SEQ ID NO: 39570 - DNA, 1173 bp, Xanthomonas campestris
atgtccattgtccgcatgaccgacctcgatctttccggcaagcgcgtgctgatccgccaggatctcaacgtgccgatcgacaacggccagatcacctccgaacagcgcatcaccgcctcggtgcccaccatcaagctggcgctggaaaagggcgccgcggtgatggtgacctcgcacctgggccgcccgaaggaaggcacctggagcgaggaagattcgctggcgccggtggccgcgcgactgaccaccctgctgggcttggacgtgccgctggtgcgtgactgggtcgagggcgtggacgtggcgccgggccaggtggtgctgctggaaaattgccgcatgaacgtgggcgagggcaaggatgacgaagcgctcgcacgcaagtacgccgcgctgtgcgatgtgtttgtcatggacgccttcggcaccgcgcatcgtgcgcaggcctccacgcatggcgtgatccggttcgcgccggtggcagccggtggcccgctgctgatggccgagctcgacgcgctggccaaggcgctggacaacccggccaagccgctgctggcgatcgtggccggcagcaaggtttcgaccaagctggaactgctggccaacctggtcaacaaggtggaccagttgatcgtcggcggtggtatcgccaataccttcatcgccgcggccggccacgatgtgggcaagtcactcagcgaaccggacctgatcccgaccgccaaccagatcgtcgccgatgccaaggcacgcggcgcggagattccgctgccaaccgacgtggtggtggccaagcagttcctgcccgatgccgaggcgagcgtgaagtcgctcgaccaggtggatgccgacgatctgatcctggacatcggcccgcagactgccgcgcactatgccgaactgattgccaatgccggcaccgtggtctggaacggcccggtcggcgtgttcgagttcgagcccttcagccatggcaccgagaccctggcgcgtgccattgccgcgtccgaggcgttctcgatcgccggtggtggtgacacgttggcggccgtggacaaatacgccatcgccaaggacgtcacctacatctcgaccggcggcggcgcgttcctggaatttttggaaggcaagaccctgccggcggttgccgcgctcgaggcccgcgggcag

SEQ ID NO: 39571 - DNA, 1428 bp, Xanthomonas campestris
atgaaagaacgtcaacgccgcaccaagatcctcgccacgctgggaccggccacggatccgcctggtgtgctggacgccttgttcaaggcgggcgtcaacgtggtgcgcctcaacttcagccacggcgacccgtccggccaggccaagcgcgctgccgaagtgcgtgccgccgccgtccgcgtcggcgccgaagtgggcatcctggccgacctgccgggcccgaagatccgcatcgagcgctttgccggaggcaagatcaagctgaccatgggcgatcgtttcgacctggtggccgatatcaatgcgccggccggcgatcagcatcaggtgggcgtgagctacctgggcctgccgcaggatgtcaccgccggtgacgtgctgctgctcgacgatggcctggtgcagctgcaggtcaccgacgtgcagggcgcgcgcatcgtcaccaccgtgctcaacgatggtgtgttgtccgaccgcaagggcctcaacaagcagggcggcggtctgtcgctgggcgcgttgaccgagcgcgacaaggagctgatcggcatcgtggccaagatcggcgtggacttcatcgcggtgtcgttctgccgtaacgcgcaggacatgcacgacgcccgccagatcgcccagcagcacggctgcgatgcgcagttggtgtccaagatcgagcgcaccgaagcgatcgagaacctggtcgaaatcgtcgaagcctccgacgtggtgatggtggcgcgtggcgatctgggcgtggaaatcggcgatgccgaattgccgggcctgcagaagaagatcattcgcgagtcgctggcgcagaacaaggtggtgatcacggccacccagatgctgcagtcgatggtggaaagcccgatcccgacccgcgccgaagtactcgacgtggccaacgcggtcatcgacggcaccgatgcggtgatgctctcggccgaaaccgctgccggtgcgtatccggtgcgtgcagtggaagcgatggcgcgcatctgcctgggcgccgagcaccagttcgagttcgataccgacttcgaagcggcgcaacgcaacctgcagcgcgccgaccaggcgatcgcaatggcgaccatgttcctgtccgagcacatcggtctgggcggcgtggtggcgttgaccgaatccggcggcacgccgcgttacctgtcgcgcttccgttccaacatgccgatctatgcattcacccgtcatgacggcgcgcgtcgccagatggcgatgatgcgtggcgtgttcccgatcggtttcgacagccgtggcctgaccccacgcgaagccgcgcgcgcagcgatccgcctgctggtggagaacgagcgcatggggcctggcgaccgcgtggtgttcaccagcggcgagcacatggaaacccatggcgccaccaacacgctgcgtctgctggaagtg

SEQ ID NO: 39572 - DNA, 1017 bp, Xanthomonas campestris
gaacagcttgccgaaaccgcccaggccatggtcgccccgggcaagggcatcatcgccatcgacgaatcgaccagcacgatcgccaagcgcttttccggcgtcggcatcgagaacaccgaagaaaaccgtcgtgcctaccgcgaactgctgctgaccacgcccaagctgagcgattacatctccggcgccatcctgttcgacgaaaccatccgtcagaagaccaaggacggcgtgccgttcgccaagtacatggccgaccacggcatcatcccgggcatcaaggtcgacaagggcgcgcagccgctggccggcatgccgggcgagttggtgaccgaaggtctggacggcctgcgtgcgcgtctggaggagtactacaccctgggcgcgcgcttcgccaagtggcgtgcggtcatcaacatcggcgaagacattccgtccggcacctgcatcgaggccaatgcgcatgcgctggcccgctatgccgcgctgtgccaggaacaaggcctggtgccgatggtggagccggaagtgatcatggatggcgaccacgacatcgagacctgctacgaagtcaccgaagccacgttgcgttcgctgttcggtgcgctgtatgagcagaacgtcgtgctcgaaggcaccatcctgaaggcctcgatggtcatctccggcaagggctgcgaagagcaggccagcgtcgaagaagtggccgagtccaccgtgatgtgcctgaagtcgaccgtgccggcaatcctgccgggcatcgtgttcctgtccggcggccagaccgacgagcagtccaccgcgcacctcaacgagatgcaccagctgggcaacctgccgtggccgctgagcttctcgtatggccgcgcgatgcagcaggccgcactgaagctgtggtccaaggacatgaccggcaactacgccaaggcgcagcagatcatttacgagcgcgccaaggaaaacggcttggctgcactgggcaagtggaagggctgatccgccgctgaggctgcatca

SEQ ID NO: 39573 - DNA, 684 bp, Xanthomonas campestris
ccttcgctggacgacctggacgcgctcaacgcgcacctggagacgctgcgcgccgacgaacgcgttgcctgggcgctgcagcacggcccccaacaagcggcgctgtcgtccagcttcggcgcgcagtcggcggtgacgttgcacctgctcacccagcagcgcccggacatcccggtgatcctgatcgacaccggctacctgttcccggaaacctaccgctttgccgatgcattgaccgaacgcctctcgctcaacctgcaggtgtatcgcccgctggtcagccgcgcctggatggaggcgcgccatggccgcttgtgggaacagggcatggtaggcatcgaccagtacaacaacctgcgcaaggtcgaaccgatgcgccgcgcgctggacgaactcaacgtcggcacctggttcaccggactgcgccgcagccagtccggtgggcgcgcacagaccccgatcgtgcaaaagcgcggggaccgctacaagatcagcccgattgccgactggaccgaccgcgacgtctggcaatacctgcagacgcacgcactgccgtatcacccgctgtgggaacaaggctacgtgtcgatcggtgacttccacaccacccgtcgctgggagccgggcatgcgcgaagaagacacgcgcttcttcggactcaagcgcgagtgcggcatccacgaa

SEQ ID NO: 39574 - DNA, 1658 bp, Xanthomonas campestris
gaagacatcaaatccaccagccgccgcttgcgcggatcgctggagcagagcctggccgatccggtcaccggggcgttgcgcgaggacgatcagacgctgatcaaataccacggcagctaccagcaggacgaccgcgacatccgcgatgagcggcggcggcaaaagctcgagccggcatatcagttcatgatccgcacgcgcacgccaggtggagtgatttcgcccagccagtggctggcactggatggcatcgccacgcgctatgccaaccattcgctgcgcatcaccacgcgccaggcgttccagttccatggtgtgatcaagcgcgagctcaaggccacgatgcaggcgatcaacgccaccttgatcgacacgctggccgcctgcggcgatgtgaatcgcaatgtgcaggtggcggccaacccgctgctgtcgcaggcgcatgccacgctgtatgccgatgccgcgcgcgtgtccgagcatctgctgcccaacacgcgtgcctattacgagatctggctggatgaagagcgcgtgtccggttcgggcgccgaggacgaaccgatctatggcgaccgctacctgccgcgcaaattcaagatcggctttgccgcgccaccccataacgatgtggacgtgttcgccaacgacctgggcttcatcgccatcctgcgcgagggccagttgctcggctacaacgtcagcatcggcggcggcatgggcgccagccacggcgatgcggagacctggccgcgcgtggccaacgtgatcggcttcgtcacccgcgatcagttgctggatatcgccacggccgtggtcaccacccagcgcgacctcggcaatcgcgccgtgcgtaagcgcgcgcgcttcaagtacaccatcgacgaccacggcctggacaccatcgtggcggagatcgaacgccgcgcgggattcagcttgcaacctgcgcagccgtttgcattcgcgcataacggcgaccgctacggctgggtggagggcgaacagggcgattggcatctgacgctgtcgctgccggccgggcgcattgccgacaccgacaccgccgcgcacctgagcgggctgcgcgccatcgcgcagttgcagatgggcgagttccgcatgacgcccaatcagaacctggtgattgccggcgtcccggccgaacagcgcgcgcagatcgaccaactggtggcgcagtacggcctggatgccggcaacctggcgcccaccgcgttggcgcgcggcgcgatggcctgtgtggccttgccaacctgcgggctggccatggccgaggccgagcgctatctgccggatttcagtgctgcgctgcagccgctgctggaacgccacgggctggcgcagacgccgatcgtgctgcgcctgtccggttgcccgaacggctgttcgcggccgtatctggctgaaatcgcattggtcggcaaggcaccgggccgctacaacctgatgctgggcggcgaccgccgcggccaacgcttgaacacgctgtaccgcgaaaacatcaacgaagccgacatcctcgccgcgctcgagccactgctagcgcgctatgccgcagagcgcgaccagcacgccgacgaaggcttcggcgacttcctgcatcgcagcggcctgatcgccctgccgccctaccccac

SEQ ID NO: 39575 - DNA, 1890 bp, Xanthomonas campestris
tcgctactccccaatcccggcgccatcagcacctacctccagcagcacgaatccaaaccgctgctgcgcttcatcacttgcggcagtgttgacgatggcaagagcacgctgatcgggcggttgttgtacgacagcaagcggctgttcgatgaccagctagccgcgctggaaagtgatagcaagcgccatggcacgcagggcgacggcatcgactacgccttgctgatggatgggctggccgccgagcgcgagcagggcatcaccatcgatgtggcgtaccgctacttcgataccgaccaacgcaagttcatcgtcgccgattgccccgggcatgagcagtacacgcgcaacatggccaccggcgcctccaccgccgatgtggcggtggtgctggtggatgcgcgcaagggcgtgctggtgcagacgcggcggcacagctacatcgtctcgttgctgggcattcgccacgtggtgctggcggtcaacaagatggacctggtggactatgacgcgcaggtgttcgccaccatcgtcgacagctatcgcgccctggcggcgcagttgggcattgccgatgtgcaatgcattccgctgtcggcactggccggcgacaacctgtccagcgcgtccacgcgcatgccgtggtaccaggggccgcatctgctgcagcacctggacagcgtgcagctggagacgcccgatgcagtgagtgggttgcgcctgccggtgcagtgggtcaatcgccccagcgcgcagttccgtggctatgccggcaccattgctgccggccaggtacgcaccggcgatgcggtggtggtggtgccgtccgggcgccgcgcgcatgtggcgagcgtgctggatgccaatggcgtggtcgacagcgcacgcgccgggcaggccgtgacgctgaccttgcgcgaagagatcgacatcagccgcggcgacatcatcgccgccgtggacgacccgccggaagtggccgaccagttcgccgcgcacgtgttgtggatggacgatgccgcgttgctgccagggcgcccgtactggctcaagatcggcacccgcacggtcaccgccagcatcagcgagatcaagcacaaggtcgatgtgaacacgcaggagcggctggccgccaagcggctggagctcaacgaggtgggctactgcaacctgtcgctggacgagccgatcgcctttgccccgtatgcgcgcaaccgggtgctgggcggcttcatcctgatcgaccggcagaccaatgccacggtcgcggccggtgcgctggagttcgcgttgcgccgcgccggcaacgtgcattggcagcacctggatgtggaccgcgccgcgcgtgcgcgcatcaagggccaggcgccacgtgtgctgtggttcaccggcctgtccggtgcgggcaagtccacggtggccaacctggtggacaagcgcctgcatgcgctgggctatcacaccttcatcctggacggcgacaacgtgcgccacgggctcaaccgcgatctgggcttcaccgacgaggaccgcgtggaaaacatccgccgcgtggccgaggtggcacggctgatggccgatgccgggctgatcgtgctggtgagcttcatttccccgttccgtgccgaacgccagctggcacgcgagcgtttcgactcgggtgaattcgtcgaagtgtttgtggacgtgcctctggcggtcgccgaggcacgcgacgtgaaaggcctctaccgcaaggcccgcgccgggcagattcccaatttcaccgggatcgattcgccgtacgaggcgcccgagcgcccggaaatccatcttcacgccgatggtgagaacgtagaggcgctggcgcggcatgtcctggaatacctgggcctggagcgctgagggcag

SEQ ID NO: 39576 - DNA, 2568 bp, Xanthomonas campestris
gagccggtgcccaatggccgcctgcccacctgggcggtgcccgagcactacagtctggccatcaaggtggatccggagcaggcgcagttcagcggccgcaccaccatccgcgtgcagctcaagcaggcatcggaccatctctggctgcacggcaaggagctgaaggtcagcaaggccacagtgaagccggccaagggcaaggcactcaccgcacgctacgtcgatgccgatgcgcagaccggcgtggtgcgcctggatttcggccgcacgctcaaaccgcagacgctcaccgtggacatcacctacagcgcgccgctcaatcagcagctgcagggcctgtatcaggtgaagtaccagggcaaggcatatgcgatgacgcagatggagccgatcagtgcacgctatgcgttccccggtttcgatgagcccgcgttcaagacgccgttcgacctgagcctgaccgtgcccgcgggcgatcaggccttggccaacaccatcgccacctccaccaagccggccggcaagggctggaagacggtgagctttgcaccgacgctgccgctgcccacctatctggtggcctacgcggccggcccgtgggatgtggtggacgtgccggccatgccggccaccccacagcgccccgcagccacaccgctacgtggcatcgccgcccagggccagggcccgcgcatcacccccgcgctggaccagaccccggcgattattgcggcgctggaggactactacgcgttcggttacccgttcgacaaactcgacctggttgctgcaccggacttcagcgccggcgccatggaaaacccggggtttgtgaccttccgcgactggctgttgctgctggacaaggactcgccggccgaaaacgtgcagcgctccttcaacaccaacgcgcacgagctggcgcaccagtggaccggcgacaccgtcaccatggcgtggtgggacgatttgtggttgaacgaagcgttcgccacctggatgcagcagaagatcaccatgcagctgcacccggaataccgtgccaatctggaccgcatcggcggtgcgcagcacgcgatggataacgacagcctggtcagcgcacgcaagatccgccagccgatcaccggcaatggcgacatcgaaaccgccttcgacggcatcacctaccagaagggtgcggcggtgctggcgatgttcgaaggtttcgtcggcgaggacgtgttccgcgagggcatgcgcgcctacatcgccaagcacaagttcggcagcgccaccgccgatgacctggtcgatgcgatcgccgaagccgccggcaagggcgaggatttcaaggccgcattccgcagtttcctgaatcagccgggcgtaccgtacctgcagacgcaggtggcgcgcgagggcggcaagaccgtggtcaaacttcagcagcagcgctacctgccgctgggctcatccggttccaccgcgcagcagtggggcgtgccggtgtgcgtgaagtacggcaagggcaagaatcaggtgggcaccgcctgccaactgctggaaagcggcagcggcagcatcgtgctggaaggtgccggcaagaacacctgggtgttcccgaatgcgcgtggcgccggctactaccgtttcagcctgccgaagaagcagctggccgcgctcggcaagcaggtcgcccagctcgacgaaaacgaaaagctttcctacgccgatgctatcgatgcggcgtatcgccacggtgatgccgacaccgaggtggtgcttgcagcgatgaagcaactggccggcgccgagtctgccgatgtgtccaccgcgttggtggaccgcttcgtctggatctggcgccaccaggccaccaccgatgcgcagcgcgccaccctgcgcaaggcggccgagcaggcctacctgccgcgcctgcgtcagctcggctacacccgccgcgccaaggagtcgatcgacgacaccacattgcgtgcgtccctggccggcctgttcggcctgtggctgcaaaccccggaggtgcgcagcgcgctgctggcccagggcgatgcggtgctggcaggtggcggcaatggcctgaacttcgccgcggccaatcccgacctgctcggcaccgtgctggcggtgaccgcgcaggagcgcggcgcggcggccgtgcagacgctgatccaggcgctgcgcacgcatgccgacccggcacagcgcaacgcgatgatcgccgcgctcggcgcggtgcaggatccggcgctgctcacccaggtgcgcgactttgcattgaccgatgcgatcaaggtcggcgagatgaagagcctgctgacgcgtgggcatagctatgacgcctcgcatgcctcgatgtggccgtggttcaccgccaacttcgaccgcatcgtgcagcgcagtggctcgttcgatggcggcggcctgccgtcgctgggcgcgtccaacggctgcagcgtggaggaagccgatcgtctggatgcgttcttcaagccacgcctggccacgctcagcggcgccgaccgcggcctggcccagaccggcgaggcgatccgcctgtgcgccgcg

SEQ ID NO: 39577 - DNA, 2259 bp, Xanthomonas campestris
ttcgagccggcgcgcctggagcgcgccatcgaccagatccatgccgaattcccgcagctggacgtgggcgactacaagcgctcggtgttcggcttcgtcgagcgcaaggacagtgtcaacgccgacgacctggtcgaccacctgatccgcgaggccgaggcccgcgtcgatctgaccaccccggagtgggagcacttcgctgcgcgtctgtacctgcgccgcctgtacaagcgcgccagccgcaaccgcttctacgacgccggccagaagtacggctcgttcgtgggcctgcaggaaagcctggccgaccgtaacgtctattccaacgacatcctcaagagctattccaaggaagagctcatcgaggcgggcaagatgattgcgcccgagcgcgacacgctgttcgcctacaacggcctgtacctgctggccacccgttacctggccaccgacaactcgcgcggcgtgttcgagctgccgcaggagcgctggctgaccatcgccctgtacctgatgcaggacgagaagccgcgcgagcgccgcatgcagctggtgggcgaggcctactgggcgctgtccaacctgtacatgaccgtggcaaccccgacgctggccaatgccggcaaggtcggcgggcagctgtcgagctgcttcatcgacaccgtcgacgacagcctgcagggcatctacgactccaacaccgacgtggcgcgcgtgtccaagcacggcggcggcgtgggcgcgtacctgggctatgtgcgttcgtcgggctcggcgatccgcggtgtgtccaactcgtccggcggcgtggtgccgtggatcaagcagctcaacaacaccgccgtgtcggtggatcagcttggccagcgcaagggcgccatcgcggtctacctggacattttccaccgcgacatcgaatcgttcctggatctgcgcctgaacaacggcgaccagcgtctgcgcgcgcacgacgtgttcacctcggtgtgcatcccggacctgttcatggaagcggtcgagcgccgcggcgactggtacctgttcgatccgcatgaagtcaagcgcatcaagggctggtacctgcaggacttctatgacgagaagaagggcgacgccaacagcagcttccgcaagaagtacgaggaagtggttgccgacgagcgcatcacccgcaagaccgtcaaggcgatcgagatcttcaagcggatcatggtcagccagctggaaaccggcaacccgttcatgttctaccgcgatgaagtcaatcgcaagaatccgaacaagcacgagggcatggtctattcgtccaacctgtgcaccgagatcctgcagaacatgagccccacgcggatgatgcaggaaatcatcagcggcaatcagatcgtcaccaccaagaaggccggcgacttcgtcgtgtgcaacctgtcctcgatcaacctgggccgcgcgatcaccgtgcaggccgaccaggccgatctgctgggtgccgacgtgctggagcggttgattccgatccaggtgcgcatgctcgacaacgtgatcgatctgaatcagttgccggtgccgcaggccaccatcaccaaccagaagtaccgcgccatcggcctgggcaccttcggctggcatcacctgctcgcgcagaaggccatccactggaatgccaaggaagccgaggactacagcgacgagctgtacgagcgcatcaactacctgaccgtccaggcgagcatggagctggccaaggaaaagggcacctacagcgtgttccgcggcagcgattggcacaccggtgagtacttccgtgcgcgcgattacaacagcccgcagtggctggagctgtccgcgcaggtggcggtcaacggcgtgcgtaacgcctggatgctggccgtggcgccgaacatgagcaccgcgcagattgccggttccaccgcgtcgatcgacccgatctacagcgcgttctactacgaagaaaagaaggacttccgtcgcccggtggccgcgcccggcctgtcgctggacacctggccgtactacgaaaagggcgcctacaaggtcgaccagttcgccagcgtgcgccagaacgcgcgtcgccagcgccacatcgaccagtcgatcagcttcaacttctatgtgcccagcaccatccgtgcgagcacgttgctggatctgcacatgaccgcctggcgtgaaggcttgaagaccacgtactacgtgcgttccaacgatatcgacatcagtgaatgtgagtggtgttcgagc

SEQ ID NO: 39578 - DNA, 954 bp, Xanthomonas campestris
atcatcaatggccagacctccggcatcctcaactggaacgacattccgtacccgtccttttatcgggcgtacaaggagctgtcgaccaacttctggatccccgacgaggtggacatgaagggcgacgcgcgccagtacaacgagctctcggcgcgcgagaaaaatgcctatgactcgatcatcggcttgctggccacgctggattcgccgcagacgcgtttcatctacaacgtcgccgaatacatcaccgacccggccgcgcatgccaatgccgcgatcatcggccagcaggaagtgatccataacgagagctacagctacgtgctggcctccatcaccggcctggccgaccagaaccgcgtgttcgagatcgcgcgcacgcacccgaccatcatcaagcgcaatgcgccgatcatgggcgcctacgacgacttcatgcgcgacaagacggccgaaacgctgatccgcgcgctgatccagtcctcgatcctggaaggcatcaacttctattccggctttgcgtacttctacaatctggtccgccagaaccgcatgaccggcaccggcaagatcatcagcttcatcaaccgcgacgagctggcccactccaagttcatcagcgaattgatccgcgccatcatcggcgagaaccaggcgctgcagggcgaccagctcaccgattacgtgcacaaggccttcgagcacgcgatcgacctggaaacggtgtggacggccgaagtgctggacggcatcgacggcatcgacgtcgacgagatgatccgctacgtgaagtaccgcgccaacaagatggccggcatgctcggcatcgagaagctgtacgaaggcgccaacgacaacgtaatgccgtggatcaaggcctacgccgacaacttcaccgagaccaagaccgacttcttcgagatgcgcaatgcctcgtacaagaagaccaattcg

SEQ ID NO: 39579 - DNA, 753 bp, Xanthomonas campestris; identical to SEQ ID NO: 39208

SEQ ID NO: 39580 - DNA, 732 bp, Xanthomonas campestris
atgatcgtcgtcgacagtttgcacaagtcgttcaagaccaagaccggcctggttaaggcggtcaacggggtcagcttcaacgccgccgatggccagatcaccggcttgctcggccccaatggcgccggcaagaccaccaccttgcgcatgctctacaccttgatgacgcccgaccagggcagcgtccgcgtggatggcgtcgatgccgcgcacgacccggtcgcggtgcgccgcgcgctgggcgtgttgccggatgcgcgcggcgtgtacaagcgcttgagcgcacgcgagaacatcgcctacttcggccaattgcatggcatgtcgcgcacgcagatcgccgagcgcacgcgcctgctgtcacatgcactggacatggacgacatcctggaccggcagaccgaaggtttcagccagggccagcgcaccaagaccgccattgcacgcgcgctggtgcacgacccgcgcaacgtcatcctggacgaacccaccaacgggctggacgtgatgaccacgcgcgcgatgcgcggcttcctgcagcaactgcgcgccgaagggcgctgcgtgatcttctccagccacatcatgcaagaggtggcggcgctgtgcgatcgcatcgtcatcattgccaagggcaccgtggtggctgccggcaccgccgatgaactgcgcgcggccactggcgaagacaacctggaagacgccttcgtcaaggcgatcggttcggacgag

SEQ ID NO: 39581 - DNA, 825 bp, Xanthomonas campestris; identical to SEQ ID NO: 39210

SEQ ID NO: 39582 - DNA, 2212 bp, Xanthomonas campestris
atgttcagcaaagacctagagcaaaccatcggccagtgctacaagcgagcccgtgaggcgcggcatgaattcatgaccgtcgaacacctgctgctctcgctgctggacaacccctccgcgcaagccgtcttgaaggcctgcggtgcggaccaggtgcgtctgcacactgacctggaacaggcgatcgaggcctcggtctcgcgcctggccgaggacgatggccgcgacacgcagcccaccctgggcttccagcgcgtgctgcaacgcgccgtctaccacgtgcagtcctccggcaagaaggaggtcaccggcgccaatgtgttggtggcgatcttcggcgaaaaagactcacatgcggtgtacttcctgaatcagcaggacatcacccgcctggatatcgtcaattacctctcccacggcatcgccaagctgggtgaagacggcgagcagccgtccgcctccgatggtgagcccaagagcgatgcgggcgagggcgaaggcaagggcgatgccttggccgagtacgccaccaacctgaacgatcatgcccgcaacggcaagatcgacccgctcgtcgggcgtgcggacgagatcgaacgcaccatccaggtcctgtgccgccgccgcaagaacaacccgctgtacgtgggcgaggccggcgtgggcaagaccgcgatcgccgaaggcctggccaagcgcatcgtcgatgccgacgtgccggaagtgctggctgacgcggtgatcttctcgctcgacctcggcgcactggtcgctggcaccaagtaccgcggcgacttcgaaaagcgtctcaagggcgtgctgacggcgctgaagaaggtgccgaacgcggtgctgttcatcgacgagatccacaccatcatcggtgcgggctcggcgtcgggcggcaccatggacgcctccaacctgatcaagccggccctggcgtcgggcgagctgcgctgcatcggctcgaccacgttccaggaataccgcggcatcttcgagaaggaccgtgccctggcacgccgcttccagaagatcgacattgtcgagccgaccgtcggtgaaaccttcgaaatcctgcagggcctcaagcccaagtacgaagcgcatcacggcgtgacctatgccgacgacgcgttgcaggcggcggtggatctgtcggtcaagcacatcggcgaccgtctgctgccggacaaggcgatcgacgtgatcgacgaagccggtgcgcgccagcgtctgttgcccgaagggcagcgcaaggagctcatcgacatcgaggagatcgagaccatcgtggcccaagatggcgcgtattccggccaagcaggtcagcgcgaccgacaaggacgtgctgcagcatctggaacgcaatctcaagatggtgatcttcgggcagaacccggcgatcgaaacgctggctggctcgatcaagctggcgcgctcgggcctggccaatccggagaagccgatcggcaacttcctgttcgctggcccgaccggtgtgggcaagaccgaggtcaccaagcagctcgcgctgcaattgggcatcgagctggtgcggttcgacatgtccgagtacatggaagcgcattcgatcagccgtctgatcggtgcgcctccgggctatgtcggtttcgatcagggcggtctgctgaccgaaaagatcgtcaagacgccgcactgcgtgctgctgctggacgaggtggagaaggcgcatccggacatcttcaacatcctgttgcaggtcatggaccgcggcatcctcaccgataccaacgggcgcgaagcgaacttcaagaacgtgatcctggtgatgacgaccaacgccggtgccacgcaggcctcgcgtcgttcgatcggtttcaccaagcaggatcattccaccgatgcgatggaatcgatccgccgcggtttcacgccggagttccgcaaccgtctggatgcgatcgtgcagttccagccgctgggctttgaccacatcctgcgggtggtggacaagttcatcatcgagctggaaatgctgttgcaggaaaagcacgtgtcgctgtcggccacgccgaccgcgcgcgactggctggcccagcatggcttcgatccgctgatgggtgcgcgcccgatgtcgcgcgtgatccaggagaagatcaagcgcccgctggccgacgagttgctgttcggcaagctggtggaaggtggccgcgtcaatatcgac

SEQ ID NO: 39583 - DNA, 1209 bp, Xanthomonas campestris
attcaagaagcctacatcgttgccgccacgcgtacgccggtgggcaaggcgccgaagggcgtgttccgcaatacccgtcccgacgacatgctggcgcacgtgttgcgcacagtggtggcgcaggcgccgggcatcgatctgtcgcggatcgacgatgccatcatcggctgcgccatgcccgagggcgagcaaggcatgaacgtggcgcgtatcggcgtgctgctggccggcctgccgaataccgtggccggtcagaccatcaaccgcttctgttcgtccggcatccaggccgtggcgatggcggccgaccagatccgtctgggcaatgccgacctgatgctggccggcggcaccgagtcgatgtcgatggtgccgatgatgggcaacaaggtcgcgatgtcgccgaatgtgttcgccgacgaccacgtggcgattgcctatggcatgggcatcaccgccgagaaggtcgccgaggaatggaaggtctcgcgcgaagatcaggatgcgttcgcgctggcctcgcaccagaaagccatcgcggccattgcggctggcgagttccgcgacgaaatcactccgtacgaaatcctgtcgcatcagcccgacctggccggcaacgtgattgcgctgcgcaagcgtctggtcgacaccgatgaaggcccgcgtccggacagctcgctcgaaggtttggccaagctgcgtccggtgttccgtaacggccagttcggcggcagcgtcactgccggtaattcctcgcagatgagcgatggtgccggcgcagtgctgctggcctccgagcaggcaatcaaggattacggcctgaccccgctggcacggtttgtgagcttctcggtggccggtgtgcgcccggaagtgatgggtatcggcccgatcgcggcgattcccaaggcgctcaagcaagccggcctgaccaaggaccagatcgactggatcgaactcaacgaagccttcgccgcgcaggcactggccgtgatccgcgacagcgaactggatccgtccaaggtcaacccgctgggcggcgcgatcgccctcggccatccgctgggcgcgaccggcgcgatccgtgccgcaacgctggtgcacggcttgcgccgccgccagcagaagtacggcatggtcaccatgtgcatcggcaccggcatgggcgcggcgggcatcatcgaagcgctttaaaccgcgcagttagcg

SEQ ID NO: 39584 - DNA, 423 bp, Xanthomonas campestris; identical to SEQ ID NO: 39213

SEQ ID NO: 39585 - DNA, 816 bp, Xanthomonas campestris; identical to SEQ ID NO: 39214

SEQ ID NO: 39586 - DNA, 765 bp, Xanthomonas campestris
attgcgacctacaacgtcaatggcatcgccagccgcctgccgcacctgctgcaatggctgcaacgcgagcagccggatatcgtggggctgcaggaattgaaatccacgcaggaggcatttccggaacaggcgatccgcgatgcgggctacggggtgatctggcagggccagcggtcctggaacggcgtggcactgctggcacgtggcgcggagccggtagagatccggcgcggcctgccgtgggatccggcggacacgcagagccgctatctggaggccgccatccacggggtgatcgtgggttgcctgtacctaccgaatggcaacccgcaacccgggccgaagttcgactacaaattgaagtggttccagcgcctgcttcggcatgcggccacgctggtggcgctgccacatccggttgcgttgatcggcgacttcaatgtggtgcccaccgatgcgcacatctatgaccccaagggctggcgcaaggacgcattgctgcagccggagagccgcgccgcgtacgcgcagttgctggcgcagggctggaccgacagcctgcaggccatccacggcgatgcaccggtctacacgttctgggactactttcgtcagcacttcgcgcgtgaccgcgggctgcgcatcgatcatctcttgctcaatcgcacgttggcggcggggctacgcgatgccggggtcgacaagtgggtgcgtgcgctggagaaggccagcgatcatgcgccgccctggatcacggtggatgtg

SEQ ID NO: 39587 - DNA, 2124 bp, Xanthomonas campestris
atgcatcgcaccacgcgctccacctgctgttactgcggggttggctgtggcgtgttgatccacagcacgcacgatgacgccggcgagcgcatcgtcggcatcgaaggcgacccgctgcatccggccaatcacgggcgcctgtgcagcaagggcctggcgttgccgcagaccgctgccagccagcagggccgcgtgctggcgccggagctgcgccgccaccgcgacgcatcgcgcacggcggtgagctgggatcaggccttgactcacgtcaccggcaaactggctgcaatcatcgaccagcacggcccggatgcggtggcgttctatgtctccgggcagctactgaccgaggactattacgtcttcaacaagctcgccaaggggctgttgggcaccaacaacatcgacaccaactcgcggctgtgcatgtccagcgcggtcaccggctacaagctcgccctcggcgccgatggcccgcccacctgctatgaggatctggagctggcgcagacggtgctgtttgccggcagcaacatggcctacgcgcatccggtgctgttccgccggctggaagacgcgcgcgcgcgcaaccccgagattcgctggatcgtgatcgatccccgtcgtaccgacaccgcggccatggccgacctgcaccttgccatcgaacccggcactgacgtcgcattgttcaacggcatgctgcatcacctgatctgggagggtctggtagatgcgcgtttcgtggcggcgcagaccgaagacttcgatgccctcaagcacatgctgcgcgaatacacaccgcgcatgagcgccgagatctgcggaatctcgcacgaggacctggtgcaggcggccgagtggttcgggcgcagcccggctgcgttgtcgctgtattgcatgggcttgaaccagtcggcgcacggcaccgacaagaacctggcgctgatcaacctgcacctggccaccggccagatcggcaagccgggcgccgggccgttttcgttgaccggtcagcccaatgcgatgggcgggcgcgaagtgggcggcatggcaacgatgctggccgcgcaccgcgagatcggcaatgcgcaggatcgcgcggaagtggagcgcgcctggggcgtgccggccgggcgcatcagcagcacgccgggcgcaccggcggtgcaattgttcgagcgcctgcgcgcgggcacgctcaaggcggtgtggatcgtgtgcaccaaccccgtgcattcgatgcccgatatcgccggcgtgcgcgcggcgctggagcaggccgaactggtgatcgtgcaggacgcgttctcgggcaccgacaccgtgccttacgccgacgtgctgctgccggccgccagctggggcgagaaggacggcaccgtcaccaactccgagcgctgcatcacccgcgtgcgcaaggcagtggaaccgcccggccaggcacgtgcggactggtggattgcgcgcgaggtggcacgccggctggaagcgcgcctggccccgcagaagggcgccggcctgttcgcgttcgacacgccggcgcagatcttcgatgagcaccgcgcgttgacggtagggcgcgacctggatatcggcggcctggaccacgccgcactggatgcacgcgggccgcagcagtggccattcccggcgggtgccacgcaaggccaagcgcggcgttacaccgatggcgtgtttgcaacccccaacggacgtgcgcgcttccatgccacgccgtaccgcaaggttgccgagcccacctcggcacgctttccgatgcgcttgctgaccggccgcttgcgcgatcagtggcatggcatgtcacgcagtggtcgcgtgcccggtgcgtttgcgcatagccccgaaccggcattgcgcatgcatccggacgatgccgtgcgccgtggcctgcaagcgggcgaactggtgcgtgtggccagcaagcgcggcgcgctggtgctgccgttggaactgtccgacgagctgcgctcgggtacggtgtttgcggccatgcactggagcgcgcagacgctggccagcggcggcatcaacgaagtcagcacgccggccgtggacacacgctcgcagcagcccgagctcaagcacgcggccgtgcgcgtg

SEQ ID NO: 39588 - DNA, 4140 bp, Xanthomonas campestris
tattcgttcaccgaaaagaagcgtatccgcaaggacttcggcaagcagcgctcgattctcgaagtgccgttcctgcttgccatccaggtggattcctaccgcgaattcctgcaggaagacgtggagcccaacaagcgcaaggacctcggtctgcacgcggctctgaagtcggtgttcccgatttccagctacagcggcaacgccgcgctggaatacgttggttacaagttgggcgagcccgtgtttgacgagcgtgaatgccgtcagcgcggcatgagctatggcgcgccgctgcgcgtgaccgtgcgcctggtgatctacgaccgcgagtcgtcgaccaaggccatcaagtacgtgaaggagcaggaggtctatctcggcgaaattccgctgatgaccgaaaacggcaccttcatcgtcaacggtaccgagcgcgtgatcgtctcgcagctgcaccgttcgccgggtgtgttcttcgaccacgaccgtggcaagacccacagctcgggcaagctgctgtacagcgcccgcatcattccgtaccgcggttcctggctggacttcgagttcgacccgaaggatgcgctgttcacccgtatcgaccgtcgccgcaagctgccggtctcgatcctgctgcgtgcgcttggctacaacaacgaagagatgttggccgagttcttcgagatcaacacgttccacatcaatcccgatgaaggcgtgcagctggagctggtgccggagcgtctgcgtggcgaaacgctgaacttcgacctggccgatggcgacaaggtcatcgtggaagccggcaagcgcatcaccgcgcgtcacgtcaagcagctggaagccgccggcgttgccgcgctggccgtgccggacgactacctggtcggccgcatcctgtcgcacgacgtggtcgatggctcgaccggcgagctgctggccaatgccaacgacgaaatcagcgaagaccagctggctgcgttccgcaaggccggcgtcgatgccgtgggcaccttgtgggtgaacgacctggatcgtggcccgtacctgtccaacaccttgcgtatcgacccgaccaagacgcagctggaagcgctggtcgagatctaccgcatgatgcgtccgggcgagccgccgaccaaggaagctgcgcagaacctgttccacaatctgttcttcaccttcgagcgctatgacctgtccacggtcggccggatgaagttcaaccgccgtgtcggccgcaaggaagtgctgggcgagtcggtgctgtacgacaagaagtactttgccgagcgtaacgacgaagaatccaagcgtctggtcgccgagcacgccgacacctccgacatcctggaagtgatcaaggtgctgaccgagatccgcaacggtcgcggcgtggtcgatgacatcgatcacctgggcaaccgtcgcgtgcgttcggtcggcgaaatggccgagaacgtgttccgcgtgggcctggtccgcgtcgagcgcgcggtcaaggagcgtctgtcgatggcggagtcggaaggtctgaccccgcaggaactgatcaacgccaagccagtggctgctgcgatcaaggagttcttcggctcctcgcagctgtcgcagttcatggaccagaacaacccgctgtcggaagtgacgcacaagcgtcgcgtctccgcgctgggcccgggcggtctgacccgcgagcgcgccggcttcgaagtgcgcgacgtgcatccgacccattacggccgcgtctgcaccatcgaaacaccggaaggcccgaacatcggcctgatcaactcgctggccgtgttcgcccgcaccaaccagtacggcttccttgagacgccgtaccgtaaggtgctggacggcaaggtctccgacgacgtcgagtacctgtcggcgatcgaagaaaacgagtacgtgatcgcacaggcgaatgcgctgaccgacgccaagaacatgctcaccgagcagttcgtgccgtgccggttccagggcgagtcgctgctcaagccgccggctgaagtgcacttcatggacgtctcgccgatgcagaccgtgtcggtcgccgcggcgttggtgccgttcctggagcacgatgacgcgaaccgcgcactgatgggcgccaacatgcagcgccaggccgtgccgaccctgcgttcgcagaagccgctggtgggtaccggtatcgagcgtgcggttgcgcgcgactcgggcgtgaccgtgaatgcccgccgtggtggtgtgatcgaacagatcgacgccgcacgcatcgtggtcaaggtcaacgaggcagaaattggcggcggcaccgatgccggcgtggatatctacaacctgatcaagtacacccgctccaaccagaacacctgcatcaaccagcgtccgctggtgaacgtgggtgacgtgatcgcgcgcggcgacgtgctggccgacggcccgtccaccgacatcggtgaactggcgctgggtcagaacatgctgatcgccttcatgccctggaacggctacaacttcgaagactccatcctgctctccgagcgcgtggtggaagaggatcgttacaccacgatccacatcgaagaactgacctgcgttgcgcgtgacaccaagctggggccggaggaaatttccgccgacatcccgaacgtgtccgagcaggcgttgaaccgtctggatgaaagcggcgttgtgtacatcggtgcagaagtgcgcgccggcgacatcatggtcggcaaggtcacgccgaagggcgagagccagctgaccccggaagaaaagctgctgcgtgcgatcttcggtgagaaggcctccgacgtgaaggacagctcgctgcgcgtgcccccgggcatggacggcaccgtcatcgacgtgcaggtcttcacccgcgacggcatcgagaaggacaagcgtgcgcgccagatcgaggaatccgagatcaagcgcgtcaagaaggacttcgacgaccagttccgcatccttgaagcggccatctacgcacggttgaggtcccagatcgtgggcaaggtcgccaatggcggtccgaacctgaagaagggcgacaacgtcaccgacgcgtacctggacggcctgaagaagtccgactggttccagctgcgcatgaaggacgacgacgcagccgatgcgatcgaacgcgcgcagaagcagatccaggcgcacgagaaggaattcgaagcacgcttcgccgacaagcgcggcaagatcacccagggcgatgacctcgcaccgggcgtgctgaagatggtcaaggtgttcctggcagtgaagcgccgcatccagccaggcgacaagatggcaggccgccacggcaacaagggtgtggtctccaacgtcgtgcctgtcgaggacatgccgtacatggccaccggcgagccggtcgacatcgtgctgaacccgctgggcgtgccgtcgcgtatgaacatcggccagatcctggaagtgcatctgggctgggcagccaagggcctgggtcgcaagatccagcgcatgctggaagcccagaccgcagtcagcgagctgcgcaagttcctcgacgacatctacaaccacgacagcgcgatcaatgccgagcgcgtggacctgtcgcagttcagcgatgaggaattgctcaacctgggcaagaacctgatcgatggcgtgccgatggccaccccggtgttcgacggtgccagcgaagcggaaatcaagcgcatgctggaactggccgaactgccgcagagcggtcagacccagctgtacgacggtcgtacaggcgaagcgttcgatcgcaagaccacggttggctacatgcattacctgaagttgaaccacttggtcgacgacaagatgcatgcccgctcgaccggcccgtactcgctcgttacccagcagccgctgggcggcaaggcgcagttcggtggtcagcgcttcggtgagatggaagtctgggcgctggaagcctacggcgcggcctacaccctgcaggaaatgctgacggtgaagtccgacgacgtgcagggccgcaaccagatgtacaagaacatcgtcgatggtgagcacgagatggtcgcgggcatgccggaatccttcaacgtgttggtgaaggaaatccgctcgctggcgatcaacatggaactggaagag

SEQ ID NO: 39589 - DNA, 825 bp, Xanthomonas campestris
atgccattgatgaagttcaaacccacctctcccggccgtcgttccgccgtgcgcgtggttactcccgatctgcacaagggcgcgccgcatgcggcactgctcgactcgcagagcaagtccggtggtcgtaaccaccatggccgcatcaccgtgcgtcacgtcggtggtggccacaagcagcactaccgcatcatcgacttcaagcgcaacaaggaaggcattccggcgcgtgtggagcggattgaatacgatccgaaccgtaccgctcatatcgccctgctgtgctatgtcgacggcgagcgccgctacatcatcgcccccaagggcctgaaggcgggtgaccaggtcatcgccggtgccaacgcaccgatcaagaccggtaacgcgctgccgctgcgcaacatcccggtcggtacgacggtccacggtatcgagctgaagccgggtaagggcgctcagatcgcacgtgcagccggtgcagccgtccagctggtcgctcgcgaaggcatctatgccacgctgcgtctgcgctcgggcgaaatgcgcaaggtgccggtcgagtgccgcgccaccatcggcgaagtcggcaacgacgagcacaacctcgagaagctgggcaaggccggcgccaagcgtcggcgcggtgttcgcccgaccgttcgcggtgcggccatgaacgcgaacgatcacccgcacggtggtggtgaggccaaggctggccagggtaatccgcatccggtcaccccgtggggtgttccgaccaagggttacaagacgcgcaagaacaagcgcacccagcaattcatcgtccgcgatcgtaggggc

SEQ ID NO: 39590 - DNA, 1431 bp, Xanthomonas campestris; identical to SEQ ID NO: 39219

SEQ ID NO: 39591 - DNA, 981 bp, Xanthomonas campestris
aaagcacccgttcgtgttgctgtgaccggcgctgccggccagatcggctatgccctgctgttccgcattgcctccggcgaaatgctgggcaaggaccagccggtgatcctgcagttgctggaactgtccaacgaaaaagcccaggccgcgctcaagggcgtgatgatggagctggaagactgcgcgttcccgctgctggccggtatggtcggcaccgacgacgccgaagtggcgttcaaggacatcgacgtcgccctgctggtcggtgcgcgtccgcgcggcccgggcatggagcgcaaggacctgctgctggagaacgccaagatcttcaccgcgcagggcgctgccctgaacaaggtcgccaagcgtgacgtcaaggtgctggtggtcggtaacccggccaacaccaatgcctacatcgcgatgaagtcggcgccggatctgaacccgaagaacttcaccgccatgctgcgcctggaccacaaccgtgcgctgagccagctctcgctcaagctcggcaagccggtcggcggcatcgagaagctggtggtgtggggcaaccacagcccgaccatgtacccggattaccgtttcgccacctccgatggcgcgtccatcggcgatgcgatcaacgaccaggaatggaacgccggcaccttcatcccgaccgtgggcaagcgcggcgcggcgatcatcgaagcgcgcgggctgtcgtcggccgcatcggctgccaatgccgccatcgatcacgtgcgtgactgggtgctgggcagcaatggcaagtgggtcaccatgggcgtgccgtccgacggttcctacggcattccggaaggcgtgatcttcggcttcccggtcacgaccgagaacggccagtacaccctggtcaaggatctgccgatcgacgacttcagccagaagtacatcgacaagaccctggccgagctggaagaagagcgcagcggcgtgtcgcatctgctgggc

SEQ ID NO: 39592 - DNA, 609 bp, Xanthomonas campestris; identical to SEQ ID NO: 39221

SEQ ID NO: 39593 - DNA, 1482 bp, Xanthomonas campestris; identical to SEQ ID NO: 39222

SEQ ID NO: 39594 - DNA, 1131 bp, Xanthomonas campestris
gacccggtggatttgaacgacgaacagcaggccttccgcgccgccgcgcgcgacttcgccgacaaggaactggcaccgcacgccgcgcgctgggacgcggaaagccacttcccgcgcgaagccatcggcaaggcggccgagctgggcttctgcggcctgtacaccgacgaaggcgttggcggcctgggcatgcggcgcctggacgcggccatcgtgttcgaggagctggccacggtcgatccgtccacttccgccttcatcaccatccacaacatggccacctggttgattgccagctacggcaatgacggcgtgcgtgcgcagtggggcgaggcgatgaccagcggtgccaagctgggctcgtactgcctgaccgagccggggagtggctcggacgcggcctcgttgaagacccgcgcccagcgcgacggcgacgactacgtgctcaacggcagcaaggccttcatttccggcgcgggcgccaccgatgtgctggtggtgatggcacgcaccggtgaagacggcgcacgcggcatcagtgcattcgtggtggcggccgatgcaccgggcatcagctacggccgcaaggaagaaaagatgggctggaatagccagcccacacgtggcatcaccttcaccgatgtgcgcattcccgccggcaacctgctcggcaaggaaggcgaggggttcaagatggcgatgaaggcgctggacggtggccggatcaatatcgccgcctgctcgctgggcgccgcgcaaggcgcactggatgcggcgcgccgctacatgggcgagcgccggcagttcggcaaaaagttggccgatttccaggcgctgcaattcaagctggccgacatggccacgcaactggtggccgcacgccagatggtgcacaccgcggcgcgcaagctcgacgccggcagccacgacgcaacggtgtggtgcgccatggccaagcgctttgccaccgacgccggctttgcgatctgcgacgaggcgctgcagatccacggcggctatggctatatccgcgaatacccgatcgagcgcctgctgcgcgacagccgcgtgcatcgcatcctggaaggcaccaacgaggtgatgcgcatgatcatcgcgcgccacctgctc

SEQ ID NO: 39595 - DNA, 495 bp, Xanthomonas campestris
ctgttggtcgaccgccctgccatcgacgccgccgtcgccaccatcgccgatgcgatcgcgcgcgactacgctggcgaagtgccggtgtatctcaccatcatgcacggcgcgctgccgttctccggccagttggcgctggagctgggcgcgcgcggccaggacctgcagttcgactatctgcacgccacccgctaccgcggcgaaaccaccggcggcgagctggtctggaagcaccgcccggccactgcgctgttcggccgccgggtgatcctggtcgacgacatcctcgatgagggctacaccctgcagggcgtgcgccagtggtgcctggagcagggcgccaccgatgtgcgcgtggcggtgttgaccgtcaagcgccatgaccgctgcgtgccgggcgttaccgccgactacgtgggcgtggaagtggccgaccgctacgtgttcggcttcggcatggacgtcaacgagcagctgcgcggcattcctgccatc

SEQ ID NO: 39596 - DNA, 1173 bp, Xanthomonas campestris; identical to SEQ ID NO: 39225

SEQ ID NO: 39597 - DNA, 702 bp, Xanthomonas campestris
gcgttctggcacggcgtgttgccggccatcactaccccgttcaccgccaacggcgacatcgaccacgacttcctggccaagcatgccaatcagctggtggacgccggctgcaccgcgatcgtgccgctgggttcgttgggcgaagccgccaccttgagcgtggacgacaagctcgccatcctcaagacgttggtaacggccttgcagggccgcgtgccggtggtgccgggcatcgccagcctggccacgggcgaggcggtggcattggcaaaggcggcaaaggaactgggctgcggcgggctgatggtgttgccgccgtacgtgtattccaccgactggcgcgagatgggcgcgcatgtgcgtgcggtgatcgcggccaccgatctgccggtgatcctctacaacaacccggtggcctacaagaccgatttcggcccggcacagatcgccgagctggcggccgaattccccaatctgcaggcagtaaaggaatcttccggcgatgtgcgccgcttcgccgcgctgcaggaattgctgggcgatcgtctggcgctgctggtcggcatggacgacgccatcgtcgaaggcctgagcatgggcgccaaggggtggatcgccgggctggtcaatgcatatccgaaggagtcggtacgcctgttcgaactggcacgcgacggcggttaccccgccgccaaggaactg

SEQ ID NO: 39598 - DNA, 1869 bp, Xanthomonas campestris
atgatgatcgactccacccgctatccgcgcctgtcgcgcatccagactcccgacgatctgcgtaccttcgaggaggccgacctcaccgcggtcgccgacgaactgcgtgcctacctgatcgaatcggtgggcaagagcggcggccatttcgccgcgggtctgggggtgatcgaactcaccgtcgccctgcactatctataccagacgccggtcgaccaactggtgtgggacgtgggccatcagacctacccgcacaagatcctgaccgggcgccgggaccagatccacacggtcaagcagaaggacggcgtggcgccgttcccaaagcgcgaggagagcgtgtacgacaccttcggtgttgggcattcgtcgacctcgatctccgccgcgctcggcatggcgatcgccgcgcagcgcaatggcgacgaccgcaaggtggtcgcggtgatcggcgatggcgcgatgaccgccggcatggtctacgaggcgctcaaccacgccggcggcatggacccggaacccaacctgctggtgatcctcaacgacaaccgcatgtcgatttccgaggcagtgggcgggctgaccaagatgctcggccgtgccagcggcagccgcacgctcaacgcgatccgcgagggcggcaagaagatcctcggcgacaagaagaacaaccccaccgcgcgcttcgtgcgccgctgggaagaacactggaaaggcatgttcgtgccgtccacgttgttcgaggaaatgggcttccactacaccggcccgatcgatggccacgacctgcccagcctggtcggcgcgctgaagaccttgaagaccttgaagggtccgcagctgctgcacgtgatcaccaccaagggcaagggctacgagctcgccgaaggcgaccagattggttaccacgcggtcggcccgttcgacccgagcaagggcctggtggccaaggccggcgccaagaaaccgacctacaccgatgtcttcagcgactgggtgtgcgacatggcggcggccgatcccaagatgctggtgatcaccccggcaatgcgcgaaggctccggcctggtgcgcttcagcaaggaatatccgcagcgctatttcgatgtcgcgattgccgagcaacacgcggtcaccctggccgccggcatggcaacgcaaggtgccaagccggtggtggcgatttattcgaccttcctgcaacgcggttacgaccagctggtgcacgacgtagcggtgcagaaactggatgtgctgttcgcgatcgatcgcggcggcgtggtcggcccggacggcgccacccacgctggcaacctggacctgagcttcctgcgctgcgtaccgcacatggtggtgatggcgccggccgatgaagccgagtgccgccagatgctcaccaccggtctgcgttatgagggcccggccgcggtgcgttatccgcgtggcaccggccccggcaccgcactggatgcttccttgaccaccctgccgatcggcaaggcgcagctacgtcacagcggcgcacgcatcgcactgctcggcttcggcgccacggtggatgccgctgaagcggtcggccgcgagttgggcctgaccgtggtgaacatgcgtttcgtcaaaccgctcgacaaggcgatgctgctggagctggccaagtgccacgaagcctttgtcagcatcgaagacaacgtggtggccggcggcgcaggctcgggcgtctccgagctgctcaatgccgaaagcgtgctgatgccgatgctgcacctgggcctgccggacagcttccagcaccacgccagccgcgaagacctgctcgcagaagccggaatcgaccaggccggcatccgcgccgccgtgctcaagcgctgg

SEQ ID NO: 39599 - DNA, 1305 bp, Xanthomonas campestris; identical to SEQ ID NO: 39228

SEQ ID NO: 39600 - DNA, 1011 bp, Xanthomonas campestris
agtgcaatgagtgagattcaatccctgaccgcgcaggcgttggccgatgttgctgccgcgcacacgccggaccagctggaaacgctgcgcgtcgcgctgctgggcaagaacggcagcatcaccgcccagctcaagcagctcggcacgttgccggccgaccagcgcaaggcggctggcgaggcgatcaatctggcgcgcgatgcgctgaccacggcgctttccgagcgcaaacaggtgctcgaaaccgcagcgctggacgcccgtctggaaggtgagcgcatcgatgtgacgctgcccggccgacgcggtgagcgcggcggtctgcatccggtgacgcggaccctggagcgcatcgtcgagatctttgcgcggctgggttacgagttgtccgacggcccggagatcgaggacgactggcacaacttcgaagcgttgaacttcccgccgcatcatccggcgcgtgccatgcacgacacgttctacttcggcgatggccgcctgctgcgcacgcatacctccggcgtgcaggtgcgttacatggataccgcagtggccaccaagagtggcccgccgctgcgcatgattgcggccggcaaggtgtatcgctccgattcggatcagacccactcgccgatgttccatcaggtcgaaggtctgctggtggacgagcattccaacttcgccgatctcaagggcaccttgtccgagttcgtgcgtgcgttcttcgagcgcgatttcgaaatgcgcttccggcccagctatttcccgttcgttgagcctggtgcggaagtggatatcgcctggcagcagcccgatggcagcacccggtggctggaagtgcttggctgcggcatggtgcacccgaacgtgctgcgcagcgtcggcatcgatccggagcgctacaccggcttcgccttcggtctgggcgtcgagcgctttgcgatgctgcgctatggcgtcaacgacctgcgtgccttcttcgaaaacgacgtgcggtttctcaggcagttt

SEQ ID NO: 39601 - DNA, 1590 bp, Xanthomonas campestris
agcgtcttgatggcagccatgctgctttattcgggagcagcctgcgctgcgcctgcacccggtgattactacggcaccctggaaccgttcgccgccgatgcggtgtatttcgtggtcaccgatcgcttcgtcaacggcgacacgggcaacgatcaccgcgaccagggcggcgcacatcgcagcttcgatgtgcccacaccgtgcgacggtggcgtgggcgacaacatcggttacctcggcggcgacttcaagggcatcgtcgatcatgccgactacattcgcggcctcggctttggcgcggtgtggatcaccccgatcgtcgacaacccggacgaagcgttcaccggtggcaagcccatcacctgcgagagcacgctcagcgatcacggcaagaccggttatcacggctattggggcgtcaatttttacaggctcgacgaacatctccccagcccggggctggatttcgccgggttcacgcgcgccatgcacgccaatgacctgaaggtggtgctggatatcgtcggcaaccacggctcgcccgcctacagcatgccggtggcgcagcccgggtttggcaagctctacgacgcacagggccgcctggttgccgatcatcagaacctcgcacccgcacagctcgacccggcgcacaacccgttgcacgcgttctacaacaccagcggcggcctggcggaattgtcggacctcaatgaagacaacccggctgtgctggactatctagccggcgcctacctgcagtggatggagcagggtgccgatgcgtttcgcatcgacaccatcggctggatgccagaccgcttctggcatgccttcgtagcgcggatccgcgagaaacgcccgggcgttttcatgtttggcgaagccttcgactacgacccggccaagatcgccggccacacctgggcgcgcaacgccggcgtcagcgtgctggacttcccgctcaaacagcagctatccgccgtgttcggccacaaacaggctggcttcgaacagctcgccacgccgctgtatctgcgcaaaggcccgtatggcaacccgtacgagttgatgagcttctacgacaaccacgacatggcgcgcctggatgccagcgataccggcttcatcgatgcgcacaattggttgttcaccgcgcgcggcattccggtgatctattacggctcggaaaccggcttcatgcgcgggcgcgccgaacacgcgggtaatcgcaattattttggcgaagagcgcgtcagcaacgcaccgcagagcccgatcttcggcccgctgcagcgcatcgcgaccttgcggcgcaataccccggccctgcagcgcggcgtgcaggtggatctgcagttgcgcggcaaccaggcagcgttcctgcgcgtctaccagcatgcgggcatgacgcagaccgcgttggtcttgctcaacaagggcgacgcggcggcggacattgcggtgtcccgcttgctgcagcccggcagctggcgcgacgccttcagtggcgagcaggtgcaggtgcaaggtcgcgtgacgctgcaggtgccggcgcatggcgtgcgcgtgctgctgtcggatgcgccg

SEQ ID NO: 39602 - DNA, 2052 bp, Xanthomonas campestris
accgccaacccgttctttgccgacagcacgctgccgctgcactacccgcagttcgacaagatcaaggacagcgacttcgcgcctgccttcgacgccggcatggccgcgcagttgaaggaagtggacgcgatcgccaaccagaaggccaagccgaccttcgacaacaccatcatcgcgctggaaaagagcggcgccacgctggatcgcgccaccacggtgttcttcaacctggtgggcgccgacaccaacgatgcgcgcaagaaactgcaggccgactactcggccaagtttgccgcgcaccgcgatgcgatttcgctcaacggcaagctgttcgcgcgcatccagaccctgtacgaccagcgcagcaagctcggcctggatgcgcagggcgtgcgcctggtcgagaagtactacagcgatttcgtgcgcgatggcgccaagctgtctgacgccgacaagaccacgctcaaggccatgaacgccgagctggccaacctgggcaccaccttcagccagaacgtgctggccgaggtcaacgccgcggccgtggtggtggatgacgtcaagcagctcgatggcttgtctgacgagcagatcgccgccgctgccgaagcggcgaaggcacgcaagctcgacggcaaatacgtgatcgccctgctcaacaccaccggccagccgccgctgacccagctcaagaaccgcgagctgcgcaagaagatctacgccgcctcggtgtcgcgtggcagccatggcggccagtacgacaacaccgccctggtctcgcgcatcatgaccctgcgtgccaacaaggccaagctgctgggattccccacgtacgctgcgtattcgcttgaaaaccagactgccaagacgcctgaagcggtcaacgcgatgctcggcaaactggcaccggccgcggtggccaacgccaagcgcgaagccgccgacctgcaggcgatgatcgacaaggaacaaaaggccgcgcgcaagcccaccttcaagctcgaagcctgggattgggcctactacagcgagaaagtgcgccaggccaagtacaacttcgacgagtcgcagctcaagccgtatttcgagctgaagaacgtgctggaaaacggcgtgttctatgcggccaaccaggaatacggcctgaccttcaagcagcgcaccgacctgcccacctaccgcgacgacatcaccgtctatgacgtgttcgacgccgacggcaagcagctggcgatcttcattgccgacatgtatgcgcgcgaatccaagcgcggtggcgcctggatgaattcctacgtctcgcagtcagagctgaccggtttcaagccggtggtggccaaccacctcaacatccccaagccgccggccggccagccaacgctgctgacctgggatgaagtgaccaccatgttccatgagttcggccatgccttgcacggcatgttctcagacgtgaaatacccgtatttctccggcaccagcgtgccgcgcgactttgtcgagttcccctcgcaggtcaacgagatgtgggccgacgagccgtcgatcctgaagaactatgccaagcattatcagaacggcacgccgatgccgcaggcattgctggacaaggtgattgccgcgtccaagttcaaccagggctttgccaccaccgagtatctgggtgcggccatgctcgaccagaactggcaccagatcagcgccaaccaggtgccggacgccgcaggcgtgatggcgttcgaagccaaggcgctggccgatgacggcatcgcctatccgcccgtgccgccgcgctacaagaccccgtatttcagccacatcatgggcggctatgcggccggctactacgcctatatctggtccgaagtgctggatgccaacacgcagcagtggttcaagcagcacggcggattgagccgcgccaacggcgaccgcttccgtcagaccctgctttcgcgcggcggtagcgtggatgcgatggagctgttccagaacttcgccgggcatgcgccgcagatcgagcccttgctggagaagcgcggcctcagc

SEQ ID NO: 39603 - DNA, 1916 bp, Xanthomonas campestris; identical to SEQ ID NO: 39231

SEQ ID NO: 39604 - DNA, 609 bp, Xanthomonas campestris; identical to SEQ ID NO: 39232

SEQ ID NO: 39605 - DNA, 744 bp, Xanthomonas campestris
ttccagctacgcggctacaagccggtctacctgctgccggcattctggaccagcgacaccaaccgcacgccgcagtcgccgaacccagccaactcggtcagcacgccacagcaactggacagcgccgagttgaagttccagctgagcttcaagaccaaggtggttgaggatctgttcggcgacaacggcgatatctggatgggctatacccagagctcgcgctggcaggcctataactccgatgcctcgcgcccgttccgcgagaccaattacgagccggaagcgatgctggtgtttcgcaacaactacagcatcttcggctggaaaggccgcatgagcggcatcagcatcaatcacatgtccaacggccgcgaagacccgctgtcgcgttcctggaaccgggtgatcctcaacatcggcctggatcgcgaaaactgggcgctgaccttgcgcccgtggttccgtatcaaggaagaccgtgccgacgacaataatccggatattgaggattacatgggccgcggcgacgccaccctggtctataacaaggatggccacgaattcgccttgattgcccggcattcgctgcgtggcggcgaccgctcgcacggctcggtgcaactggattacggcttcccgatcaccaacctgttgcgcggccacgtgcaggtgttcgatggctacggcgagagcctgatcgactacaaccacaaggccacctatgtgggcgtgggcgtgtcgttg

SEQ ID NO: 39606 - DNA, 1110 bp, Xanthomonas campestris
gatgacttgttcgacgtgcgtgcgcagctcagcgatgacgaacgcgcggtgcaggatgcggtggcacgtttcaccgatgcgcgggtgctgcccggcatcggcgaggcattcgacgccgtgcgcttcccgcgcgaactggtccccgagctggcagcgctgggcttgctgggtgccagcctgccggtgagcgagggcggcgccggcctgggcgcggtggcgtacgggctgatctgccaggagctggagcgcggcgatagcggcctgcgcagctttgtcagcgtgcaatcgtcgctgtgcatgtatcccatccatgcctatggcagcgacgcacaacggcgccagtggctgccggagatggcggccgggcgggtgatcggctgtttcggcctgagcgaggcgcaaggtggttcggacccggcggcgatgaccacgcgcgcggtgcgcgacggtgacggttggcggctgcgtggcgccaagatgtggatcaccaacggcagcatcgcggacctggcaatcatctgggcacataccgacgacggcgtgcgtggctttctggtggacacacgcagcgagggtttccgtgcgcaggacatcggccacaagatgagtctgcgcgcctcggtcacctcggcggtgttcctggacgatgtcttcgtgcccgagcagcaacgcttgccggatgcactgggattgaaggcgccgctgggctgcctgagccaggcgcgcttcggcatcgcctggggcgcgatcggggcggcggtcgcctgcctacgcgaggcgctggcttacagcggcgagcgcattctgttcgggcggcccctggcggccacgcaaagcgcgcagatcaagctggccgacatggcgcgccggatcgccaccgcgcagctgctggcgctgcaactagggcggctgaaggaggccggcacgctgcgcccggaacagatctcgctggcgaagtggaataattgccgcatggcactggatgtggcgcgcgagtgccgcgacctgcttggggcggcggggatcaccaccgagcacgtggcgatccggcatgcgctgaatctggaatcggtgattacctgcgagggcaccgaaaccgtgcatcgcttt

SEQ ID NO: 39607 - DNA, 1908 bp, Xanthomonas campestris
cccgcgttcgccgctgatgcgcgcattacgcgcgagcagtacgcaacgctgtaccgcgaatcgatcgaacaccccgagcagttctggggcaaggccgcgcagcggctggactggttcaagcaacccacccagatcaaggacgtcagcttcgcgctggacgacttccacgtgcgctggttcggcgacggcgaactcaatgccagcgtcaactgcctggaccgccagctggccacccgcggcgacaagaccgcgctgctgttcgaacccgacagcccggattcgccgtcctacccggtcacctaccgcgagctctatgagcgcgtgtgcaagctgggcaacgcgctgcgcaacctgggcgtcaagaagggcgaccgggtcaccatctatctgccgatgatcgtcgatgcggccgtggcgatgctcgcctgcgcgcgcatcggtgcggtgcactcggtggtgtttggcggctttgcggccaactccatcgccgaccgcgtgatcgactgccagagcaagctgatcatcaccgccgacgaaggcctgcgcggcggcaagaagatcccgctcaaggcgaacgtggacgcggcgctgaagatccccggcaccaacacggtcgaaaccgtgctggtggtgcgccacaccggcggtgcagtggacatgcaggccccgcgcgaccgctggttccatgacgtggtcgatggccagccggccgagtgcgaacccgagcgcatgaacgcggaagacccgttgttcatcctctacacctccgggtccacaggcaagcccaagggcgtgctgcacaccaccgccggctacctgctgtttgccagctatacgcatgaagtggtgttcgacctgcgcgaggacgacatctactggtgcaccgccgacgtgggctgggttaccggccacagctacatcgtctacggcccgctggccaacggcgccaccgcggtgatgttcgaaggcgtgccgaattaccccaacgtctcgcgtttctgggaagtgatcgacaagcaccaggtcaccatcttctacaccgcgcccaccgccatccgcgcgttgatgcgcgaaggcgaagcaccggtcaagaagacctcgcgcagcagcctgcgcctgctcggcagcgttggcgagccgatcaatcccgaagcctggcgctggtactacgaggtggtcggcgacagccgctgcccgatcgtggacacctggtggcagaccgaaaccggcggcatcctgatctcgccgctggccggcgcagtggacctcaagcccggctcggccaccctgccgttcttcggcgtgcagccggccctggtcgatgccgaaggcaagatcctggaaggcgccaccgagggcaacctggtgctgctggattcgtggccgggccagatgcgcaccgtctacggcgaccaccagcgcttcatcgacacctacttccgcacctacccgggcagctacttcaccggtgatggctgccgccgcgacaccgatggctactactggatcaccggccgcgtggacgacgtgatcaacgtctccggccaccgcatcggcaccgccgaggtggaaagcgcgttggtgtcgcacccgaaggtggccgaagcggccgtggtcggcttcccgcacgacgtcaagggccagggcatctacgcctacgtgaccctgatcgccggcgagacgcccagcgaagagctgcacaaggaactggtgagctgggtgcgcaaggagatcggcccgatcgcctcgccggaccatctgcaatgggccccgggcctgccgaagacccgctcgggcaagatcatgcgccgcatcctgcgcaagatcgccgaaaacgccccggatcagctgggcgatacctccacgctggccgatccatcggtggtggattcgctggtcaatgagcgg

SEQ ID NO: 39608 - DNA, 1955 bp, Xanthomonas campestris
ggcgacagttcgccaagcttttatcagcctcggtgacgcgccggccggcacaccgtggcgccatcgcaccggtccgccgatgcggctatacccgtaaagtacgcgcgcgatgcgcttgccaggccacccgtctgcgctatgctgcgtccgtcagtatcgcttgcattcgccagttcgttgccacggcaatcagtggcaggccgcgcggtgcagcggtcacccttaccgcgtccaaccagcggacacggcgcaacggaggcgcgcgtgaagtcatcgcattgtttcatccggttctgctgtgtggtgctgctggccatcaccggctgttcgcctgccgcgcaatcgcgctatgcgcccgagcgcaacttcaccgaccccaaggccttggcactggccttggcggccgagcagggcgatgccgaggaagtgcggcggttgatgaaggtggagggcgtgaacccggacacgatcttctccaaggatggatatccactgttgttctggccgatcttcacccacaacccgaccgggctgaaggcgatgctggacaatggggccgatccgaatgtggccaagccctatcccccggagccgggacgaaatcagaccaatgtcagtaatgccatggtctgggcagccgagcaggacgacccgctctatctcaagttgctgctggatcatggtggtaatccgaatacgcggaacgcgaacaacgagagcctgttattccacgcgtttatcaagcagaacaaatgggacaacataaagcttcttgtcgagcgcggtgcggacataaacgcggttgcgggaatgggaaatagcattacggccgcctatgcaatccgcggtggcttcgacttcgtctactggcttctgcagcatggtgcagatccaaccatcgagttcgcttatggcaaccctgtccatctcaaagactctggaataattgaggccatcttttggcatccgggcaatcccaaggatccgcagtggcagcggcagtgccagcaatggctgttgaagcggggatatgagcgccctccattgccagagaactatcggagtatgcgcaaggcgttccacttcccaacggaagaaaaagatatcccgctgctttgacctccatgcacaaggattgattgcatgcaaacgcccacccagccggcaccgcaacgccgagaagacgcagcgcacacgaaatgcagcgcaggtcctgcgctgcaagcggccaactggcttaccatcctgttcctatgcaatcagccgcaacggaggcgcgcgtgaagccatcgcattgtttcatccggttctgctgcgtggtgctgctggccatcaccggctgctcgccagcggcgcaatcgcgctatgcgcccgagcgcaacttcaccgaccccaaggccctggcgctggcgctggcggccgagcagggcgatgccgaggaagtgcggcggttgatgaaggtggagggcgtgaacccggacaggatcttctccaaggatggatatccacttttgttctggccgatcttcacccacaacccgaccgggttgaaggcgatgctggagaatggggccgatccgaatgctgggcaactgcatcctttgcaggagacgacgcggttcaagggacgttaccggaaccgcgcaatggtgtgggcagccgagcaagatgattctgtttacctcaagctgctgctcgatcacggcggggatccgaatacttacaattcaaatggcgagacactgcttttccacgcacttatcaagcaggataagtggtcgaacatccagttgttagtgaaaaagggagccgacgttaatgcattggccggaatgggtggaaccattctggagaattactcggggtccggcggatttgagcgggttttctggttgttggagcacggggcggacccgaggattgagtattccggggatattccgttagccaaaatg

SEQ ID NO: 39609 - DNA, 762 bp, Xanthomonas campestris
atgaagattgcctcctggaacgtcaactcgctcaacgtgcgcctgccgcacctgcaacagtggctggccgattttgcgccggacgtggtgggcatccaggaaaccaagctggaagaccacaagttcccggatgcggcactggccgcgctgggctaccgcagcgtgttctgcgggcagaagacctacaacggcgtggcgatcctgtcgcgctcgccggcgctggaggtgcagatgggcatccccgggttcgatgacgtccagcagcgcgtcatcgccgccaccgtcgatggcgtgcgcatcatcaatctgtatgtggtcaacggccaggacgtgggcaccgacaagtacgcctacaagctgcgctggctcgaggcggtgcacgactggatcgcgcaggagctgcagcgccacccgcagctggtggtgctgggcgacttcaacatcgccccggacgcgcgcgacgtgtacgagccggaggtgtggagcgacaaccacatcctcacctccaccgccgagcgcggcgcactgcacaagctgttggcgctgggcctgcacgatgcctttcgcctgcatcacgacgatgccggccacttcagctggtgggattaccgccaggccgcctaccgccgcaacctggggctgcgcatcgacctgacattggtgtcggatgcgctgcgcgcccgcgcggtggaggcgggcatcgaccgcgaaccgcgcacctgggagcgccccagcgaccacgcaccggcgtgggtgcggctg

SEQ ID NO: 39610 - DNA, 792 bp, Xanthomonas campestris
gtggtatcggtgcatgtggaaaaccgcattgcgtgggtaaagtttgcgcggccggacaagcgcaacgcgatgagcccggcgctcaatcgccgcatgctggacgtgctggacgagctggaattcgacgacaacgtcggcgtgctggtgcttggtggcgaaggtaccgcgtggtcggccggcatggacctgaaggaatactttcgcgagaccgaagcacaaggcctgcgcggcgtgcgccgatcgcaacgcgaatcctatggctggttccgccggctgcgctggtaccaaaaacccaccatcgccatggtcaacgggtggtgtttcggcggcggcttcggcccgttgttcgcctgcgacctggccatcgccgccgacgaggcgcaattcggcctgtcggaaatcaactggggcatcctgcccggtggcggcgtcaccaaggtggcggtggaattgctctccatgcgcgatgcgatgtggatgacgctcaccggcgaactggtcgacggcaggaaggccgccgaatggcgcctggtcaacgaaagcgtgccgttggaacggttggaaacacgtacgcgcgaagtggccgagttgctgctcaagaaaaatccggtagcgctgaaatatgccaaggatgcggtgcgtcgcgtcggcaccatgacctacgacgaagccgaagactatctggtacgcatgcaggaagcggccaactcgttcgacaacaacgcgcgcaaggaaggcatccgtcagttcatcgatgaaaagcgttacaagcccggtctgggtgcgtacgag

SEQ ID NO: 39611 - DNA, 1425 bp, Xanthomonas campestris
cgtggaccgtggggtttattcatcgatggtcagtggcgcgccagcaccggcagccagacgctggatgtcatcgcgccgcacaccgaagaacgcctgctgcgctacaccgaaccatcgcatgccgacaccgaggccgcggttgccgcggcgcgcagagccttcgatagtggcccctggccgcagctgccgccgccagaacgcggcgccgcgctgaagcgcattgccgagcatttgcgggcgcgcatgccggaactggcagatgcatggaccgcgcaggtcggcgccgtcatcggtttcagtcggcgcgcctccaagcaggcgccggatctgttcgactactacggcgacctgatcaccacccacccgttcgtcgagccacgcacgcgctccagcggcgggcgcgtgcatgtggtacaggaaccggtcggcgtggtcgtcgccatcacgccgtggaatgcgccgttggtgctgctctgctacaaggtcgccgccgcgctggcggccggctgcacggtggttgccaagccgtctccggaaacgccgatcgacgcctatattctggccgaatgcatcagcgccgccgggctgccggatggcgtgttcaatctgctaccggccgggcgcgaggtgggtgaacagctgatccggcacccttcggtggacaaggtgagcttcaccggctccacccaggcagggcgatcgatcggtgtggcctgcgccgagcgcctggcgcgcgtcgggctggagctgggcggcaagtcggcggcgatcgtgctggaggatgccgacatcgagaaagtgctgcccagcctggtgccctactcgatgccgatcaccggccaggtgtgtttcgcgctcacccgcgtactggtccccgcgcatcggcgcgaggccatcctgcacgcgtattgctcggcgctggccacgctcaaactcggcgacccgtttgccgccgacacgggcatgggcccgctggcactcggccgccagttggaacgtgtgcaaggctacatcgcccagggcagcgccgaaggcgcaaagctggtcatgggcggcgggcggccagagcacttgccacgcggtttctttcttgagccgaccgtgtttgcaggtgtgacgccggagatgaccattgcccgcgaagaaatcttcggccccgtcgtgagttttatcgactatcacaacgaagaagatctgatcgccaaagtcaacgacagcgattacggcctgcatggcaccgtctatagcgacgatcccgaacgcgcctacgcgattgcgcgacgcgtgcggagcggcagccattcgatcaacggcatgtgcgtggatatcgagatgccgttcggtggtgtcaaacactccggcatcggccgcgaaggtggcatcgaaggcctgcacgggtttctcgaaaccaaaacgatctatctc

SEQ ID NO: 39612 - DNA, 1419 bp, Xanthomonas campestris; identical to SEQ ID NO: 39239

SEQ ID NO: 39613 - DNA, 492 bp, Xanthomonas campestris
atgaaactctcgctcatcgtcgccttcgaccgcaaccacgccatcggccgcgacaacgatctgccgtggaagctgcccgatgacctgaagcgcttcaaggcgctgacactgggtaagccgatcctgatggggcgcaagaccgcgcagtcactgggccgtgcgctgccagggcgcctgaatctggtgctgacgcgctcggggcaggtgcctttcgagggcatgcatgcagtggtttcggtagacgaggcgatcgaacgcgcggcgcaggaaggtgcgcaggagctgtgcgtgatcgggggaggcgaggtgtaccgcctgaccatggagcgcgccgatctgctggcggtcaccgaagtggacacggctgtcgagggcgccgatacgcacttcccgccgatcgatccggcggtgtgggtgcccgcagagcgcagcgcgcatgcggcagacgcgcggcacgccttcgctttcagtttcgtggattaccagcgccgc

SEQ ID NO: 39614 - DNA, 702 bp, Xanthomonas campestris; identical to SEQ ID NO: 39241

SEQ ID NO: 39615 - DNA, 429 bp, Xanthomonas campestris
gagctgccgatcgacgtcaatcagatccagacgctgatcccgcaccgctacccgttcctgctgatcgaccgcgtcatcgagctggacctggaagccaagcgcatcgtcgggcagaagaacgtcaccatcaacgagccgttctttcaggggcacttcccgacccgtccggtgatgccgggtgtgctgatcatcgaagcgctggcgcaggccggcggcgtgatgacccagctcggcctgggccgcgatgcgctgtccaagctgttctacatggtcaaggtcgacaacgcccgcttcaacaagcaggtggtgccgggggatgtgctgatcctggaggtgcagatgaagcgcctgatccgcaacatgggatgctattacggcgaagccaaggtcaacggcgaaatcgtggccagtgccgaagtcatgtgcgcc

SEQ ID NO: 39616 - DNA, 909 bp, Xanthomonas campestris; identical to SEQ ID NO: 39243

SEQ ID NO: 39617 - DNA, 1380 bp, Xanthomonas campestris; identical to SEQ ID NO: 39244

SEQ ID NO: 39618 - DNA, 840 bp, Xanthomonas campestris
gaagcccgcgcggaccgcatcgactggctgcgtgcgctgccgttcatcgccttgcacctggcctgctttgcggtgttctgggtcggtgtgtcgtggttcgcagtgggcatggccgtggcgctgtacgcgctgcgcatgttcgcgctgaccgggttctatcaccgctatttctcgcaccgcgcattcaagacctcgcgcgtggtgcagttcgtgttcgccgcgatcgccgccacctgcgtgcaacgtgggccgctgtggtgggccgcacaccatcgcaaccatcaccgccataccgacaccggccgtgacccgcattcgccggcacagcacggcttctggtggagccataccggctggttcctgaccccgcgcaacttccgcaccgattgggaagtgattccggatctgcgccgctttaccgagctgcgatttctggaccgcttcgacatcgtgatgccggtgctgctggcgctgggcctgtacctgctcggtgactggctggcggctgcagcgcctggcctgcagaccaatggcgcgcagttgctggtgtggggcttcgtgctgtccacggtggcgttgttccatgccaccttcaccatcaattcgctggcgcaccgcttcggcagccggcgcttcgacacccgcgacgacagccgcaacaactggctgctggcgctgctcaccttcggcgaaggctggcacaacaaccatcatttctttcccggctcggcgcgccagggcgtgcgttggtgggaatacgacatgacctggtacgggctcacggtgatgtcgtgggtgggcctggtgtgggatctcaaaccgatgcccgccatgctgacg

SEQ ID NO: 39619 - DNA, 1893 bp, Xanthomonas campestris
cgtgcgcgccgttccaacgtgcgtggcaagccgaccggccgtccgggttcgtcgtcgtcgcgtcgcaacgatggtggtcgcggtagcaatcagagcaacagtggcccgcacgggttcgagcgtccgaccgcaccggtggtgcgtgaagtggcgatcggcgagaccatcaccgtcgccgatctggcgcagaagctcgcgctcaagggcggcgacgtggtcaaggcgctgttcaagatgggcgtcatggcgaccatcacccagagcatcgatcatgacaccgcggcgctggtgaccgaagagctcggccacaaggcggtgcgtgcggacaatgccgacttcgaagatgcgctgctggcgcatgccgaagacgcccagggcgaaaccacctcgcgtccgccggtggtcaccatcatgggtcacgtcgatcacggcaagacctcgctgctggattacatccgtcggaccaagattgcctctggcgaagccggcggcatcacccagcacatcggtgcgtaccacgtcgaaaccggccgtggcgtcatcagcttcctggatacgcccggccatgccgcgtttacctcgatgcgtgcgcgcggcgccaagatcaccgacatcgtggtgctggtcgttgcagccgatgacggcgtgatgccgcagaccaaggaagcggtggcgcatgccaaggcggcaggcgttccgttgatcgtggcagtcaacaagatcgacaaggccggcgcggatccgctgcgggtcaagaacgagttgctggctgaaaacgtggtggccgaagacttcggtggcgatactcagttcatcgaagtgtcggccaaggtcggtaccggtgtggacacgctgctggatgcaatttcgctgcaggcagaagtgctggaactcaaggcagtggccgatggccgcgccagcggtaccgtgatcgaatcgtcgctggacaagggccgcggcccggtcgcgacggtgctggtgcagcagggtgcgctgaagcgtggcgactacctggtgtgcggtattcaatacggccgcgtgcgtgcgttgttcgacgaaaccggccaccagccggcctctgcgggcccgtcgattccggtgcaggtgctcggcttgtccggcgtgccggaagccggcgacgacttcgtggtcgtcgacgacgagcgtctggccaaggacgtggcgcagcagcgcgaaaccaagcgccgcgaatcgcgtctggtcgcctcggccaccaaccgcatggaagacatcctggcccagatgggcaagggcgaaggccagcaggtgttgaacctggtgatcaaggccgacgtacagggttctgtggaagcgctcaagcagtcgctggtggcgttgtccaatgacgacatccgcatcaacgtgatccactccggcgtgggcggcatcaccgagtcggatgcgaattcggcagcggcctccaaggccacgatcatcggcttcaacgtgcgtgcggatgcatcggcacgcaagatcgtcgagtccaacggtatcgatctgcggtacttctcgatcatctatgacgtgatcgaccaggtgaagcaggtggcgtccggtctgctcggcgtggaaatccgcgaagagatcatcggtatcgcgcaggtccgcgatgtgttccgcagctcgaagttcggcgcggttgcaggctgcatgatcatcgaaggtgtggtgaagcgcagcaagccgatccgcgtgctccgcgacagcgtcgtggtgttcgagggcgagctggaatcgctgcgtcgcttcaaggaaaacgtcgacgaagtgcgcaacggcaccgagtgcggtattggcgtgaaggcctacaacgacgtcaaggcgggcgaccagatcgagtgcttcgagcgcatcgaagtggcgcgtacgctg

SEQ ID NO: 39620 - DNA, 1431 bp, Xanthomonas campestris
tggcacggctgtatcttcaatggcgactgggttcccggtagcggcggcacgctgcagatccatgagccggccaccggcggcctgttgcacgaggtcggcaaggccgatctatccgatgtggaggccgccattgcgcaggccaagcatgcccaacgtgcctgggcaatcacctcgccgcgcgagcgtgcagcggtgttccaccgcgctgcgcaactgatggaagcgcaccgcgccgaggctaccttgctgatcgcgcgcgagaccggcggcatcatgcccaaggccgagcgtgaggtgagcgaggcgattgcctactaccagcaagcggccgggctgccgctgcaggcgatgggccaggtgctgccaaccgccgcaggccagctcagcctggccaggcatttgccgctgggcatcattgcggtgatttcgccgttcaacttcccgctgatcctgtcgctgcggtcggtggcaccggcgctggcgatgggcaatgcggtgatcctcaagccggacccgcgcacgccgtataccggcggtgtgatcatcgcccaagtgctcgaagaagccggactacccaaggggctgctgcacgtgctgcacggcggcgccgacatcggccaggccctggtcgaagcgccggacgtgccgatgattgccttcaccggctccaccgctgccgggcgccggatcggcgagctcgccggccgtcacctgaaaaaggtggcgctggaactcggtggcaataatgcagtgatcgtgctcgacgacgccgacctggagcgcgccgcatcggcaatcgccttcggtgcatacctgcatcaaggccagatctgcatggccaccggccgtgtgctggtgcaacgcggcgtggccgacgcgctgaccaaactgctggccgacaaggcacgccacctgccggtgggtgacccggtcagcggcacggtggcgctgggcccgatcatcggccagcgccagttgcagcgcgtgctggacatcgtcgatgacagcatcgacgccggcgcggtggtcgaagccggcgccacccacgacggcctgttctatgcagcgaccgtgttgtcgaacgtgcgcccgggcatgcgggtgttcgatgaggaagtgttcggcccggtgatcaacatcacggtgttcgataccgacgaagaagccgcggtactggccaatcacggcgaatacggcctggtggcaggcatcatgtcggcgtcggtgtcgcgcgccatggtgctgggcgagcaattgcacaccggcttgctgcacatcaacgaccagaccgtggccgatgaggtcatcaatccattcggtggcacgggcgcttcgggcaacggcaccagcgtgggtgggccggccgattgggagcagtacatgcactggcaatggctgacgatcaagcacgcggtgccgcagtacccgttc

SEQ ID NO: 39621 - DNA, 1479 bp, Xanthomonas campestris
tacgtccttgcgatcgaccagggcaccaccagctcgcgcgcgatgttgttcgatcgccagggcaaggtggccggcgtggcgcagcgcgaattcggccagatctttccgcagccgggctgggtggaacacaacccgcgcgagatcatgaccagcgtctacaccaccattaccgagctgctcaacaacgcgcagatcgacgcgcgcgagatctcaggcatcggcatcaccaaccagcgcgagaccgcagtggtatgggacaaggccaccggccagccgatctacaacgccatcgtctggcaatcgcggcagaccaaggacatctgcacccagctcaaagaggccggccatgagcagatggtgcgcgacaagaccgggctgctgatcgatgcgtatttttccggcaccaaggtcaagtggattctcgaccacgtggacggcgcacgtgaacgcgcacgcaagggcgagctcgccttcggcaccatcgatagctggctgatctggaacctcaccggcggcaaggtgcacgtgaccgactacaccaatgcctcgcgcaccatgatgtacaacatccacaccctggagtgggatgccgagctgctggagatgctggacgtgcccgcgcagatgctgccggaggtgcgctcctccagcgaggtctatggcatgacccagacccagtacttctacggggaacaggtacccatcgccggcattgccggcgaccagcaggccgcattgttcgggcaagcgtgctttgaaccgggcatggcgaagaacacctatggcaccggctgtttcatgctgatgaataccggcgacaaggccgtggcctccaaggccggcttgctgaccaccatcgcctggggcatcgacggcaaggtggaatacgcactggaaggcgccatcttcgtggctggctcggtggtgcagtggctgcgcgatgggctgcgcatgttcggcaaggcgagtgattcgcaagcctacgcggagcgtgccggcgacaacgacggcgtgtatttcgtcccggccttcgtgggcctgggcgcgccgtactggcgcagcgatatccgcggtgcggtgttcggcctgacccgcggcaccagcaaggaacacttcgtgcgcgcggcggtggaatcgatggcctaccagacccgcgatgtgctcaccgcgatgcagagcgattcggggatcgaactgaaggagctgcgcgccgacggtggcgcgatcgccaacgacttcatggcgcagttccaaagcgacattctcaacgtgccggtgctgcgtccggaggtggccgaaaccaccgcgctgggcgcggcctacctggcgggcctggccaccggattctggagcagccgcgaagaaatcgccaaacaatgggcggtggatcgtcgcttcgagccgaacatgcccgaagagcggcgcgaacagttgtatgccggctggcagcaggcagtggaagccacgatgggcttccgc

SEQ ID NO: 39622 - DNA, 1467 bp, Xanthomonas campestris
gagacatacgatcttctggtaatcggcggcggcatcaacggggtcggcattgcccgtgacgcggccgggcgcggtctgtcggtgtgcctgtgcgaacaggacgacctggccgcgcataccagcagcgccagcaccaagctcatccacggtggcctgcgctatctggagcagtacgagttcgcattggtcggcaaggcgctggccgaacgcgaggtactgctgcggctagcgccgcacatcatctggccgctgcgcttcctgctgccgcatcagccgcatctgcgcccggcctggatgattcgcgccgggctgttcctgtacgaccatcttggcggcagcaagcgcagcctgccgcgctcgcgccggctgtcgctgcgcacccatccggttggccagccgctgcaggagtcgctgcgcaccggctttgtgtattccgacgcatgggtgcaggacgcgcggttggtggtgctcaacgcgatggatgcggccaagcgtggcgcgcagatccatacgcgtacgcgctgcgtcggcgcctggcgcgatgccgggttctggtacgcggagctggaaggccgcgacggacgccgccgcaccgtgcaggcgcgtgcgctcgccaatgcggccggtccgtgggcggtgtcgttcctggacaaggtggccgcggtgccgcaccagcatgcgctgcgcctggtcaagggcagccacatcgtggtgcccaagctgttcgaccacgaccacgcgtacatcttccagcaacccgatcgacgcatcgtgtttgccattccctacgagcacgacttcaccttgatcggcaccaccgacgtggactacgaggccgacccgtccgcacccaagatcgacccggccgaagtgcagtacctgtgcgatgcggtgaatctgtatttccagcagcagatcactccgcaggatgtggtgtggaactacagcggcgtgcgtccgctgctcgacgacgccgaagacaacgccgccgaagtgacccgcgactatcagctggaagtgctcaccgacggcgcaccattgctcaacgtgttcggcggcaagctcaccacctaccgcaagctcgccgaagaagccgtcgaccggctgacccaggccctgggcgcgcgcaagccggcgtggaccgcgcgtggcgaagccctgcccgggggcgaacaacgcgacatcgccagcctgctggagcgcgtgcgcactgcgcgtccctggctgccggcggccaccgcacagcggctggtgcgcaactacggcacctgtgccgagcagttgctcggcgatgcgcaggacatggctgcactcggccagcattttggtgcggacctgtaccaggccgaggtggattacctgtgcgcccgcgaatgggcgcagaccgccgacgacatcctgtggcgccgcagcaaactgggcttgcgtgtggatgccgaggggcgcgcgcgcctggaggcgtatctg

SEQ ID NO: 39623 - DNA, 1474 bp, Xanthomonas campestris
ccggcctgcccggtgccggccccaccgtggtggtcaccgatctatgcgtgatggaacccgacccggtcagccgcgagctcaccgtgaccgcgctgcatcctggcgtgacccaggcgcaggtcaccgcggccaccggctgggcggtgcgctttgccgcaacgctgaccgaaactgccgcacccaccgccaccgagttgcacgccttgcgtgcgttgcaggcacgcaccgccgcagcccacggaacgcaagcggcgggagctgaggcatgagcgaggtctatctggtggatggcattcgcacgccgatcggccgttacggcggcgcactgtccagcgtgcgcgccgacgacctgggcgcggtgccgatcgccgcgttgttggcgcggcatccacagctggacccggcggccatcgacgatgtctacctgggctgcgccaaccaggccggcgaggacaaccgcaatgtcgcgcggatgagtgtgttgctggctggtttgcccagttcggtgccgggcagcacggtgaatcgcctgtgcggctcgggactggaagcggtgggcattgcggcacgcggcatccgtgccggcgaactggagctggcagtggctgggggcgtggagtcgatgtcgcgcgcgccgtgggtgatgggcaaggcggaatcggcgttcgcccggaaccagcacctgcacgacaccacgatgggctggcgcttcatcaatccgcgcctggaagcgacctacggcgtggagctgatgggcgagaccgccgagaacgtcgcgcagcgctacgccatcagccgcgacgaccaggatgcgtttgccctgcgcagccagcagcgcaccgccgccgcgcaggccgccggcttcttcgacgacgagatcaccgcagtggcggtggccgggcgcaagggcggcgagggcgtgcaggtcatgcgcgacgaacacccgcgggccgatgccagtgccgaggccctggcgcggctcaagccggtgttccgccagccgggcacggtcacggccggcaatgcggccggcctcaatgacggtgccgccagcctgttgctggcctcggcgcgcgcgctgcacctgcacgggctcacgccacgcgcgcgggtgctggggtttgcctcggcgggcgtggagccaacctacatgggcatcggcccgatcccggccacgcaacgcctgctggcgcggctggggctgcagatcgcgcaattcgatgcgatcgaattcaacgaagccttcgccgcgcaggcgctggcctgcacgcgcgcgttcggattggccgacgatgccgcgcacgtcaatgccaatggcggtgcaatcgcgctgggccacccgctgggcatgagcggtgcacggctcgcactgacgctgctgcgtcaactcgacgcctgcaatggccgccgcggattggccagcatgtgtattggcgttggccagggcgtagcgctggcgatcgagcgtgtttga

SEQ ID NO: 39624 - DNA, 1962 bp, Xanthomonas campestris; identical to SEQ ID NO: 39251

SEQ ID NO: 39625 - DNA, 1125 bp, Xanthomonas campestris
ttcgagcttggcgaagacatcgatctgctgcgcgaaagcgtggccgccttcgccagccaccatatcgccccgcttgccgcggcggccgatcacgacaacgtcttccccgcgcagttgtggcggctgttcggtgagcagggcctgctgggcctgaccgtggaagaagcatacggcggcagcggcatgggctacctggcgcacgtggtggcgatggaagaaatttcgcgtgccggcggtgcgatcgggctgtcctacggcgcgcactccaacctgtgcctcaaccagctgcgcaagaacgccacccacgaacagaagcagcgctacctgcccaagctgtgcaccggtgagcacgtcggcgcactggcgatgagcgaggccggttcgggctcggacgtggtgtcgatgaagctgcgcgccgaggcacgcggcgaccgctttgtactcaacggcagcaagatgtggatcaccaatggccccgatgccgacgtgctggtggtgtacgccaagaccgaccccagcgccggtgcgcgcggcatcactgccttcatcgtcgaaaagggcatgcccgggttttccaccgcgcagaagctcgacaagctcggcatgcgcggctccaacacctgcgaactggtgttcaccgattgcgaagtgccggccgaaaacgtgctgggcacgctcaacggcggcgtgcgcgtgttgatgtccgggctggatttcgaacgcgtggtgctggcgggtggaccactcggcttgatggccgcggccatggacgtggtgctgccgtacgtgcacgagcgcaagcagtttggcgagccgatcggcaccttccagctgatgcaggccaagctggccgacatgtacgtggggctcaacgcgtgccgtgcgtacgtctatgccgtggcacgcgcctgcgatgccggccgcaccacgcgccaggatgcggctggcgcgattctgtatgccgccgagaaggccacctggctcaccggccaagcgatccaggtgctgggcggcaacggctacatcaacgagtaccccaccgggcggttgtggcgcgatgccaagctgtacgagattggcgccggcacgtctgaaatccggcgcatgctgatcggccgcgagttg

SEQ ID NO: 39626 - DNA, 801 bp, Xanthomonas campestris; identical to SEQ ID NO: 39253

SEQ ID NO: 39627 - DNA, 765 bp, Xanthomonas campestris; identical to SEQ ID NO: 39254

SEQ ID NO: 39628 - DNA, 1995 bp, Xanthomonas campestris
acccgccgccagctggccaacgccatccgtttcctcgccgccgatgcggtcgaagccgcaaaatccggccaccccggcatgcccatgggcatggccgatatcgccgaagtgctgtggaacgatttcttccggcacaacccgaacaatccgcagtggttcaaccgcgaccgtttcgtgctgtccaacggacacggctcgatgctgcagtacgcgctgctgcacctgtccggctacgacctgccgatcgagcagctcaagcagttccgtcagttgcacagcaagaccgccggccaccccgagcgcagcgaaacgcctggagtggaaaccaccaccgggccgctggggcagggctttgccaatgcagtcgggttcgcgctggccgagaagttgctggcgcagcgctataaccggcccgaactggaaatcgtcgaccaccgcacctgggtgttcatgggcgacggttgcatgatggagggcatctcgcacgaggccgcctcgctggccggtacctggggcctgggcaagctggtcgcgttctgggacaacaaccagatctccatcgacggcaacactgccggctggttcagcgacaacaccccggcacgcttcgaagcctatggctggcatgtgatccgtgatgtggacgggcacgacgccgagaagatcaagacggccatcgaggcggcgctggaaaacagcgacaagcccacgctgatctgctgccgcaccaagatcggcttcggtgcacccaccaagtcgggcaaggaatcctcgcacggcgcaccgctgggcaaagaggagctggaaggcgcgcgcaaggcgctggaatggccgtacggcccgttcgagattcccgaagagatctacgccggctggcgcgcaggtggcaccggcacgctgcgtcaggccgagtgggagcagctgttcgacaagtacgccaagcagtacggcgaacaggccgacgagctgacccgccggtcgcgtggcgagttgccggccgacttcatcgcccaggccgatgcctacatcgccaaggcgcaggaagatggccagaccatcgcctcgcgcaaggcatcgcagctggcaatcgaagcgttcgcaccgctgctgccggagctggtcggcggctcggccgacctggcgcattccaacctcaccttgtggaaggccagcaagtcggtcgccaccgacgacccgaacgccaactacgtgtattacggcgtgcgcgaattcggcatgaccgccattgccaacggcctggcgctgcatggcggcttcatcccgttcgacgccaccttcctggtgttcagcgactacgcgcgtaacggcgtgcgcatgagcgcgttgaatccggcgcatgccatccatgtgtacacgcacgactcgatcggtctgggcgaagacggcccgacccatcagccggtcgaacacctggcctcgctgcgctacatccccaacaacgatgtgtggcgcccgggcgatgcggtggagtcggcggtgagctggaaggccgcgatcactcgcaaggacggcccgagctgcctggtgttcagtcgccagaatctgcagcaccagccgcgcagcgccgagcagatcaagctgatcgaacgtggcggttacgtgttggccgatgccgaaggcggcacgcccgacgtgatcctgatcggcaccggctcggaagtgggcttggcggtggaagcgaagaagacgctggatgcggccgggctgaagacacgcgtggtgtcgatgccgtccaccgacgtgttcgatcgccaggatgccgcgtaccgcgagcaggtgctgcccaatgccgtgcgcaagcgcgtggcggtggaagcgggcgtgaccggcttctggcgcaagtacgtgggcctggacggtgcggtgatcgggatcgacacgttcggcgcgtcggcacccgccgaccagctgtatgcgtacttcaagatcaccgccgagcacgtggtcgaggccgccaaggcgctgtaatgcgtt

SEQ ID NO: 39629 - DNA, 1236 bp, Xanthomonas campestris
ctgcattggaagatgggcattggcttcgccatcggcctggtgctgggtctggccgtgtactacctggccgggagcgacgccgaatgggtgcggctggtgaccaagtacgtcaccacgccgttctcgcagatcttcctcaatctgatcttcatgctgatcgtgccgctgctgttttcggcgctggtggtcggcattgcggaaatgggcgacatccgcgcgttgggccgggtgggctggcgcacgctgggctacacggtggtgttgtcgggcattgcggtgttgctgggcttggtcctggtcaatgtgctcaagcccggtgcaggcgtggacccgcaactggccaaccagttgatccaggaaaatgccgaccgcacccgcgagatcatctccagctccggcaatcagccgcagggcatggacatgctgctttccatcgtgccgaacaacgtgattgcggcggcctcgagcaatggcgcgatcctgtcattgatgttcttcgcggtgatgtttggcgtgggcatggtgctcactgccgacgaaaaagtggccacgctcaagcgcggcattgaaggcatcttcgagatctcgatgaccttgatcgggctggtgatccgcctggcgccgtacgcggtggcctgtttcatgttcaatctggccgcgttgttcggcttcgatctgctgattcgcctgggcgcctacgtcggcgtcgtggtgctggcgctgggcctgcacatggtggtcagctacgggctggcggtgaagttcgccgggcgttcgccgatcggcttcttccggcagacgcaggaggccacgctgatggcgttctccaccgcctccagcaacgcgaccttgccgactgccttgcgcgtggccgacgagatgggcctgccaccgcgggtctcgcgcttcgtgctcaccgtgggcgccaccgccaaccagaacggcaccgcgctgttcgaaggcgtgacggtgatcttcctggcgcagttcttcaatgtggacctgagcatcggccaacaattcatggtgatgatcgtctgcatcctgggtggtatcggtaccgccggcgtgccctccggctcgctgccggtggtggcgctgatctgcgcgatggtcggggtcaacccggtcggcatcggcatgatcctgggcgtcaatcacttcctggacatgtgccgcaccgcgctgaatgtcaccggcgatctggcgttgacgacgctggtggctaaaggtgag

SEQ ID NO: 39630 - DNA, 2031 bp, Xanthomonas campestris
attcgcgaaggccgtcccaatccactcggtgccacctgggatggcctgggcgtcaatttcgcgctgtattcgcgcaacgccacccgcgtggagctgtgcctgttcgacgagcgtggccgtgagcaggaacgcattcccttacccgaatacaccgacgaggtctggcacggttacctgcccgacgcgcgcccgggccagctttacggctaccgcgtgcatggcccgtacgcacccgatgccggccaccgcttcaaccacaataaattgctgctggacccgtatgccaagcagatcgtgggcgagctcaaatgggcgccgcatctgttcggctacaccatcggtcatcgcgacaaggacctgagttttgaccgccgcgacagcgccgcgttcatgcccaagtccgcagtgatcgacccggcctttacctggggccaggaccgcccgccgcagaccccgtggaaccgcacggtgatctacgaggcgcacgtgcgcggcctgagcatgctgcacccggccgtgccaccggaaaaccgcggcacgttctcggcgctgaagaccgacgagctgatcgatcacatcagttcactcggcgtcactgcggtcgaattgctgcccgtgcacgcctttgtcgatgaccagtacctgctggaaaaaggcctgcgcaattactggggctacaacacgctgggctttttcgcgccgcagggccgttacatgtccacgcgcacggtggccgagttcaagcagatggtggcgcggttgcaccacgccgggctcgaagtgctgctggatgtggtctacaaccacaccgccgaaggcaacgagctcgggccgacgctgtcgttcaagggcatcgacaacgccagctattaccgcctggccgacgatcgccgtttctacatcaacgacaccggcaccggaaataccttcgacctcaccaacgttggcgcgctgcgcatggtgatggattcgctgcgttactgggtgcaggaaatgcacgtcgacggcttccgcttcgacctggccagcatcctcggccgcgagcgctatggattcgatccttcaggcagcttcctggatgccgtacgccaggatccggtgctcagccagaccaagctgatcgccgagccgtgggacatcggccccggcggttatcaggtgggcaacttcccgccaggttgggtggagtggaacgacaaattccgcgacaacgtgcgtgcgttctggcgtggcgatggcggccagctggcagaactggccacgcgcctcaccgggtcggcagacctgttcaaccacagcggccgccgccccaccgcgtcggtgaatttcgtcaccgcgcatgatggcttcaccttgcgcgatctggtcagctacgaaggcaaacacaacctcgccaacggcgaagacggccgcgatggcagcgatcacaatatctccgccaactacggcgccgaaggcgagaccgacaaccccgccatcaagcagctgcggcggcaacagatgcgcaacctgctggccaccttgctgctctcgcaaggcacgcccatgctgctggccggcgatgaattcgggcatagccagaacggcaacaacaacgcgtattgccaggacaacgagctgacctggatcgactggaccgcggccaccaaagccgccgccgccgatcaggccgccttcgttcgccgcctgatccgcatccgccagcggtacccgttgctgcatcgcgcacgcttcttcgacggcaagttcgatgaagcactgggcctgaaggatctgacctggctggcgcccaacggcaacgagatggacgaagccgcctggcacgaccccgaagcccgcgcgctgatgctgcgcctggacggtcgctcgccgaccaccggcctgcgcgagatcgccgccaatgtgacgctgttgatgctgatcaatgccgcgcccaccagcgtcgctttcacgctcccggcgatgcacgacgaacactggcgcgtgctggtggacaccgcgcgtcatggtggccgcgtggtcgccggtggc

SEQ ID NO: 39631 - DNA, 2142 bp, Xanthomonas campestris; identical to SEQ ID NO: 39258

SEQ ID NO: 39632 - DNA, 1386 bp, Xanthomonas campestris; identical to SEQ ID NO: 39259

SEQ ID NO: 39633 - DNA, 1137 bp, Xanthomonas campestris
cacgaacggatttcgtcgctgcgcaaattgcgcgtggcccaggagcgggtgcgggtgcggcggcaggtgggccgccgcgacggcgtgcgcctggaaatcgatgggcgttggctgaccggtttctgctccaacgattacctggggttgtcgcagcagtttgaagtggtggccgcgctgcaggatgccgccgcgcgcgatggcgccggcgcgactgcctcgcatctgatctgcggccatcacaccgcgcacgagacgctggagcgcgacatcgccgaatggctgggctatccgtcggcgctgctgttcggcagcggcttcatcgccaacctggccgtgcagcaggcgctgctcagcgaagaagacgatgtctgcgtgcaggaccggctcaatcacgccagcctgctggatgccacgcgcctggccggctgccggttgcgccgctacccgcacctggatgtggaaggcgcgatgcgccagctcaagggcgcgccggagggcgcggcaatgctcgccagcgacggtgttttcagcatggatggcgacgttgcgccactgcgtgcgctgagcctggtcgcgcgcatgcaggaggccttgttctatgtcgacgatgcgcacggcgtgggcgtgctggggccgcagggccgcggttgcgtggccgatgccgggctcggcgtggccgaagtgccgctgcaattggtcaccctgggcaaggccctgggcggctatggcgcggtggtggtgggcgaagaagcgctgatccgccacctggccgaaaccgcgcgcccgtacatctacaccaccgcgctgccgcccgcgcaggtggccgccaccctggctgcggtgcgcctggcgcgtcgcgacgattggcgccgcacgcggctgaccgaactgatcggcacattccgcgatggcgcgcgccggcatggcttcgaactgatggcctcggacacccccatccagccattgctgtgtggcgaggaagccaccgtgatggcgatgtcggcagcgctggagcaagccggcttcttggtcggtgcaatccgcccgcccaccgtgcccgaaggcaaggcgcggctgcgggtgacgttgtcggcattgcacacgccgcaacaggtgcaggccctggtcgatgccatc

SEQ ID NO: 39634 - DNA, 777 bp, Xanthomonas campestris; identical to SEQ ID NO: 39261

SEQ ID NO: 39635 - DNA, 666 bp, Xanthomonas campestris
gcgtcgcacaacgttgcatcgttggatctctcataccttccactgccacgattcccggagcagacttaccgctttgggcatcttcaagacatgagcatcgccggcgcgggcttgttggaacttcccgaatccatcagtgacctggccaacttgcggaccttgacgttgagtcaaaatccgatcggcgcgttgcctgcgtccatttccaggctgggggaattgcaagagctcaccatcttcagctgccccaacctgaccgaactccctgaacatcttgcaattcgcaacactgctggccagcgcgaaggattggtcaagctgcggacgctgacactgtcgcgcacaggaatccgctcgctcccgtcatcgcttgaatacctgaaagatctgacccacctaaaaatcaactcctcgccacttaccgaactcaacacaagcattcatcgcctccccctgctggaagaggttgatctgcgcggctgcacgcgtttacgccattacccttcgatttcgggacagcagtggtcgcttaggaaactcagcctgcaggactgcagctctctgcaaacgctgccatcgaatattgacgcactgcggaatctgcaagagctcgacctgcgcggctgcaacaacctgcgcgcactcccgcccagtatttccgggtta

SEQ ID NO: 39636 - DNA, 612 bp, Xanthomonas campestris
accatgcacgccccctttgggtgcatgcgcatgagccagtccgaccagcccgattcatccgttacccaggcccaggccgaagaggccgtgcgcaccctgctgcgctgggccggtgaggatcctgcccgcgaaggcctgctggacaccccgcgccgggtggccgaagcctatggcgactggttcagcggctaccgcgaagaaccgcgcgcctacctggagcgcaccttcgaagaagtggccggctacgacgaattgatcgtgctgcgcgacatctcctacgaaagccattgcgagcaccacatggcgccgatcatcggcaaggtgcacgtgggctacctgccgcgcggcaaggtggtgggcatcagcaagctggcccgcgtggtggaaagctacgcgcgccgcttccaggtacaggaaaagatgaccgcacagatcgcccagtgcatccaggacgtgctgcaaccgcgcggtgtgggcgtggtggtggaaggcgcgcacgaatgcatgaccacccgcggcatccacaagcgcggcgtcagcatggtgacctccaagatgctcggcagcttccgcgaggacgcgcgcacccgcgccgaattcctgcagttcatc

SEQ ID NO: 39637 - DNA, 1788 bp, Xanthomonas campestris
ttggacctggacgtctgtgcgcgcgaacccatccatattcccggcctgatccagccttacggcgtgctgctggtgatcgaccccgccgacggccgcatcgtgcaggccagcaccaccgccgccgatctgctcggcgtgccgatggccgcgctgcttggcatgccctacacccaggtgctgacgctgcccgaagcacagccgttcgccgtcgatgaccagccacagcacctgatgcatgccgaggtgcggttcccgcaacgcgccacgccaccagacagcgcctgggtcgcggcctggcatctgtatccgcagcagtggctggtggaaatggagccgcgcgatgcgcgcctgctcgatgtcaccctgcgcgaggcgatgccgctgctgcgcagtgtcgaacgcgatcccggcatcgccgaggcagcggtgcgcgtggccaagggcctgcgcagcctgatcggcttcgaccgcgtgatgatctaccgcttcgatgaggagtggaacggcgacatcatcgccgaggcgcgcaagccggaactggaggcctatctcggcctgcattaccccgccagcgacatcccggcgcaggcgcgcgcgctgtacctgcgcaaccgggtccgccagattgccgatgtcggctaccagccgtcgccgatccagcccaccgtgcatccgcagttgggcacgccggtggatttgagcgatgtgagcctgcgcagcgtttcgccggtgcacctggagtacctggccaacatgggcgtcaccgccacgctggtcgcctccatcgtggtcaacgatgcgctgtgggggttgatctcctgccatcactacagcccgcatttcaccaaccacgccatgcgcgatgtcaccgatgcggtggcgcgcaccctggccgggcggatcggcgcgctgcaggcggtggcccgtgcgcgcctggaatcggtgctgctcaccgtgcgcgaaaaactcatcaccgacttcaacgatgccgagcacatgaccgtcgaactgctcgacgacatggccccggacctgatggatgtggtggacgccgacggtgtggcgatcttccacggcaacgacatcagccgccacggcaccaccccggacgtggcggcgctgcggcgcatccgcgatcacatcgaatccgaacaccacgatgccctgcgcgaagacgcggtcggcgcgctgcatgtggacgccatcggcgaggtcttccccgagctcgccgacctggcgccattggcggccggcttcatcttcgtgccgctgatgccgcaatcgcgcagcgccctgctatggacccgccgcgagcagatccagcagatcaaatgggccggcaatccgcagctggccaagctggaagacatccccaactcgcgcttgtcgccacgcaagagtttcgacctgtggcagcagacggtgcgcggccgtgcgcggcgctggtcgccgctgcacctggaatcggcccgcagcctgcgcgtgctgatcgaactgatggagcgcaagcgcttccagcaggacttcaccctgctggaagcctcgctctcacgcctgcgcgatggcgtggccatcatcgagcgcggcacggccaatgccgcgcaccgcctgctgttcgtcaacaccgcctttgccgatgtctgcggcagcgacgtcgccgagctgatcggacgtgagctgcagacgctgtacgccagcgatgcaccacgcgccaacgtggaactgttgcaggatgcgctgcgcaacggccgggccgcctacgtcaccttgccgttgcaagtgagcgac

SEQ ID NO: 39638 - DNA, 1611 bp, Xanthomonas campestris
tggtacaaggacgcgatcatctaccaggtgcacgtcaagtcgttcttcgactccaatgacgatggcatcggcgatttccccggcctgatttccaagctcgactacatcgccgaactgggcgtggacacgatctggctgctgccgttctaccccagcccgcgccgcgacgacggctacgacatcgccgaatacatggcggtgcatccggactacggcaccatcgccgacttcgagcagctggtggcgcaggcgcatgcgcgcggcatccgcatcgttaccgagttggtgatcaaccacacctccgatcagcatccgtggtttcagcgcgcccgcaacgcgccggctggttcgccggagcgcgacttctacgtctggtcggataccgaccaggaatacgaaggcacgcgcatcattttttgcgataccgaaaagtccaactggacctgggacccggtggccggccagtacttctggcaccggttctattcgcaccagcccgatctcaacttcgacaacccggcggtgctggaatcggtgctggaagtgatgcgcttctggctggaccgcggcgtggacggcctgcgtctggacgcagtgccgtatttgatcgaacgctccggcacctcgaacgaaaacctgccggaaacccacgccatcctgcgcaagatccgcgccacgctggatgccgaatacccggaccgcatgctgctggccgaggccaacatgtggccggaagacacccagcaatacttcggccagaacgccgacgaatgccacatggcgttccacttcccgctgatgccgcgcatgtacatggcgatcgcgcgcgaagaccgcttccccatcaccgacatcatgcggcagacgccggagattccggagacctgccagtgggcgatcttcctgcgcaaccatgatgagttgacgctggaaatggtcaccgattcggagcgcgattacctgtggcagacctatgcttcggaccgccgcgcgcgcatcaacttaggcatccgccgccgcctggcgccgctgctggagcgcgaccgccgccgcatcgaattgatgacctccttgctgctgaccatgcccggcacgccggtgctgtactacggcgatgagatcggcatgggcgacaacatccatctgggcgaccgcgatggtgtgcgcaccccgatgcagtggtcgatcgaccgcaacggtggcttctcgcgtgccgacccggctgcactggtgctgccgccggtcatggacccgctgtacggcttccaggcggtgaacgtggaagcgcagatccgcgaccagcattcgctgctgacgtggacccgccgcgtgctcagcgtgcgcaagcgctaccaggcgttcggccgcggcacgctgcgctttttgtacccaggcaaccgccgcatgctggcctacctgcgctgctatcaggacgaaaccgtgctgtgcgtggccaacctttcgcacaccttgcaggcggtggagctggacctgtccgagttcgaaggccgcgtgccggtggacatcatcggcggtggcagtttcccgccgatcggccggctgacctatctgctgaccgtgccgccatttggtttctatgcgttccagctg

SEQ ID NO: 39639 - DNA, 2160 bp, Xanthomonas campestris
gtgacgaatcgatgggaccccggcgtgacccgcgccctggccgaagcgcggcacggcgatgcattcgccgtgctgggcgcacatcccagcaccaacggccgcctgctgcgcacctatcaccccggcgccgagcacgtcaccgccgtgctggcggatgggcgcgaggtaccgctggaagccggcccggaaccaggcctgtttgccggcgaattgccggccgagggaggctaccgcctacggatcggctggccgggcggcacccaggacaccgcagacccgtacgcgttcgggccgctgctcagcgacttcgacctgcacctgatcagcgaaggccaccatctgcagctggccgatgcgctgggtgccaatgtggtggaagtggacggcgtgcgcggtacgcgctttgcggtgtgggcaccgaacgcctcgcgcgtggcggtggtgggcgacttcaatagctgggacgcgcgccggcacccgatgcggctgcgccaccaggccggcgtgtgggagctgttcgtgcccgacgtgggccccggcgcgcactacaaatatcagctgcgtggcccgcatgggcatgaactgccggccaaggccgacccggtggcacgccgcgccgaactggcgccgggcactgcctcgatcgtggccgaccccacgccgcaccagtggagcgacgacggctggatggccacgcgtgcgcgccgccaggcgcacgacgcaccgatgagcatctacgagatccatgccggctcctggctgcgcgaggaaggcctggatctggattgggatggcctggccgatcgcctgattccgtacgtggccgacatgggcttcacccatgtggagctgatgccggtgaccgagcatccgttcggtggctcgtggggctaccagccgttgggcctgttcgcgcccaccgcgcgcttcggcagcccggatggctttgcgcgctttgtcgaccgctgccaccgcgaaggcatcggcgtgatcgtggactgggtgccggcacactttcccaccgacgcgcacggcctggcccacttcgacggcaccgcgctgtacgaacatgccgacccgcgcgagggcttccaccgcgactggaatacgctgatctacaaccatggccgccgcgaggtgtctggctttctgatcgccagcgcgctggagttcctgcagcgctatcacgtcgatggcctgcgcgtggatgcggtggcctcgatgctgtatcgcgactacagccgcaatgccggcgagtgggtgcccaatatccacggcgggcgcgagaactacgaaaccatcgcgttcctgcgccggctcaacgcggtggtgcgcgagcacgcgccgggtgcggtgaccattgccgaagaatccaccgcctggccgggcgtgaccgcggatgtgtcgcatggcggcctgggcttccactacaagtggaacatgggctggatgcacgacacgctgcattacatcgggctggacccgatctatcgccgctatcaccacggcgagctgactttcagcatggtgtatgcgtactcggagcgcttcgtgctgccgatctcgcacgacgaagtggtgcacggcaagggctcgttgctgggccgcatgccgggtgacgactggcagcgtttcgccaacctgcgcgcctatctcggtttcatgttcacccacccggggcgcaagttgctgttcatgggctgcgagttcggccagcccaccgagtggaaccacgatgctggcttgccgtggcatctgctcgatgacgcacgccaccgcggcgtgcagacgctggtgcgcgacctcaaccacctgtacgcgcaataccccgccttgcacgcgcacgacgacgacccatcgggctttgcgtggctggtaggggatgacgcggccaacagcgtggtggcgttcctgcgcaagggcaaacgcggcgatgcaccggtgctggtagtgatcaactacaccccgatggtgcagcaggggtatcgcctgggggtgccgcagggcggcctgtggcgcgaagtgttcaacagcgatgccggcatctacggcggtgccaacctgggcaacggcggtgcggtgactgccgaaccgcagtccatgcatggccacgcgcagtcgctgccgttgctgctgccgccgctgggcgtcatcgtgctg

SEQ ID NO: 39640 - DNA, 747 bp, Xanthomonas campestris; identical to SEQ ID NO: 39264

SEQ ID NO: 39641 - DNA, 741 bp, Xanthomonas campestris; identical to SEQ ID NO: 39265

SEQ ID NO: 39642 - DNA, 711 bp, Xanthomonas campestris; identical to SEQ ID NO: 39266

SEQ ID NO: 39643 - DNA, 1248 bp, Xanthomonas campestris
tccatcttcgtcaatccacagcggcggtttcaggcgttgctgggcattggcggggcgatcaccgattccagcgcggaaaccttcgccaaactgcccaagcaggcgcagcggcaactgctcaccgcctactacgacccggacaagggcatcggctacacgctggcgcggaccaccatccatagctcggatttcagcagtggcagctacacctatatcaaggaaggcgacgcggcgctgaagaccttttcggtgcagcacgatgcgaaataccgcattccgatgctgcgccaggccattgctgcggccggtggcacgctcaccacgtttgccagcccgtggagcgcgccggccttcatgaaagacagcaacgccatgctcaagggcggcaagctgttgcccgaatatgcgcaggcctgggccacgtactacacgcgcttcattgccgcgtatgaaaaggccggcatcccgatctggggcatcagcctgcagaacgagccgatggcagtgcagacctgggagtcgatgctgttttctgcggaagaagagcgcgactttctcaagaatcatctgggccccaccatggccaaggccggctatggcgatcgcaagatcatcgtgtgggaccataaccgcgacatgatggtgcaccgcgcgcatgtgatcttcgatgatccggaggcttccaaatatgcgtggggcatgggcttccactggtacgaaacctgggccgggttcgcgccgatggtggagaacgtggcggcggtggcacaggcgtacccggacaagcacctgctgctcaccgaagcggcggtggaaaagttcgacccggccaagctgcagcactggcccaatggcgagcgctatggcacggccatcatcaacgacctcaatcacggtgcggtgggttggacggactggaacatcctgctggacgagcacggtggccccaatcacgtgggcaactattgctttgcaccggtgcatgccaacacgcgcaccggcgaggtgatctacacgccgagctattggtatatcggccacttttccaagttcatccggcctggcgcgcagcgggtgagtgcggcgagcagccgcagtaacctggctaccactgcgttcgtcaacagcgatggcagcctggcgacggtggtgatgaatgccacggatgtggcgatccgctacaacctgtatgtgggcgatgcctccagcgtgctggagattcccgcgcatgcgatccagacggtggtg

SEQ ID NO: 39644 - DNA, 861 bp, Xanthomonas campestris; identical to SEQ ID NO: 39268

SEQ ID NO: 39645 - DNA, 1107 bp, Xanthomonas campestris
atgaaatcccgtgcagcagttgcattcggacccggcaagccgctggaaatcgtcgagatcgacgtggcaccgccgcaggccggcgaagtgctggtccgcatcacccacaccggcgtctgccacaccgacgcgttcacgctgtcaggggatgacccggaaggtatttttccgtcggtgctcggacacgaaggtggcggcatcgtcgagcagatcggcgaaggtgtgaccggcgtcaaagtgggcgatcacgtcatcccgctgtacacggccgaatgccgcaagtgcaagttctgtctctccggcaagaccaacctgtgccaggccgtgcgcgcaacccaaggcaagggtttgatgcccgatggcaccacgcgcttctcctacaacggcgagccgatcttccactacatgggctgcagcaccttcagtgaatacaccgtggtgccggagatctcgctggccgtggtgaacccggaagcgccgctggaaaaagtttgcctgctgggctgcggcgtcaccaccggcatcggtgccgtgcacaacaccgccaaggtcaagccgggtgagagcgtggctgtgttcgggctgggcggtattggtcttgcggtgatccagggcgcggtgcaggccaaggccgggcgcatcctggccatcgacaccaacccgggcaagttcgacctggcgcgcagcatgggcgccaccgattgcatcaacccgaaggattacgacaagccgatccaggaagtgatcgtcgagttgaccgatggcggcgtggatttcagcttcgaatgcatcggcaacgtcaacgtgatgcgttcggcgctggagtgctgccacaagggctggggcgagagcgtcatcatcggcgtggccggtgccggccaggaaatcagcacccgcccgttccagctggtgaccggccgcgtgtggcgcggctcggccttcggcggcgtcaagggacgtacccaattgccgggcatggtggagcagtcgatgaagggcgagatcgatctggatccgttcatcacccacaccatgccgctggaacagatcaacgaagccttcgacctgatgcatgaaggcaagtcgatccgcaccgtgattcatttc

SEQ ID NO: 39646 - DNA, 1470 bp, Xanthomonas campestris; identical to SEQ ID NO: 39270

SEQ ID NO: 39647 - DNA, 1656 bp, Xanthomonas campestris
gaatacgactacatcatcattggcgcaggctcggccggcaatgtactggccgcgcgcctcaccgaagacccgggtgtcagcgtgctgctgctggaagccggcgggccggattaccggctggatttccgcacccagatgcccgccgcattggcgtttccgttgcagggccgccgctacaactgggcctatgagacagagccggaaccgcacatggacaaccggcgcatggagtgcgggcgcggcaaggggctgggtggctcatcgctgatcaacggcatgtgctacatccgcggcaacgcactggatttcgatcattgggccaagcgcccggggctggaagactggagctaccgcgatgtgttgccgtacttccgcaaggcagaaacgcgcgacatcggcgccaacgattaccacggcggcgaaggcccggtgagcgtggccacgccgaagaacgacaacaacgtgctgttccaggcgatggtcgatgctggcgtgcaggcgggttacccgcgcaccgacgacctcaacggctatcagcaggaaggcttcgggccgatggaccgcaccgtgacgccgcaagggcggcgtgccagcaccgcacgcggctatctggacatggccaagccgcgcgacagcctgcacatcgtcacccacgccaccaccgaccgcattttatttgccggcaagcgcgcggtcggggtgcattacctggtgggcaacagcagcgaaggcatcgacgcgcacgcgcgccgcgaagtactggtctgtgcgggtgcgattgcctcgccacagttgctgcaacgctccggcgtgggtgccccggacctgttgcgcgcgctcgacgtgcagctggtgcacgacctgcccggcgtggggcagaacctgcaggaccacctggaggtgtacatgcaatatgcatgcaccaagccggtgtcgttgtacccggcgctacagtggtggaatcagccggccattggcgccgagtggttgtttgccggcaccggcaccggggccagcaaccagttcgaggccggcggtttcattcgcacccgcgaagagttcgactggcccaatatccagtaccacttcctgccggtggcgatcaattacaacggcagcaacgcggtaaaagagcatggcttccaggcccatgtgggctccatgcgtacacctagccgcggccgcgtgcatgccaggtcgcgcgacccgcgccagcatccgtcgatcctgttcaactaccaatctaccgaccaggattggcaggaatttcgcgacgcaatccgcatcacccgcgagatcatcgcccagcccgcactcgacccttaccgtgggcgcgagatcagccccagcgcagactgtaagaccgacgccgagctggatgcgttcgtgcgcgcacgcgccgaaaccgcgtatcacccctcgtgctcgtgtgcgatgggcaccgacgacatggcggtggtggatgggcaaggccgcgtccacggcatggaggggttgcgcgtgattgatgcctcaatcatgccgcgcatcatcaccggcaacctcaacgccaccaccatcatgatcgccgagaagatcgccgaccggatgcgcgggcgcgcactgctgccgcgcagcaccgccgactattacgtggcgggtgatgcacctgtgcgc

SEQ ID NO: 39648 - DNA, 1234 bp, Xanthomonas campestris; identical to SEQ ID NO: 39272

SEQ ID NO: 39649 - DNA, 747 bp, Xanthomonas campestris; identical to SEQ ID NO: 39273

SEQ ID NO: 39650 - DNA, 1057 bp, Xanthomonas campestris; identical to SEQ ID NO: 39274

SEQ ID NO: 39651 - DNA, 2565 bp, Xanthomonas campestris
cacaccccgctgatgaagcaattcttcgcagccaagtcggactaccccgacctgctgctgttcttccgcatgggagacttctacgagctgttctacgacgatgcgcgcaaggccgcgcgtctgctggatatcacgctgacccagcgcggcagttccggcggtgcgccgattccgatggctggcgtgccggtgcatgcctacgagggctatctggcgcgcttggtggcgttgggcgagtcggtggcgatctgcgagcagatcggcgatccggcactggccaagggcctggtcgagcgcaaggtggtgcgcatcgtcaccccgggcacggtcaccgacgaggcgttgctggacgagcgccgcgacacgctgttgatggcgatctcgcgcagcaagcaaggctatggcctggcctgggccgatctggccggcgggcgtttcctggtcaatgaagtggacagcgtcgatgcgctggaagcggaaatcgcgcgcctggaaccggccgagctattggtgcccgacgaagacaactggccggaattcctgcgtggacgcgtcggcgtgcggcgccggccaccatggctgttcgacgccgatagcggccggcgtcagctgttggcgttcttcaaattgcacgacctgtccggcttcggcatcgacgacaagccctgcgccaccgcagcggccggcgcgctgctcggctatgtcgaagaaacccagaaacagcgcttgccgcatctgacctccatcgcgatggaagtggccagcgaggcgatctcgatgaacgcagccacacgccggcatctggagctggacacgcgcgtggatggcgatacccgcaacaccttgctcggcgtgctggacagcacggtcacgccgatgggcgggcgcctgctgcgccgctggctgcatcgcccgttgcgtctgcgcgaggtactggtgcagcgccaccacgcggtcggcagcctgatcgacaccggcgccgataccgacgtgcgcgaggccttccgcgcgctgggcgatctggagcgcatcctcacccgcgtggcgctgcgctcggcgcgcccgcgcgatttctccaccttgcgcgatggcctggcgctgctgccgaaagtgcgcacgatcctcgcgccactggattcgccgcgcctgcagacgctttatgccgaactcggcgagcacgatgccaccgcgcatctgttgatcagcgcagtggccgaacaaccgccgctcaaattcagcgacggtggcgtcatcgccaccggttacgacgccgatctggatgagctgcgccgcctgtccaccaacgccgaccaattcctgatcgacctggaacaacgcgaacgcgccagcagcggcatcgccacgctcaaggtcggctacaaccgagtgcacggctactacatcgagatcagcaagggccaagccgagaaagccccgctgcactacagccgccgacagacgctgaccaacgccgagcgctacatcaccgaagaactcaagagcttcgaagacaaggtgctatcggcgcgcgagcgctcgttgtcgcgcgaaaaactgctctacgaaggcctgctcgacgcactcggcggcgagctggaaggcctcaagcgctgcgccagtgcattgagcgaactggatgtgttggccgggttcgccgaacgggcccaggcgctggattggtcgcaacccgaactggaaagcgcgccgtgtctgcacatcgaacgcggccgccacccggtggtggaagccgtgcgcgaccagccattcgaacccaacgatctggacctgcacccggaccgccgcatgctggtcatcaccggcccgaacatgggcggtaaatcgacctacatgcggcagaacgcgttgatcgtgttgctggcgcatatcggcagctatgtaccggccagccgcgcggtgatcgggccgatcgaccgcatcctcacccgcatcggcgccggcgacgacctggcgcgcgggcaatccaccttcatggtggaaatggccgagaccagctacatcctgcatcacgccacgccgcaatcgctggtgctgatggacgagatcggccgcggcacctccacctacgatggcctggccttggccgatgcggtggcgcgtcatctggcccacaccaatcgctgctacacgctgtttgccacgcattatttcgagctcaccgcgctggcggatgcctcgcatgccggtggcggcagcggcatcgccaacgtgcatctggatgcggtggaacacggcgagcgcctggtgttcatgcatgcggtcaaggacggcccggccaatcgcagcttcggcttgcaggtggccgcgctggccggcctgccgaaggcggcggtgcagcaggcacgccgccggctggccgaactggagcaacgcggcggcgacagccacgctgccgagatggcacccgccgcgctggatgcaccgcagcaattcggcctgttcaccgcgccgtcttcggccgcgcaggaagccttgcaggcgctggatccggacgaactgacgcccaagcaggcactggaagcgctgtaccggctcaaggcgctgctc

SEQ ID NO: 39652 - DNA, 2255 bp, Xanthomonas campestris
aatgccatgactaccgaagcaaagtgccccttcaaccacagcgtcgtcggcgccggcaccaccaatcgcgattggtggcccaagcaactgcgtgtggacctgctcaaccagcactcggcccgctccaatccgctggcggcgtcttttaactacgcggaagccttcaagcgcctggacctgcagacactcaagcaggagctgcgcgcattgatgaccgattcgcaggactggtggccggccgacttcgggcattacggcccgctgttcgtgcgtatggcctggcacagcgccggcacctaccgcaccggtgacggccgcgggggcggcggccgcgggcaacagcgcttcgcgccactcaacagctggccggacaacgtcagcctggacaaggcacgccgcctgctgtggccgatcaagcaaaagtacgggcaggcgatttcctgggccgacctgatgatcctcaccggcaacgtcgcgctcgaatccatgggcttcaagaccttcggctttgccggcggccgggaagacacctgggagccggaccaggacctgtactggggccgggaaaccaagtggctgggtggcgatgaccgctacgcgcacggctcgccgggcgtggaccaggcgcatggcgtgctggtcaaggacgacgacagcgaagtgcagcacacccgcgatctggaaaacccgttggccgccgtgcagatgggcctgatctacgtcaacccggaaggcccggacggcaatccggatccgctattggcggccaaggacatccgcgacaccttcggccgcatggccatgaacgacgaagagaccgtggcgctgatcgccggcggccacaccttcggcaagacccacggtgctgccgatgcggcgcacgtggcggccgagccggaagccagcgacctggaaagccagggcctgggctggcacaacagcttcggcagcggcaagggcggcgacaccatcaccagcggcctggaagtgacctggaccaccaccccggcgcagtggagcaacgactttttcgaccacctgttcggcttcgagtgggagctgagcaagagcccggccggtgcgcaccagtgggtggccaagaacgcccaggccatcattcccgatgcgcacgacgcctccaaaaagcgtttgccaacgatgctcaccaccgacctggcactgcgcatcgatccggcgtacgaggccatctcgcgccgcttccacgccaacccggaccagttcgccgatgcctttgcgcgcgcctggttcaagctcacccaccgcgacatgggcccgcgcgcgcgctatctcggcgcggatgtgccggccgaagaattgctgtggcaggacccgatcccggccttaaaccatgcgctgatcgatgcgcaggacgctgccgcgctcaagcagaccgtgctgagctccggcctgagcgttgcgcaactggttgccactgcctgggcctcggcgtccagcttccgtggctcggacaagcgcggcggtgccaatggtgcgcgcattcgtctggccccgcagaaggactgggcctccaacgagcctgcgcagctggcccaggtgctggccacgctggagcgtatccaggccgacttcaatgcacgccagtccggtggcaagcagatctcgctggccgacctgatcgtgctgggcggcaatgccgcagtcgaacaggccgcgcacgccgccggccacgcggtcaccgtgccgttcgcccccggccgcatggatgcctcgcaagcgcagaccgacgtggaatcgttcgcagtgctcgagccggtagccgatggcttccgcaactacgccaaggcccgctacgcggtgtctgccgaagcgctgctgatcgacaaggcccagttgctgaccctcaccgcaccggaaatgaccgtgctggtcggcggcctgcgcgtgctcggcgccaacaccgggcagtcgcacaatggcgtcttcaccacccgtccgggcgtgttgagcaacgacttcttcgccaacctgctcgacatgcgcaccgagtggaaagccacgtccgagaccaaggaaacctacgaaggccgcgaccgtgccaccggtgagcacaagtggaccggcacccgcgtggcatctggtgtttggttccaactcgatcctgcgcgcggtggccgaggtctatgccagcgccgcacgatcagcaaaagtttgtgcaggacttcgtgcccgcgtggaccaaggtgatgcagctggaccgtttcgacctggcctga

SEQ ID NO: 39653 - DNA, 1476 bp, Xanthomonas campestris
gatgtgcaggtgcgcggcacgctgcaggtagagaagccaggcgcgcaggtgtcgcggcatctgttcgggcagttcgccgagcacctgggcaccggcgtgtatggcggtctctgggttggaccggagtcttccattcccaacacgcgcggctatcgcaacgacgtgctggcggcactgaaggcgattgcggtgccgaatatccgctggcccggcggctgcttcgccgatgagtaccactggcgcgatggcatcggcgcgcccggcaaacgcccgatcagcgtcaacacgcactggggcggcgtggaagagtccaaccgcttcggcacgcacgaattcatggacttcaccgagctgctgggcaccgacgcgtacgtggcgggcaatgtcggtaatgccgcgccggacgaaattgcacagtgggtggaatacatgaccgccggcacgcgctccagcctggcggagcaacgtcgcgccaacggccgccaggcaccgtggaaggtgccgttcttcggcgtcggcaatgagttgtggggctgtggcggcaacatgcgggtggagtacgccgccgatgtgtatcggcgctaccagaccttcgtcaaggcgccgtccgaccagaaaatcctgaagattgcgcccggccccaacaacgacgattaccactggaccgaggtaatgatgcgcgaggcgggcacgctcatggatggcctgagcctgcattactacaccgtgcctggcggctggccgccgcgcgcctcctccaccgacttcgacgaagcagcctggatcgagacgctgtcgcgcacgctggtgatggacgagctgatcaccaagcacagcgcgatcatggaccgctacgacccggccaagaaagtggcgttggtggtggacgaatggggcacctggtacgccggcctgcctggcgccaacccgggctttttgcaccagcagaacagcctgcgcgatgcgctggtggcagcgttgaacatcgacatcttcagtgcgcatgccgatcgcgtgcgcatggccaatatcgcgcagatgatcaatgtgctgcaggcgatgatcctgaccgatggcgaccggatggtgctgaccccgacctatcacgtatttgcgatgtacaagccgttccaggatgccacccacctgccactgcaattgcagccccccgactatcggcatggcgacatccacgtgcccgccgtgcatggctcggcggtcaaggccaaggatgggcatgtgtatgtggcgctcaccaatctggatgccaacagcccggccacggtcagcgtggcggtggacggggtcagcgtgcgcggcgtggaggggcaactgctcaccgcaccgacgatcaccgcgcacaacaccttcgctgcgccccgcaccgtgcaaccaaccgccttcaccggcgcgcggatccagggcaacacgctgcaggtggcgctgccggcacgggcgatcgtgatgctcaagcta

SEQ ID NO: 39654 - DNA, 813 bp, Xanthomonas campestris
ttgcgtttcaccaagatgcatggcgccggcaacgatttcgtggtgctggatctgcgcaatggcacaccaccgcccgatgccagcctggccgcgcggttggcggatcgtcatttcggtgtgggctgcgaccagatcctgaccatcgaaacgccacgcagcgccgaggcggtggccgcctaccgcatctggaattccgacggatcacactcgcagcagtgcggcaatggcgcgcgctgtgtggccgcgtggctggtgcgcgagggcaccgcgcagggcgatgtcttcaccatcgacagccccttcaccgcgcaccgcgtcgagcgattggacgcgggcacatattcggtagcgatgggtgtaccgcagttcgagcccacgcagattccgctggccggctttgcccatgcgcgcgacgaatacgcgctgcccgtgcacggagaaaccgtgcgctttggcgcggtgtcgatgggcaacccgcacgcggttgtggaagttggccgggtcgatgcggcgccggtggagcgggtaggtgcgttgctgcaacagaatgcggcgtttcccgaatcagtcaatgtcgggtttgcacaggtggtggacccggcgcatgtgcggttgcgtgtgtacgaacgcggcgttggcgaaacgctcgcctgcggcagcggtgcgtgcgcggccgcggtggtgctgatgcatcggggccgggtcgagcgcgatgtacgggtgtccttgccgggtggcgaattgcggatccgctgggccggcgagcaggcgcaggtggtgatgtccgggccggccgtgttcgtcttcgatgga

SEQ ID NO: 39655 - DNA, 1764 bp, Xanthomonas campestris
gacgaaagctcctacgcccagccgcagctggtggtcatcaaggacctggcgctggatctgaagctggatttcgacgccaagcagatcggcggcaccgccacctacacgctggactggaaggacaaggccgccaagcagctggtgctggatacgcgcgagctcagcatcgcccaggtgcaggccgacgatggcaagggcacgctgtcgccactgcagttcgtgctggcgccggccgacaagaccttcggcagcatgctcaccatcgaaacccccgaccagccggccaaggtcgtcatcacctaccacactgcgcccaccgcatcgggcctgcagtggctggagccggcgatgaccgaaggcaagcaactgcctttcatgttcagccagtcgcaggcgatccacgcgcgcagctgggtgccgttgcaggacacccccagcgtgcgcttcacctatagcgcgcatgtgacctcgcgcccggacgtgatggtgctgatgagtgccgacaacgaccccaaggccgcgcgcgacggcgactacagcttcaagatgcccgagccgattccctcgtatctgctggcgatcgctgccggtgatgtggtgttcaagccgatctccgcgcgctcgggcgtgtgggccgagccgagcatggccgacaaggctgcgaaggaattcgaagacaccgagaagatgatcggtgccgccgagaaactctacggcccgtatcgctggggccgttacgacatgctggtgctgccgccgtcgttcccgttcggtggcatggagaacccgcgcctgaccttcgccacgccgacggtgatcgtgggcgacaagtcgctggtgtcgctggtggcgcacgagctggcgcatagctggtcgggcaacctggtgaccaatgcgagctggaaggacatctggctgaacgaagggttcaccacctacgtgcagggccgcatcaccgaagcgctgtacggcaacgagatggccgagatggagcgcgagatcgaccagggtgatttgctggccgaagtgaagggcatggcgccggccgaccaggccctggcgctgccgccgctggccgagcgcgacccggatgaagcgctgagccaggtggcctacgtcaagggcgcgtggttcctgcagttcctggaacagcgcttcgggcgcgaggtgttcgacccgttcctgcgtggctggttcgacgatcatgcgttccagagcgcgaccaccgaccagttcgtcgactatctcaacaagaacctgctggccaagcatcccaacacggtgagcgcggccgaagtggacgcctggttgaagcagccgggcatcccggccttcgccgccaaggcacgctcgcgcagcttctcgatcgtggacaccgcacgtatcgcctggagcggtagcggcacgctgcccaacaagcaggtcaccggcgaatggggcacgcaggagtgggtgcatttcctcagcggcatgggcgcgactttgaagcccgaacaactcaagcagctggacgatgcctaccacttcaccggcacgcccaacggcgagatcgcaatgcgctggtatccgttggcgatccgcagcggctacatcgatgcacgcccggccgcgggcgagttcatcgaacgcgtcggccgtcgcaagctggtgctgccgatctatgccgagctgctgaagaccccggacggcatcaccttcgccgagcaggccttcgaaaaggccaagccgagctaccacccgatcaccaccgcgtcggtggccgag

SEQ ID NO: 39656 - DNA, 1776 bp, Xanthomonas campestris
gcagtggtcgataccgatggcgaattcaccaccaacgccagcaacccggataactggggcggtgtcggtcgcgacttcgccttgacccgccacagcccgttggcggagatcaatcgcgacaacgtcaagaacctcaagatgtcgtgggaaatgaagaccgacgccacgcgcggccacgaaggccaaccgctggtgatcggcagcatcatgtacatggtcagcgcgtatcccaacaacgtgtacgcgatcgatctggcatcgcaggacgacggcggcaaggtgttgtggaaatacaccccgcagcaggacgaacgctcggtggcagtggcgtgctgcgacacggtcaaccgcggcgcatcgtatgccgatggcaagctggtgttcggcagcctgagtggcgatgtgatcgcgctcgatgccaagaccggcaaggaagtgtggaagcagaaacttggccaccccgacaagggcgaaaccatcaccatggcgccgatcattgccgacggcaaagtgatcgccggcatcagcggcaacgagttcggcgtgcttgggcgcgtggccgcctacaacctggccgatggtaagcaggcgtggtcctgcgatgcggccggcaccgacaaatccatctgcctgggcgccgatttcaacaaggccaacccgcaacatgggcagctcggcgacctgggcgtgaagacctttcccaacgacgaatggaagcgcggcggcggtgcggcctggggctggtacagctacgacccgaagctgaagttgctctactacggcaccggcaacccggggctgtggagcccgtcgtaccgctgcggcaaaacctcgcatgaggaatgcaacaacggcgagcatgacaacaagtggtcgatgaccttgttcgcccgcaagatcgacaccggcgaagcggtgtggggctaccagaaaaccccgttcgaccagtgggattacgacggtatcaacgagccgatcctggtcgacctgaccatcgacggcaaggaagttccctcggtggtgcagttcgatcgcaacggctttgcctacgtgctcgatcgccgcgatggcacgctgctgcgcgcgcacaagttcgtgccggccaactgggccgaacgcatcgacatgaagaccggccgcccggtgaaggtggctgcgcattcgccactggaacgcggcaagaaagtgcaggcgttcccgtcggcaatgggcggcaaggaccagcagccgtgctcggtggatccggccaattcggcggtgttcttctgcggcaccaacaactggcacatggagcttgagccgcaggaacgcggcaacaccatgatgggcctgccgtatgtgttcgccaacgtgatgatgaagcccaacgagcccggcgcactgggcattgtcaaggcgttcgacgtggtggaaggcaagtccaagtgggagatcaaggagaagttcccggtgtggagcggcaccctggtcaccgatggcgggctggtgttctacggcacgctggacggctggttccgcgcagtggacaaggacaccggcaagaagctgtgggagatgaagttgccctccggcatcatcggcaacccgatcgcctacaaggccaatggccaccagtacgtggcggtgttctccggcatcggcggctggattggtttgccggtggcggcaggtctggatccggctgatccgtacggcgcgctgggtgctgccgggctggcgtttggcgccggtttcgacaagatcccgctcggcggcatggtgcataccttccgcatc

SEQ ID NO: 39657 - DNA, 687 bp, Xanthomonas campestris
gcagatccgaaccaggaactggcccacgcgctggatgccggtgatgcgctgcgtgcagcgtggttgctacgccatggcgccgatgccaaccagcccaacctgctgggcgagccaccgttgcaccaggccatccgcaatcaggaaccggacctggttggcctgctgatcgacgccggcgcacgccttgacgcgcgtgatggcaacggctggacggccttgatgaaggccgcctggggcaacgatgcggacagcgtgcaacggctgctcgcccgccgcgcgccactggacaccgtgtccagcgatggctggaacgcgctggagctggcggtgtcgtacgccgacgtcggtgtcgttgaggcgttgctgaaagccggcgccaaggcacgtggcgccaaccgcaccgggtttacgccggtgatgtttgcagtaccgcgcgaggacccggccattctggatgcattgctgaagcacggcgccgatgtacgtggcgccaaccaggccggcgtcaccgccttgatgctggcggctgcctccggccgcgaagcgacggccaagcgcttgctggccgccggcgccgacccggctgcgcgcaatcgcgacggtaagaccgctgcgaccttggcgcaggagcgcggcgatgcggcactggccgcgctgctggcacctggcaagcgcaataccacgcaa

SEQ ID NO: 39658 - DNA, 942 bp, Xanthomonas campestris; identical to SEQ ID NO: 39281

SEQ ID NO: 39659 - DNA, 1215 bp, Xanthomonas campestris; identical to SEQ ID NO: 39282

SEQ ID NO: 39660 - DNA, 2415 bp, Xanthomonas campestris
ctgttggtggcctatgccgtggtgctcgccgtgcttggtgcggcgctcgcctatgaaggcgggcgcctggtggccgttggtggctcctggtactacgtgctggccggtatcgccgtgctggtggccggtgtgctgctggcactgggcaaacgcgctggcctgtggctgtttggcgctacgttggcggccaccatcgtgtgggcgctgtgggaagtgggcctggatggctggggcctgatcccacgtctggcctggatctcggtgctcggcctggtgctgttgccgttctggggcgtggcgcggcggcgcatgcagccgttgtccgggctcggctatgtcgtggtcaccggcgtgctgccggtgctgggtgcggcgctgatcctgtggccgctgctggtgccgcgcaatgtggaactggccgatgcatccaagcagccggccgatgcggcaacgccgttcagccgtggcagcgtgcccagcccggacgggaacgtggcggccaaccacgatgccagtaactggaccgcctacgccggttccaacctgtccaaccattacacccccggcgcgcagatcacgccggagaacgtcaagggcctcaaggtggcctgggaattccataccggcgatctcaagccgaaggattccaagctgggctatgcgttccagaacaccccgctcaaggtcggcgacctgctctacatctgcaccccgacccagaaggtgattgcggtggaggcggccaacggcaaggagcgctggcgcttcgacccgcagaccaatccgaaggcgatggccggcgtggccgccaccacatgccgcggcgtgtcgtactaccaggcgccggaaggcactgccgagtgcccgacgcggatcttctggccgatggtcgatggccgcctgggtgcgctggatgcgcagaccggcaagctctgcgccagcttcggtaacaacggctatgtggacctcaatgccggcaccggcaacaccaagccgggcttcgtcggcccgacctcgccgccggtggtcatgcgcggtgtggtgatccagcccaccgggcaggtgcgcgacggtcaggaacgcgatgcgccgtccggcgtggtgcgcggcttcgacgcgctcaccggccagctgcgctgggcctgggatctgggcaacccggccatcaccgccgaaccgccggccggccagacctatacccgctccaccccgaacgtgtggtcgctgatggccgccgatgacgagctggggctggtgtatctgcccaccggcaacgctgccggcgacttcttcggcaagggccgcaccccgcaggaagaggaatacaccgcctcgctggtggccgtggatgcggcaaccggcaaggagcgctggcacttccgtaccgtcaatcacgatctgtgggactacgacatcggcccgcagccgaacctggttgattggccggttgccggcggtggcacccgccccgccgtgatccaggccaccaagtccggccaggtgttcgtgctcgaccgcgccaccggccagccgatcatgcctgtcaagcagatcgccgtgccgcagggcaccgaccatggcgactggaccgcatccacccagccggtgtcgccgggcatgcccaacaccgtgggtgcgcccagccgtgactacgagaccatcgttgaatctgacgcgtggggcatgaccccgttcgaccagctcgcttgccgcatcgagttcaagaagctgcggtacgaaggcatgttcaccccgccaagcctgcagggctcgctgtcgttcaccggcaaccatggcggcatcaactggggcggcgtgtcggtcgatctgcagcgcggcatcatggtgatgaacagcaatcgcctgccctataccgagcacgtctacccgcgcacggtgatgaacgagctgggcgtggtgtcggtgttcaacggcagcagcaagaccaagggctacatggcgcaggaaggcctggcctatggcgcgcgcaaggagccgtggatgtcgccgctcaacacgccgtgcgtggcaccgccgtggggctatatctccggcgtggatctgcgcacgcagcaggtgatctggcgccgtccgctgggcaccggttacgaccagggcccaatgggcatcccgtccaagaccaagttcgagatcggcaccccgaacaacagcggctcgctggccactgccggcggcgtcaccttcatcggtgccagcctggacaacttcatccgcggctttgacacccgcaccggcaagcaggtctgggagacccgcgtgcctgcgggcccgcaggccgcgccgctgagctacaccatcgatggcaagcagtacatcgttgccgcggtgggtggccatgtccgcatggaaaccaagtcaaaaaacagcgtctttgcctgggcactgcccgacgac

SEQ ID NO: 39661 - DNA, 1356 bp, Xanthomonas campestris; identical to SEQ ID NO: 39284

SEQ ID NO: 39662 - DNA, 720 bp, Xanthomonas campestris; identical to SEQ ID NO: 39285

SEQ ID NO: 39663 - DNA, 2547 bp, Xanthomonas campestris
atgcggatggacaagctcacctcgcggttccagcaggcgctggccgacgcgcaatcgctggccgtgggccgcgaccacaacatcatcgaacccgtgcacgtgctggccgccttgctcgaccagagcggcggcagcacgcgcccgctgctgtcgcagtccggcgtcaacgtgccggcactgcgcgagcgcctgggcgaagcgctggacaccctgcccaaggtgtccgggcaggaaggcaacctgtcgatcggcaacgatctcaatcgcctgctcaaccagaccgacaagctcgcccagcaacatggcgatgccttcatcgccagcgagtggttcgtgctggccgctgccgacgatgccagcccgctgggcgtggccttgcgcgcggccggtggcgacaagaagaagatcgaagcggccatcgataaattgcgcggtggcgaaacggtgcaatcggaaaatgccgaggagcagcgccaggcgctggagaagtacaccatcgacctgaccgcgcgcgcggagagcggcaagctcgatccggtgatcggccgcgacgaagaaatccgccgcaccatccaggtgttgcagcgacgcaccaaaaacaacccggtgctgatcggcgaaccgggcgtgggcaagaccgccattgtcgaaggcctggcgcaacgcatcatcaacggcgaggtgcccgaaggcctgcgcggcaagcgcgtgctgtcgctggacatgggcgcgctgattgccggtgccaaattccgcggcgaattcgaagaacgcctgaaggcggtgctcagcgacctgtccaagaacgaaggccagatcatcctgttcatcgatgagctgcacaccatggtcggcgccggcaaggccgatggcgcgatggatgccggcaacatgctcaagccggcgctggcgcgcggcgagctgcattgcatcggcgccaccacgctggacgaataccgcaagtacatcgaaaaagacgctgcgctggagcgccgtttccagaaagttttcgtgggcgagccgacggtggaagacaccatcgccatcctgcgcggcttgaaggagcgctacgcggtgcatcacggcgtggagatcaccgacccggcgatcgtggccgcggccaccttgtccaaccgctacatcaccgaccgtcagttgccggacaaggccatcgacctgatggacgaagccgcatcgcgcatccgcatggagatcgattccaagcctgaagagctcgaccgcctggagcgccgcctgatccagctcaagatccagcgcgagatgctcaagaaggaaaaggacgaggcctcgcggcaacgtctggccgatctggaaagcgacatcgacaagctcgagcgcgaattctccgacctcaacgaagtgtggaagtcggagaaggccgcgctgcagggcaccaccaagatcaaggagcagatcgagcacgccaagctggagctggaagcggcgcagcggcgccaggactacgccaagatgagcgagatccagtacggcgtattgccgcagctggaaaagcagatgctgctggccaacgaagtggagcatcacgacttcaagctggtgcaggaccgcgtgaccgccgaagaaatcgccgaggtggtgtcgcgttggaccggtatcccggtcaacaagatgctcgaaggcgagcgcgacaaactgctgcgcatggaagacgaactgcaccgccgcgtggtggggcaggaagaggcgatcaaggtggtgtccgatgcggtgcgccgctcgcgtgccggcctgtccgatcccaatcgtccgagcggttcgttcctgttcctgggcccgaccggcgtgggcaagaccgagctgtgcaaggcgttggcggatttcctgttcgacagcaccgaggcgatgatccgcatcgacatgagcgagttcatggagaagcattcggtctcgcgcctgatcggtgcgcctccgggctatgtgggctacgaggagggcggttacctcaccgaggcggtgcggcggcgcccgtattcgctgatcctgctcgacgaagtggagaaggcgcacgccgatgtcttcaacatcctgttgcaggtgctcgacgatggccgcctcaccgacggccagggacgtaccgtggacttccgcaataccgtcatcgtgatgacctccaacctgggctcgcaccagatccaggagttgtccggcgacggcagcgccgaggcctacacgcagatgaaggcggcggtgatgggcgtggtgcaggcgcacttccgcccagaattcatcaaccggctcgacgacatcgtggtgttccatccgctggacaaggcgcagatcaagtcgatcgcgcgcatccagttgcagggcctggaaaagcgcctggccgaacgcggccttaagctggacctggacgacccggcgctggaattgctgggcaatgtcggcttcgacccggtgtatggcgcgcgcccgctgaagcgtgcgatccagtcgcaggtggaaaacccgctggcccagcagattctctccggccagtacaccagcggcgacaccgtgcgtgta

SEQ ID NO: 39664 - DNA, 1260 bp, Xanthomonas campestris
gaaaccatcgccgtgcacggtggctaccgtcctgatcccaccacccgcgcggtggcggtgccgatctatcagaccgtggcgtatgccttcgacgacacccagcatggcgcggatctgttcgacctgaaagtgcagggcaacatctacagccgcatcatgaatcccaccaacgacgtgctggaacagcgcgtggctgcgctggaaggcggcatcggtgcgctggcactggcgtcggggcaggcggcggtgacctatgcgatccagaccattgccgaggctggcgacaacatcgtctcctccagcgcgttgtatggcggcacctacaatctgttcgcgcacacgctgccgcagttcggtatcaccacgcgctttgccgattaccgcgatccgcaggcgtttgccggcttgatcgacgagcgcaccaaggcggtgttcgtcgagtcgatcggcaacccgcgcggcaacatcaccgacatcgaagcggtggcggcagtggcgcatgcgcacggtgtgccgctgatcgtggacaacaccgtcgccacgccgtcgctgctgcgcccgatcgacttcggcgcggatatcgtggtgcattcgctgaccaaatacctgggcgggcacggcaacagcatcggcggtgcgatcgtggacagcgggcgcttcccgtgggcggcgcacaaggcgcgctttgcgtgtctcaacgagccggacgtgagttaccacggcgtggtctataccgaagccctgggcgaggccgcctatatcggtcgtgcgcgcgtggtgccgctgcgcaataccggtgcggcgttgtcgccgttcaatgcattcctcattttgcaaggcatcgagaccctgccgctgcgcatggagcgcatcaatgccaacacgttggcgattgcccggtatctgcaggaacacgcgcgcgtggcctgggtcaattacgccgcattgccggatcaccccgagcatgcgttggcgcagaagtatctgggcgggcatggctcgggcgtgttgaccttcggactgccgggtggacgcgcggcgggtgcgcggtttctggatgcactgcagctgttcacacggttggtcaacattggcgacgccaaatcgctggccacgcatccggcctccaccacgcaccgtcagctcggcccggccgaactggagcatgccggcgtcagcgaggacaccgtgcggttgtcgattgggatcgagcacatcgatgatctgctggcggatctggagcaggcgctgcagggcgcg

SEQ ID NO: 39665 - DNA, 2094 bp, Xanthomonas campestris; identical to SEQ ID NO: 39290

SEQ ID NO: 39666 - DNA, 1446 bp, Xanthomonas campestris; identical to SEQ ID NO: 39291

SEQ ID NO: 39667 - DNA, 2025 bp, Xanthomonas campestris
aacccgctgctgaccgccagcacgctgccgttccaggcgccgccgttcgacaagatccaggacagcgattacctgcctgcgttcgaggaaggcatgcgccagcacctggcggacgtgcgcaagattgccgacaaccccgagccggccaacttcgacaacaccatcgaggcgatggagcgcagcggcgaaacgctcacccgcgtctcgcgcattttctttggcctggtgcaggccgataccagcgacgcccgccagaaaatccaggaagaggtggcgcccaagttggccgcgcaccaggacgagatcaatctggatcccaagctgttcgcacgcgtcaaggcgatctacgatcaacgcgatacgctgagcctggagccggagcaaaagcgcctggtcgaacgccattacgaaaaactggtgcgcgccggcgcgcagctgtccgacgccgacaagaccacgttgcgcaagctcaacgtggaggagaccacgctctccacgcagttccataccaagctggtggccgcctcggctgccgccgccgtggtggtggacgacaaggccaagctcgatggcttgagcgagggcgacatcgccgccgccgccgatgccgccaaggcgcgcaagctcgatggcaagtatctgctgaccctgcagaacaccacccagcagccggtgctggcgtcgctgaaggatcacgacctgcgcgcgcgggtgatgaaggcctcgcaaacccgtgccgaacagggcgacgccaacgacacccgccagaccatccagcggctggcgcagctgcgcgcgcaaaaagccaagctgctcggcttcgacagctacgccgcctacagcctgggcgaccagatggccaagacgcccgacgccgcgctcaagctgttgaccgacaccgtgccggcggcgaccgccaaggcgcgccgcgaagtgggcgagatgcagaaggtcatcgatgcgcagcagggcggcttcaagctcgctgcggcggattgggacttctacgccgagcaggtgcgcaaggccaagtacgacctggacgaatcgcagatcaagccctatttcgaactggacaacgtgctgcagaacggcgttttctacgcagccacgcagctgtatggcatcaccttcaagcagcgcaccgacatcccgacctatcacgcggatatgaaggtgtacgaagtgttcgatgcggacggcacctcgatggcgctgttctacaccgactacttcaagcgcgacagcaagtccggtggcgcttggatggacgtgttcgtggagcaggacgggctgaccggcaccaagccggtggtctacaacgtgtgcaacttcaccaagcccgccgcgggccagccggcgttgctgagctttgatgacgtcaccaccttgttccatgagttcggtcacgcactgcatggcatgttctccaaggtgaagtacccctcgatcgccggcaccagcacctcgcgtgactttgtcgagttcccctcgcagttcaacgagcactgggcgtccgacccgaaggtcttcgccaactacgccaagcactaccagaccggtgcagcgatgcccgatgccctggtggagaagatcaagaaggccaagaccttcaacagcggctacgccaccaccgagtacttgtcggcggcattgctcgacctggcctggcacacccagccggccgatgcaccgctgcaggacgtgagcaagttcgaggccgatgcgttgaagcgcttcaaggtcgatctggccgaagtcccgccgcgctaccgcagcacctatttcgaccacatctggggcggcggttattcggccggctactacgcctatttctggtcggaagtgctcgatgacgacgcgttcgagtggttcaaggaaaatggcggcctgacccgcaagaacggcgacaccttccgcgccaagatcctttcgcgcggcaataccgtggatctggcgacgctgtaccgcgatttccgtggcaaggatcccagcgtcaaggcgctgttggaaaaccgtggtttg

SEQ ID NO: 39668 - DNA, 978 bp, Xanthomonas campestris
aagattctggtaacgggtggtggcggctttctcgggcaggcgctgtgccgtggattggtggcgcgtggacacgaggtggtgagctttcagcgcggtgactatccggtgctgcacaccttgggtgtgggccagatccgtggcgatctggctgacccgcaggcggtgcggcacgcacttgccggcatcgatgcggtgttccacaacgcggccaaggccggggcatggggcagctacgacagctatcaccaggccaacgtggtgggcacgcagaacgtgctcgatgcgtgccgtgccaatggcgtgccgcgcttgatctacacctccacgcccagcgtgacccatcgcgccaccaatccggtggaaggcttgggcgcggacgaagtgccgtacggcgaagacctgcgtgcgccgtatgcggcgaccaaggcaattgccgaacgcgcggtgctggcggccaacgatgcgcagctggccaccgttgcgttgcgcccgcgcttgatctgggggccgggcgacaaccacctgctgccgcgtctggcggcacgtgcgcgcgccgggcggctgcggatggtgggcgatggcagcaacctggtggacagcacctacatcgacaatgcggcgcaggcgcacttcgatgcgttcgcgcatctggcgccgggcgctgcgtgcgcaggcaaggcgtacttcatctccaacggcgaaccgttgccgatgcgcgagctactcaaccgtttgctggcggcggtggatgcaccggcggtgacgcgctcgctatcgttcaagacggcgtaccgcatcggtgcggtgtgcgaaacattgtggccactgttgcgtctgccaggcgaagtgccgctgacgcggtttctggtcgagcagctgtgcacgccgcattggtacagcatggaaccggcgcgacgtgacttcggctatgtgccgcagatcagcatcgaagagggtctgcaacggctgcgatcctca

SEQ ID NO: 39669 - DNA, 879 bp, Xanthomonas campestris
ggtatccatgcacggcgcttgtgggaccaggatgtccaggcatcggacgccgccacccaggctgcccgcaaggccctgatcgatgccaacatcggcatcgagaagatcggcttgctgatcaatacctcggtgagccgtgattacctggagccgtccacggcctccatcgtgtccggcaacctgggtgtcagcgaccactgcatgaccttcgacgtggccaacgcctgtcttgccttcatcaatggcatggacatcgctgcgcgcatgctcgaacgcggcgagatcgactacgccctggtcgtggatggcgaaaccgctaaccttgtttacgaaaaaaccctcgagcgcatgacctcgccggacgttaccgaagaagagttccgcaacgaactcgctgcgttgacgctgggctgcggtgcggccgccatggtgatggcacgttcggaactggttcccgacgcgccgcgctacaagggcggcgtgacgcgctcggccaccgagtggaacaagctgtgccggggcaacctggaccgcatgttcaccgacacccgcctgctgctgatcgaaggcatcaagctggcgcagaaaaccttcgtggccgccaagcaggtgctgggctgggctgtggaggagctggaccagttcgtcatccaccaggtcagccgcccgcacacggcagcgttcgtgaagtccttcggcatcgacccggccaaggtcatgaccatcttcggtgagcacggcaacatcggcccggcctcggtgccgatcgtgttgagcaagctcaaggagctgggccggttgaagaagggcgatcgcatcgcgctgctcggcatcggttcgggcctgaactgctcgatggccgaagtggtttggtgaagg

SEQ ID NO: 39670 - DNA, 1710 bp, Xanthomonas campestris; identical to SEQ ID NO: 39295

SEQ ID NO: 39671 - DNA, 1002 bp, Xanthomonas campestris
atgagcgatccgacacagaaaatcgccgttctcggcgccggttcctggggcacggccctggcggcgctggttgcccggcacggtcacccgaccgtgctctggggccgcgatgcggcgatggtggatgccatcgaccgcacccacgagaaccctcgctatctgccaggcattgccctgccggacagcctgcgcgcgaccaccgatcttcagcagaccatcgccggcgccagctggatcctggtggtggtgccgtcgcacgcgtttaccgaaacaatcaagctgctcgcgccgctgcgcccagctggcgcgggcatcgcctgggccaccaagggcttcgagccgggatccgggcgcttcctgcatgaagtggcgcgcgacatccttggccccagcgtgccgctggccgtggtgaccgggccctcgttcgccaaggaagtcaccctgggcctgccgaccgcgatcaccgtgcacggcgatgacgccgcgtttgcgcaggtggtggccgatgccatgcacgggcccaccttccgcgcctacaccggcgatgacatggtgggcgccgaactgggcggcgccatgaagaatgtgctggcggttgccaccggcgtggccgatggcatgcagctgggcctcaacgcccgtgcgggcctgatcacgcgcggcttgaacgaaatgctgcgcctggccgcggtcatcggcgcacggccggaaacattgatgggcctggccggcctgggcgatctggtgctgacctgcaccggtgatctgtcacgcaatcggcggctgggtctggcgctgggacgcgggcagagcttgagcgatgccatccgtgagatcggccaggtggttgaatcagtgcagaccgccgacgaggtcatgcgtcaggcagagcagcatggcatcgagctgccgatctccaacgcagtgcgtgcagtcctgcatggcgagatcaccccggaagcgggattgaaggaattgctggcacgcgagcgcaagcccgag

SEQ ID NO: 39672 - DNA, 1296 bp, Xanthomonas campestris; identical to SEQ ID NO: 39298

SEQ ID NO: 39673 - DNA, 777 bp, Xanthomonas campestris
atgacccacacgcgcacaaatggcacttcctggaccctgctgtcgctgcgccccagcggcgagcacgcgccgctgcggcgtgcggtggcccggcatggcggccagttgctggcggtgtcgccctggcgcctgcagatcaacgatacgctgcaggcacgcgatgcgctgcggcacgcactgggagcgccgattgtcgtgttcaccagcccggccgccgtgcacgcggcgcaccggctgctgcccctgcagcggcctggaccggcccagtgggcaagcgtgggcgaaggcacggcgcgggcgctgcaggcctgcgggatcgacgcggtggtgcgcccggcgcgcatggacagcgaaggcctgctggcactgccggcgttcaatcccccgctgcacgccgtgggcctggtcaccgcgcccggcggccgcggcatgctggcaccggcgctggagcagcgcggtgcgcggatcctgcgcgcagatgtgtatcagcgtgttgcgctacggctgcgtgcgtcgacagtgcatgtgttggagaccgcgctgccacgcagcgtgatggccctgagcagcagtgaagcactgatgttgatcgtgcagcagctgccgccgtcattggccactgcattgaagacccgcccggtggtcgcctccagcgaccgcatgctggaagccgcccgcgctgccggcttcatgcaggtccatcgcgcggagggcccactgcctgcgcaattggcagccgccgccgctgcgatcatgacgccgccgccaccttgctga

SEQ ID NO: 39674 - DNA, 963 bp, Xanthomonas campestris; identical to SEQ ID NO: 39299

SEQ ID NO: 39675 - DNA, 921 bp, Xanthomonas campestris
tctacgctcgctttcgtgtttcccggccagggctcgcagtccctgggcatgctggctgaacttgccgaactgcatccgcagatccgcgagaccttcgtcgaggcctccgatggcgccggcgtcgatctgtgggccctgtcgcagggcggcccggaagagatgctcaaccgcaccgaatacacccagccggcgttgctggccgccggtgtggcggtgtggcgcctgtggaacgcgcagcgcggcgaacgaccggcggtgctggccggccatagccttggcgagtacaccgcactggtcgctgccggcgccttgtcgctgcacgatggtgcccatctggtgcggctgcgcgggcagttcatgcaggcagcggcgcccgccggtgtcggcgcgatggccgcggtgctgggcgccgaggatgcgctggtgcgcgaggtctgtgtcgaggcctcgggcagccaggtggtggtgccggccaacttcaattcgcccggtcagattgtgatcggtggcgatgcggcggcggtggatcgcgcgctggcgttgctggccgagcgtggcgtgcgcaaggcggtcaagctggcggtgagcgtgccgtcgcacactccgctgatgcgcgaggcggccaaccagttgggtgaggcgatggccgggttgacctggcacacgccgcagattccggtggtgcagaatgtcgacgcgcaggtgcacgccggccacgaggcgatccgccaggccctggtcgagcagctgtatctgccggtgcagtggaccggctgcgtgcaggcgctggccgcgcagggcatcagccggatcgccgaatgcggcccgggcaaggtgctgagcgggctgatcaaacgtatcgacaaaagcctggatgcccgttcgctcgcgaccccggccgattacgccggcgcgctggat

SEQ ID NO: 39676 - DNA, 726 bp, Xanthomonas campestris
ttgcagggcgagatcgctctggtcaccggcgccagccgcggcatcggcgcggccatcgccgatacgctggccgcccagggtgccacggtcatcggcacggccacctccgcctccggggccgctgccatcggcgagcgcctggctgccaacggcggccacggccgggagctcaatgtcaccgatgcggccgcggtcgatgccttgatcgatgcgatcggcaaggagttcggtgcggtctcgatcctggtcaacaacgccggcatcacccgcgacaacctgctgatgcggatgaaggacgacgattggcaggcgatcatcgacaccaacctgaccagtgtcttccggacctccaaggcggtgatgcgcggcatgatgaaagcgcgcaagggtcgcatcatcaacatcgcctcggtggtgggtgtgaccggtaatccgggccagaccaactacgcggcggccaaggccggcatcattgcgttttccaagtcgctggccaaggaaatcggctcgcgcgggatcactgtcaatgtggtcgcgcccggcttcatcgataccgatatgaccaaggcgctgccggaagatgccaagacagcgttgctgcagcagatcgcgctgggccatctggggcagccggacgacatcgccaatgcggtggcattcctggctggcccgaccgcccgttacatcactggtgagaccctgcacgtcaacggcggcatgtacatg

SEQ ID NO: 39677 - DNA, 225 bp, Xanthomonas campestris
atgagcaccatcgaagaacgcgtcaagaaaatcgtcgtcgaacaactcggcgtcaaggaagaggaagtcaccaccagcgcatcgttcgtcgatgacctgggtgccgactcgctggacaccgtcgagctggtgatggcgctggaagaagagttcgagtgcgaaatcccggacgaagaagctgagaagatcacgtcggtccagcaggcgatcgactacgtcaaggct

SEQ ID NO: 39678 - DNA, 1227 bp, Xanthomonas campestris; identical to SEQ ID NO: 39303

SEQ ID NO: 39679 - DNA, 612 bp, Xanthomonas campestris; identical to SEQ ID NO: 39304

SEQ ID NO: 39680 - DNA, 642 bp, Xanthomonas campestris
tcatggaaggcgcgggtgggggagtggttgttgcagccgcagatgcaggagctgtccgcgttcctgcgccagcgcaaggccgccaatgcgcgggtgttcccgcccggcccgcagatctttgccgccttcgatgccaccccgttcgagcaggtcaaggtggtggtgcttggccaggacccgtaccacggcgaaggccaggcgcatgggctgtgcttttcggtactgcccggggtgccggtgccgccgtcgctgctgaacatctacaaggaaatccaggacgacctgggcattccgcgccccgaccatggctacctgatgccatgggcgcgccagggcgtgctgctgctcaatgcggtgctgacggtggagcagggccgcgccggcgcgcaccagaacaagggctgggaaggcttcaccgaccatgtggtggaaaccctcaacagcgagcgcgagggcctggtgttcctgctctggggcagctacgcgcagtccaagggcaaagtgatcgaccaggcgcgccaccgggtgttcaaggccccgcatccgtcgccgttgtcggcgcaccgcggcttcctggggtgcaaacatttctccaagaccaacgaccatttgcagcggcgcgggctgagcccgatcgactgg

SEQ ID NO: 39681 - DNA, 1467 bp, Xanthomonas campestris
gacggaataatgagcgacaaaccgctgaccgatttgactttttcctcgttcgacctgcatccggcgctggtcgccgggctggagagcgccgggtttacgcgctgcacgccgatccaggcgctgaccctgccggtcgccctgccgggcggcgacgtcgccggccaggcccagaccggcaccggcaaaacgctggcgttcctggtcgcggtgatgaaccgcctgctgatccgcccggcgctggccgaccgcaagccggaagatccgcgcgccctgatcctggcgcccacccgcgagctggccatccagatccacaaggacgcggtcaagttcggcgccgacctgggcctgcgctttgcgctggtctacggtggcgtggactacgacaagcagcgcgagctgctgcagcagggcgtggacgtgatcatcgcgaccccgggccggctgatcgactacgtcaaacagcacaaggtggtctcgctgcacgcctgcgaaatctgcgtactggacgaagccgaccgcatgttcgacctgggcttcatcaaggacatccgcttcctgctgcggcgcatgcccgagcgcggcacccgccagacgctgctgttctcggccacgctcagccaccgcgtgctggagctggcctacgagcacatgaacgagccggaaaagctcgtcgtggaaaccgagaccatcaccgccgcgcgggtgcgtcagcgcatctatttcccctccgacgaagagaagcagacgctgctgctgggcctgctgtcgcgcagcgaaggcgcgcgcaccatggtgttcgtcaacaccaaggcgttcgtggagcgggtggcgcgcaccctggagcggcacggctaccgcgtgggcgtgttgtccggcgacgtgccgcagaagaagcgcgagtcgttgctgaaccgcttccagaagggccagctggaaatcctggtggccaccgacgtggccgcgcgcggcctgcacatcgatggcgtcaagtacgtctacaactacgacctgccgttcgacgccgaagactacgtgcatcgcatcgggcgcaccgcgcgcctgggcgaggagggcgatgcgatcagcttcgcctgcgagcgttatgcgatgagcctgccggacatcgaggcctacatcgagcagaagatcccgggtcgagccggtgactaccgagctgctgaccccgttgccgcgcacaccgcgcgcaacagtgtaaggtgaagaggtcagcgacgacgctggcgacagcgtgggcacgatcttccccaaagcacgcgagcagcgtgcggccgacgaagcgcgtcgtggcggtggccgtagcggtcccggtggcgcatcgcgtagcggcagtggcggcggtcgtcgcgacggcgccggtgccgatggcaagccgcgcccgccgcgtcgcaagccgcgcgtggaaggcgaggccgatccggccgcagcgcccagcgagacgccggtggt

SEQ ID NO: 39682 - DNA, 3139 bp, Xanthomonas campestris
ttgcgtgccgccatcaccgctgcctggctcaaggacgaaaccgagcacgtccgtgaattgctggagcaggcgcgcctgccggccgcagagcaggccaaggtgcaggcgctggccgccgacctggtcacccgggtgcgcgcacgtgcccaggatcagggcgcgatcgaagcctttatgcgccaatacgatctgggcagcgaagaaggcgtgctgctgatgtgcgtggccgaagccttgctgcgcattcccgaccaggacaccgccgacaagctgatccgcgacaagctgggcgaggcggactggaaaaagcacgtgggtggcagtgattcggtgctggtcaacgcatccacctggggcttgatgctcaccggcaagctggtgcagctcaacgaccttacccgcgccgatgtgccgggcgccttcaaacggctgatcggccgcgtcggcgagccggtgatccgtttggccgtgcgccaggcgatgaagatcatgggccaccagttcgtcatgggccgcaccatcggcgaggcgctggcgcgttcgcgcaagggtgacaacgccaattaccgctattcgttcgacatgctcggcgaaggcgcgctgaccatgaaggatgcgcagcgctatctgcaggcgtatcgcgatgccatccacgccatcggccgcagtggcagcttcgtcggtaccgacgtgtttgccgcgcccagcatttcgatcaaattgtccgcgctgtatccgcgctacgaacacgccaagcgcgcacgcgtgatggccgagctggttcccggcgtgctggagctggcacaactggccaagtcctacggcatcggctacaccgtcgatgccgaagaggccgaccgcctggagctctcgctggacatcatcgaagccacgttttccgatccatcgctggatggctgggagggctacgggctcgcagtgcaggcgtatcagaagcgcacgccctacacgatcgatttcctcgccgatctggcgcgtcgcgttggccgccgcattccggtgcgtctggtcaagggcgcgtattgggacgcagagatcaagcgtgcgcagatcgacggccaccccgggtatccggtatttacccgcaagcagaacaccgacgtgtcctatctggcctgcgcacgccgcatgttcgcgcacagcgacgcgctgtacccgatgttcgccacccacaacgcacagaccatcgctgcggtgcgcgcgatctcggcagggaaaacctacgagcaccagaaactgcacggcatgggcgatgacctgtatgccgaggtgattccggccgatcggctgggattgccgtgccgggtgtatgcaccggtcggctcgcacgaagacctgttgccgtacctggtccgtcgtctgctggaaaacggcgccaactccagcttcgtcaatcgcatcaccgatgaagacgtcgccatcgaagacctgatccgcgatccggtcgaggcggtgtcctcgtttgcgtccatcccgcaccccaagatcccgctgccggccgacctgctgcgcagccagaaccagaacaggaagaactccatgggcgccaacctcgccaacgacaacgatctgcggcagctggccgaccaactcactgccgcgatcaagccgtggaacgccgcgccgctggtgccgggtgccgtgatcaccacgccaagcgaggccgtgctcaacccggccgaccgccgcgagacagtcggccactggcagcctgcggacccggccaccgtgcagaaggcattggcgtctgccgcagccgcccagccagcgtggaatcgcacgcctgccgccagccgcgccaccattctcgaacacgccgcagacctgctcgaggcccgcatgccggagttcatggcgatctgcgtcaaggaagcagccaagaccctgccggacgccgttgccgaggtacgcgaagccttggacttcttgcgctattacgctgcccaggcgcgtgcgcagtttggtgcgcctgagcgcctgccgggccccaccggcgaatccaatgagctgcagctgcatggtcgcggcgtgttcgtctgcatcagcccctggaacttcccgctggcgatcttccttggccaggtcgccgcagcgctggcggcaggcaacgccgtcatcgccaagccggccgagcagaccaatctggtgggctttgcggcggtcaaactgttgcatgaagccggcgtgccggaagccgctgtgcagttcctgcccggcgatggcgccacggtcggcgccgcgttgaccaacgatccccgcgttgccggcgtcgctttcacagggtccaccgacaccgcccgcatcatcaatcgcaccctcgccgcgcgtgacgccgcgattggcgtactgatcgccgagaccggcggccagaatgccttcatcgccgattcgtcctcgctcccggaagccgtagtcaaggacgccatctccagcgccttcatctctgctggtcagcgctgctccgcagcccgcgtgctgttcgtgcaggaggacatcgccgacaaggtcatgaccatgctcgccggcgcgatgggcgagctgaaaatcggcgacccggccctgctctccaccgacgttggtcccgtaatcgacgccgatgccctgaagatcctggaagaacacgcgagccgcatggacagcgaagcacgcctgatcggcacgaccacgctggacagcgccacggcatatggcagcttctttgctccacgtgcctacgaactgaagtccctggcgcagctgcagcgtgagattttcggccccgtgctgcacatcattcgctggaaagccgaccagctggattcggtcatcgatcagatcaacgccaccggctatggcctcaccctgggcgtgcattcgcggatcgatgagaccatcgatcgcatcacctcgcgcgtggccgtaggcaatgtctacgtcaatcgcaaccagatcggcgctgtggtcggcgtgcagccgttcggtggccagggattgtcaggcaccggcccgaaggccggcggtcctcactacctgctgcgctttgccaccgaaaaggtcgtcaccgtgaacaccaccgcagccggcggcaatgcttcgctgctgaccttgggtgactgaggccggtagtgccgcatcttgg

SEQ ID NO: 39683 - DNA, 1386 bp, Xanthomonas campestris
aagaatttccacctgcccgacctgggcgaaggcctgcccgacgccaccatcgtcgaatggttcgtcaaggagggcgaccccgtgcgcctggacgacccgctagtatcgatggagaccgccaaggcggtggtcgaagtgccctcgccgttctccggcaccgtggtcaagctcgccggcgcggccggcgatgtgatcaccaccggtgcggtgctggcgcagttcgcgctggatgcctcgcagccgcagcgtgcggacggccaggacaccggccacgggcatggccatggcgcgcctgccgcagcgccgaccccgagcactggcgaaagcgcggccggccccaccacccgcgtggtggcctccgatgagggtggcgagattgccgatgccgacagcgacggtggccgcgacgatgccggcaccgtggtcggcgcgatgcagagctccaacgccgtgcagagcgagcaggccatcgccgtgggcggcgtgcgcgccatgccggtggtgcgcgcgctcgcacgcaagttgcgcgtggacctgacccaggtgcgcgccaccggcccggatggcacggtgacgctggcggacgtgaagcaggcggctgcggcaggcacggcgcaggccgtgcgcggcgcagtgatcgcaccaatcggcggcgcagcggcggcaagccttggcggcgatcatgggcagcgcccggccgcagccggcacgacgtcgccgcaggccagcaacaccacacgtactgccgaccaggcgcgctccacgctgtcggccagcggcaagccgatgcgcacgcaatcgccgggcaccctggtcaagggccagcccgaacagctcaagggcgtgcgccgcaacatggcgcgcgtgatggccgatgcgcacaccaaggtggtgcccaccacgctcaacgacgacgccgacctgcacgcctggcaacccggcaacgacgtcaccgtgcgcctggtgcgcggcatcgtgcgcgcctgccaggccgtgcccgcgctcaacgcctggttcgacggcgaggcgctgagccgcacgctgcacccgcaggtggacatcggcattgcggtggacaccgaagaaggcctgttcgtgccggcactgcgcaacgccgacatgctggacgcgcacggcatccgcgaaagcatcaaccgcctgcgccagcaggtggaaaaccgcagcatcgccgcgtccgagctgagcggctacaccatctcgctgtccaacttcggcatgtttgccggccgctacgccacaccggtggtggtgccgccgtgcgtggcgatcgtcgccgccggccgtgcgcgctaccagctcaccccggtgatgggcggggtggaaacgcacaaggtgatgccgttgtcgctgaccttcgaccaccgc

SEQ ID NO: 39684 - DNA, 969 bp, Xanthomonas campestris
agttcgcccatcaccctgatcgaagccatcacccaggcgctggcctgggagctggaacacgaccccgcggtgctggtgctgggcgaggacgtaggggtcaacggcggcgtgttccgcgccaccgccggcctgcagcaacgcttcggcagcgcgcgcgtgctcgacaccccgctggatgaaaccaccatcgccgggctgagcgtcggcctggccgcgcaaggcatgaagccggtggccgaagcgcagttcgacggcttcgtgtatcccatggtcgatcacctgatctgccacgccgcacgcctgcgcaaccgcacccgtggccgcctgcattgcccgatggtgctgcgcgtgccgtggggcggcggcatccgcgcaccggaacatcacagcgaggccaacgaagccatcttcaccaacgtgcccggtttgcgtgtggtgctgccgtcctcgccgcagcgtgcgtatggcttgttgctggccgcaatccgcgacccggatccggtgatctacatggagcccaagcgcatctaccgccagtacaaggaagtggtggccaatgacggcgaagcgctgccgctggatgtctgcttcgtgctgcgcgacggcaccgatgtgaccctggtgacctggggcgcgcaggtgaaggaagcgctggaagcagccgacaaactggccagcgaaggcatcagcgccgaagtcatcgacgtggccacgctgcgcccgctggatttcgacaccattgccgaatcggtcgccaagaccggccgctgcgtgatcgtgcaggaagccccgcgcactgccggtttcggtgcggagattgctgcgcagcttgccgaaaaatcgatgtacgacctgctcgctccggtggaacgggtgaccggctatgacacgcatatcccgctgttccggctggagatgaagttcctgcccagcgtggagcgcatcgtcaccgccgcccgccgcgcggtg

SEQ ID NO: 39685 - DNA, 1059 bp, Xanthomonas campestris
gaaatcgaatatctgcaatacatggacgcggacggccaactggtccgcgacgatctgccggccgacgccgccaacccgcaacagttgctcgctctgttcaagcgcatgctgttcgtgcgcaccttcgacagcaagtcgatcgcgctgcagcgcaccggcaagctcggcacctacgccgccagcctgggccacgaggccacccatgtgggcatcggtgcctcgatgcgcagcggcgatgtgttcgcgcccagctaccgtgaatacggcaccatgttcgaacgcggcgtgcgtccacgcgatgtgctgctgtactggggcggcgacgagcgcggcagcgactacccgcgcgatgccgatgcggcgatcgacttcccgatctgcgtgccgatttccacccaatgcctgcacgcggccggcgcggcgctgtcgttcaagctgcagggcaaggcgcaggtggcagtggcgtgctgcggcgatggcggcagctccaagaccgacttctacgccgcgctcaactcggccggcgcctacacgctgccgctgatcctgtgcgtgatcaacaacggctgggcgatctcggtgccgcgctcggcgcagaccggtgcgcagacgctggcacagaagggcctggccggcggcctgcactgcctacaggtggacggtaacgacctcatcgccgtgctcgaagccatgcgccaggcgcgcgcgcgcgcgctggccggcgatggcggcaccgtgatcgaattcctcacctatcgcctcaccgaccacaccaccgccgacgacgcccgccgctaccgtggcgaggacgaagtgaagcaggcctggacacgcgaaccgatgctgcgcctgcgccgctatctcaccgcgcaaggtctgtgggacgaggcgcaggaagaagcctggaaagccgagtgcggcgcgcgcatcgacgaagaggtcaatgcgtacctcaataccccggtgcagccggtggaagcgatgttcgattatctgtacggcgacccgccggccgaactgctggcccagcgcgccgaggtcatcgccctggaggcccgt

SEQ ID NO: 39686 - DNA, 804 bp, Xanthomonas campestris
cacaccgatctggaagggcggctgacctacggcggctacctgcgcctggaccagttgctgagtgcgcagcagcccttgtccgagccggcgcaccacgacgaaatgctgttcatcattcagcaccagacctccgagctgtggctgaaactgctggcccacgagctgcgcgcggccatcgtgcacctgcagcgcgacgaggtctggcaatgccgcaaggtgctagcgcgcagcaagcaggtgctgcgccagctgaccgagcagtggtcggtgctggaaacgctgacccccagcgagtacatgggctttcgcgacgtgctcggcccctcgtcgggcttccagtcgctgcaataccgctacatcgagttcctgctgggcaacaagaatccgcagatgctgcaggtgttcgcctatgaccctgccggccaggcacggctgcgcgaagtactggaagccccgagcctgtacgaggaattcctgcgctacctggcgcgcttcgggcatgcgattccgcagcaataccaggcccgcgactggaccgctgcgcacgtggccgacgacacgctgcggccggtgttcgagcgcatctacgaaaataccgaccgctactggcgcgaatattcgctgtgcgaagacctggtggatgtggaaacccagttccagctgtggcgcttccggcacatgcgcacggtgatgcgggtgatcggcttcaaacgcggcaccggcggctccagtggcgtggggttcctgcagcaggccctggcactgaccttcttcccggagctgttcgacgtgcgtacgtccgta

SEQ ID NO: 39687 - DNA, 1047 bp, Xanthomonas campestris; identical to SEQ ID NO: 39312

SEQ ID NO: 39688 - DNA, 1269 bp, Xanthomonas campestris
tacatgaccggcttcggcaatgaattcgccagcgaggcagtagccgataccttgccggttggccagaactcgccgcagcgtgtggcgcacgggctgtatgccgagcagttgtcgggtactgcattcaccgcgccgcgcggcgaaaatcggcgcagttggctgtaccgcatgcgtcctgctgcggtgcacgggacgttctcgctgatcgagcagtcgcagttccacaacgatttcggccacggaccggtgccgccggaccagttgcgctggagcccgctgccgttgccgcagacacccaccgatttcatcgatggcctgtacaccatggccgggaatggtagccccgaagcaatgaatggcgtggccgtgcatctgtatgcggccaatgcctccatgcaggatcgcttcttctataacgccgacggcgagctgctgctggtgccgcaactcgggcgcctgcgcgtgcacaccgagctcggcatgctcgagctggagccgcagcagatcggggtgattccgcgcggcgtgcgcttccgggtcgagctacgcgacggcaccgcacgtggctatgtctgcgagaacttcggtggtttgctgcacctgcccgacctggggccgattggcagtaatggcctggcgaatccgcgcgacttcgaaaccccgtgtgcggccttcgagcaacgcgaaggccgctttgaactggtggccaaattccagggccacctgtggcgtgcggacatcggccattcgccactggacgtggtggcctggcacggcaactacgcgccgtaccgctacgacctgcgccgcttcaacaccatcggttcgatcagcttcgatcatccggacccgagcatttttacggtgctgacctcgcccagcgacacgcacggcacggccaacatggatttcgctatcttcccgccgcgctggctggtggcgcagcacaccttccgcccaccgtggttccaccgcaatgtggccagcgagttcatggggctggtgcacggcgtgtacgacgccaaggccgacggcttcgcgccgggcggtgcgtcgctgcacaactgcatgagcggccacggcccggatgccgccaccttcgacaaggcttcgcaagccgacctgtcgcggccggacgtcatcaccgagacgatggccttcatgttcgaaacccgcgccgtgctgcgccccaccgcgcaatcgctgcacgcaccgcatcggcagggcgattaccagcagtgctgggcggggttgcgcaatgcatttcag

SEQ ID NO: 39689 - DNA, 285 bp, Xanthomonas campestris
gtgcttgggttcgcggtgtatttcttcaattactccacctggctgggccgcaacggcctgtatctggaagacctgttcgtgcggccgcaagcgcgcgggcagggcgccggcctggcgctgctgcggcatctggcgcagctggcggtggacaagggctgcggacgcttcgagtggtcggtgctggactggaaccagccggcgatcaagttctaccaggccgtgggtgcccgccccatggagtgctggaccgtgtaccggctcgacggcgagcgcctggccgcgttt

SEQ ID NO: 39690 - DNA, 1989 bp, Xanthomonas campestris; identical to SEQ ID NO: 39315

SEQ ID NO: 39691 - DNA, 879 bp, Xanthomonas campestris
gtgttggtggtggccacgctcatttccgaaaccttgcgttggcgtgcgcgcgcgcagcccagcgcagtgctcgataatctggtggcccgcatccgcgcctggtgggtgatggccggcgtggtaggcattgcgttcgtgttcgggcgcgccggggtgatcgggctgtttgcgctggtgtcgttgttcgcgctgcgcgagttcatcaccctcacgcccacccggcgcggcgactactacgcgctgctggcggcgttctacatcgtgttgccctggcagtacgggctggtgtggacgggttggtatggcatgtacacgttgctgatcccggtctatgcgtttttggtgctgccgatcctggccaccatcggcggcgacaccacgcgttatcttgagcgcaccgccaaggtgcagtggggcttgatgatctgcgtgttctgcatctcgcacgtgccggcactgctgaatctggagatccccggttatgccgggcggaatctgctgctgatcgccttcctggtgatcgtggtgcagtcctcggacgtgttgcagtacgtgtggggcaagctggccggccggcatctgattgcaccgaagctgtcgccgtccaagaccgtggaaggcttcatcggtggcgtgctctcagccagcctgctcggcatggcgctatggtggatcaccccgttcgcaccgtggcacgcgttcgggctggcgctggtggccaatctgatgggcttcttcggcgggctggtgatgtcggcgatcaagcgcgatcgcggcatcaaggattggggccacatgatcgaaggccacggcggcgtgctcgatcggctggattcggtgtgtttcgccgcgccggtgttcttccacctgattcgctac

SEQ ID NO: 39692 - DNA, 606 bp, Xanthomonas campestris
atgatcgacctgtactactggcccacccccaatggccacaaggtcaccttgtttctggaagaggccgggctggagtacacgctcaagccggtcaacatcggcaagggcgcgcagttcgagcccgccttcctgcagatttcgcccaacaacaagataccggccatcgtggaccacgcaccggccgggggcggcgcgccgctgagcgtgttcgagtccggcgcgatcctgctgtacctggccgagaagaccgggcgctttctgccgcgcgacgcacgcggccgcatcgcggcgctggaatggctgttctggcagatgggcgggctgggcccgatgagcggccagatgggccacttcactgtctatgcgccggaaaagattccctacgcgatcgaacgctacaacgccgaggtgcgccggctgcatggcgtgctcgacaagcgcctggccgagcacgcgttcctggccggcccggaatacggcatcgccgacatggccagctacccgtggatcgaagtgtatggcgacctcaagccggactatgccgcgttccctcatgtgaagcgctggcacgacgccatcgccgcacgcccggccgcccagcgcgcg

SEQ ID NO: 39693 - DNA, 2226 bp, Xanthomonas campestris; identical to SEQ ID NO: 39318

SEQ ID NO: 39694 - DNA, 978 bp, Xanthomonas campestris
gcccacccccactaccgtccccgtcgtatgcgccacgatgcgttttcgcgccggttgatgcgcgagaacacgttgaccaccgacgatctgatctggccggtgttcgtacatgagttgccagggcgcgcgccgattgcctcgatgcccggcgtcgaacgtctgtcgctggacgagttgctgcgcgaggcggaaaacgcgctggaactgggcatcccggtgatcgatctgttccccgtgatcgaccccgccggcaagagcctggacgcggccgaagcctggaatccggacggcctggcgcagcgcgcggtgcgcgccctcaaggcgcgctttcccgagctgggcatcatgaccgacgtggcgctggatccgtacaccacccacggccaggacggtttgatcgacgccaagggttatgtactcaacgagatcaccgtcgaggcgttggtgaagcaatcgctgtcgcatgcgcaggcgggcgtggacatcatttcgccctcggacatgatggacgggcgtatcggtgcgatccgccgcgcgctggatgccgaggaccatctcaacgtgcgcatcatggcgtattcggccaagtacgcctccgcgttctacggcccgttccgcgatgcggtgggcagcgccggcaatctcggcaaggccgacaagaccacctatcagatggacccggccaacagcgacgaggccatgcgcgagatcgcgctggacctggaagagggcgcggacatggtgatggtgaagccaggcatgccgtatctggatgtggtgcggcgggtcaaggaagagttccgcgtgccgaccttcgcctaccaggtcagcggcgagtacgcgatgttgaaggccgccagcgccaatggctggctggacgaacgcaagtgcgtgctggaagcgctgatggcgttcaagcgcgccggtgccgatggcgtgctgacctacttcgcgccgcaggtggcgcgctggctgcgc

SEQ ID NO: 39695 - DNA, 813 bp, Xanthomonas campestris
gtatcccgttatgccgtgttcggacaccccgtcgcccattcgctgtcgccggccatccatgccgacttcgggaagcagaccggcatcgcgctggactacaccgccatcgacgccgcgccggaggaattcaccgccgcgctggagcgcttcgcggccgacggtggcaagggcgccaacgtgaccctgccgctgaaggaagccgcgttcgccctgtcggcgagcctgagcgaccgcgcgcgcgtggctggtgcggtgaacacgctggtgcgcaacgacggccagtggcagggcgacaacaccgatggcgccggcctggtgcgtgacctcaccgagcggcacggcctagatctgcgcggccgccgcgtgctgctgctgggcgccggcggtgccgcacgcggcgttgcgccggcgctgctggaggccggcatcaccgagatggtggtggtgaaccgctcgcccgagcgcgccgatgcgctgtgcgatgcgctgggcgaacccgggcgcgtggtgtcgcgctatctggaagacctgcgcgagctgggcgacttcgagctgatcgtcaatgccaccgctgccggccgcgatcgcgacgccggtgcgttcgcgctgccgctgggcctggtcaacagcctcactgcggcggtggacctcaattacggcgccaccgccatcgccttccttgcctgggcacgttcggcgcagtgccgctacgccatcgacggcctgggcatgctggtcgagcaggccgcggaaagctttgcgctgtggcacggcgtgcgcccgcagaccgacccggtgtacgacgcgctgcgt

SEQ ID NO: 39696 - DNA, 1503 bp, Xanthomonas campestris
atggtgctagccctgctagcccccacgctgatcgccccgccggtctttgcccaatccgtcctgacccgcgacaacggcgccaaggtcggcgacaaccagaattcgcagaccgccggtgccaccggcccgacgttgctgcaggacgtgcaactgatccagaagctgcagcgcttcgatcgcgagcgcattcccgagcgcgtggtgcatgcgcgcggcaccggcgtcaaaggcgagttcaccgccactgccgatctgtccaacctgaccaaggccaaggtgttcagcgccggcgaaaagaccccggtgttcgtgcggttctcctcggtggtgcatggcaaccattcgccggaaacgctgcgcgacccgcacggcttcgccaccaagttctacaccagcgaaggcaactgggatctggtcggcaacaacttccccaccttcttcattcgcgatgcgatcaagttccccgacatggtccacgcgttcaagccggatccgcgcaccaacctggacgatgattcgcgtcgtttcgatttcttctcgcacgtgcccgaatccacccgcacgctgaccctgctgtattccaatgaaggcaccccggccggctatcgcttcatggatggcaacggcgtgcacgcctacaagctggtcaacgcgcaaggcgaggtgcattacgtcaagttccactggaagacgctgcagggcatcaagaatctcgaccccaagcaggtcgccgcggtgcaggccaaggactacagccatctgaccaacgatctagtcggtgcgatcaagaagggcgactacccgaagtgggacctgtacgtgcaggtgctcaagccggacgacctggccaagtttgacttcgacccgctcgatgccaccaagatctggccggatgtgccggagcagaaggttggccagatggtgttgaacaagaacgtcgacaacttcttccaggagaccgaacaggtcgcgatggcgccggccaatctggtgccgggtatcgaaccgtcggaagaccgcctgctgcagggccgtatcttttcgtacgccgacacgcagctgtaccgcatcggtaccaatggcctgagcctgccggtcaaccgtccgcgtgtggccgtcaacaatggcaaccaggacggcgaagccaacaccgggcacaccaccagcggcgtgaactacgagccgagccgtcttgaaccgcatccgcaggacaccgccgcgcgttacagcgagctgccgttgtcgggcaccacccagcaggccaagatcacccgcgagcagaacttcaagcaggccggtgagttgtatcggtcctacagcaagaaggatcgcgccgatctggtgcagagttttggcgagtccctggccactaccgacaccgagagcaagcacctggtgctgtcgttcctgtacaaggccgaccccgagtacggcgccggtgtcacccgcgtggccaagggcgatctggcgcgcgtgaagcagctcgcgtcgaccctgcaggac

SEQ ID NO: 39697 - DNA, 540 bp, Xanthomonas campestris; identical to SEQ ID NO: 39322

SEQ ID NO: 39698 - DNA, 468 bp, Xanthomonas campestris
aaattggtgttcgtgggcggcatgggcgcgggcaagaccaccgcggtgcgtgcgatctccgacgtggaaccggtcagcaccgaaatgccgctgagccaggatgcctacggcgacaagacctacaccaccgtggcgctggactacagctcgatcgagctcgaagacggcgagctgctgcacgtctacggcgtacccggccagaaatacctggatttcatgtggcccctggtgtgcgacggcgccctgggcgtgatcgtgctgaccagcgcgcgcgatacgcagatgcgcgacaccacgctggagctgctgcgcgaattttcgcggattgcgccagaggccagcctcgccgttggcgtcaccatgaccgacgaggtgcaggaatttctgctgccgccgttccgcgaggcgctggtggccgcaggcttccgtatcccggtcatgcgcgtggatgcgcgctcggccacccag

SEQ ID NO: 39699 - DNA, 897 bp, Xanthomonas campestris; identical to SEQ ID NO: 39324

SEQ ID NO: 39700 - DNA, 1962 bp, Xanthomonas campestris; identical to SEQ ID NO: 39325

SEQ ID NO: 39701 - DNA, 2316 bp, Xanthomonas campestris
tgggcgcgcctgctcggccggctggccgacccgtggctgagcctgaccatcgaacccgaacaacccgggcgctatgacgacggcaagccggtggtgtatgtgctcgaggattacggcctctctaatgccctgatcctggacaaggcctgccgcgaggccggcctgccgtcgccgctggtgccgctgccgggcgacccgctggagcgcaagcgcgcctacctggcgttgtcgcggcgcagcagcagcaactcgctgattcccgaacaacgcggcggcaagacgcattccgattcgctggccaagttgctgcaggcgcaccgcgtgcgcgccgacctggacgtgcatctggtgccggtgtcgatcttcgtcggccgtgcgccggacaagcagagcggctggtttgcggtgctgttttcggaaaactgggcgctggtcggccgcttccgccgcctgctctcggtactgctcaatggccgcaccaccatcgtgcgtttcgcgccgcccatctcgctgcgccagaccatggccgaagggctgccgcccgagcgcacgctgcgcaagttgcagcgcgtgttgcgcacgcatttccggcgcatccgcgaggcggtgatcggcccggacctgtccacccgtcgtctgctggtggaccaggtgctggccgccgattcggtgcgcgaagccatcgccacccaggccaagcgcgacaactccaagccggtcgatgcctggcgcaaggcgcacgcctatgcctgggaaatcgctgcggactattccagcccggtggtgcgctcggccagcttcctgctcactcatgtgtggaaccgcatctacgccggcgtgctggtgcatcacctggacaagctcaaacaggccgcgcccgggcatgaagtggtgtacgtgcccagccaccgcagccacatggattacctgctgctgagctacctgttgtatgagcgcggcatcgtgccgccgcacatcgtggcgggcatcaatctcaacctgccggtggtgggcacgctgctgcgcaagggcggtgcgttcttcatccgccgcagcatccgtggcaatgcgctgtattcggcggtgctgagcgaatacgtggcgcagctggtggctggcggttattcgatcgagtacttcgtcgaaggcgggcgctcgcgcaccgggcgcttgttgcagcccaagggcggcatgatcgcaatgacgctacgcgcgtatctgcgccagccgcgcaagccagtgttgttccagccggtgtacatcggttacgagaagctgatggaaggcaacagctatctcgacgaactcaccggccgcccgaaggaaaaggaatcgatctggggcctgctgtggtccatccccaaggtgctcaagcagaactacggccaggtggtggtgaacttcggcgagccgatcgcgctcaacgacgtgctggccaagcacgcgccggaatggaatgacgaaccgctgccagacgatgaaaagccgacctggcttgcaccggcggtggacacgttggccacgcagatccagacccgcatcaactgcgccgccgacgtcaatccaatcaacctgctcgcgctggcgctgctgtccacgcccaagcatgcgatgggcgaagccgatttgatcgcgcagatcgaactgtgcaagaagctgctggccgaaatgccgtattcggaccgcgtcacggtcacgccgcacacgccggcgcgcatcatcacccacgccgaagagatcaacgtgctcacccgcgtctcgcacccgctgggcgatgtgctgagcgtcagtggcgataccgcggtgttgctgagctacttccgcaacaacgtgctgcatctgtttaccgcctcctcgtgggtggcgtgctgcttccagaacaaccgccgcatgagccgcgccgggttgttgcggctgggccgcacggtgtacccgttcctgcaggccgagttgttcctgccgtggagcgaggaccgcttcgccgaacgcatcgagcagaccatcgacatgttcgtgcgcgagggcttgctgctcaacgtcaccgatgacgatggcggcatcctggcgcgcaacaccgggcagaccgacgaagtgttccgcctgcgtgcgatcggccattcgttgcagcaggcgttcgagcgctattacatcgccatttcggtgctggtgaagaacggccccggcgtgctcggtgccggcgagctggaaagcctgtgccagcaggccgcgcaacgcctgagcctgctgtacgcaccggccgcgccggagttcttcgacaagaccctgttccgcagcttcatccagaaactgcgcgaa

SEQ ID NO: 39702 - DNA, 2511 bp, Xanthomonas campestris; identical to SEQ ID NO: 39327

SEQ ID NO: 39703 - DNA, 1116 bp, Xanthomonas campestris; identical to SEQ ID NO: 39328

SEQ ID NO: 39704 - DNA, 912 bp, Xanthomonas campestris; identical to SEQ ID NO: 39329

SEQ ID NO: 39705 - DNA, 897 bp, Xanthomonas campestris
tccgacaccgccctgctggtggtcaacctcggcacccccgagtcgcccactgccccggccgtgcgccgctacctggccgagtttctcagcgaccgccgcgtggtcgccatcccgccgctgttctggaagccgctgctgtatggcgtgatcctgcccatccgcggccccaagtcggcagaaaaatacgccaaggtgtggctgccggatggctcgccgctggcggtgtacacgcggcgtctgaccgaaggcctgcagcaggtcatgcccgactggcacgtcacctgggccatgcgctacggcgcgccggccctgcgcaaggcgctggacggcctgcgtgcgcgcggcatcaagcgcatcgtggtgctgccgctgtatccgcagtattcgaccaccaccaccgcctcgatccaggacgtggtcgatgcctggcgcccgagcgcgccagagatcgcggtggaggtgatccaggactattgcgaagacgccggctgggtggcggcgatcgccgattccatccgcacgcactggcaggtgcatgggcgcagcgagaagctgatgttctccttccacggcctgccgcagcgtgtggccaacgccggcgacccgtatccgcagcagtgcgaacgcagcgcgcaggcgatcgtcaccgcgctgggcctgggcccggatgcgtggcagatgggctaccagtcgcgcttcggtgcagaacgctggttgcagccgtatgccgaacccacgctgtgggcactggccgagggcggcgtgcgcagcttcgacctggtgtgcccgggctttgccaccgactgcctggaaacgctggaagaagtggcgctgggctttgccgaaacgctggccgaacgcggcgccacgctgagctacatcccctgcctcaacgac

SEQ ID NO: 39706 - DNA, 374 bp, Xanthomonas campestris; identical to SEQ ID NO: 39331

SEQ ID NO: 39707 - DNA, 282 bp, Xanthomonas campestris; identical to SEQ ID NO: 39332

SEQ ID NO: 39708 - DNA, 483 bp, Xanthomonas campestris
ctgggtatgatcagcttccacttcgcccgcgccgacaacgggcgtgtcggccgtgacgggcagctgccctggcggctcccgggcccatctcaagcggttcaaggcgcagacgatgggccgcccgatgatcatgggccgcaagaccttcgagtccttccccgcccccctgctcggccgccgccacatcgtgctgacccgcgacaccgcttggtccgcctcgggcgccgaaatcgcgcacagcgtcgaggaagccctggcactggccggcgaggatgccgcggtgatcggcggggccgagatcttcgcactgttcctcgatcgtgccacccgcatcgagctgaccgaggtgcatctcgatgccgaaggcgacgccagcgtgcccgctttcgatccggcccgctggcgcgagacagcaccgaggcgtaccctgccgagggtgaacgcccggcctatgccttcgtgacgctcgagcgccagaagtga

SEQ ID NO: 39709 - DNA, 882 bp, Xanthomonas campestris
  unsure (1)..(882): unsure at all n locations
acgcataactgacatgctcaagaccacacacaaccanacacacgcacaccacacgcaacgaacgaactcaaaaggcacacgaccaccacacgacaggcacacacacctacagaacaacagacagcaacacggaaccagaacccaacaaccgagccacaccgaaccagcactgccgagcggcaaccaaccacacacccaaacagcgacaagcaaccaacaaccaagcaccacgaccaccgcgaaagaccaagaaaactacacaaacaaccacaaccaccacaaccaaacccaagactcccactcaacacagcacaacacgcctcacagccacgaccacactgacccgcaacaaccgacccgcaaagaccccaacacaacacaaaatcaaccacacctaccaacacacgaagagacaaacacacacgcaccacaaaccgcaaacaccacacgaccacccacgcccaacacgaccacaacacccgaacacaaccgacaatcagacacaacagcaacgacacaacaaaccacaccgacaaaccacacaacacaaaacacaaccaaaccaccacacaaaacgcaacgcacaacgaaccaccacgaccagagcacgacacagcacgcgaaagaccacccacccacactcaacaaggacacaaacaatacgccaaccgaccacacaacacagaccgaggcacacaaactgcaacacacactccagagcaccacagctgcaaccccgcgcacaaccacaacacaacgacgagagatgcgccacagacacagaacacacacatccgagcaaacgccacacgcacgcaacaggagaggcagaccgacgcctaccaacaagcagacgcatcgaacgcaaccacgacgaccccg

SEQ ID NO: 39710 - DNA, 1468 bp, Xanthomonas campestris
  unsure (1)..(1468): unsure at all n locations
agagaaaacacaacagaaaaacgccacagagaacgaacacacagacaacgcacccccacagaaaacaacagagaacaaagaaccaacacagaaaagaaaaacaacccacacacccccaccaggagggagcgtggaaacccatgaataccatggaaaaagccaaacaaaattcgagaaaaaagagacccagacaaaagaaaacaacaaccagaacaaaaacgcaacaagcggaattcgccgcaaaacaagtttgcaagaaaacggagagacacaaacacaacacaggggagaaaaacagagggggggggaaacaaccacagaaagaaagagacacagaaaacacacaggacagagaaaagagcacacacagaccaagagacccagccaaaccagacacaaaagacaaagacaaaccacagcgccaaacagaaacacaccgaagcagaaaagacagacagggccagagacagaaaacaagaataaccaacgaagaagacggggagccaaagaaacaagagaaagaaacagaacgcaaggcgacggcgaccacagctaccgacagagaaaagagccgcaacacaaaggagacaaaaccaccaaggaacngagacccaaaggaaaaacaccagaaaaacagacgagaaaccaacagcccaaaatgacaggagagaaacggaacacagcacaaaacagagagaagaaggaccaagaaggaaaagaagcgagaaaacaggagcacatgacgaaaagcggagcagacacaacacacaaaccagagggccacaacagaaacggaaccaccaggaagaccgaaacaggaacaacaagcaagacacgagcgaagaaccacagacacgggacgagcgacacaacaacaagaaaggcagagaaggaacaacaacgagagcaaaagagaggaagagacgcacaaacaacaccaagagacaaggaaaacagcaacacacacagggacaaacagagaacacaaaaaagacgaagaaaccaaaaaacccaaaaaacaaaggaaccgagacaccacggcaaaagaaacagacaaacgagaaaaaaaaaagagcaacgagaaagcacaagcaagagaaccacaaaaaaaagggaaagagcggcacacagacagaacaacagcgggccacaggagcaacaccgagaggcaacgacacaacaagacacaacacgaccaaagccagacagcaaacggaaacaacgagccagagcaaaaaaacagagagacaaggaaaaagagagaaacagacacaacagaaaaacaagcaacaacacacaacaagagaagaacaaaaaacaagcaccaggccaaaaaacaaaaacagcgaccgaaacaaaaaacaccgaacaagacgagaacagaagaacagcaaaaacaggcaagagaacacaagcaaaacacggagagcaaacaaggaaagacggaaaaccgagaaagaaaaaacca

SEQ ID NO: 39711 - DNA, 1525 bp, Xanthomonas campestris; identical to SEQ ID NO: 39334

SEQ ID NO: 39712 - DNA, 1383 bp, Xanthomonas campestris; identical to SEQ ID NO: 39335

SEQ ID NO: 39713 - DNA, 1374 bp, Xanthomonas campestris
  unsure (1)..(1374): unsure at all n locations
tcgataggatgcantgtatctngacgtgggcatcggcgaacnggcgcgaaggagnggagcggcgacaggcgcacaccncnccgcaaatcaccagatacacgaccgccncaccagaacaacacttttggtgaaagcttgtacggaaaagggagagagggagccccccggaaccccccccacaanacnanccncaacanggaaaacaaccccagccagagcgggcgcaagcacgggacgggggaaacgagaagcggaaacagccagcacgcagaacaacaggggaccgaacgagcaggacaacgacaaaagccccggccagccaaaagacgcccacgccacgaacaaaaagcgggccaaccgaggaaacggcaaacacggggcaagagaaggacaaacaggcagaccaaggggggccggcacccaacggcagaacaaagcacgcagagaaacccgcgaaagcggggaaggacacagccagagcaaacaagaggcggacaccgcagacaccaaccaacaggcccgcaaagcccagaacacgcaagaccgcaaagcgccctacagggccgcccaccaaaaacccgggcaaaacaagggcggaacaacaaagcacggaaaaccacgaccgaaacccaaggcaagccaccgaccaagagaaaccaacaaacacgacaagggcaaaacccaaaaccgccaagccgacaagcacaaaggagaggaggacaaagaaccacccacaacaaggagccccgaacaaaaaaaaaaagaaacgagcacgaaaccaccacaaccaaacagagaaaggaacaccccaagacaacccgaccagcaaacggaagggaacaccgacaacgcgaacgaaagcgacaagacgcagcaaacaccgaggaagacgcgcaacagcggaaaacaaaaaacaaacagccccacacgacagcacccgaaagagaggcaacacgcccccaccagaaaaggcgcagcagggcacaaaggacgaccaaacagacgcggaaccaggacaaccagccacgagagcacacaccagcgacgcaagacagatgaaacagacggctagaccacacgagtacacggacggaatcgacacaagaacacaaccacgcagagaggtagacacggacacgaggaaaaggacacacccgcacggacaagacagcagagacgatacggcagaagcgaaacaagagaaagagacacaacacacagagaagaaagaagacgccagctcacgagcggaagcggacaacacagacgacaacaaaagcgcagacacgaaacgacacggatacagaacaccaagatcccaaagagacggacagaaacacgacgcacagcaacgatcaagcacgcgacagaaga

SEQ ID NO: 39714 - DNA, 793 bp, Xanthomonas campestris; identical to SEQ ID NO: 39337

SEQ ID NO: 39715 - DNA, 1189 bp, Xanthomonas campestris
  unsure (1)..(1189): unsure at all n locations
tcttaggcgatggcggcgcccanggcccgcgggccgaacgggacaggggcaagaggggaaagcaggacggaaaacaaacacgcgtgttcctccctatcaagacgcggaacccacacgacgccaaaaagaccccacagggggaggcagggaggacccacgaaaccaacggggggcgagagccccccacaaagcgaagaaagggcgcacgacaaaaaacaggggcaaaaaccgaggaaagcacaacacaacggggcgaaaaacggaaaagaaccaccgcgaaagaacagacccggagcccgaagcgcccacaagggaacgaacaacacaaaaccccggacacaaaaaagccccgaaggcaccgcccccgaaggaacggagaaaaccggaaaaaaaaaggggggaacggggaaacaagagtgaacaaacaaaacgcgcagaaaaaacagagaagacacacaaaaagagagagaacgacgacaagcaacgggcggagaagaagcgcccccgaagggaggggaagaagaacacagcccaccccggaaggagggaacgccgggggcacaccgaacaacccaagagggaaaggaatgaaaaaccacaggaccaaagaccgcgacgggacaacaccgaccaggaaaaacgggaggagagcaacccacaaaacaaaaagggaacgagacaaaagcgccggcccggcgatagacagagaacgaaacggaccaaacaaggaagcgaaggagcgcacgaaacaaaccacgcaccctcggacacacagaaggcgcagaaaagcaagaagagggcaaccgacgaacggggggagggcaccccaacaagcaacaacggacagaccccgggacgaagaggagcacagagaaaaccgacgcacgggagaaggacagagaaacaaacaaaagaaccaacgaacacgagagagagaacgagatancgggacgaccagagaacaaaaccccagggaagggaagccgaagggcacgggaagaacacacgaaaggagccaacgcgacggcgaacccgaaccgagggaagcgacccgacaaagagggccaaggacagacgggaaaaacaaccacacgaagacacaggaggggacgcaggaaccacaccatgcacgagaacggagacgcgagcaaacacaacacggcaggacgagggagccaaggcacaattg

SEQ ID NO: 39716 - DNA, 1244 bp, Xanthomonas campestris
agagaaaaaaaggcaggcgagcacggcagaggagtacaccggagaccaaacacgcttgtcgaaaattgttctggagaaggccagggacgaccaccaccaaggcgcggggacaaggggggaacaaaccgaccgaaaagagcaaaaagggacgccgacccccaggtaggggccccacaccaagaaacacccaaccaaccaaaccaaaaacccagaaaaggggccaaacggcaagacggcaagaacccaaccacgagaaccagggggggcaaagcaaacaaaaaagcacggaaccagcaaacaaaagaggggccagacgccaagcaccgggggccggaaccaccaagcgggggaaccgaaggaagaaaagcgagcccacaaaagccacagccccctcaaacaccagagacaaacggagacccaacgaccaaggacaaaggcgaccgcgaggcgcgaacaagggagacccaccaaacgccagggagaacacgcggagcaggactaaaacacaccccaagggaaaccacgagagcgacgcacaaacaaaggcaggaaaaacacaccgagggaacaagcaacagcgacacaaacacagggcggagagcacaacgcaaacggaggcagaagcgaaacaaaaacagaacacaagaacgaaacggcacaaaacgaccccgcaaaacacaagacgacacagacgaaacgagcacagcggagcgcaacaacgagggacgcgacagcaaaacccacagaagcgcacacaaggagagctacgaaaacggacacctacaacacaccagaaccaggaagcggaaggcaaaggaacaggagcaaaacccaacgaaaaacacgacacacacaaccgacacacgccggcgggggacgagcgccccagaaaaagcaaccacccgcaacgaaacaaaccacggcacaagacaacgggaacaacaaacgagaaaccagcggagaacacaagactgacagagacgaaacgagccccggacagagacaagcgcgcaacccacaacacacacagcgaaacacgcaacatcacacgagaatgaatagcccaacaaaacaccactcccacagagcgacaagagaggacggaacataaccgcgcagaaccaaaacaaccaaatgggcagacgaagaccagacgcgaagcacacccacagaagacgaacagaccgcaggagacgaaaagcgacgtacaccccacacaggcacggggacgaccacccaacaca

SEQ ID NO: 39717 - DNA, 1406 bp, Xanthomonas campestris; identical to SEQ ID NO: 39338

SEQ ID NO: 39718 - DNA, 869 bp, Xanthomonas campestris
caaaaaaaaaaccccgcagggagaaacaacgccacgacacagcacgccaaacacagaaggagatttatataacaccagcagcaaaaaaccaacaaaaacgggggggagaccaaagagaaaacgggaagcccgaaccgcggaaagcaggccaggaaaaaacgcgcgaggcgggggaccggggggggcgagggcaaaaaccgcggagcaagcaaacagaacggcggggccgcaaacggcaccaccggcggccacccccagcggggcaggagagacgcaccaaacgaacgagccacacaaaagaagggcgagaaaagccggccaacaaaggcaagcaaaacgagcgacaagaagaggccccgccaaaccaacgacagagagaacaagaaaaaaaaacgcacaaagcaggcagacaggcaaacaacgggggcgcaccacgcggggagcagaaccgacaggccccgcgaccggcgcacaaaaaagcaccaaccacaaaaggccaaaaacgaaaaggcaggggggcccagccgacgcaaccgaagacaaggcccagcacgggccagggggaggaaacacgaaaaagcaagcgccggacgggggaacaaccaggaaagcccaccggggggaaaaaaaaagaccaaaggaaagaaagacggccgggggggaaacgaaacgagagggacccgccggaagggacccagcaccagaaaaaaaggcaaaccggagagaccacacagccaaaccaggaacgaaaaaaacccagagagcagggaaaaccccaacacacaccccggagaagagacccagaaaaaaaaacccgaagaccgagccaacaaacacaagacaaacgccagaccgggggcacaaaaaag

SEQ ID NO: 39719 - DNA, 524 bp, Xanthomonas campestris
  unsure (1)..(524): unsure at all n locations
ccgaccggagagggacagagagtagagcgccaaagacagccagcgacaggcttgtaatttcgacaacggcccgagggaagccaaccacggggggcggggcaaactcggcaaccaaagacaccacccaacaaataagcagaagggaccccaggcgcgcgcggaacaaaaccgggcctgagagggagcggagcaacaagggaaaaaaacaacagagccgcaagcacggccagagacagaccaggctccgacccccagaacacccaaagaaaccagccaggaaagaaccggaagaaggacaaacaaacaacggggaggaagaccaaaacaaagccccgagacacggggcagtaagacggaacacacgatcgaaaccagaggggccaagagaaaagacgaaaaccggtgggccagagcagagaacccccggggcacaaccaaagcagagtagcgtaagagcgaggaacagcactgaaagagggcaggcacaaagcaaagnagagggagctccagcagcgggcgagcac

SEQ ID NO: 39720 - DNA, 907 bp, Xanthomonas campestris
ccaaggccccaccccagcttttctttccaaagccaggaacagggacggcccccgagacagcgaccgcacagcaacccgccgacgcccgccaaaacaaaacaaaaccacgacgcagagcaacaaagacgccgaggagcaacacccggcaacacaagccgacgagccgccaagaaacaccagagacccccgacagaaagaaaaccgcgccgcataaccgacacccgaagggacgagcaggcaacaacgccaaaaaacggagcaccagacacaaaggcaccgccccgagggagacccaagaaaggaacgacagacacaccacgaaaacgaaatgcccccagcccgacagaacaaaatcaccacaaaccgaggaccagaacaccccactgaagccgaacacgccgaagacaagcccccggaacccacaccccataaccggcaagaaaccaaaccagggccaaccgcagacacacccagaggaggaaaacacgcccacaaagcgcaaagacgcaccaaagccagaaggataagcctaccatggcgtacaagacgacgcacaccttaacagagccgcgcaccagcctccaactgcagaacaggaaacacaggcaagcaccagcctacaaaagcaagccatgcccaaagcaagaaggacgatcccgaggataacgtacagcaacactcagccatacaagagacagacgacgctctgcagaaatacggataacccccctaatagcaatcgcccagtaaacgggcgagaacaagacaaccgcgaaacacgaaagagagccagagaaacaagggctcaaacaccccacaaccatgacgcacagccatgcaccaacagcccaacggaaagccaaccgaccacaaagccagaggaccgtagcaggagactcagtcacac

SEQ ID NO: 39721 - DNA, 1547 bp, Xanthomonas campestris
  unsure (1)..(1547): unsure at all n locations
gggaggaaaaacaaagcagcggccggagaccaaggcgaaaacaaccaaacggaaaatataaaatagcagggaaaacacgggacagaaaccccgggaacccaaaggagggggggcacagaaaagggaaccagggggggggacaaccacaaagcgaccccagcaacagagccaacaacgaggaacgcaaagacgggggaacagaaaaggaacaaaccgccgagcaaagaacagaccgcgaagaccggaagaggagaacacaccggggagacagaacgaacccaaggaagcgcgcaacacggagacaccaggggaaaaagagcagaggcgagccgcagcacgcagagaagacgagcagcaacagaacagaacaaaacgaacaagaacacgaggacacggcacaggaaacacgggggggacagagacaaaaagcagacgaagcacacagagcaggaacagagacaaacaaacagcagagagaaagaacacacacagcggggagcccgggcacaagcaaacaccacacggcacgaagaacaaaaccaaggacacgcgacaggaaacacgggaacaccaaggacaccggagcaggagccacggggaaaagaaagccgaaaaagcgcacaaaacagacgggagacaaacacaagaagaagcaccacaagaacccgcagaggacgcaagggagaccaacacacccaggagaagaggagagaagacccgccgacacaacacagcgacaagacaccagaacaagaaggggcacacggacagaacgacacaagggcgcacgagcagcagcgagaacagaagacacacaagacgacggaaagcaaacacagcctaccaacaggcaagagaggacggcaacacgaacaacaccaggcgagcgagacgcacagcaacaacatgacaagaagtccaagagacacgggacagaaccaacgagaggaggagagaaggagagccaagacgagcgacatagacgaagggaacgcaccaccgacaaacgaagagcaacacagagagaccacagtcacaatgcgaatatcacgccagaacatagacagagcagcagcgaagaacagacggagacacacgcaccacatgaggacgacacagacancacgcagtgacgacgccacgggcaagacccaagaaggatgcacagcatgccaacgcacagacagcagagcacgcactgagacgcgagcacgagacacgaacacagacagagaacaacacgcacagctacgaatgaggagagcggacctcacgaaacaagagaccaacagggagccagcgcacacaacacggacgaagagaacaaagaagagacaggacaacacgcgatacacaacaacgagagagccgcacacatgcaaacaacgagcaggaacaaacatcaaggagacgaacgcaccagagaaaacgaagacagaagactcacgaccagacaccgcacgaagacagtccgcaagagagtacacacgggatctcggaacgagatacggagagagcaacccgcagcgcgagagcgagagacgacc

SEQ ID NO: 39722 - DNA, 1706 bp, Xanthomonas campestris
  unsure (1)..(1706): unsure at all n locations
aggatacattagacacaacagggacacacacagaacacgatcagtacgagcgacaaacagaacggacacacgaaagccaagaagaacaagagacaatagaagaacgcacacgacaccaccaaacacaaagaagaggagacgttgaagnangttcccaattagccannaaaagcaccaaangaacgacacacggaacgacagagcagagcgggagaggggcgacagcagaggagctataaggagancatgaagaatagccaagaacactaagcgcactcgccanacagagcagagcaatggacagataactcacaacaagagcgacacagggcgagagaacagaacagagaagagacagacgaaccagacncacaacaacnctagcgncacaaggcacactcatagagcacgagaagagaacacacaacggcagaacacagacgaacaatcacgagacactcgaaacaaatagagggaaacgacggaacggaaagccaacaagagtaaacatgacagcaacaacaaaaagaagtacgagacggaagcacaccagcgtagcagggacgagacaggacgagaccgaacaagcaacagccccacaacaacagaataacgcaaaccggcacggcacaccactagcagggacgaagcagagaacccgacgagacaccagaacaaggaaggaatcaaagaacaacagaacaacaaaacgtggaacaacaagagccaccgaacaaccaaagccggcacaagagaaaagaaggaaccaacaaccaaaagacccgaagcaagacgcaaaggaagaacgcacaacaggccaggaagaaagaaaaccaagcagcagcgacacacaaagcaacacacgaggccgaacaccgaaaaaaaaaagggcccagaacggcgaacaaaacggccccaagatgacggaagcaggacaaaggaacaaaaaagggaaaaggagacaacacagagtaaaggcaaacaaaacaaaaaagagaagagagcacaaaaaacgcaaacgcacgagcacagacacaggaaacaagacgagcaggaacaccataaaacaacaaggaaacacgacgaagagaggaaaaacaacgaagaggaaggccaacagaaggacaaccacaagggcgaccccagaaaatcaggagaagacaggcacgcgagagaaacaagaggccagaaagaacagaagaaacacgccaagggaatacacccaccaggagacaaaagcagactcctacacaagacaaccaagacgtagaaacaaagagaggaaacgaaaacaggagcaaaaacacgaaacagacgaaagaacacaccggagcacaaaacagaaatcacaaaggaacaagaggaaccagacctacaaacaggaagaaggaggacagaaaagaccaaaacacgagcacaaacaagagacacagagaggaacaaggcaagccaagacaaacaaagagagaacgcgcggagaggatgaacgagaccagaacagacgcagagcggagagacgcgcgaaaagaagaaagctcaacaacagggagaaaaacaaagataaaaagaagcaacaacggagagtacacaatgtaaccgacggcggaacaaagaaacaagacaagaacacgagcaactggacgagctacgagaaaagaaaagcgaggcagagagaccacaaaggaggtggccggcacacaaagcca

SEQ ID NO: 39723 - DNA, 1571 bp, Xanthomonas campestris
  unsure (1)..(1571): unsure at all n locations
aacaccgcaccacgacagcaaatacacgcccaagccaaacaaggaaaccagccaagagacaaaacaccacccacacacccccaaagcagggaaaatagacagccaatgccaaaagcacacaccccccaatgcggaaaagaacaaccccagccccggagcaaaaagaacggacacgacgagacacgacgaagaccagaagaaagcaccattaacccacaacaaggccacgcggccaacaaaaaaacaacacgcaacaggggggagcacagagaggaacaagaaagaggcaacaggcggccaacaccaaacacacaacgacacagaatcaggctgagaaaagaaatacaaaacagaaacaggacgagaactgacaaacacccaaaggcgggacgtccgcgccaaaccgcaaacncacacaccccaacgcgacagaaagacccaccaccacgacacaccgcgcagaaacacanacgcacgggcaacggagaacccaacacgacgaaaatcaaacaaccgcacgcacagaagcgcatcaccacaaaggcgcagaacaacgccacgaaaagcgcgaaagacacgaagacaaaacgaacaccacacgaaaccaaggacgacacaccgcaaacatccgaaacgcaaaagcaatcaacacgcacacgacacagcagataaacacacacgagcaacagcacaacaacagcacgacgacacatgtgtcaacgaccgatacacgcgcatacagagaacagagagcaancgcaccacgacaagatanagcacaagcagaagaaacgagacacgtgacgacgagattgagcacgaccacaggacaaacagaagagacagagcacagacacacgacaaacagaagatacagcactacgtgcacacgaatctcacacgccgcagacgcacacgaagagcacacgcacacagtagcgtaccgacagcatgacgcacgcataaaagagagacaggaaagatcagcgccaacagcgacacacaaggacacgacaaaatgcgcaccgcaccaacgcgaacgaagaagaggacacacagacgaaacaagagagacaactaaacataccaacaagcgacgacgggtcgaataacacaacgagacgacaccgacgtagcgcgaagagatacaaacaaagcgaactaccgacgacaagcaaatagagcaagacacgagcgcgagatgcgcgaacagacgcgcgagagcacacaacanggacacgcgcacgacagaggaaagacacaacacaaacgacgaagacgatcacgcacacacagacagcaccagacgagagangctacgacaagacgaaaagaagngacgcaaaatacacaaccgacgcgaacgaccacaacaccacaaacaacagcaacgaaacacgngagaaaatcacaagagacgcaagacaacacacggacaaggcaaacacaacaacacgatgcagaaaccgacacagagcgcaactaccacgacagcnccagaaggngacacaccacgaaacgcacggccactacacgtcaagagcaagccacacgaacgacggaccacagca

SEQ ID NO: 39724 - DNA, 973 bp, Xanthomonas campestris; identical to SEQ ID NO: 39339

SEQ ID NO: 39725 - DNA, 1031 bp, Xanthomonas campestris; identical to SEQ ID NO: 39340

SEQ ID NO: 39726 - DNA, 600 bp, Xanthomonas campestris; identical to SEQ ID NO: 39341

SEQ ID NO: 39727 - DNA, 601 bp, Xanthomonas campestris
  unsure (1)..(601): unsure at all n locations
cccggaggaacaccacgaggcagaacaccatggaggccgaggccacaacaacgaccaccgaggccagacgaccaacggaccgcactggcccaacacaagacagagcgcaacgcaccaggagacaccacgaccacgacgagagaccggaaacaccacagncacgggaccacaaagatagacacccaaaaagcgcgcccccacacacacacgcgcaccccgcacgcccagacgaccccaccacaccaggagcaatcagcacggacgaccacaacagagcagggacaccacacacccccaacacaggcgagccccgacagggacccgcaacacaagggcaaccccgcaccccagcagcccggaccaacgcataggacagaccagggaaaccgcagcagaccaaccaccccacggacacaacaacccaaacaacggggacaccaggagcaaccccagagaccaccagccagccaccccggagccagacacggcccaacacctgaacaaaaaacgccccacgagccaaaaaacaaggcacaacagccccccgaaaagcgccacaccaacaaagaagcccacaagaccgacccgcaaagcccaacac

SEQ ID NO: 39728 - DNA, 1340 bp, Xanthomonas campestris; identical to SEQ ID NO: 39342
  unsure (1)..(1340): unsure at all n locations

SEQ ID NO: 39729 - DNA, 1302 bp, Xanthomonas campestris
agcgaacccgaccaggagccaacgaaaccaaacacacgtgcgagaaaaggaacatgctacagtcatgatgaccagcgcaaaccaagcaaacgacaacaagcacgaaggggcgccacaaaaacacaacgacaacacggggaaccaccccaaccaaaaccacaaaacaccaaacacaccatcaaaaaacgacacaccgacacacccgacgaaaacgacaggaccagaacccaaaccccccaaaaccagaacagacgagcaaaaagcgacaagcacaccaccagggccgcccaccaagaacgcacaaaagaaaacgaaacacaccagagcaagcacaaaacaaaagacacacaacacacaggaaggacaacaacacgaaacctacccgacaccgacagccagcgacaacaagggacccccaaaacagcacacagcgaacacaaacgaacacaaccagagcaccacccacacacaacaaaagaccacacagcaacaaagaaaaaagccaccacacaaacaccccacaaaaacaccaaggcccagaaccagcacacacaacggcgcaaaaacccaggcaccacaacaaaaacgacgacgcagcaaacacacagacagccgcacacaccaaagcacatagacaaaccaaggacacaccacaggcgacgggcggaccgcaaaccacaccaacccacagaacacaaccccagaaaccgcacaaacaccacaacacaaacgaaagacacaacgaccgaataccacacacacggagacgacaacaagacgacaaaccagaacaccgaaaaggaccgcccacgcaaaaggaacacacagacaacgcagaccaaacagcacatgagcacacacaaagcacaacaccaggaagaacagagaacaccacacaagaacgagaaacgcgacaaacaacaaaacaaggcgccacagcacacacacagaactggacaagtaccagacacaagacaacagcacaacacgagaagagacgaacgagaaagaccacgagaagaaccaaagacaccaacaggcccaacacaaacgaccagagggtcacacaagaaccgacgagagcagcagccagcacaaacacacaaaaagcgaccacccgcaataacaaccccaacaaccaaaccagacacgagcagacacgccaccgacgacacggaccgacacgaacccagccaacagaagacgaccaaagacaaacagagataagaacgacacagcggaagagacagcacagaacgcaccaaacagaaccacagacgccaccaaggacaccacgagaca

SEQ ID NO: 39730 - DNA, 1162 bp, Xanthomonas campestris
  unsure (1)..(1162): unsure at all n locations
ccgagagagagccccccccaacacagagcgcccgctccgccacagccccagcagaaaacccaaggatggcacttagccgtagccggcccatccggcttgccataatatactggtagcgacccgcagcgcgccgcgcccagcaatggctcgaggctcccacctgtccgccggcccctccaaaccaaaggaagccccgaagcccccaaccacaggaccaccccgagccngtagaggccggcgggtttcatggctggaactttcccgccgccatagcgcccaccgtggaccgagcgcggaacacgccatacctgtacgcactacgagccagccgcctccaaatggaagacactggatgggccaactgcctaaacttggctccaaaagacccttagcacacccccgccaaccgtgcacccgatggggtgccacccgccaaaccggtcgagccacccgaatttgcccacccccggtgcccgcccgaaacaacgaccagcccccggaacgtcccggagaacgccccatgccccctagcaaaggatcccccaatgcccgtgtcgaccgccccccacacgcgtggctcttggggcaagcccacccctataagacacccactcggcctccgataagaacaccccaccgcgccccacaatggtcccaaaacagaaaaacacgcccctcacgtgggtgatcacaacctatagggcgcccgcgcctataatttccccaaaaaaaccaagaccgcgacaccccccaaatacacagcgaatggccccccatttggtgacacaagccttatcccttggacacactaaacgttgggttcgagcacccctcgcnacgacaacaacaaatccagcggtgggcgcgtgacaacagccccgccacccacacccgttggaagactctcccaaccctccctgagcggaagcccctcgaaccacaagggggccccccaaacccccggagctcacacggagtgcccccacgccacaaccacaggcggggttgttatcagtgttgggantctctaggagccgtccctccacgccgatccggaagccccaactgcgcctctgaggggaacccacacccaaaaaggccccgcgccccggtcgggtaccccaaaatcccgccgcgtgaggctcctttacgcgagccaaca

SEQ ID NO: 39731 - DNA, 1066 bp, Xanthomonas campestris
  unsure (1)..(1066): unsure at all n locations
gacgggcnncaatcatgaagttcagtagaccnatngccannnnccntncgngcaatacgaggcagaggcccgccgccaggccagaccgcccagggcccgaaaccggcgcggcaaatgatgaataacgcccagaccccgccgaggcaccacggggtagtgtgggacccggaccaggagacgccccacaacaacgccnagagcccgtcaaaggccgagcgccacccgagggcgaagggccagccgcacaccaaggacaggggcgcgacccgggaacaaggggcgccgccgacccgccgaagccagcaaaccggcaaagagagcgagcagcggcaagtggaacagccgaaggagcgacgcggcgagccggagaccaccaaaaggaacaacagcgccgcaccgaaccgcggcgaagacagcagcatcgggggcccgaacaaccagggcaacgagaacaccgagacggagcgcgccgaacgcccgcgcgccaccaaagccgagcggcacacaccagcagaacaaaacagaacccccgagaaacaacccaaaaacaaaacaacaacccccggaaacaaagagaaaacgcccaaccgacaaaaagagcccgccaaaaaataaaaccgacaaagaggagcgagcaaggacaccaccacaacaaaagacacacccaaaccaggagaagacccgaaaaccactaggacacagaggcacccagaacaacaggacaagaacctcacgaaagagacgagcacccaagcacaagcagagcaccccaacaccacacaaacacagcgagacacaaatagacacaacacggtcacaaacgacacaacacgcaagcacacaccaccgacaaccgacaaagacacaacagaacacaacaaagcgacncatacacaacgagacacacacaaatgaacgagaaaccacacaaccacggccacaacaacaacaccaccacaaaacccaagaancgcacaacacacaacaaaacagaacgacacatacaccagagacacaaaaagacccaccccacaagcgacacaaaaaacgcacgcaacacaccaac

SEQ ID NO: 39732 - DNA, 1416 bp, Xanthomonas campestris; identical to SEQ ID NO: 39343
  unsure (1)..(1416): unsure at all n locations

SEQ ID NO: 39733 - DNA, 761 bp, Xanthomonas campestris
cgtgcgacggaggcgcaccaacgaacacacggcgacgaagacctgagggaccgccagacgagacaaagcgcccggagcaggcacaacccgcagacacccaacgacaggaggcgggacggagaaccggacgaaggagggataggtcagccgagaagacaccgaccaagaggaccgccgaacgaaccaagcccaggccagggaacacgcacagaggacacaacgggacaaggatcacgcaacccagcacgcggaataacgaagagggcgagcaacagggaccagaacgcgaaagcacagcaggaaaccgggacagacccggacaggaaacccgcacaccccggcaagggacgggacaggagggacaggatagcgaaacgggaagggaacacaggaaacaagacactcgacgcgagagggcacaagcaaggacaaccgacatagagggggcgacaagccaaaagcccacagagcaacaaaccggccggaggggacggaaacccggatagagggaccccagcacacagacagagacgacaaaaggaacccagagcggacacagcacaaacgaggggagacaaaggggaccagcgcacatcaaaaggcgcccagcgggcccacgaaaagacacccgcgggcgaagcagagaaggcacccaccacacgaagaaagagcacgcaacacccacaacaggaccgcgagccggacacgggaacccaacaggaacgcccaggcgagaggacagggagaccccaggcgaggga

SEQ ID NO: 39734 - DNA, 951 bp, Xanthomonas campestris
agaacacgacacagggcggggagggcgcaggcaaaaagaaaacaaacgaagcagaccacacagcaggaaaccagagcacacaaaaccaggagggccggaggcgccacgggaaaaagccacgcacagcgacgcacgcccaagacaggcatggaagggagacaaaaacgcccgggagcagaacggggcagacggaaccggaccaagagccccccccgaaacaagcagcccagcccaaagaacaacaacgacagacaaacccgccacagaaaacgcaggagcccgggaaaccggcaagtaataggcaccacaacgcaaagaaacgggggcagaaaacaaaccagaaagagggggggcacccgaagagaagaagtcaccccacgagggccccaacaacaaacacagcccggaagcacgcccggaacacaaaaaacaggcgggaacaagacaacgcgagcgaccaccaggagagggccgcccaaaaggcaacagaccagaaagggggaaaaggccagagaacagagaaggcacacgaacccagggggcggcaacgcccaaaaaaagaccaagccggacaaacgagaaaccgaggcccgaggaaaaaaaggccggaaaccgaacaccaaaagaccccgacacccaaaagggaacacaaccacccaggcaaagcgaggcggcacccaagaaagaagaaccccaaagaaagggcaaacagccacaaaaagaagggacaaaggcacagcacggcaagaaaaccaaagacggcaacgagggagaaaagaggcagaaacccgaccaaaacgggggaaaaaggcacgccgcaaacgggaaaaagcgggaaacgcgaggaagggaaaagaagccccaagagagcagccaaaaaagacgcccgagaagaaccccaaaagaacaaaacaaccgaaaacccaagccagggacgggccaccaaacaca

SEQ ID NO: 39735 - DNA, 418 bp, Xanthomonas campestris
gtcggccgtgacgggcagctgccctggcggctcccgggcccatctcaagcggttcaaggcgcagacgatgggccgcccgatgatcatgggccgcaagaccttcgagtccttccccgcccccctgctcggccgccgccacatcgtgctgacccgcgacaccgcttggtccgcctcgggcgccgaaatcgcgcacagcgtcgaggaagccctggcactggccggcgaggatgccgcggtgatcggcggggccgagatcttcgcactgttcctcgatcgtgccacccgcatcgagctgaccgaggtgcatctcgatgccgaaggcgacgccagcgtgcccgctttcgatccggcccgctggcgcgagacagcaccgaggcgtaccctgccgagggtgaacgcccggcctatgccttcgtga

SEQ ID NO: 39736 - DNA, 690 bp, Xanthomonas campestris
gcccagctgccgttcccggcgatcagggtcaacgacagcgtcaccaagtcgaagttcgacaacctctatggctgcaaggaatcgctggtcgacgctatccgtcgcgccggcgacgtgatgctcgccggcaaggttgcgtgcgtcgccggcttcggtgacgtgggcaagggctcggcccagagcttgcgcaacggcggcgcccgcatgatggtcaccgaaatcgatccgatctgcgcactgcaggcggcgatggaaggcttcgaggtcgtcacgatggacgaggccgtgaagcgcgccgacatcttcgtgaccgcgaccggcaacgccgacgtgatcaccgccgatcacatgaaggcgatgaagccgatgtcgatcgtgtgcaacatcggacacttcgacagcgagatccagatcgccgcgctgtcgaactacaagtggaccgaagtgaagcccggcaccgacctggtcgagttcccggacggcaagcagatcatcatcctcgccaagggccgcctggtgaatatgggctgagccaccggccaccccagcttcgtgatgtcggccagctttaccaaccaaacactggcgcatatcgagctgtggacccgcggcgagcactacaaaaacgaagtctacgtcctgccgaagcacctcgacgagaaggtcacggcgctgcacctcgaaaagctg

SEQ ID NO: 39737 - DNA, 610 bp, Xanthomonas campestris
gggggaagccggggtctcgaacgggtccatttgcgagcgtctgctgtcaaaggggcaggaggtccttgcgcttgcgcgttcggtgaagtacgtgccatatgctgcgctagcgtgcgatgtgtccgactacgcgcaggtaaaagccgtcgcgaagcaccttcggcaaaataacatgaaggtttccggtgttgtaaatgccgccggtatcgctgccatgaatctggcggtcaccacgccgccggacactacggcgcgtgttgtgcaggttaatttgcttggtacgatctattgttgccaagtatttgcgccgttgatgatgcgtcagaagggcggatgctttatcaatttctcgacgattgcggtggcgctaggcctaaagggggaggcggtatacgccgcgtccaaagctggcgtcgaagggtttagccgcgcgttcgcgcgcgagatggcagactttaacatccgtgtgaactgcatcgcacctgggccgatcgacaccgccctcctgcgtgggattacatccgaccagatcgggaaaattgtttcccagcaaatattgccttggcagtttgggccggatgcggtcagcgacgtagtagaacttctgctc

SEQ ID NO: 39738 - DNA, 2436 bp, Xanthomonas campestris; identical to SEQ ID NO: 39347

SEQ ID NO: 39739 - DNA, 1377 bp, Xanthomonas campestris; identical to SEQ ID NO: 39348

SEQ ID NO: 39740 - DNA, 1515 bp, Xanthomonas campestris; identical to SEQ ID NO: 39349

SEQ ID NO: 39741 - DNA, 1188 bp, Xanthomonas campestris; identical to SEQ ID NO: 39351

SEQ ID NO: 39742 - DNA, 498 bp, Xanthomonas campestris; identical to SEQ ID NO: 39352

SEQ ID NO: 39743 - DNA, 1089 bp, Xanthomonas campestris; identical to SEQ ID NO: 39353

SEQ ID NO: 39744 - DNA, 1464 bp, Xanthomonas campestris; identical to SEQ ID NO: 39354

SEQ ID NO: 39745 - DNA, 1350 bp, Xanthomonas campestris; identical to SEQ ID NO: 39355

SEQ ID NO: 39746 - DNA, 1734 bp, Xanthomonas campestris; identical to SEQ ID NO: 39356

SEQ ID NO: 39747 - DNA, 1734 bp, Xanthomonas campestris
ctcaccagcctcggccgcagcgacaccagcgaatggacctatgtcagccaggacggccgtcgcctgccagtgctgctgaccttgagcacgttgcgcgacgacaacgaccaggtgatcgggtacctgggcgtggcggtggacctcaccgagcagaaactgcacgaaaaacagctgcgtctggcaatggacgcggccagaagcgccaaccagtccaagtcggatttcctggccaacatgagccatgaaatccgcacgccgatgaacgccatcctgggcatgctgtacctgctccagcgcagcgagttgccgggcgccgcgcaggacatggtgaccaagatcgaccgctcggcgcgctcgctgctggagatcatcaacgacatcctggacttctccaagatcgaggccgggcgcatcgatctggagcgcgcaccgttcgacctcaatcaattgttcgacaacatcgccgacctgatgcgctcctcgctcagcgccaagccggtggagatgatcgtcgagccgttgccgcgcgaatgccgctggctgctcggcgatgcgctgcgcatcaaccaggtgctggtcaacctggtcggcaatgcgatcaagttcaccgaacaaggcgaagtggtgctgtcggtgcgccgcttccccagtggcgaccccaacaagatcaagctgctgttctcggtacgcgacaccggcatcggcatctccaaggaaaagcagagcctgatcttctcgccgttcctgcaggcggatacctccaccagccgccgctacggcggcagcgggctgggcctcaccatcagccggcgcttgatcgaactgatgggcggcgcgctggaagtggaaagcgtgcccgggcgtggcagcgagttctatttcgtcatcacgctggaaagaaccgatccacccaaggcccagcaggaagccgcgctattgccgcccgaatccatgccgcgcgtgctgattgccgacgaccacgatgcggccttgaacaacctggtgcgcatcgccaccgagctgggctggcgggtggatgcggtggccagcggccaggccgcgatgcaggcgatcgaagacgccaccgaaccgtacgacatcttcctgctggactggcgcatgcccgacatcgacggcgtggcgatcgcgcgccaggtgcgtgcccgcgccacaccgggccggcatccggtgatcgtgatggtcaccgcctacgaacgccggctgctggagcaacaccccgagcagcaggacctggatgcggtgatgaccaagccggtgaccagcgctgcgctgcatcggctggtggaacaattggtcgacgagcgccccaaggcgcgcccgagcacgccaaccttcgtcgcgcgccggctggaaggcgcgcagctgctgctggtggacgacagcgagatcaactgcgaagtggcacagcgcatcctcgaaggcgaaggcgccatggtcaccgtggcccacgacggcgagcaggcggtgaacacgctcaagcgcgcgccggacctgttccacctggtgctgatggatgtgcagatgccggtggtggatggctacgaggccacccgccgcctgcggcagattccgtcgctggccagcctgccggtgatcgcgctgaccgccggcgccttccgcccgcagcaggaaaaagcgctggaagcaggcatgaatggtttcatcgccaagcccttcaacgtggaggaactggtcaccgcaatccggcacttc

SEQ ID NO: 39748 - DNA, 591 bp, Xanthomonas campestris; identical to SEQ ID NO: 39358

SEQ ID NO: 39749 - DNA, 729 bp, Xanthomonas campestris; identical to SEQ ID NO: 38993

SEQ ID NO: 39750 - DNA, 939 bp, Xanthomonas campestris; identical to SEQ ID NO: 39360

SEQ ID NO: 39751 - DNA, 939 bp, Xanthomonas campestris; identical to SEQ ID NO: 39361

SEQ ID NO: 39752 - DNA, 948 bp, Xanthomonas campestris; identical to SEQ ID NO: 39362

SEQ ID NO: 39753 - DNA, 1698 bp, Xanthomonas campestris
ctgctcatcgtcgaatcgcccgccaaggccaagacgatcaataaatacctcggcaaggacttcaccgtcctggcctcgtatgggcacgtgcgtgacctggttcccaaggagggcgccgtggatccggacaacgggtttgcgatgcgctacgacttgatcgaaaagaacgagaagcacgtcgaggcgattgccagggctgccaagagcgccgacgacatctatctggcgaccgacccggaccgcgagggtgaggcgatcagctggcatatcgccgagatcctgaaagagcgcgggctgctgaaggacaagacgatgcagcgggtggtcttcaccgagatcacgccccgcgcgatcaaggaagccatgctcaagccgcgcgcgatcgccgccgacctggtggacgcgcagcaggcacgccgtgcgctggattacctggtcggtttcaacctctcgccggtgctgtggcgcaaggtgcagcgcgggctatcggccggccgcgtgcagtcgccggcgctgcgcatgatcgtcgaacgcgaggaagagatcgaagccttcatcgcccgcgaatattggtccatcgatgcgcactgccggcatccctcgcagccgttcaatgcgcgcctgatcaagctggacgggcagaagttcgaacaattcacggtcaccgacggcgataccgccgaggcggcgcgcctgcgcatccagcaggccgcgcaaggcgtgctgcacgtcaccgatgtggccagcaaggagcgcaagcgtcgccctgccccgccattcaccacctccacgctgcagcaggaggcctcgcgcaagctcggcttcacgacccgcaagaccatgcaggtggcgcagaaactctatgaaggcgtggcgctcggcgatgaaggctcggtcggtctgatcagctatatgcgtaccgactcggtgaacctgtcgcaggacgcactgtcggaaatccgcgacgtgatcgcgcgcgatttcggcaccgcctcgctgccggatcagcccaacgcctacaccaccaaatccaagaacgcgcaggaagcgcacgaagcggtgcgcccgacctcggcactgcgcacgccggcacaggtggcgcgctttttgtccgatgacgagcgccgtctgtacgagttgatctggcgccgcgcggtggcgtgccagatgattccggccacgctcaataccgtcagcgtggatctgtcggccggcagcgagcacgtgttccgcgccagcggcaccaccgtggtggtggcgggctttctggccgtgtacgaagaaggcaaggacaccaagagcagcgaagacgaggacgaaggccgcaagctgccgctgatgaaggccggcgacaacatcccgctggaccgcatcgtcaccgatcagcatttcacccagccgccgccgcgcttcaccgaagcggcgctggtcaaggcgctggaggaatacggcatcggccgtccgtccacctacgcctcgatcatccagaccctgcagttccgcaagtacgtggaaatggaaggccgcagcttccgcccgaccgatgtgggccgtgcggtgtccaaattcctgtccgggcacttcacccgctacgtggactacgacttcaccgccaatctggaagacgatctggatgcagtctcgcgcggcgaagccgagtggatcccgttgatggagaagttctggggcccgttcaag

SEQ ID NO: 39754 - DNA, 1872 bp, Xanthomonas campestris; identical to SEQ ID NO: 39363
  unsure (1)..(1872): unsure at all n locations

SEQ ID NO: 39755 - DNA, 663 bp, Xanthomonas campestris; identical to SEQ ID NO: 38998

SEQ ID NO: 39756 - DNA, 1125 bp, Xanthomonas campestris; identical to SEQ ID NO: 39366

SEQ ID NO: 39757 - DNA, 861 bp, Xanthomonas campestris
gacctgaagggcaacaacgatctgctgctgctgtccagcccggagatcatcgccggcattcatcgcgcctacctggatgccggtgcagatctgctggaaaccaataccttcaacgccacctcggtcagtcaggccgactatcacctcgaacatctggtgtacgagttgaacaaggccggtgcccaggtcgcacgcgcctgttgcgatgccgtcgaagagctgacaccgcagaagccgcgctttgtgatcggcgtgctcggccccaccagccgcaccgcatcgatcagcccggacgtcaacgaccccggttaccgcaataccagcttcgatgcgctgcgcgaaacctatcgcgaagccatcgacggcctgatcgatggcggcgccgataccttgatggtggaaaccatcttcgacaccctcaacgccaaggctgcgttgtatgcgattgaagaagtgttcgaagcgcgtggcggccgcctgccggtgatgatctccggcaccatcaccgatgcctccgggcgcacgctgtccgggcagaccgccgaagcgttctacgcctcggtcgcacacggcaagccgttgtcggtgggcctgaactgcgcgctgggcgccaaggagttgcgcccgcacgtggagacgctctcgcagatcgccgatgcctacgtcagcgcgcatcccaatgccgggctgcccaatgcgttcggcgaatacgacgagacgccggcagaaatggccgaaacgctgcgcgagttcgccaaatccggcctactcaacctggtaggcggttgctgcggcaccacgccggaccatatccgcgcgattgccgaggccgtggccgacctgccgccgcgccagctaccc

SEQ ID NO: 39758 - DNA, 945 bp, Xanthomonas campestris
tccaagcttgcccaactgcgtgacctgtccgttgtcgttgccgatacgggcgactacgacgcgatcaagcggctcaagccggtcgattgcaccaccaatcccaccctggtcaagaaagccctggatctgccggtgtatgccgacctgatcgagcgcgagctggcctggggccgtgcgcacggtggcgaagaccgcaacagcaccatcaacgaagtagctgatcgcctgaccgtcggcgtgggcaccatgttgtcggaactggtacccggccgcgtgtccaccgaagtggacgcggacctggcgcacgacacccaggccaccatcgccaaggcacgcaagttcatcgcgatgtatgccgagcgtggcgtgtccaaggacaagatcctgatcaagatcgccgccacctgggaaggcatcgaagccgcacgccaactgcagcaggaaggcatcgactgcaacctgacgctgatcttcaaccgctcgcaggcgctggcctgtgccgaggccggtgtgttcctgatctcgccgtttgtcggccgcatcctggatttctttgtcgccaagggccagaccccggccagcatcgacgaagatccgggcgtggtgttcgtgcgcggtgtctacgacgagttcaagcgccgcggctcctccactgtggtcatgggcgcctcgttccgctccactgcgcagatcgaggcgctggccggctgcgaccgcctgaccatctcgccggacctgctggagaagctcgacgccgaccacggcgacctgccgcgcaaactgtcgccattgaatgcggacaacgcggccatcacgccgatcaacagcgacagcttcgccaccgacttggccgctgacgatatggccaccgagaagctggccagcggcatcgacaccttcgccaaggacctggaggcgctgcgcaagaccatcgccgacaagctc

SEQ ID NO: 39759 - DNA, 567 bp, Xanthomonas campestris
tggaacaagggcgacggcttgctgcctgtgatcgtgcaggacgccgacaacctgcgcgtgctgatgctgggctacatgaacgccgaggcgcttgcggtgacgcgtgcgcgtggcgaggtcacttttttcagccgcagcaagcagcgcctctggaccaaaggcgagagctcgggaaatgtgctgcgcgtggtcgcgatcgaaaccgattgcgatgcggacaccttgctggtgcaggcacgtccgcacggcccgacctgccacctgggccgcaccagttgcttccccaccgcgcccagccagttcctcggcagcctggacgccttgatcgccgagcgcgagcacgagcgcccgcatggcagctacaccaccaagctgtttgagcaaggcatccgccgcattgcgcagaaggtgggcgaggagggcgtggaaaccgcgctggccggggtggtgcagggcgatgccgagttgctgggcgaatccgctgacctgctgtaccacctgatcgtgctgctgcgcgcacgcgggctgggcctgggcgatgcagtggcgctgctggaatcgcggcac

SEQ ID NO: 39760 - DNA, 765 bp, Xanthomonas campestris; identical to SEQ ID NO: 39369

SEQ ID NO: 39761 - DNA, 1113 bp, Xanthomonas campestris; identical to SEQ ID NO: 39370

SEQ ID NO: 39762 - DNA, 876 bp, Xanthomonas campestris; identical to SEQ ID NO: 39373

SEQ ID NO: 39763 - DNA, 1272 bp, Xanthomonas campestris; identical to SEQ ID NO: 39372

SEQ ID NO: 39764 - DNA, 1077 bp, Xanthomonas campestris; identical to SEQ ID NO: 39371

SEQ ID NO: 39765 - DNA, 1332 bp, Xanthomonas campestris; identical to SEQ ID NO: 39374

SEQ ID NO: 39766 - DNA, 561 bp, Xanthomonas campestris; identical to SEQ ID NO: 39375

SEQ ID NO: 39767 - DNA, 1277 bp, Xanthomonas campestris; identical to SEQ ID NO: 39378

SEQ ID NO: 39768 - DNA, 936 bp, Xanthomonas campestris; identical to SEQ ID NO: 39376

SEQ ID NO: 39769 - DNA, 828 bp, Xanthomonas campestris; identical to SEQ ID NO: 39377

SEQ ID NO: 39770 - DNA, 1008 bp, Xanthomonas campestris; identical to SEQ ID NO: 39379

SEQ ID NO: 39771 - DNA, 1182 bp, Xanthomonas campestris
aaagatatcgtcctcgctttctccggtggcctcgacaccagcttttgcattccgtacctgcaggagcgcggctatgccgtgcacaccgtgttcgccgataccggcggtgtggatgccgaagaacgcgatttcatcgagaagcgcgccgccgagctgggcgcagccagccatgtcaccgtcgatggcggcccggcgatctgggaaggcttcgtcaagccgttcgtgtgggccggcgagggctaccagggccagtacccgttgctggtgtccgaccgttacctgatcgtcgatgctgcgctcaagcgcgccgaagaactgggcacgcggatcatcgcgcacggctgcaccggcatgggcaacgatcaggtgcgtttcgacctggcggtaaaggcgctgggcgactaccagattgtggcgccgattcgcgagatccagaaagaacacacccagacccgcgcctacgagcaaaagtacctggaagagcgcggcttcggcgtgcgtgccaagcagaaggcctacaccatcaacgagaacctgttgggcgtgaccatgtccggcggcgagatcgatcgctgggaagcaccgggcgaaggcgcacgcggctggtgtgcaccgcgtagcgcgtggccgaccgaagcgttgacggtgacgctgaagtttgtcgaaggcgaggccgtggcgctggacggcaaggccctgccaggtgcgcagatcctggccaagctcaacaccttgttcgcgcagtacggcgtgggccgtggcgtgtacaccggcgacaccgtgatcggcctgaagggccgcatcgtgttcgaagcgccgggcctgatctcgctgctcaccgcgcaccgtgcgctggaagacgcggtgctgaccaaacagcagaaccgcttcaagccggacgtggcgcgcaagtgggtggagctggtgtacgagggcttctatcacgacccgctcaagaccgacatcgaggcgttcctgaagtcgtcgcagtccaaggtcaatggcgaagtgacgctggaaacccgcggcggccgcgtcgatgcggtggcggtgcgttcgccgcacctgctcaacgccaagggcgcgacctacgcccagtcggccgactggggcgtggaagaggccgaggggttcatcaagctgttcggcatgagctctacgctgtacgcgcaggtgaatcgc

SEQ ID NO: 39772 - DNA, 2875 bp, Xanthomonas campestris
acccgccagaccatcgtgcgcctgctttcgagcatggccagcgcgaaagagatcagccagtacctgaagcgtttctcgcagctggacgccaagcgctttgcggtggtcaaggtgggcggcgcggtgttgcgcgacgacctggaggcgctgacctcgtcgttgtcgttcctgcaggaagtagggctcaccccgatcgtgctgcacggcgcgggcccgcagctggatgccgagctatcggccgccggcatcgaaaagcagaccgtcaacggcctgcgcgtgacctcgccgcatgcccttgcgatcgtgcgcaaggtgtttcaggcctccaacctcaagctggtggaagcgctgcagcagaacggcgcgcgtgcgacttcgatcaccggcggcgtttttgaagccgaatatctggatcgcgacacctacggcctggtcggcgaggtcaaggcagtgaatctggcgccgatcgaggccagcctgcaggccggttcgatcccggtgatcaccagcctgggcgagaccccgagcgggcagatcctcaacgtcaacgccgattttgccgccaacgaattggtgcaggaactgcagccgtacaagatcatcttcctcaccggcaccggcggtctgctggatgccgaaggcaagctgatcgactcgatcaacctgtccaccgaatacgaccatctgatgcagcagccgtggatcaacggcggcatgcgggtgaagatcgaacagatcaaggatctgctcgatcggctgccgctggagtcgtcggtgtcgatcacccggccggcggatctggccaaggaactgttcacccacaagggttccggcacgttggtgcggcgtggcgagcgcgtactgcgcgcgacctcgtgggacgaactggatctgccgcggctcacctcgctgatcgaatccagcttcggccgtacgctggtgcccgattacttcagcaacaccaagttgctgcgtgcctatgtcagcgagaactatcgcgcgggggagagcctcaccgatgagggcatgctgggtgcaagcgcgctgatctatctggacaagtgtgccgtgctcgacgatgcgcatggcgagggcctgagccgtgcgctctgtaacgtgatgcgcgaagaaaccccgcagctgttctggcgctcgcgtgacaacaaccaggtcaacatcttctactacgccgaatccgacggctgcatcaagcaggaaaagtggaaggtgttctggtacgggctggacaacttcgagcagatccagcactgcgtggcgcattgcgcgacgcgtcaacccaccttgctggggtgagtgcaatgacggccgccgcatcgcaaacgctctggcgcgaggtgcccaccttgcgcggccagcacgtcacgctggagccattgcgcgctgcccacgccgatggcttgcgtgcggcagtggccgatggcgcgttgtcgcgcctgtggtacaccagcgtgcccagtgctgcgcaagtcgatgactacatcgccgccgcgttggcagcgcaggcggacggcactgcgctgccgttcgtggtgcgcgatgcggcgggcgagatcgccggcagcacgcgctactacgcactggatgcgtcggtgccgaagctgtcgatcggctacacctggtacgcgccgcgggtgcagcgcaccggcctcaataccgaggcaaaacgtctgctgcttgggcatgcctttgaaacgctcggctgcctgagcgtggtgttcgagaccagctggttcaatcacacctcgcgcgcggccatcgcgcggctgggtgcaaagcaggacggggtgctgcgcaatcacacgcgccacgccgacggcacgccacgcgacaccgtggtgttttccatcatcaatgcggaatgggccggggtgaaacgccacctgcagttccgcctggacgcacacgcatgactgttcaaccaaccaccatcggcattgtgggcgcacgcggccataccggcgcggagctgatcaagctgattgccgcacacccgcagttgcagctggtgttcgtgtcctcgcgcgagctcgccggccagcgcgtggccgagcacagcgatggctatcagggcgagctgcgctatgaaagcctggacgccgacgcggtggctgccaaggccgcggatgtggtgatcctggcattgcccaacggcaaggccgagcccttcgttgcggccatcgatgccagccggccgcagacgctgctgatcgacctgtcggccgactaccgcttcgatccggcctggtattacggcttgccggagcttacccgccacacctacgccgggcagcgccgcatcagcaatcccggctgctatgccacggccatgcagctggcgatcacgccgctgcgcgagcaactggcagggccgccgcagtgctttggcgtctccggctattccggtgcgggcaccacgccttcagacaagaacaatcccgcgttgctggccgacaacctgatgccgtacgcgctgaccaaccacatgcacgagcgcgaagtctccgcgcagctcggcgtgccggtggaattcatgccgcatgtggcgccgcatttccgcggcatcaccatgaccgtgaacctgtggctgcagcagccgttgacgcgcgagcagatccacgcacgctacctggagcggtatgcgcatgagcccttgatcgagatcgtggacgaggcgccgtgggtgagccgtatcgccggcacccagggcgtgcagatcggtgggttcaccatggcgccgggcaacaagcgcgtggtggtggtggcaacgctggacaacctgctcaagggtgcggccacgcaggccatgcagaacctcaacctggcgctgggctgggacgaattgaccgcaattggc

SEQ ID NO: 39773 - DNA, 1104 bp, Xanthomonas campestris; identical to SEQ ID NO: 39382

SEQ ID NO: 39774 - DNA, 1485 bp, Xanthomonas campestris; identical to SEQ ID NO: 39383

SEQ ID NO: 39775 - DNA, 1653 bp, Xanthomonas campestris; identical to SEQ ID NO: 39384

SEQ ID NO: 39776 - DNA, 1333 bp, Xanthomonas campestris; identical to SEQ ID NO: 39018

SEQ ID NO: 39777 - DNA, 759 bp, Xanthomonas campestris; identical to SEQ ID NO: 39019

SEQ ID NO: 39778 - DNA, 1262 bp, Xanthomonas campestris
atgtcatttgcccacctctcgctgtcgccaacgctgcagccctgtttcgataccgcactggccaaggccgggcaccacacgcccacgccgatccagcagcaggcgattccggccatgctggccgggcgcgacctgatcgccatggcgcagaccggctccggcaaaacgctggcctatgcgctgccgctgctgcaacagcgcatgcaggcgccggaccaggcgccgcgcgtgctcggcggcctgatcctggtgcccacccgcgaactggcagcccaggtggagcagagcctgctgcagctggccgcgcatctgccacgacggctgaagatcgtcgccgccaccggcggcagctccatcaacccgcagctgatggcgttgcggggcggcgccgacatcgtggtggccacgccggggcgcctgctggacctggtggaacacaacgcgctgcagctgggcacagtggccacgctggtgctggacgaagccgaccgcctgctcgacctgggctttggcgccgagctcgaacgcatcctggcgctgctgccggcgcaacggcagagcgtgctgttttcggccacgtttccgccggcaatcacggtcttggccaagcgccgcctgcgcgacccgctgcgcatcaccattgcggccaccccggagcaggccccggcgatcgcccagcgcgccatcgccgtggacgccggcctgcgcacccagctggtgcggcagttgctgcaagaccacggctggccgcagctgctggtgttcgtcgccagccggcacaccgctgaaaaagtcgccgagaagctggaaaaaaccggcatcaccgcactgccgctgcatggtgacctgagccagggccggcgcgagcgcacgctgcacgccttcaaacaggccgaggtgcaggtgctggtggccaccgatctggctgcgcgcggcatcgacatcgccgcgctgcccgcagtgctcaactacgacctgccccgcgtcacggtcgactacacccaccgtatcggccgcaccgcgcgggccggtgccaacggcaccgcgatcagcttcgtcacaccggagagccggccgcagtggcgcctgatcgaaaaacgtgaggatgtgcgcgtgccggtcgaggtgttggcaggcttcgagccggtggccgcgccgcagaccgatgcaaccgcgcgtgcgccggacgccaccggcggcatcaagggcaagcgcccgaacaagaaggacaagctgcgcgcggcccaggccgccgcggcatc

SEQ ID NO: 39779 - DNA, 1782 bp, Xanthomonas campestris
gcttacaagattacagaacacaagtacgacatggtcgtggtgggcgccggcggcgccggcttgcgcgcgaccttcggcctggcccagaagggcctgcagacggtctgcctgaccaaggtcttcccgacccgttcgcacaccgtggccgcgcagggtggtatttccgccgcgctgggcaatatgggtgaggacgactggcggtatcacttctacgacaccatcaagggctccgattggctgggcgaccaggacgcgatcgagtacatgtgccgtgaggcgatcccggccatcatcgagctcgagcactacggcgtgccgttctcgcgcaccgaagagggcaagatctaccagcgcccgttcggcggcatgaccaccaagtacggcgaaggtccgtctgcgcagcgcacctgcgccgccgccgaccgcaccggtcacgcaatgctgcatacgttgtaccagcagtcgctggcgcacaacgcacgcttcatgatcgagtacttcgcgctcgacctgattttcgacgaagaaggtgtgtgccgcggcgtgctcgcgctggacatggccgaaggttcgctgcacctgttccgcgcccacggcgtggtgctggccaccggcggctacggccgtgcctacttcagcgccacctctgcccacacctgtaccggtgacggcggcggcctgatgatgcgtgctggcctgccgatgcaggacatggagttcgtgcaattccatcccaccggtatctacggtgcgggctgcctgatcacccaaagcctgcgttgctaaggcggcattttgcgcaacagcaacagcgagcgcttcatggagcgctatgcaccgcactacaaggatctggcctcgcgcgacgtggtgtcgcgttcgatgaccatcgagatccgcgaaggccgtggcgttggcgagcacaaggaccacattctgctcgacctgacccacctcggcccggaagtgatcaacgacaagctcccaggcatcgccgagagcgcgcacatcttcgctggcgtggacgtggccaagcagccgatcccggtgctgccgacggtgcactacaacatgggcggcatcccgaccaactaccacggtgaagtcgtgcgcaagcagggcgacaacccggatgcggtggtgcccggtttgtatgcgatcggcgaagcggcttgcgtgtcggtacatggcgccaaccgtctggggtccaactcgctgctggatctggtggtgtttgggcgtgcggtagccaaccgctgcgcggaaaccgtcaagaccaatcagccgcacaagccgctgccgtccgatgcctgcgacaaggcgctgggcttgctggacaagttgcgccatgccaatggctccacgccgacctcggtgatccgcgacaacatgcagcgcaccatgcagtcggacgcagcggtgttccggaccagcaagacgctgaaggaaggcgtcgacaagatggccgagatcttcgccaccttcgaggacgtcaaggtatcggaccgctcgctggtctggaattcggacctgatcgagacctacgagttgaacaacctgctgctcaatgcagtggcgacgatcaactcggccgaacagcgcaaggaaagccgtggcgcgcacgcgcacgaggatttcccggaccgcgacgacgtcaactggcagaagcacacactggtcaccgtggacgacaagggccagtgcgacttcgaataccgcccggtccacatgtacacgctgagcaaggaagtggacgtggttccgccgaagccgcgcgtctac

SEQ ID NO: 39780 - DNA, 774 bp, Xanthomonas campestris
atggcagagttcaccctccccaagaattcaaagatcggcaagggcaagcattaccctgcacaaggcgccaagaacaagcgcaccttcaaggtctaccgctgggatccggatggcgacgccaatccgcgcaccgacagctatgaaatcgatctggacaagtgcgggccgatggtcctggacgcgctgatcaagatcaagaacgagatcgacccgaccctgaccttccgccgttcctgccgcgaaggcatctgcggttcgtgcgcgatgaacatcgacggcaccaatacgctggcctgcaccaaggcgattgccgcgtgtggcaaggccgaggtgccgatctatccgctgccgcacatgagagtgatcaaggatctggtgccggacctgacgcatttctatgcgcagtacgcctcgatcaaaccgtggatccgtacccagaccccgccgccgccggaccgcgagcgcctgcagtcgccggaagaccgcaagaagcttgacggcctgtacgagtgcatcctgtgcgcgtgctgctccaccagctgcccgagctactggtggaacggcgaacgctacctgggcccggcgatcctgctgcaggcctaccgctggatcatcgactcgcgcgatgaagacaccggtgcgcgcctggacgatctggaggatccgttcaagctgtatcgctgccacaccatcatgaactgcgcccgcacctgcccgaaggggctgaacccggcgctggcgatcgccgagatcaagaagctgatgatggcgcgc

SEQ ID NO: 39781 - DNA, 1377 bp, Xanthomonas campestris
aacaccctgatcctgttcggcgccaccggcgatctcgcccagcgctatctctttccatccctgctgcgcctgtttgtcgacggcctgttgccggaggacttccgcatccgtgcgttggccctgtcgcagcacgacaccgacgccttccgcgaggtactgcgcccgcgcctggcccaggcgctgccgattgccaccgccgcgcagatcgatgcgctgctgcagcgcatcgactaccgctcggcggacctgcgcaatgccgaatcggtggccgaggccgtgcgcgaactggccagccgccagtgcgtaagctatctggcgattccaccgggcctgtacatcagtacctgccagggcctggccctgggcggcgcgctggctgcaccgcaccggttgatgctggaaaaaccgatcggccacgattcggacagcgcccgcgagatcctgcagtcgatcggcgcactgatcgacgaagaccgcgtgttccgtctcgaccactacctgggcaaggccgcggtgcagaacctggtggcgctgcgcttcggcaacaccttgctggaagcggtgtggaaccggacctacatcgaatcggtacagatcctggtggccgagagcgaaggcgtggacggccgcgatgcctactacgcccgctccggcgcgctgcgcgacatggtgcagagccatatcctgcagttgctgtgcctggtggccatggagccgccggcctcgctggaagccgaccgcatccgcgacgagaaggtcaaggtgctgcgcgccttgcgcccgatgaccgccgagcacgccgcgcaagacagcgtgcgtggccgctacaccgccggcagcatcaacggcgagccggcgcaggcctaccacccgccggaaggcagcgatgtggaaaccttcgtcgcggtcaccgcgcacatcgacaactggcgctgggctggcgtgccgttccacctgtgcaccggcaagcgcctggctgagcgctccacgcgcatcgtggtcacgctcaagccggtgacgcattggttgttcgagcgtccggaccgccagaacgcggtgcccaaccgcctgaccttccagctgcagccgctggaaaacatcgagctgggcctgatgagcagcctggccggcccggaatggggtgcgatcgaactgcagccgctggaactggagctgtccgtgcccaccggcctgcaccgccgtatcgcgtatgaacgcttgttcgtggatgccttcaacggcaacccggcgctgttcgtgcgcgatgacgaggtcaaggccgcctgggcctggatcgacagcgtcagcgatgcctggtcggacgcacagctgccgctgcagccgtatccggccggtagctggggccccgagaccgcc

SEQ ID NO: 39782 - DNA, 1291 bp, Xanthomonas campestris; identical to SEQ ID NO: 39391

SEQ ID NO: 39783 - DNA, 1836 bp, Xanthomonas campestris
gccgaccagttcgtggcgcgcatcagtgccgaatacaaggcggcgtatccggaaatgactgccgcgcagtggctgtcgtcgacctacatcaacggcgactcgcagttgctggcggccaaggccaacgagcgcgcgctgagccagctggatcgctggatcgaccaatccaagcagtacgccggcaccccgatgtccgccgacagcgcgcgtgcgctgcaattactcaagctgatgagcgccctgcccgccccgcgcgacccgaccaagctggccgaactcacgcgtatcgccgcgaagatggaaggcgactacggcgcgggcagcgcctgcaccggtgaaggcgagcaacgccgttgccgccagctgggcgagctcgaacaagtgctggcacgcagccgcggctacgacgaacaactgcaagcctggcaaggctggcacgccaccgcgcaacccatgcgcaaggactaccagcgctttgtcgagctcgccaatgacggtgcacgcggcatgggctttgccgatgtcggtgcgatgtggcgcagcggctacgacatgccgccggcgcaattggccagcgaaaccgaccgcctttgggaacagctcaaaccgctgtacacccagctgcagtgctacgcgcgcggcaagctggacacgcagtacggcaaggacaagggcgaggtggccggcggcatgctgcccgcgcacctgatgggcaacatgtggcagcaggactggagcaacctgtgggatctgctgcagccctatcccggtgcgggcgacctggacatcacctcggcactggaaaaacagtaccagggcaacctgagcgccgcgctggcgcgcaataccggtggcgatggcggcgcagctgcacgcttcctcgccgagcgcgacgcgcaactgcgcactgcccagcagatgaccgaacgcgcgcaggatttctacacgtcgctgggcatgccgaagttgccggacacctattggcaacgctcgcagttcatcaagccactggaccgcgacgtggtctgccacgccagcgcgtgggacatgaacatgggtggcgagccgaacgcgggcatcggcccggacgtgcgcaccaagatgtgcatccgccccactgaagaagacttcaccaccatctaccatgagcttggccacatctattacgacatggcctacaacccgttgccgccgctgttccagaacggcgccaacgacggcttccacgaagccatcggcgacaccatcgtgctggcgatgacccccaagtacctgcagtcgatcggcatggttggcgagcagcagagcgggcgcgaggcattgatcaattcgcagatgcgcatggcgctgagcaaggtggcgtttctgccgttcgggctgatgatcgaccgctggcgctggggcgtattcgacggctcgattcccccggaacgctacaaccaggcctggtgggagttgaaggccacctaccagggcgtggcaccggtgagcccacgcggcgaggacttcttcgatgccggcgccaaataccacgtgcccggcaacacgccctacacccgttattttctcgcgcacatcctgcaattccagttctacaaaggcctgtgcgatgccgccggccaccaggggccgctgtacgaatgcagcttctacggcaacaaggaagccggccagaaattctggtcgatgttgcaacgcggctccagccagccctggcagaccacgctgaaggaagtgaccggcaaggacacgctcgatgccggcccgatgctggaatatttcgcaccgatgcaggaatggctcaaacagcagaaccagggccagatgtgcgggtgg

SEQ ID NO: 39784 - DNA, 687 bp, Xanthomonas campestris
tactacctgccggtgtaccgcccgcgtcaggtggtgctggagcgtggccagggcagtcgcgtgtgggacgaccagggccgcgaatatctggatctgtcctccggcatcgcggtcagcgggctggggcacaacgatccggacctgatggccgcgctcaccgagcaggccggcaagctgtggcacaccagcaacgtgttcttcagcgcgcccccgctgaagctggccgaagagctggtcaccgcctcgcgctttgcgcagaaggtgttcctgtgcaactccggcaccgaggccaacgaggcggcgatcaagctggtgcgcaagtgggccagcagccagggccggccggccgacaagcgggtgatcgtcaccttccgcggcagtttccacggccgcacgctggcctcggtcaccgccaccgcacagcccaaataccaggaaggctacgagccgttgccgggcggattccgctacgtggatttcaacgatgtgccggcgctggaaagcgcgatggccagcggcgatgtggcggcggtgatgctggagccgatccagggcgagggcggggtgatgccggccgcaccgggctttttggcgcgcgtgcgcgcgctgtgcgaccagcacgacgcactgctggtgctggacgagatccagtgcggcatgggccgcaccgacagcctgttagcgcat

SEQ ID NO: 39785 - DNA, 603 bp, Xanthomonas campestris; identical to SEQ ID NO: 39031

SEQ ID NO: 39786 - DNA, 2355 bp, Xanthomonas campestris; identical to SEQ ID NO: 39396

SEQ ID NO: 39787 - DNA, 648 bp, Xanthomonas campestris
gcggccgagcagaccacccagcaggtgcgcgcggccggcggatcggccgaggccttggcactggacgtcaccgacgagcacagcattgcccaggcactggcggccgcctcgcgcgcgcccgaggtgttggtcaacaacgccggcctgcagcaggttgcgccgctggaggagttcccgatgcagcgctgggcgctgctggtggacgtgatgctgaccggtgccgcacgtctcagccgcgcggtgctaccgggcatgcgggcgggcggctacgggcgcatcgtcaacatcggcagcatccattcgctggtggccagcccttacaaaagcgcctacgtggccgccaagcacgggctgatcgggctctccaaggtgctcgcgctggaaaccgccgactgcgacatcaccgccaacacgctgtgccccagctacgtgcgcacgccgctggtggagcggcagatcgccgaccaggcacgcacgcgcggcattgccgaagacgcggtgatccgcgaagtgatgctcaagccgatgcccaaaggcgccttcatcgagtacgacgaactggccggcaccgtggccttcctgatgtcgcacgcggcgcgcaatctcaccggccaggccattgccatcgacggtggctggaccgcgcaa

SEQ ID NO: 39788 - DNA, 2532 bp, Xanthomonas campestris
cagctgccgcgtaccgccaggcccagccactacgcgatcgagatcaccccacatgccgagacgatgaccttcgacggtaaggtcagcatcgatgtcgaggtgctggcgcccaccgatgccatcgtgctgcaggccgcgcagctgaccttcggcaaggccacgctggccgcagcaggccgcaagccggtcgcagccaaggtcaccaccgacgcggatgcgcagaccgccagcattgccaccggcaagccactggcgccgggtaaatatgtgctgacgctggcctacagcggcaccatcaacacgcaggccaatggcttgtttgcgctcgattacaccactgcgcagggcgcgcgccgcgcactgttcacgcagtttgaaaactcggatgcgcgccgcttcgtaccctcgtgggacgagcccaacttcaaggccaccttcgatttggtcatcaatgcgcccgccgggcagatggcagtgagcaacatgccggtcgcctcgtccaagccgggtacaaacgggtgcacccgcgtggcgttccagacctcgcccaagatgtcgacctacctgctcttcgtgagcgtgggcgactttgagcgcgccaccgtcaaggccgataacggtaccgagatcggcgtcattgcgcagaagggcaaggtaggccaggcgcagtttgcgctggaatccggccgtgatgtgctgcacgaatacaacgactacttcggcatccaatacccgctgcccaagctggacaatatcgccgcaccagggcgcagccagttcttcagtgccatggaaaactggggcgcgatctttaccttcgagtacacgctgttgctcgatcctgcggtggccaacgtcagtaccaaacaaggcgtgttcactgttgcagcacatgagatcgcgcaccagtggttcggtaatctggtgaccatggcgtggtgggacgacctgtggctcaacgaaggctttgccaactggatggaagcacgcaccacggcaaaattgcatccggaatgggatatcgacaagaccggcccggcgcaaaaaagtcgcgcggccatgcgtcgcgatgcgtatgtcaccacccatccggtggtgcagcacgtggccaccgtggagcaggccagccaggccttcgacagtatcacctacgccaagggtgaggccgtgattgccatgctggaagactacgttggcgaggatgcctggcgcaccggcgtgcgcagctacatccggcagcatcagtacggcaatgcggtgaccgaccagttgtggcagcagatcgatacggtggcacccggcaagcaattcatccaggtggctcacgacttcaccctgcagccgggcgtgccgttgatcaaggccagcagccgttgcgtgggtggtcagaccacggtcacgctggagcagggcgagttcacgctggatcggcccgacaagcagccgctgcgctggcatgtgccagttgtgctgcgtggcggtgatggcaaacaggtgcgtgtgctggtggacggcactgcacaggtacagttgcctggctgcaaggtgccggtggtggtcaatgccgggcaaaagggctatttccgcacagcgtatgcaccgatgcagttcaaggcgctggccgcgggcttcagcgcattgccggtggtggaccagctgggcgtgttgaacgacaccaatgcactggccggcgcgggcgtacaaccggagacggacctgctgaatctcgcggcccaggtaaaggtcggcgcatcgccggatatctgggagatggtggccagcatctacgacagtgtggatggaagcttcgagcgtgaccaggctgcgcgcgctgcctggcgcgcgtacgccgtgccgcacctgtcggcggagttcgcaacattgggctgggacaatcgtgatgacgattcggcggagatccaacaactgcgcacacgcttgatcggcagcctcagcggcatgggcgatgcggccgtgattgccgaagcgcgccggcggtttgccgggttccaggccaaccccgcgtcgctgtcgcccgaactgcgcgacagcgtgctcggtgcggttgcgctcaatgccgatgccgctacctgggatgcgttacatgcgttggccaagcaggagacctcatcgatggtgcgcgacacctattacgactttctttccatggccgatgatcaggcgctggccaagcgcgcgttggaactggcgctgacagaggagccaggcgccaccaccggtgcgagcatgatcgaccgggtcgcctcccggcacccggagttggcgttcgactttgcggtggcgcatcgcgcacaagtagacatgttggtggattccacctcgcgtgcccgctactacccaagcctggggatggattcggccgacctcgccacagccaacaagatcaaggcctacgccgacacgtacatcgcgccaacctctcggcagaccgcagacaacgccatcaacacgattcagacgcgggtgaagctgcgggcggcgtcgctgccgcagatcaaagcgtggttggcc

SEQ ID NO: 39789 - DNA, 1290 bp, Xanthomonas campestris; identical to SEQ ID NO: 39400

SEQ ID NO: 39790 - DNA, 1673 bp, Xanthomonas campestris
gtggcaatcggcatcgtgcactgcctgcgtgccgcgcagaccgaggtggccgaccagccgatcggcctgggcgacggcggcgtgctgctgcatgacgccctcacccgcacccgccagcagctggccgccatccaggacgacacccagcgccgcctgggcgcctcggacgcggcgatcttcaaggcccaggccgagctgctcaacgacaccgacctgatcacccgcacctgccagctgatggtcgaaggccacggtgtggcgtggtcgtggcaccaggcggtggaacagatcgcctccggcctcgcggcgctgggcaacccggtgctggccggccgcgccgctgacctgcgcgacgtgggccgccgtgtgctggcccaactcgacccggcagcggccggcgccggcctcaccgacctgcccgagcagccctgcatcctgctcgccggcgacctgtcgccgtcggacaccgccaaccttgacgccgattgcgtgcttggcctggccacccgcccagggtgggccgaccctgcacaccgggatcctgtcgcgcacgcttggccttgcggcgcttgtccccgctggcggccaattgctggatatccaaaaacggcgtcaccgccatcatcgacggcagcagcgggcggctctacatcaacccgtcagaacaggatctggacgccgcccgcacgcatatcgccgagcagcaggccatccgcgagcgcgaagccgcccagcgcgccctgcccgccgaaaccaccgacggccaccacatcgacatcggcgccaacgtcaacctgcccgagcaggtggccatggccttgacccagggcgccgaaggcgtgggcctgatgcgcacagagttcctgttcctggagcgcggcagcacgcccaccgaggacgagcagtaccacacctacctggcaatggcacaggccctgaatggccgcccgctgatcgtgcgtgcgctggacatcggcggcgacaagcaggtggcgcacctggagctgccgcacgaagaaaacccgttcctgggcgtgcgtggcgcgcgcctgctgctgcgccgccccgacctgctcgagccacagctgcgggcgctgtatcgcgcggccaaggacggcgcacggctgtcgatcatgttcccgatgatcacctcggtgccggagctgatcagcctgcgcgagatctgcgcacgcatccgcgccgaactcgacgcaccggagctgccgatcggcatcatgatcgaagtgcccgccgccgccgcccaggccgatgtgctggcgcgccatgcggatttcttctcgatcggcaccaacgacctcacccaatacgtgctggcaatcgaccgccagaacccggaactggccgccgaagccgacagcctgcatccggcggtgctgcgcatgatccgcagcacgattgacggcgcgcgcaagcacgaccgctgggtcggggtgtgcggcggtctggccggcgacccgttcggcgccagcctgctggccgggctgggcgtgcaggaattgtcgatgacgcccaacgacattccggcggtcaaggcgcggctgcgtggcagggcgctgagcgccttgcagcagctggccgagcaggcgctgcactgcgagaccgcagagcaggtgcgtgcgcttgaagcacagcgcgagggccaggcatgagcc

SEQ ID NO: 39791 - DNA, 1377 bp, Xanthomonas campestris
cgcacccgttttgcccccagccccaccggttacctgcacatcggcggcgcacgcaccgccctgtactgctggctggaggcacgtcaccgcggcgggcagttcgtgctgcgcatcgaagacaccgaccgtgagcgcagcacccaggtcgccatcgacgccatcctggaagccatggagtggctgggcctgggctacgacgaaggcccgatctaccagacccagcgcatcgcccgttaccaggaggtggccgagcagctgctggcgcagggcaaggcctattacgcctacgagacccgtgaggagctcgacgcgatgcgcgaggccgcgatggccaagcaggaaaagccgcgctacaacggcgccgcgcgcgagcagcagctgccgtatcgcgacgacccgaaccgggtgatccgcttcaagaacccgctcgcgggcacggtggtgttcgacgacctgatcaagggccgcatcgagatcgccaacagcgagctcgacgacatggtgatcttccgcccggatggctaccccacctacaacttcgcggtggtggtggacgactgggacatgggcatcaccgaggtgatccgcggcgacgaccacatcaacaacaccccgcgccagatcaacatctacgaaagcgctgggccgcaccggtacccaagttcggcgcacatgccgatgatcctggacgagcagggcgccaagctctccaagcgcactggcgcggccgatgtcatgcagtacaaggacgccggctacctgccgcatgcgctgatcaattacctggcccgcctaggttggtcgcatggcgaccaggagctgttcagccagcaggagttgctggacctgttcgacgtcaaggacgtcaattccaaggccgcgcgcctggacatggccaagctcggctgggtgaatcagcattacttgaagaccgacgacccggccagcatcgcgccgcagctggaataccagctccgcaagctgggcattgatgtggccgccggcccggccgctgccgatgtggtggtggcgctgcgcgagcgcgtgcagacgctcaaggaaatggccgaaaaagccgtggtctggtaccagccgctggaaacctacgacgaagccgcggtgatcaagcacctgaaactgggcgcggaagtgccgctgggcaaggcgcgcgagatgctcgctgcgctgaacgagtggagcgtggagaacgtatcggcggcgctgcatgccgctgccgcggcgctggaactgggcatgggcaaggtggcccagccgctgcgggtggccatcaccggcacccaggtcagcccggacatttcgcagacggtgtacctggccgggcgcgagggtgccttgaaacgcatcgatgcggcactc

SEQ ID NO: 39792 - DNA, 1653 bp, Xanthomonas campestris
gcaggtgggcgatctgatcatcgtggccgcgtttgccggcatgagcgaagacgaagccaagaccttcaagcccaatctggtatatgtggacgcgcacagcgcgatctcccacaccaaccacagcatccccactcaggccgcatgacacataccaacggattcgacgcgcttcacgcccacgcccagcgcctgcgcggcgttgccatccccacattgcttgccgcagagccccagcggcccacgcagtacgcccggcaagtcggtccgttgtatttcaacttcgcgcggcagaaatacgatcgcgccgcgctcgatgcgctgtttgcaatcgcacgcgagcgtgacctggcaggcgcattccagcggctgttccgtggcgagcaggtcaatgtcaccgaaaagcgcgccgccctgcacaccgcgctgcgtggtgatctcaccgatgcaccggtcgcatccgatgcatacgccaccgctgctgaggtccggcatcgcatgggcgcgctgatccagcagctggaaggcaccgacgtcaccgacattgtcagcgtcggcatcggtggttcggatctgggcccgcgtctggtggccgatgcattgcgtgcaccgtccggcgcgcgtttccgggtgcatttcgtttccaatgtcgatggcgcggccatgcagcgcaccctggcaacgctggacccggcacggaccgccggcatcctgatttccaagactttcggcacccaggaaaccctgctcaacggcagcatcctgcatgcgtggctgggtggcagtgagcgcctgtacgcagtgagtgccaatcccgaacgtgccgccaaggcgttcgacattgcacctggccgcgtgctgccgatgtgggactgggtgggcggccgctattcgctgtggtcggcggtcggtttcccgattgcactggcgatcgggttcgagcgcttcgagcaattgctcgacggtgccgcgcagttcgacgcgcatgcgctcaacacgccgctggaagaaaacgtggcggtgctgcacgggctgaccgcggtgtggaaccgcaacctgctcggtagcgccacgcatgcggtgatgacttacgaccagcgcctggccttgctgcccgcgtatctgcagcagctggtgatggagagcctgggcaagcgcgtcaagctggacggctcggccgtggacagcgacaccgtggcggtgtggtggggcggtgccggcaccgacgtgcagcacagcttcttccaggcgctgcatcagggcaccagcgtggtgccggccgatttcatcggcaccgtgcacaacgacgacccgtacgcagaaaaccatgtcgcgctgatggccaacgtgctggcccagaccgaggccctggccaatggccaggacagcagcgatccgcaccgcagttatcccggcggtcgcccgagcacagtgatcctgctcgatgcactcaccccgcaggcgctgggtgcgctgatttcgatgtacgagcacagcgtgtacgtgcagtcggtgatgtggggcatcaacgcgttcgaccaattcggtgtcgagttgggcaagcagttggccagccaattgctgccagccctgaagggcgaggccgccgatgtggccgacccggtcacgcgcgagctgttggccaagctgcgcggc

SEQ ID NO: 39793 - DNA, 798 bp, Xanthomonas campestris; identical to SEQ ID NO: 39407

SEQ ID NO: 39794 - DNA, 1374 bp, Xanthomonas campestris
atgaacgaattctccgcgctgccgctctcgccagccttggcccccggcatcgatgccctgggctacaccaccctcacgccgatccaggcgcagagcctgccgccgatcctccaggggctggatgtgattgcccaagcgcccaccggcagcggcaagaccgccgcgttcgggctgggcctgctgcaaaagctcgacccggcactgacccgtgcgcaagcgctggtgctgtgccccacgcgcgaactggcagaccaggtcggcaagcaactgcgcaagctggccaccggcattcccaacatgaagttgctggtgctcaccggcggcatgccgcttggtccgcagctggcatcgctcgaagcgcacgacccgcaggtcgtggtcggcacgcccggccgcatccaggaactggcgcgcaaacgcgccctgcatctgggcggcgtgcgcacgctggtgctggacgaggccgaccgtatgctcgacatgggctttgaagaacccatccgcgagatcgccagccgctgcgacaaacactgccagagcctgctgttctcggcgaccttccccgacatcatccgcacgctggcgcgcgagctgttgaaggacccggtggaaatcaccgtggaaggtgcggacaacgcaccggagatcgaccagcagttcttcgaagtggaccccacttatcggcagaaggcggtggccgggctgctgctgcgcttcaatcccgaatccagcgtggtgttctgcaatacccgcaaggaagtggacgaagtcgccggctcgctgcaggagttcgggttctccgcgctggcattgcatggcgacatggagcaacgcgaccgcgacgaggtgctggtgcgcttcgtcaatcgcagctgcaacgtactggttgccagtgacgtggccgcgcgcggcctggatgtggaagacctcgcggcagtggtgaattacgagcttcccaccgacaccgaaacctatcgccaccgcatcggccggactgcgcgcgccggcaagcacggcttggcactcagcctggtggcgccgcgcgaaagcgctcgtgcgcaggcgctggaggccgagcacggccagccgctcaagtggtcacgcgcaccgctggccaccgcacgcccggcgcaattgccgctggccgcgatgaccacgctgcgcatcgacggcggcaagaccgacaaactgcgtgccggcgacattctgggcgcattgaccggcgaagcaggcttgtcgggtgcggcgatcggcaagatcgccatctaccccacccgctcgtacgtggcgattgcgcgggcgcaggtcgctcgtgcactgacccacttgcaggccggcaagatcaagggccgccgcttccgggtgaccaagctc

SEQ ID NO: 39795 - DNA, 867 bp, Xanthomonas campestris; identical to SEQ ID NO: 39410

SEQ ID NO: 39796 - DNA, 663 bp, Xanthomonas campestris; identical to SEQ ID NO: 39411

SEQ ID NO: 39797 - DNA, 1530 bp, Xanthomonas campestris; identical to SEQ ID NO: 39045

SEQ ID NO: 39798 - DNA, 1038 bp, Xanthomonas campestris; identical to SEQ ID NO: 39414

SEQ ID NO: 39799 - DNA, 942 bp, Xanthomonas campestris; identical to SEQ ID NO: 39413

SEQ ID NO: 39800 - DNA, 1557 bp, Xanthomonas campestris
accgcgcacagcatctccaccagttggggtgtcgtgcagcagcccgcgctccccagccaggtctgcacaacgctcaaggctgcgctggtgccggttgccggctcgctggatgcgctcgaccaggatcccacccaatccaaacgcgacaccgcacgcctgcaggccgccatcgacgattgccctgccggcagcgcggtgcgtctggtggtcggcgatggcggagaatccggcctgttgagcggcccgctcaccatcaagagcggcgtgacgttgtggatcgatcgcggcgtgaccttgttcggctcgcgcaatccgcaggattacgacaatggcctgggcacctgcggcaccgccaccaccgacaaggccaagtcctgcaacccgttgatccacgtcgccgacactgccaagagcgccatcgtgggcgccggcaagatcgacggccgcggtggcagcacgctcaccgcgggaccgaatgccggcaaggccagctggtgggatctggcctatctcaacgtcaccaagggcctgagccagcacgtgccacggctgctgcagatcgatgacagcaccgacttcacgctgtacgacatcaccctggaaaactcgcccaatttccacgtcaccaccgacaacgtggtgggcctgaccgcctggggcatcaagatcctggcacctagcctggtgtattcgcgccccggctaccactgccctgccggcagcaccccggacgtcaatccgcacgccagctgctttaccccggaaaccgtcaagaacaccgacggcttcgaccctggccaatccaagaacgtgctgctggcgtactcgtatatcggtaccggcgatgacggcgtggcgatcaaggcgcatgccaaaaacaagcgcagcatcgcctcggaaaacatgctgttcgcctacaaccagttctactacacgcacggtttttcgctcggcagcgaaaccgattcggggatgcgccatatcgccgtgcgcggcttgagcatcgacggcttcaacgccaacgacgtgcagcgcgatccctactcggccaatggcctgcgtatcaagtccgatgcttcgcgcggcggccaggtctacgacatcagattcgagaacatctgcatgcgcggggttgcgcggccgctggtattcgacgccaactacgccaacccggccacacgcgaccagttgccgcggttcagcggcattgcactgaccaatgtgcactccctgggttccaaggccttcggtggcggcgaattgagcttctacggctatcgcgatgcgaccaccaccctgcccatcaccatgtcgctggacaacgtggtgctcgacggcggcccggtcgcctttgcgcagccgcattttggtggaccggccagcaacccgggcgcggtgcacttcaccttcaaaggcgggccggtgagcttctttgatcagctcaccgagtcggcggccaacgatgtgcagttgcagggccggcccgggccgggcgcgccgttgcaatgcgacgatgccttcattgcgtaccacagcgtgctgcccgactcaccgatc

SEQ ID NO: 39801 - DNA, 1100 bp, Xanthomonas campestris
accgccagccgcccgcagctcaccagcagcgaagcaagcacgtatacgatcagcaaggcgctcgccaaggccggcccgatcacagcgttggtgaccgacaactggaaccccaccgccggcgtggcgctgctgaccgccgactttgcagtggccgccgatggctccacccgttatcgcacggtgcaatcggcaatcgatgcggcggtggccgccggtggcagcacgcgccgctatatcagcgtcaaggccggcacttacaacgagctggtgtgcgtgccgagcggtgcaccgccactgaccctgttcgggcttggcagcgccacgaccgataccgtcatccgctacaacaacgccaaccccacgcccaagccaaccggcaccgcaagtcacccctgcgccagcaatgcgtcagccgccacagtgggcacttccaatagcgcgacggttaccgtgcgtgccagcggcttccaggcacggcatctgcgctttgacaataactatgtcgaaggcacttacgccgacaacaatcaatcggcagtggcactggccgtgcgcggcgaccaggccagcttcgaggacgtgctggtcaccggcaaccaggacaccttgctgatcagcgcgaccaacgccgccaacgtgatccgcgcctatttcaagagcagcacgatcgaaggcgatgtcgatttcatcttcgggtccggcatcggcgtgttcgacaacgcaatcattcgctcggccggcgcgcgcctgggcagcagccgtggtggctacatcttcgcgccaagcacgcgcccgggcagcggctacggctttctggcgatcaacagccgcttcgtagcgggctccggttcgccggacaatcaaacctacctcgggcgcgcatgggacgaaggcgttagtggcctgtccgcgtacgtcaacggcacctcgcccaatggccaggtgaccatccgcgattccacgctgggcagccacatccgcaagaccgcgccatggaatgcctccaccgccagccgcccgttctgcagcagcaactgcaccaactcggccaaccgctttttttcgaatacggcaacagcggtgctggcagtgccgactga

SEQ ID NO: 39802 - DNA, 738 bp, Xanthomonas campestris; identical to SEQ ID NO: 39417

SEQ ID NO: 39803 - DNA, 1989 bp, Xanthomonas campestris; identical to SEQ ID NO: 39418

SEQ ID NO: 39804 - DNA, 840 bp, Xanthomonas campestris; identical to SEQ ID NO: 39419

SEQ ID NO: 39805 - DNA, 1344 bp, Xanthomonas campestris; identical to SEQ ID NO: 39054

SEQ ID NO: 39806 - DNA, 1059 bp, Xanthomonas campestris; identical to SEQ ID NO: 39420

SEQ ID NO: 39807 - DNA, 1467 bp, Xanthomonas campestris
gatctggcgtatccggagctgttccaggccgtgcagcgcggcgagctgttcgacgaccagaagcacttcgtcgactttctgccgctgcgcgacccggccctgatcaacgccgactatctggcgcagcacgagcatgccggctttgacctgcgcaagttcgtggatgccaacttcgaggaatcgccgccggtacagaccgatgcgatccgccaggacaccgcgctgcgcgagcacatcgacgcgctgtggcccaagctggtacgcagccagaccaacgtgcccgcacacagcagcctgctggcgttgccgcacccgtacgtggtgccgggcggacgcttccgcgaggtgtattactgggattcgtacttcaccatgctggggctggtgaaaagtggcgaaaccacgctgagccggcagatgctggacaacttcgcctacctgatcgacacctacgggcacatccccaacggcaaccgcacctactacctgagccgctcgcagccgccgttattctcctacatggtggaactgcaggccggcgtggaaggcgaggcggtgtaccagcgctacctgccgcagctgcagaaggaatacgcgtactggatgcagggcggcgacgatctgcaacccggccaggccgcacgccatgtggtgcgcctggccgatggcagcgtgctcaatcgctattgggacgagcgcgataccccgcgcccggaagcctggctgcacgacacccgcaccgctgccgaggcgcatgaccgcccggccgccgatgtctaccgcgacctgcgcgccggcgccgaaagtggctgggactacaccagccgctggctggccgacggcaagacgctgagcaccatccgcaccaccgcgattgtgccgatcgatctcaacagcctgctgtatcacctggaacgcaccctggcgcaggcctgcgcgcacaccggcaccgcctgcagccaggactacgctgcgctcgcacagcagcgcaagcaggccatcgacgcgcacctgtggaatgcagccggctactacgccgactacgactggcagacccgcacgctgagcaaccaggtcaccgcggcggcgctgtacccgctgttcgccggcctggcttcggatgaccacgccaagcgcactgccaccagcgtgcgcgcccgcctgctgcgtcccggcggcctggccaccaccgcgttgaagaccggccagcagtgggacgaacccaacggctgggcgccattgcaatgggtggccgtggacggcctgcgtcgctacggcgaagacggcctggcccgcaccatcggcgagcgcttcctcacccaggtgcaggcgctattcgcgcgcgagcacaagctggtcgaaaaatacggcctggacgccgatgcagccggcggcggcggtggcgaatatgcattgcaggacggctttggctggaccaatggcgtcacgttgatgctgttgaacctg

SEQ ID NO: 39808 - DNA, 894 bp, Xanthomonas campestris
ggactcagcaagacctacgccggaggtttccaggcgctcaaacgtgtggatctggacatccagcgcggtgagatctttgcattgctcggccccaacggcgccggcaagaccaccttgatcagcatcatctgcgggctggtcaatccaagcaccggcaccgtgctggccgatggccacgacatcgtgcgcgactaccgcgccgcgcgtgccagcatcgggctggtgccgcaggagctggccaccgatgcgttcgaaaccgtgtgggccacggtgcgcttcagccgcggcctgttcggcaagccggccaatccgcagtacctggaatcggtgctgcgccagctgtcgttgtgggacaagcgcaacagcaagatctccaccctgtccggtggcatgaagcggcgcgtgctgatcgccaaggcgctggcgcacgagccacgcatcctgttcctggacgagcccaccgccggcgtggacgtggagctgcgccacgacatgtggcagatggtgcggcggctgcgcgagcagggcaccacggtgatcctgaccacccattacatcgaagaagccgaagacatggccgaccgggtcggtgtcatcaaccgcggcgagctggtgctggtggaagacaagcacacgctgatgcgcaagctcggcaagaagcagctcagcttgagcctgcaggcgccgctgcaggtgattcccgcgccgctggccgacctgccgctggagctgtccgccgatggaaccagcctgatctacaccttcgacacccaggccgagcagaccggcatcggcgcgctgctgcgccggctcaacgagcagggcatcgacttcaaggacctgcattccagcgaaagttcgctggaagagatcttcgtcaacctggtgcatggc

SEQ ID NO: 39809 - DNA, 738 bp, Xanthomonas campestris; identical to SEQ ID NO: 39057

SEQ ID NO: 39810 - DNA, 1453 bp, Xanthomonas campestris
atgtccatattcaggaccgcaagcacgctcgctttggccaccgccctcgcactggccgccgggccggccttcagctattccatcaacaacagcaggcagatcgtcgacgacagcggcaaggtcgtgcagctcaagggtgtgaacgtgttcggcttcgaaaccggcaaccacgtgatgcatggcctgtgggcacgcaactggaaggacatgatcgtgcagatgcagggcctgggcttcaacgccgtgcgcctgccgttctgcccggccacgctgcgtagcgacaccatgccggccagcatcgactacagccgcaacgccgacctgcagggcctgacctcgctgcagatcctcgacaaggtgatcgccgaattcaatgcgcgcggcatgtatgtgctgctggatcaccacacccccgattgcgccggcatttccgagctctggtacaccggctcctataccgaggcacagtggctggccgacctgcgctttgtggccaaccgctacaagaacgtgccgtatgtactcggcctggatctgaagaacgaaccgcacggcgccgccacctggggtaccggcaacgccgccaccgattggaacaaggctgccgagcgcggctcggccgcggtgttggcggtcgcgccgaaatggctgatcgcggtggaaggcatcaccgacaacccggtgtgctccaccaacggcggcatcttctggggcggcaacctgcagccgctggcctgcaccccgctcaacatcccggccaaccgcctgctgctggccccgcacgtgtacggcccggacgtgttcgtgcagtcgtacttcaacgacagcaacttccccaacaacatgcccgccatctgggaacgccatttcggtcagttcgccggcacgcatgcgctgttgctgggcgagttcgatggcaagtacggcgaaggcgacgcacgcgacaagacctggcaggacgcgctggtgaagtacctgcgcagcaagggcatcaaccagggcttctactggtcgtggaatcccaacagcggcgacaccggcggcatcctgcgcgatgactggaccagcgtgcgccaggacaagatgaccctgctgcgcacgctgtggggcaccgccggcaataccacgccgacgccgactcccacacctacgcccacaccgacaccgacgcctacccccacgccgacgcccaccccgggcaccagcaccttcagcaccaaggtgatcgtggacaacagctggaacggcggctattgcaaccgcgtgcaggtgaccaacaccggcaccgccagcggcacctggtcgatcgcggtgccggtcaccggtacggtcaacaacgcctggaatgcgacctggtcgcagagcggcagcacgctcagagccagcggcgtggacttcaaccgcaccctggcagccggcgccaccgccgagttcggcttctgcgccgcgagct

SEQ ID NO: 39811 - DNA, 903 bp, Xanthomonas campestris; identical to SEQ ID NO: 39425

SEQ ID NO: 39812 - DNA, 606 bp, Xanthomonas campestris
gtgatctggctgcatggcctgggtgcggacggcagcgacttcgcgccgatggtgccggaactggtgcgcgcgcagtggccggcgctgcgcttcgtgttcccgcatgcgccaatccgcccgatcaccatcaacaacggcgtgcgcatgcgcggctggtacgacatcgtcggcatggactttgcccagcgcgcggacaaggtcggcatcgccgagtcggtggcccaggtcgaggccttgattgccaacgaacaggcgcgcggcattgcgcccgagcgcatcctgctggccggcttctcgcaaggcggcgccgtcaccctggcggtgggcctgcagcgtcgcgtgccgttggccgggttgatcgccatgtccacctatctgcccgatccggccgccgccgccagccaactgcagccgggcgcgctggcgcaaccactgttcatggcgcatggcagcgccgacccggtggtgccttaccgcgccggcgagcagagtgcgcaggccctgcaggcactggggttcatgctggaatggcatagctacccgatgggccaccaggtctgcgtggaagagatcgacgccctgcgcgactggatgcaggcgcgcttc

SEQ ID NO: 39813 - DNA, 1146 bp, Xanthomonas campestris; identical to SEQ ID NO: 39061

SEQ ID NO: 39814 - DNA, 933 bp, Xanthomonas campestris; identical to SEQ ID NO: 39062

SEQ ID NO: 39815 - DNA, 1425 bp, Xanthomonas campestris; identical to SEQ ID NO: 39063

SEQ ID NO: 39816 - DNA, 1407 bp, Xanthomonas campestris; identical to SEQ ID NO: 39432

SEQ ID NO: 39817 - DNA, 477 bp, Xanthomonas campestris
atgggcgtttcgggcagcggcaagaccaccattgcgcaggccctggccacgcactacggcttccgttttctcgatgccgacgactatcacagcgtggccgcgcgcgcgcagatggcatccgggcaaccgcttaccgatgcgatgcggctgccctgggtggagctgctgtcggcgaccttgcgcgactgcgtgcagagcggtgaatcggtggtgctggcgttctccggattgcgcggcacgcaccgccaattgctgcgccgcagcggggttccgatgcgctttgtgttcctgcatgccgcgccgcacgtgatcgccgcacgcctgagcgcgcgtgcgggccatttcatgccgccgagcctgctcgacagccagctgcagacgctggaactgccgctggacgaagccgacgtggtatcggtggacgtggatgccaccgtgccggaggtggtgcaggacgcgatcgcgcagctggcattg

SEQ ID NO: 39818 - DNA, 1515 bp, Xanthomonas campestris; identical to SEQ ID NO: 39066

SEQ ID NO: 39819 - DNA, 1005 bp, Xanthomonas campestris; identical to SEQ ID NO: 39435

SEQ ID NO: 39820 - DNA, 603 bp, Xanthomonas campestris; identical to SEQ ID NO: 39068

SEQ ID NO: 39821 - DNA, 1251 bp, Xanthomonas campestris
ccgggtgcggtggcgctgccgcgcgataccgatgacgtggtggcgatcgtgcaggcgtgccgcgcgcatggcgtgccgatcgtggcgcgcggcgcgggcaccggcaccactggcgcggcggtaccgttctcgggtggcgtggtggtatcgatggcgcgcatgaaccgcatcctggcgttgcgcccggccgaccgctgtgcggtggtgcaaccgggtgtgctcaatggcgatttgcagcaggccttgcagccgcacggcctgttctggccgccggatccatcgagcgcggagatctgcagcgtgggcggcaacctgtcgaccaatgccggcggcccgcgtgcggtgaaatacggcgccacccgcgacaacgtgctcggcttggtcgcggtgaccggcaccggcgatgtcattcactgcggtggcgcgtacaccaaaaattccactggctacgacctcacgcatttgctggtcggcagcgaaggcacgctggcgatcatcgtcgaagcgacgctgaagctgaccccgcgcgcagtcgcgcaagccggcgtgcgtgcgctgtaccgcgatgccgccagcgcggcggcggcggtgtcgcgcatcatggcgcaacccaccacgccgacgatgctggaattcatggatgccagcgcgattgcgctactgcgccgcaatggcagcgacgtgcccgatgccggcgcgatgctgttgatcgaagccgatggcgatcacgacaccctgccctacgcattgcaggccctgcatgacgcggccgatggcgatggcgtcctcagcctggacatcgccgccgatggcagcgcgcgcgacaaactatgggcggcacgccgtgcgttgtcgccggcattgcgcaccatcaagccgggcaagatcaacgaggacgtggtggtaccggtctcgcgcattcctgagcttgtcgctggtgtggaagcactggcggtggaattcgcggtgccaatcgttgccttcggtcatgccggcaatggcaacctgcacgtcaacatcatgtatgacccggacgacgccgatgaaacggcgcgcgcgcaggcggcactgccgcgcgtgtttgcgctggtactggcgctggaaggcacgctctccggcgaacacggcatcggcgtggccaagcgcgatttcatgacccaggccttcagcgcacccaccctcgcggccatgcgcgcgatcaaggccgcgctggatccggatggcattttgaatccgggcaaggtgctgccc

SEQ ID NO: 39822 - DNA, 1224 bp, Xanthomonas campestris; identical to SEQ ID NO: 39438

SEQ ID NO: 39823 - DNA, 792 bp, Xanthomonas campestris; identical to SEQ ID NO: 39071

SEQ ID NO: 39824 - DNA, 1374 bp, Xanthomonas campestris
atgttccgcgcgtacgacatccgtggcgtggtgggcaaggatctcaaccccggcatcgccgcgctgatcggccaggccatcggcagcgtgatgcaggcgcaaggcctgcgcgacatcgtggttggccgcgatggccgtttgtctggcccggaattgaccaacggcctgatcgaaggcctgcgccgcgccggttgcaacgtcaccgacatcggcctggcgccgacgccggtggtgtacttcggcgcctacgaattgcgcgccggcagctgcgtggcggtgaccggcagccacaatccgcccgactacaacggcttcaagatcgtgatcggcggcgagacgctctccggtgcggcgatcaccgagctgcaccagcgcatcaccgaaggccgcctgcataccgcagccagccccggcgaactggagcagcgcgacatcagcgatgcctacatccagcgcattgccgacgacgtgcagctggaccgcccgatcaaggtggtggtggacgccggtaatggcgcggccggcgagatcgcgccgcgcttgttggaggccatcggtgcggaagtggtgccgctgtattgcgaaatcgacggcacttttcccaatcaccatccagacccgagcgagccgcacaatctcggcgatctggtgcagatggtgcagcgcttcgatgcggatatcggcgtggccttcgatggcgatgccgaccgcctgggcgtggtcaccaaggaaggcgccatcgtcttccccgaccgcctgctgatgctgtttgccgccgatgtgctgcaacgcaatcccggcgcgctggtgatctacgacgtgaagtgcaccggcaagctgtccgactacgtgttgcgcaatggcggcagcccgttgatgtggaagaccgggcattcgctgatcaaggcgaagatgcgcgaaaccgatgccgagctggccggtgaaatgagcgggcacttcttcttcaaggagcgctggtacggcttcgacgatggcatctatgccgccgcgcgcctgctggaaatcctcgcccagcgcgaagagaccccgtccgacgtgctcggcgagctgcccgaaagcgtgtccacgccggagatcaaggtaccgttggacggcgatgcgcatgcgctggtggcccggttcgtggagcgtgcccaggccggcgaggagtcgccgttcgaggccgcgcggttgtccaccatcgatgggctgcgcgcggatttcggcgacggctggggcctggtacgtgcgtccaacaccaccccgatcctggtgctgcgcttcgaagccgacaccgctgtggcgctggaacgcatccgcgcgctgttccgcagcgaactgcaggcgctgctgccggatcacccgctcgcattc

SEQ ID NO: 39825 - DNA, 459 bp, Xanthomonas campestris
  unsure (1)..(459): unsure at all n locations
gcactcgaatgcatccatgtctattcgctgatccatgacgacctgccggcgatggacgatgacgacatgcgccgcggcaagcccaccgtgcacaaggcgttcgacgaggcgaccgcgatcctcgccggcgactgcctccacgatctcgctttcgagctgctcgcgcatgaggcgacgcatgccgacccgttcgtccgtgtcgaactgatttccgaactggcccgttcctcgggccccgccggcatggccggcggccagatgatggatctggaggccgagaaggccagcttcgatctcgccaccgtcacccggctgcaggcgctgaagacgggcgcgctgatcagttgcgcggtcgaatgcagcgcgatcctcggccgcgtgcagcacgccggccgcacgggcctgcgcggctatacgcggaacatcggcctcgccttccagatcgtcgncgccattctc

SEQ ID NO: 39826 - DNA, 2919 bp, Xanthomonas campestris; identical to SEQ ID NO: 39075

SEQ ID NO: 39827 - DNA, 1635 bp, Xanthomonas campestris; identical to SEQ ID NO: 39073

SEQ ID NO: 39828 - DNA, 2298 bp, Xanthomonas campestris
tttccgcacatggtgattccgctgttcgtcggccgtgacaagtcgatgcgcgcgctggaaaaagccatggaggcggacaagcgcatcctgttggttgcgcagaagtcggccgagaccgacgacccggcagcgggcgatctgtacacggtcggcacgctcgcccaggtgctgcaactgctcaagctgcccgatggcacgatcaaggtgctggtcgaagggttgtcgcgcgtcaccgtcgacaaggtggcggaacaggacggcgccttgcagggccgcggcaccgaagtggaagccagcgatgcacgcgagccgcgtgagctggaggcgattgcgcgttcgctgatgtcgctgttcgaacagtacgtcaagaccaaccgcaagctgccgccggaattgctgcagaccctggccggcatcgatgagcccggacgtctggccgacaccattgccgcgcacatcggcgtgcgtttggctgataagcaacgcctgctcgaaatcaccgagatcggcgaccggctggagctgctggttggtctggtcgatggcgagatcgacgtgcagcagctggaaaagcgcatccgcggccgcgtcaagtcgcagatggaaaagagccagcgcgagtactacctcaacgaacagatgaaggcgatccagaaggaactgggcgatctggacgacgcgcccggcgaactggaagaactcgcccgcaagatcgccgaggccggcatgcccaagccggtcgagaccaaggccaaggccgaactcaacaagctcaagcagatgtcgccgatgtctgccgaagctgcggtcgtgcgcaactatctggattggttgctcggcgtgccgtggaagaagcgcaccaaggtccgcaaggatctcaaggttgcgcaggatacgctggatgccgatcactacggtctggacaaggtcaaggaacgcatccttgagtacttggccgtgcagtcgcgcgtgaagcagatgaagggcccgatcctgtgcctggtcggcccgccgggtgtgggtaagacgtcgctgggtcagtcgatcgccaaggcgaccaaccgtaagttcgtgcggatgagcctgggcggcgtgcgcgacgaggccgagatccgtggtcatcgccggacctatgtcggttcgatgccgggccgcctggtgcagaacctcaataaggtcggcagcaagaacccgctgttcctgctggatgagatcgacaagatgtcgatggacttccgtggcgatccgtcatcggcgctgctggaagtgctcgacccggagcagaaccacaccttcaacgaccactatcttgaagtggatctggacctgtcggaggtgatgttcgttgctacctccaactcgctcaatatccccggcccgctgctggaccgcatggaagtgatccgcatccccggctataccgaggatgaaaagctcaacatcgccatgcgctacctggtgcccaagcagatcaaggccaacggcttgaagccggaagagatcgagatcggcagcgatgccatccaggacgtggtgcgttactacacgcgtgagtcgggcgtgcgtaaccttgagcgcgaagtggccaagatctgccgcaaggtggtcaaggaaatcgcattggctggcccgcagccggcggccaagaaggcggtcgcaaagaaggccaagcccaaggcgctggtgacggtgacctccaggaacctggacaagtatctgggcgtgcgtcgcttcgatttcggtcgtgcagaagaagagaacgagattggcttggtgacgggtctggcttggaccgaggtcggtggcgaactgctgcagatcgagtccacgctggtgccgggcaagggcaacctgatcctcaccggtcagctgggcaacgtgatgaaggagtcggcatcggcggccttgtcggtggtgcgctcgcgcgcagagcggctgggcatcgatgtggatttcctgcagaagcaggacgtgcacgtgcatgtgcccgacggtgccacgccgaaggatggccccagcgcaggtatcgcgatggtgacctcgctggtgtcgatcctgaccaaggtgccgatccgtgcggacgtggcgatgaccggcgaaatcaccttgcgcggccgcgtctctgcgatcggcggcttgaaggagaaattgctggcggcactgcgcggcggtatccgtaccgtgttgatccccgatgagaaccgcaaggacctggcggacatcccggccaacgtcacgcgcgatctgaagatcgtgccggtgaagtggatcgacgaagtgctggatctggccctggag

SEQ ID NO: 39829 - DNA, 990 bp, Xanthomonas campestris; identical to SEQ ID NO: 39445

SEQ ID NO: 39830 - DNA, 1020 bp, Xanthomonas campestris; identical to SEQ ID NO: 39079

SEQ ID NO: 39831 - DNA, 1158 bp, Xanthomonas campestris; identical to SEQ ID NO: 39448

SEQ ID NO: 39832 - DNA, 2064 bp, Xanthomonas campestris; identical to SEQ ID NO: 39078

SEQ ID NO: 39833 - DNA, 732 bp, Xanthomonas campestris
acagacagttccaaggtggtcctgatcaccggtgccgcccgccgcatcggtgcgcagatcgccaccaccctgcacggcgccggctaccgcgtggccctgcacgcgcaccgctctggcgatgcattggctgcacgcgtggcggcgctatgcgcccagcgcgcgggcagcgcctgtgcactgcaggccgacctgcgcacgcccgaggcaccggcccagctggtggatgcctgtgtggctgcattcggccgcctggatgcggtggtcaacaatgccagcgcgttttatcccaccgtgctgggcgaggccacgccggcgcaatgggacgagttgttcgcggtgaacgcacgcgctccgttcttcattgcacaggccgctgcggcgcagttgcgcgcgcaccacggcgccatcgtcaacctcaccgatctgcatgccgaacaacccatgcgccagcacccgctgtatggcgcctccaagagcgcgctggaaatgctgacccgctcgctggcgctggagctggcgccgcaggtccgcgtcaatgccgtcgcaccgggcgcgatcctgtggccggaagacggcaaggccgacgccgccaagcaggcactgctcgcgcgcacgccgctggcgcgcatcggcacgcccgaagaagtggccgaggccgtgcgctggttgctggacgatgccagcttcatcaccggccataccttgcgcgtggacggcggccgccggctcagc

SEQ ID NO: 39834 - DNA, 912 bp, Xanthomonas campestris
atggaactgggtatggtgggactgggccgcatgggcgccaacatggccgagcggctggtgcgcggcggacatcgcgtgcatgggttcgatctgggcgctgccgcacgcaccagtgcgcaatccaaggggatccagacaaccgacgcgctggccacgctggtctccgcactgccgagtccgcgcgtggtgtggctgatggtgccggccggcaagatcgtcgacgacacgctggcgcagctgctgccgttgctgcaggccggcgacatcgtcatcgatggcggaaattcgtactacaaggattcgcagcgccgcgctgcgcagctgcagtccagcggcattgcatttgtcgattgcggcaccagcggtggcgtgtggggcctgcaggaaggctacagcctgatggtgggcggcgacgaagcggccgtgaccacgttgcatccggtgctggccacgttggcaccggcgccggacaagggctggggacgggtgggcccgagcggtgccggccacttcaccaagatggtccacaacggcatcgagtacggaatgatgcaggcctatgccgaaggcttcgcgctgctgcagcacaagaccgatttcgcactggacctgcaccaggttgccgagatctggcgcgatggcagcgtggtgcgttcgtggctgctggacctcaccgccgatgcgctggcgcacaacccgaccatgggcggcattgcgccgtatgtggccgattccggcgaaggccgttggacggtggcagaggccatcgacctggaagtctccgcgccggtgatcaccttgtcgctgatggagcggttgcggtcgcgcgacaaggattcgttcaccgataaattgctggcggcgatgcgcaatcagttcggtgggcatgcggtgctgaccaccacgccaacc

SEQ ID NO: 39835 - DNA, 897 bp, Xanthomonas campestris; identical to SEQ ID NO: 39451

SEQ ID NO: 39836 - DNA, 753 bp, Xanthomonas campestris
ctgatgcgtcgaaagatcgttgctggaaattggaagctgcatggcacgcgtgccttcgccaccgaactggtggcgcaggtggccgcgcacatgcccctggcgggtgtcgatgtcgtcatcctgccgcccttgccgtatctcggtgatctgatcgaggacttcgaggcccaccacctggcattcggtgcacaggacgtcagtagcaacgagaagggcgcctacaccggtgaagtgtccgcctcgatgctggtggatgtcggtgccgaatacggcctggtcgggcattcggagcgccgtcagtatcaccaggaaagcagcgagctggtcgcgcgcaagtttgccgccgcgatgcatgccgggttgatcccggtgctgtgcgttggcgaatcgctggaacagcgcgaggccggtcacactgaggcaatcctacgtgcccagttggagccggtcctgagcttggtcggcagtgccggattcgcccgcgccgtggtggcctacgagccgatctgggccatcgggaccgggcgtaccgccacgccggaccaggcccaggccgtacacgccttcattcgtggcgaagtcgcgaaggcggatgctagaattgcggattcactgcccatcctgtacggggggagtgtcaagcccgacaacgccagcgagctgtttttccagcccgacgtcgacggtgggctggtcggcggcgcatcactggttgccgaagacttcctggccatcgcgcgtgcggcggccgct

SEQ ID NO: 39837 - DNA, 1785 bp, Xanthomonas campestris; identical to SEQ ID NO: 39453

SEQ ID NO: 39838 - DNA, 1122 bp, Xanthomonas campestris; identical to SEQ ID NO: 39086

SEQ ID NO: 39839 - DNA, 2460 bp, Xanthomonas campestris
gccacgctgccgtacaccgcgcgtgtgcatgccgaaaacctggtgcgccgcgccgatccgcaacacgtggacgcttatctgcggcagttgatcgagcgcaagcgcgacctggatttcccgtggttcccggcgcgcgtggtgtgtcacgacatccttgggcagaccgcattggtggatctagccggtttgcgtgatgccattgccgagcagggtggtgacccggcgcaggtcaatccggtggtgccggtgcagttgatcgtggatcactcgctggcggtggaatatgccggcttcgacaagcaggcctttgccaagaatcgtggcgtggaagaccgccgcaacgcagaccggtttcacttcatcgaatggaccaagcgggcattcgagaatgtggaagtgatcccgccgggcaacgggatcatgcatcagatcaatctggaaaaaatgtcgccggtgatctacgtgcaggacggcgtggcgtttccagatacctgcgtgggcaccgacagccacaccccgcacgtggatgcgttgggcgtgattgccgtaggcgttggtggcctggaagcggagaacgtgatgctcggccgcgcttcgtggatgcggctgccggacatcattggcgtggagttgctggggcggccggcgccgggtatcaccgccaccgatatcgtgctggcgctcaccgaattcctgcgccagcagcgcgtggtgggcgcgtacctggagttctacggtgcgggtgccagtgcgctgaccatcggcgaccgcgccaccatttccaacatgacgccggagttcggcgccaccgcggcgatgttctacatcgaccagcagacgctggactacctgcgcctgaccgggcgcgaagacacgcagattgcgctggtggaaacatatgcccgccagaccggcttgtgggccgacgatctggtcaccgcgcagtacgagcgcatgctgcagttcgatctgtccagcgtggtgcgcaacatggccggcccgtcgaacccgcacaagcgtgtggcgaccagcgagctggccagccgtggcattgccgctgcgtgggagcaggtgcccgggcagatgcccgatggtgcggtcatcatcgcggcgattacctcgtgcaccaatacctccaatccgcgcaacgtcatcgccgctggcttgctggcgcgcaatgcgaatgcgcgcggtcttacgcgcaaaccatgggtgaaaagttcgctggcacctggctccaaggcggtgcagctgtacctggaagaggccggcttgcttggcgagctggagcagctgggcttcggcatcgtggcgttcgcttgcaccacctgcaacggcatgagcggcgcgctggacccggtgatccagcaggaaatcatcgagcgcgacctgtatgccaccgcggtgttgtcgggcaaccgcaatttcgatggacggatccacccgtacgcgaagcaggcttttctcgcatcgccgccgttggtgattgcctatgccatcgccggcacggtgcgcttcgatatcgagaaggatgtcctgggcgtggatgccgagggtgtgccggtcacgctcaaggacctgtggcccagcgatgcggagatcgatgcggtggtcgcgcgcagcgtgaagccggagcatttccgcagcgtgtacgagccgatgttcaggcgcagtggcctgcagggtgcacgcgtcagcccgttgtacgactggcgcgcgcagagtacctacatccgccgcccgccgtattgggagggcgcgctggcaggtgcgcgcaccttgcagggcatgcgcccgctggcggtgttgggcgacaacatcaccaccgatcatctgtcgccgtccaatgcgattcttgccagcagtgcggccggtgaatacctcacccagatgggcgtgccggaagaagacttcaattcctacgccacccaccgcggcgaccatctcaccgcgcagcgggcgacctttgccaaccccaagctggtgaacgaaatggcagtggtcgatggccaggtcacggccggttcgctggcgcggctggagccggaagggcaggtgctgcgcatgtgggaggcgatcgaaacctacatgcagcgcaagcagccgctgatcatcattgccggtgccgattacgggcaaggctcgtcgcgcgattgggcggccaagggcgtgcggctggccggtgtggaggcgatcgtggccgaaggcttcgagcggattcaccgtaccaacctgatcggcatgggcgtgttgccgctggagttcaagccggggaccgaccgcaagatgctgggtatcgatggcagcgagacgttcgatgtggtcggcgaacgcaccccgggcgcaacgctgacgctgtcggtgcatcgacgcgacggcgagcagctgcaggtgccggtgacctgccgcctggataccgcagaagaagtgtcgatctacgaggcgggcggcgtgctgcag

SEQ ID NO: 39840 - DNA, 822 bp, Xanthomonas campestris
gatggtcgccgcattgccgaggaattgctcgacggtctgaagctgcgcgtggatgcgcgcttggcggcgggcaagacccggcccgggctggcggtggtgctggtgggcggcgatccggcctcgtcggtgtatgtgcgcaacaagcgccgtgcggccgaaaaagtgggcatcgaggccttcgactacgacctgccacaaggcaccaccgaagccgagctggccgcgttgatcgaccaactcaacaccgatcccaagatccacggcatcctgatccagttgccgctgccgggcattcccgatgccaaccggttgatccagcgcatcgacccgcgcaaggacgtggacgggttccatccgcagaacgtcgggcatctggcgctgcgcgaattcggtttgcggccgtgtaccccgcgcggcatcgtgaccttgctggcgcataccgaccagccggtgcgcgggcgcaacgccaccatcgtcggggtgagttaccatgtgggccgcccgatggggctggagctgctgattgccgggtgcacggtgaccagctgccacaagttcaccccgccggatgtgctggaagccagcgtgcgcaacgccgacatcctggtggtggcggtgggccggccggggctgattccgggcgaatgggtcaagcctggcgcggtggtcatcgacgtgggcatcaaccgcctggacgatggacgcctggtcggcgatgtggggttcgaggccgcagcgcagcgcgccggctggatcaccccggtgccgggcggggtggggccgatgacggtggccacgctgatgcagaacacgctcgaggcg

SEQ ID NO: 39841 - DNA, 888 bp, Xanthomonas campestris
atgagcaagcgtattcgcaaggccgtattccccgtcgcaggtcttgggacccgctttcttccggcaaccaagacggtgccgaaggaaatgctgccgatcatcgataaaccgcttatccagtacgccgtggacgaagccatccaggccggttgcgatacgctgatcttcgtcaccaatcgctacaagcactcgatcgccgactacttcgacaaggcctatgagctggaacagaagctcgagcgcgcaggcaagctcgagcaattggagctggtgcgccatgcactgcccgaaggcgtacgcgccatttttgtgacgcaggccgaagcactcggcctgggccacgcggtgctgtgtgccaaggccgtggtcggtgacgaaccgttcgcggtgctgctgccggacgacctgatgtggaaccgcggcgatgctgcgctgacccagatggccgatgtggcagaagcctccggcggcagcgtgatcgccgtggaagatgtgccgcacgacaagacggccagttatggcatcgtgtccaccgatgcgttcgacggccgcaagggccgcatcaatgccatcgtcgaaaagcccaagccggaagtggcgccgagcaatctggcagtcgtcggtcgttacgtgctcagcccgaagatcttcgagtacctggagtccacgggcgccggtgcaggtggcgagatccagctcaccgatgcgatcgccgagctgctcaagcaggaacaggtcgacgcgttccgtttcgagggccgtcgcttcgactgcggcgcgcacatcggtttgatcgaggccacggtgcactttgcgctcgagcacgacaagcatggcgcaccggccaaggaaatcattcgcagcgccttggctgcggctgacgcacgc

SEQ ID NO: 39842 - DNA, 1096 bp, Xanthomonas campestris; identical to SEQ ID NO: 39459

SEQ ID NO: 39843 - DNA, 1008 bp, Xanthomonas campestris; identical to SEQ ID NO: 39460

SEQ ID NO: 39844 - DNA, 618 bp, Xanthomonas campestris; identical to SEQ ID NO: 39461

SEQ ID NO: 39845 - DNA, 828 bp, Xanthomonas campestris; identical to SEQ ID NO: 39458

SEQ ID NO: 39846 - DNA, 1734 bp, Xanthomonas campestris
gtgtggcgcttttacctgcattatctgcggccgttgtggccaattctgttggcgaccttgatcgccggactactgctggcgctggtggaagtggcgatgttcgacttcctcggccgcatcgtcgacatgctggccgagcagccggggccggagttcttccgtcgccatgctggcgagctggtgtggatggcggcgatcacgctggtggcgcggccgtttttcaccgggctgcataacctgctggtcaatcaggccatcgtgccgggcctgagcaaccgttcgcgctggctgatgcacaactacgtggtgcgccagagtctggcgttcttccacaacgattttgccgggcgtatcgccaaccgcgtgatgcagaccggcacctcgctgcgcgaatcggcggtgcagatggtcgatgcactctggtacatcgtggtctataccggcagcgcactgtggttgttcgcgcaggccgacccgtggttgatggtgccgctgctgtgttggctggtggtgtatgtggggttgatggcgttcttcgtgccgcgcatgaaggcgcgtgcgtgggtggcatcggacgcgcgctccaaggccaccggccgcatcgtggacggctacaccaatatcgccacgctcaagctgttttcgcatgcgcgccgcgaagaggcctacgtgcgcgatgcgatcgacgagctggcggtcaagcatcgcctgcagacgcgcgtgaccaccgcaatggacaccgccatcgccatcgccaacggcttcctgatcgtgggcacctgtgggctggcgttgtggctgtggagccgcggccagatcagcgtgggcgccattacgctggccaccgggctggtgatccgcatccacaacatgtccggctggatcatgtggacggtgaacggcattttcgaagacatcggtagcgtgcaggacggcatgcagaccattgcccagcccctgacggtgcaggaccagcccaccgcgctgccgctgcaggtgacacgcggcgccgtgcatttcgaccagatccacttccattatggcaagcgcggcggtgtgatcgccgggctcgacctgcgggtgcgcgccggcgaaaagatcggtctggtggggccctccggcgcaggcaagtcgacgctggtcaacgtgctgctgcgcctgtacgacctggagcaggggcgcatcctgatcgatggccaggacatcgcccaggtcacgcaggaaagcctgcgcgggcagatcggcctggtcacgcaggacacctcgctgctgcaccgttccattcgcgacaacctgctgtacggccgcccgcaggccaccgaggcgcaactgctggacgcagtgcacaaggcgcgtgcggatggctttatcgacacgctggtggatggcgaaggccgccgcggtttcgatgcacatgtgggcgaacgcggggtcaagttgtcgggtggccagcgccagcgcatcgccatcgcacgcgtgctgctgaaagacgcgccgatcctgatcctggacgaagccacctcggcgctggattcggaagtggaagcggccatccaggacagcctggatgcgttgatgagtgacaagaccgtcattgcgatcgcgcatcggctctccaccatcgcgcgcatggatcgcctggtggtgatggatggtgggcgcatcgtcgagacaggcacgcatgcggaactgatcgcgcacggcggcctgtacgcccggctatgggcgcggcag

SEQ ID NO: 39847 - DNA, 1032 bp, Xanthomonas campestris; identical to SEQ ID NO: 39463

SEQ ID NO: 39848 - DNA, 1323 bp, Xanthomonas campestris; identical to SEQ ID NO: 39465

SEQ ID NO: 39849 - DNA, 3480 bp, Xanthomonas campestris; identical to SEQ ID NO: 39466

SEQ ID NO: 39850 - DNA, 2394 bp, Xanthomonas campestris; identical to SEQ ID NO: 39100

SEQ ID NO: 39851 - DNA, 1083 bp, Xanthomonas campestris; identical to SEQ ID NO: 39470

SEQ ID NO: 39852 - DNA, 1521 bp, Xanthomonas campestris; identical to SEQ ID NO: 39101

SEQ ID NO: 39853 - DNA, 345 bp, Xanthomonas campestris; identical to SEQ ID NO: 39471

SEQ ID NO: 39854 - DNA, 1203 bp, Xanthomonas campestris; identical to SEQ ID NO: 39472

SEQ ID NO: 39855 - DNA, 2022 bp, Xanthomonas campestris; identical to SEQ ID NO: 39473

SEQ ID NO: 39856 - DNA, 1875 bp, Xanthomonas campestris; identical to SEQ ID NO: 39474

SEQ ID NO: 39857 - DNA, 1518 bp, Xanthomonas campestris
cctgggacgaaatgcccagcgactccgtcacaccgcgccgcgcacgaatcgggcgggcacaatctctcgctggccagcccatatggatgcgctatccaatgcaagatcagtgagactacgggcctgcacctgggacgatacacaccaccaatgacgcgctgcgagctttgcctgaacaccgtattgatcaagcgctacgcgcggctgatggggatctgactgaacgtggggtgcatcccgtccaaagcgctgctgcacgccgctgcggtcatcgatgaagtggctcacgccggcgacttcggcgtggacttcggccagcccaagatcaccctggacaagctgcgcgagtacaaggaaaaagtggtcggcaagctcaccggcggcctggccagcatggccaagcagcgcaaggtgcgcaccgtcaccggcgtggccagctttgtctcgccgaacgagttggagatcgtcggcgacgacggcaagacccaactgctgcgctttgagcactgcgtcatcgccgccggttcgcaggcggtgaagctgccgaacttcccgtgggacgacaagcgcgtgatggactccaccgacgcgctggaactgcacgacatccccaagaccctgctggtagtcggcggcggcatcatcggcctggaaatggccacggtgtacagcgcgctgggcagcaaggtcaccgtggtggagttcatggaccagctgatgccgggcgccgacaaggacctggtcaagccgctggccgatcgcctgaagaagcagggcgtcgaggtccatctcaagaccaaggccaccgacgtcagcgccgatgccaagggcatcacggtgtcgttcgaagcggcctccgaaggcgaaaagcctggcctgcaggccaccgccttcgatcgtgtgctggtcgcggtgggtcgctcgcccaacggcaagaagatcggcgctgaaaaggctggcgtcactgtcaccgaacgcggctttatcccggtggaccggcagatgcgcaccaacgtgccgcacatcttcgccatcggcgacatcgtcggtaacccgatgctggcgcacaaggccacccacgagggcaagctggccgccgaagtggctgcaggcgagaagaaggaatgggtggcgcgggtgattccgtcggttgcctataccaatccggaaatcgcctgggtgggcgtcaccgaaaccgaggccaaggccaagggcttgaaggtgggcgtggccaagttcccgtgggccgccagcggccgtgcgatcggcatcggccgcaccgagggcttcaccaagctgatcttcgacgaagacacccaccgcatcattggtggtgcgatcgtcggcgtgcatgccggtgatctgctggccgaaatcggcctggccatcgagatgggcgccgaagccgaagacattggccacaccatccatgcgcacccgaccctgagcgagtcggtcggcatggcggccgaggtgtacgacggcaccatcaccgatctgtacattcccaagaagaag

SEQ ID NO: 39858 - DNA, 1533 bp, Xanthomonas campestris; identical to SEQ ID NO: 39108

SEQ ID NO: 39859 - DNA, 861 bp, Xanthomonas campestris; identical to SEQ ID NO: 39109

SEQ ID NO: 39860 - DNA, 1392 bp, Xanthomonas campestris; identical to SEQ ID NO: 39110

SEQ ID NO: 39861 - DNA, 1830 bp, Xanthomonas campestris
atgtgcggcattgtcggcgccatcgccgggcgcgacgtggttccggtcctcatcgaagggctcaagcgtctggagtaccggggctatgattcctccggcatcgcggtgctggacggcacgcaggtacgccgcgtgcgccgcactggtcgggtggcggaaatggcccaggcggcgcaggccgagcagttcggcgcgaccctgggcatcggccatacccggtgggccacccatggcggcgtcaccgaagccaatgcgcatccgcacatcagtgccggcgtggcgctggtgcacaacggcatcatcgaaaaccacgaggagcagcgcgaaaagctgcgcgcgctcggctacaccttcgagtcgcagaccgataccgaagtcatcgcgcatctgatccatcaccatcttgccgatgcgggcgatctgctcagcgcgctgcagcgcacggtgaaggaactcaccggcgcctacgcgctggcggtgatgagccaggccgagccggagcgcttcgtctgcgcgcgcatgggctgcccattgctgatcggcgtgggcgagggcgaaaacttcgtcgcctccgatgtctcggcaatcgtgcaggccacccggcaagtgatctttctggaagagggcgacaccgccgaattgcgccgcgatggcgtgcgcgtgttcgacgcgagcgacgcggcggtggagcgcccgctgcacctgtccgatgtctcattggcctcgctggagctgggcccgttccgccacttcatgcagaaggaaatccacgagcagccgcgtgcgctggccgacaccattgaggcggcgatcgatgccaagggcttccccgcatcgttgttcgggcccactgccgatgcggtgctgcgcgacatcgaaggcgtgcagatcctggcctgcggcaccagttactacgccggcctgacggcgcgctactggatcgaagcgatcgccggcttgccgtgcagcgtggagattgccagcgaataccgctaccgcactgcctatgccaacccgaagcatctgatcgtcaccatctcgcagtccggcgaaacgttggacacgatggaagcgctcaaatacgccaagtcgctcgggcatctgcacaccttgtcgatctgcaacgtgccggagagcgccatcccgcgcgccagcgagctggtctgctacacgcgcgccggtgccgagatcggcgtcgcttcgaccaaggcgttcaccacccagctggcggtgttgttccagctgaccatggtgctgggcaagctgcagggccgcatcagcgacagcgaagaagccgattacctggagcagctgcgcttcctgcccggtagcgtgcagcacgccttgaacctggagccgcagatcatggcctgggccgagcgtttttccccgaaagagaatgcgctgttcctcggccgcggcctgcattacccgatcgcgctggaaggtgcgctcaagctcaaggaaatctcctatatccacgccgaagcctacccggctggcgagttgaagcacggcccgctggcgttggtggatgccaccatgccggtggtggtgattgcaccgaatgaccggctgctggaaaaggtcaaatccaacatgcaggaagtgcgcgcgcggggtggcgaactgttcgtgttcgccgatcaggacagccatttcagcgagtccgacggcgtgcatgtgatccgcacaccgcgccacgccggcgtgttgtcgccggtgatccacaccatcccggtgcagttgctggcttatcacaccgccctggcacgcggcaccgacgtggacaagccacggaatctggccaaatcggtgacggtggagtaa

SEQ ID NO: 39862 - DNA, 1173 bp, Xanthomonas campestris; identical to SEQ ID NO: 39480

SEQ ID NO: 39863 - DNA, 705 bp, Xanthomonas campestris
gcgctggtcaccggcggtagcggcgatcttggcggtgcgatctgccgtcagctggccgcgcagggccggcacgtcattgtgcatgccaatcgcaatctcgcccgggccgaagaggtggtggcgtccatcgtggccgcgggcggcagtgccgaagcggtcgccttcgatgtggccgatgcgcaggccagtgcggatgcattggcggcgttgctggaggccgggccgatccacatcgtggtcaacaacgccggcatccacgacgatgcgccgatggccggcatgaacgcgcaacagtggcatcgggtcatcgatgtgtcgctgcacggcttcttcaatgtcacccaaccgctgctgctgccgatggcgcgcgcgcgctggggccgcatcgtcagcgtgtcgtcggtggcggcggtgctgggcaatcgcggccagaccaattacgccgctgccaaggccgcgctgcacggcgccagtaaatcgctcgcgcgcgagatggccagccgcggcatcgccgtcaacgtggtcgcaccgggcgtgatcgaaagcgagatggtcggcgacagcttcgcgccggaactgatcaagcagatggtgccggctggccgcgttggcacacccgacgaagttgccgcgctggtggcgttcctgtgctcggatgttgctggttacatcaacggccaggtgattggcatcaacggcggcatg

SEQ ID NO: 39864 - DNA, 2679 bp, Xanthomonas campestris; identical to SEQ ID NO: 39482

SEQ ID NO: 39865 - DNA, 1209 bp, Xanthomonas campestris; identical to SEQ ID NO: 39483

SEQ ID NO: 39866 - DNA, 2184 bp, Xanthomonas campestris; identical to SEQ ID NO: 39116

SEQ ID NO: 39867 - DNA, 876 bp, Xanthomonas campestris
gtacgtgactatctgaccgatctgcaggaccgcatctgcgccgccgtggaagccatcgatggcaaggcgcggtttgctgaggacctgtggcagcgcgcggaaggcggcggtgggcgcacccgcatcctgcgcgacggtgcggtgttcgaacaggccggcatcggcttctccgacgtgtccggcgcgcggctgccgccctcggccagcgcgcatcggcccgagctggccggcgccacctggcgtgcctgcggggtgtcgctggtgttccacccacacaatccgcacattccgaccacacacgccaacgtgcgctatttccgcgccgagcgcgatggcgagatggtggcggcctggttcggcggcggcttcgacctgaccccgttctacccggtcgacgaagacgtcatgcactggcaccgcaccgcacaggcgctatgcgcgccgtttggcgaggagcgttacgccgcgcacaagcgttggtgcgacgagtacttcttcctgcgccaccgcaacgagacccgcggcgtgggcgggctgttcttcgacgacctgggccaggacttcgaacgcgacttcgcctaccagcgcgcggtcggggacggcttcctggacgcctacctgccgatcgtcgaacgccgcaaggacacgccctacggcgaggctgagcgcgccttccagctgtaccggcgtggccgctacgtggagttcaacctggtctacgaccgcggcaccctgttcggactgcagagcggtggccgcgccgagagcatcctgatgagcctgccgccgcaggtgcgctgggaatatggattccagccgcaaccgggaagcgccgaggcacgcttggccgattatttgattccgcgtgattggctc

SEQ ID NO: 39868 - DNA, 627 bp, Xanthomonas campestris; identical to SEQ ID NO: 39486

SEQ ID NO: 39869 - DNA, 1917 bp, Xanthomonas campestris
ttgaccaagaatctgctgctatgggtggtcgtcgcggttgtgttgatggtcgtcttccagagcttttcgccgcgcatggccggcggagtgggccctgactcgatcacctacacccagttcctgaaggaagtggattcgggccgggtgaagtcggtggattacaccgatgagaccaacttggccgtcaacgcgatccgcttcaagcgcaccgacggcagcgaagccaccgtctacggtccgcgcgacgacaagctggtcgacgtgctgtacagcaagaacatcgaaatgacccgccagaagccgtccaccgggccgggcttctggtcgctggtgctcaacttcctgccggtcatcctgatcatcggcttctggctgttcatcatgcgccagatgcagggcggtggcggcggcgccaagggggcgatgagcttcggcaagtcgcgcgccaagctgcagggcgaagaccaggtcaaggtcaccttcgctgacgtcgcaggctgcgatgaagccaaggaagaagtgggcgagctggtcgacttcctgcgcgatcccaccaagttcaccaagctgggtggcaagattccgcgcggcgttttgatggtgggcccgccgggtacgggcaagacgttgcttgccaaggcgatcgccggcgaagccaaggtgccgttcttcagcatctccggttcggacttcgtcgaaatgttcgtgggcgtcggcgccagccgcgtgcgcgacatgttcgagcaggccaagaagcatgccccgtgcatcatcttcatcgacgaaatcgatgcggtgggccgtcatcgcggtgccggtctgggcggcggtcatgacgagcgcgagcagaccctcaaccagttgctggtcgagatggatggctttgagggcggcgaaggcgtgatcgtgattgctgcgaccaaccgtcctgacgtgctggatccggcgttgctgcgtccgggtcgcttcgaccgtcaggtcgtggtcggcctgccggacgtcaagggccgcgagcagatcctgcgcgtgcacatgcgcaagctgccgctggccgacgacgtcgtgccgctggtgattgcacgtggtaccccgggcttctccggtgccgatctggccaatctggccaatgaggctgcgttgtttgccgcacgtggcaacgagaaggaagtccgcatggaccacttcgaccgtgcacgcgacaagatcctgatgggtgccgagcgccgctcgatggccatgagcgaggacgagaagaccctgactgcgtatcacgaggctggccacgccatcgttggtcgcctggtgcccgagcatgacccggtctacaaggtcacgatcattccgcgtggtcgcgccctgggcgtgacgatgtacctgccggaaggtgaccgctactcgatgaatcgcgtggcgatcgaatcgcagctgtgctcgctgtatggtggccgcgttgccgaagagctgatcttcggtggcgacaaggtcaccaccggtgcgtccaacgacatcgagcgcgccaccaagatggcccgcaacatggtcaccaagtggggcctgtccgacgaactcggcccggtggcctacggcgaagaagaggacgaggtgttcctgggccgttctgtcacgcagcacaagaacgtctcggatgagaccgcacgcaagatcgatgaagtggtgcggtcgatcctggacaaggcgtacagcaagaccaagaccatcctcacggagaatctggacaagctgcatgcgatgtcgcagctgctgctgcagtacgagaccatcgacgtgccgcagatcgacgccatcatggaaggccgcgacccgccgccgccggctggctggggcaagtccgacaaggacggtggcaacaacaacgacaagggtagcccgcgtccgttgccgccgatcgcaggtcct

SEQ ID NO: 39870 - DNA, 702 bp, Xanthomonas campestris
gtggttgccggctcgaccggcgaagcggcggcactgagcgacgacgagtacgacacgctagtgcgtgcggccgtggcacaggtggccggtcgtgtgccggtactggctggcaccgggctctccggtaccgcaaaaaccatcgcgcagacccgccgtgccgccacgctgggcgcgcagtacgcgctggtggtgacgccgccttacgtgcggcccacccaggccggcctgctggcgcacttccaggcggttgccgacaacggcggcctgccggtgttgctgtacaacgtgccgggccgtaccggctgcgacctgctgccggaaacggtcgccgcgctggtgagccacccgaacatcgtcggcatcaaggaagcgcgcagcgaaccggagcgggttgccgcgctggtggccatgcgcagcgacagcttcgtggtgctcagcggtgacgacggcagcgccgcccagtcaatgctggccggcgccgacggcctggtgtcggtggcgtccaacgcgctgccgtcggcctaccgccggctctgcgatctggcccgcactggtcagcacgaggccgccaacgcctgggacacgcgtctgagcgagtaccacagcttctgcggcatcgaatccaatcccatccccgtcaaggcgctgctgcagcgcgccgggatcggccacggcctgcgcttgccgttgctgccactttcc

SEQ ID NO: 39871 - DNA, 1783 bp, Xanthomonas campestris; identical to SEQ ID NO: 39121

SEQ ID NO: 39872 - DNA, 1701 bp, Xanthomonas campestris
caggtcacacgcggcagtggcagtttccacatcggtgccggcacggtgatttcgatcgtcggtggcgatgccgatgcacgccgcagcgccgaatatctcgccgagctgctcaagcgcacgcgcggcctctcgctggaagtgcgcaacgaaaccagcgcatcgccgggcagcatccgcctggaacgcagcgcgcaggcaccggtagcgcagaaggaaggctatagcctggatagcgacgcgaagggcctccgcatccaggcgcgtgatggcgccgggttgttctacggcaccgtgagcgcgtggcagttgatgaccccggatgcgcgcaagggcgatgtcgaggtaccagcggtggccatccgcgactggccgcgtttcagctggcgcggccagcatctggatgtggcgcgccacttccacgacgtggcaacggtcaagcacgtgctcgacacgatggccgtgcacaagctcaacgtgctgcactggcatctcaccgatgaccagggctggcggatcgagatcaagcgctaccccaagctcaccgaggtgggtgcatggcgcacgccgccgggcgcgggccagcacggcacaccggagcgctatggcggcttctacacgcaggaacagatcagcgaagtggtggcctacgcggcgcgcctgcacatcaccgtgctgcccgagctggatatgcccgggcatgcgcaggcggccgttgccgcctaccccgaagaggtgggcgtccccggtgtgcgcacccaggtgggtgtggactggggcgtcaacccgtacctgttcaacaccagcgaacgcagcctgaccttcatcaccaatgtgctggatgaagtgctcacgctgttcccgtcgacctacatccacatcggcggcgatgaggcagtcaaggaccaatgggaagcctcgccggccgttcgcgcacagatgcgcaagctcggcgtcaaggacgcacacgcgatgcaaggctggttcaacgaacagctggcccagtacctcacccagcatggccggcgcatgatcggctgggacgaaatcctcgaaggcggcgtgccggccagcgcggccgtgatgtcctggcgtggcatcgaaggcgcggtgaccgccgccaagcaaggccacgacgtggtgctggcaccgggcgattcgctgtatctggacaacctgcagaccacgcgcagcgatgaacccaacggccgcctgaccacgctgccgctctcgaaggtctacgcgttcaacccggtgccggccgcgctcaatgccgagcaggccaggcatgtgctcggcgcgcagggcgcgttgtgggccgaatacattccctcgcgctggcacgtcgaccacgcgctgttcccgcgcctggcagcggtagccgaagtgacgtggtcgccgatggccgcgcgcgactggaagaatttcctggcgcggatgccggcgcagctgcagcgttatcaggcgctgggcatcgattacagcgatggcgcgtttgccgccgacatcgatctggacggcgacgtcaacgcggtactggccggtggcccggccaaggtatcgcttggcaaccagagcggcgccggcagcctgcactacaccgtggatggcagcgaccccacgccggatgcaccgcgctacacggcgccgttcgcgattcagctgcccaccaccgtcaaggccacagccttcaccgacgatggc

SEQ ID NO: 39873 - DNA, 933 bp, Xanthomonas campestris; identical to SEQ ID NO: 39492

SEQ ID NO: 39874 - DNA, 798 bp, Xanthomonas campestris; identical to SEQ ID NO: 39491

SEQ ID NO: 39875 - DNA, 1353 bp, Xanthomonas campestris; identical to SEQ ID NO: 39494

SEQ ID NO: 39876 - DNA, 1077 bp, Xanthomonas campestris; identical to SEQ ID NO: 39495

SEQ ID NO: 39877 - DNA, 648 bp, Xanthomonas campestris; identical to SEQ ID NO: 39498

SEQ ID NO: 39878 - DNA, 960 bp, Xanthomonas campestris; identical to SEQ ID NO: 39496

SEQ ID NO: 39879 - DNA, 765 bp, Xanthomonas campestris
cgcggacagcaaccgcaaccgcaggaccggcaatttccggagctgctgcaagatctctatgccactgccaatcaacgccgtgaaggcggcgccgaaacctttgcgccgctggccaacggctggtcgcgtatggacgacagtgcgctgcagcaggccggcatcgatccggcactgctgcacgacgccaaaagcggcttcgatgccgcgttctatcgcaacgatcaaggccaggtggtgttcggtttttgcgggaccgacgaaggcaaggactggaagcacaacattggccagggcctgggcttcgacgatgcgcagtacgcatcggcaatccagctcggcagccaggccaaacaggccttcggcgaccaggtggtgatctccggccattcgttgggcggtggtctggcatcggcatcggccatggtcaacgacattcccgcggtgacgtacaacgcggccggcgtcaacgaccgtaccctcgaacgcgagggcctggatgcatcggcagccaagcagtacgccagcgaggagttgattcgcggctaccacgtcaagaacgaaatcctcacccatctgcaggaagacagcattccgctgaagtggacgatgcccaatgcggctggccaccagatcgaattgccggagccggacccgctgtcgttcgggcagcggctggtacccggcatgatgctcaagcaccgcctggacctgcacgggatggactcggtgatcaaggcgcaggacatgcaatcgcccgaccaggca

SEQ ID NO: 39880 - DNA, 1272 bp, Xanthomonas campestris
ccgttcacggccaaccggcagttcaaggcgcgcccgcgcctgctggcctcggccgcaggcatgtattaccgcgacgtggagggccggcagatcctggatggcaccgcggggctgtggtgctgcaacgccggccatgcgcgcgagcgcatcgtggcggcgatccgcgcgcaggccggcacgctggatttcgcgcccaccttccagatgggctcaccgctgccgttcgccctggccgaacggttggccgcgttggccccgccaggcctgggccatgtgttcttcaccaactccggctcggaggcggtggatagcgcgatgaagatcgtgttggcctatcaccgcctgcgcggcgagggccagcgcacccgcttcatcggccgcgagaaggcctaccacggggtgggcttcggcgggatgtcgatcggcgggctgcccaataaccgcaaatggttcggcccgctgctggccggcaccgatcatctacggcacacgctggatctgcagcgcaatgcgtattcgcgcggcctgcccgctttcggagtggagctcgccgacgacctggaacggctgatcaccctgcacgacgcctccaccattgccgcggtgttcgtcgaaccggtgtccggctcggccggggtgatcctgccgccggagggctatctgcagcggctgcgcgccatctgcgaccgccacggcatcgtgctggtgttcgacgaggtgatcaccggcttcgggcgcgtgggcgaggcgttcgccgcgcagcgcttcggggtgaccccggacctgatcaccgccgccaagggcctgaccagcggcacggtgccaatgggcgcggtgctggtggccgatgcgatccacgatgccttcatgcatgggccgcaggcggcgatcgagctgttccatggctacacctattccggacatccgctggcctgtgccgcagccctggccacgctggacacctacgccgaagaacagctgttcacgcgggcaattacgctggggccgcagtgggaggaggcgttgtacagcctgcgcggactgccgcacgtcatcgacatccgcaacatcggcttgatcggtgcgatcgaactggcgccgcgcgagggtgccccgggggcgcgcggttacgaggtgttcgaacgctgcttccacgagggcggcctgctggtgcgtgtcaccggcgatgtcattgcgttgtcgccgccgttgatcgtcacccctgaccagatcggacaaatgttggagacactggccgcgatcctgcgcaag

SEQ ID NO: 39881 - DNA, 765 bp, Xanthomonas campestris; identical to SEQ ID NO: 39131

SEQ ID NO: 39882 - DNA, 1908 bp, Xanthomonas campestris; identical to SEQ ID NO: 39500

SEQ ID NO: 39883 - DNA, 1407 bp, Xanthomonas campestris; identical to SEQ ID NO: 39133

SEQ ID NO: 39884 - DNA, 1131 bp, Xanthomonas campestris
tccgatgccgagctggcccgcgccagcgcactgcaaaagcgactggtcacgctggattcgcacctggacacgccggccaatctggagcgcggcgatttcgatgtgatgcagggccatgccggcaatcggctgtcgcaggtggactacccgcgcatgctcgaaggcgcgctcgatggcggcttctgggcggtctataccgggcaaggcaatcgcagcgcagccgcgcatctcgatgaccgcgacgccggcctgcagcggctgatgaagatccacaacctgctggccgcgcagccgcaacgcttcgcgctggccaccacgcccgccgatgccgcccgcatcaaggccgccggcaaacgcgtggtgtacatcagcatggaaaacgccagcccgctggtggccgacccgtcgctgttgcgcttttattacgcgcagggcctgcggctgatgagcacggtgcattttctcaacaacgagttcgccgattcggccaccgacccgaaaggggccgagtggaaaggcctgagcccggccggcaagcagctggtgcagcaggcactgggcatcgtgatcgatcaatcgcatgcctccgatgcggtgttcgaccagttgatcgcgctgtcgccggtgccgatcgtgctctcgcacagcggcgcgcgggcggtctacaaccacccgcgcaacatcgacgacgcacgcctgaaggtgctggccgcgcacggcggggtgatccaggtgaattcgtatggcggctatctcatcgacagcggcgccagccccgagcgcaaggccgccgagaaggcgctggccgaccaatacggcggctgggagcatctgaagatgtccgacggcaccgccctgagtgaagcgctcaaggcgctggatgcgcgctacccggtcaagcgcgcgaccgaagaggatttcttcgcgcatctggagcacgtgctcgccgtcgccgggcccgcgcatgtgggaatcggcatggactgggatggcggcggtggcgtggtcgggctggaagacgtctccgacctgccgcgcatcaccgcctggctgctgcgcaagggctatagcgagccgcagatcgccggcatctggggtgggaatctgctgcgggtgatggagcaggcgcag

SEQ ID NO: 39885 - DNA, 1332 bp, Xanthomonas campestris
cgcatcgaccgcctgcccgccagcgccacgctgtggcggctggtcgggctgctggcgctgggcggtttcttcgagttgtacgaccttttccagaccgcctatatcagcccggggctcattcgcgacggcatctttgccagcggcaatgacggcgccttcggcatgtccgatcaagccgcgtttgccgcggcgacctttcttggtctgttcgtcggggccgccctgctcagcccctttgccgatcgcttcggccgccgcctggtgttcaccgtggcgttggtctggtacaccgccgccacggtggccatgggcctgcagagcactgccacggcagtgatcgtgctgcgctttgtggtggggatcgggctgggcatcgaactggtgaccatcgatacctacctgtccgaactggtaccgcgtcacatgcgcggggccgcatttgcgttcgcgtttttcctgcagttcctggcggtgcccagcgtggcgctgagcgcctggctgctggtgccgcacgcgccgctgggtgtcagcggctggcgctgggtggtgttgctgagcggtgtgtttgcgctggcgatctggtggctgcgcagccggctgccggagtccgcacgctggctggcggcgcaagggcggcatgccgaggccgaagcggtgatggcccagctcgaagctgcctgcagccgcgatcttggccgggcgttgccgccgccggaaccggtgcaacgggtcgccgcacccgacagccgtctatccgcattgtggcggcagccctaccgcgggcgtatcggcatgctggtggtgttccagatcttccaggccatcggcttcttcggttttggcaactggctgcctgcgctcatcaacgcgcaaggcgccggggtgaccaagagcctggcgtatgcgtttgcgatttcgctcgcttacccattggcgccgctgttgctgctgcgtgttgcgcatcgctgggaaaacaaatggcagatcagtgcatcggctctgggtgcagtggtatttggcgtgctcttcgcgctacagcacgcgccgctgggcatgattgcctgcggggcgatgattgccttttgcaatgcgtggatgagctttgcctaccacggctaccaggccgaactgttccccacggcactgcgcgcacgtgcggtgggtttttgctattccttcagccggttgtctacggccggcagcagcgtgttgatcggttggctgctggcgcagaccggcagccacggcgtgctggccttcatcgtgatcagcatgactatcgtggccagcgtgattgctgcgttcggcccacgcacgcgcaatcgtgctttg

SEQ ID NO: 39886 - DNA, 1284 bp, Xanthomonas campestris; identical to SEQ ID NO: 39505

SEQ ID NO: 39887 - DNA, 852 bp, Xanthomonas campestris; identical to SEQ ID NO: 39504

SEQ ID NO: 39888 - DNA, 1950 bp, Xanthomonas campestris
gatatcagcgagctgggccctgcagccagcgcgtgccaaaacctggacgagttcgtcaatggcgcctgggccaaggccaatccgattccggccgaccacaccagctggggcatcgacgaactcctgactgaaaaaagcctgctgatccaacgcgagctgcttgaagccgcggcgaaacaggccggtacacaggccccatcgctggaacaaaagatcggcgcgctgtatgcgtccggcatggacgaggccgcaatcgaagccgccggtgccaagccgatccagccgcagctggataagatcgccgcattgcactccggcaaagatgtcgctgcctacatcatcagccggcatggcgaaggcgacgcacaggtctttgcgttcggtgccggtgcagatttccacaatgccgaccagcagattgcgtttacacaggaaggtggccttggcctgccaaccaaggactactacaccggtgcggagcacgcgccaatccgcgcagcctaccttgcctacatcgccaaatcgttcgaactcaccggcacccctgccgcgctggccaagacacaggcaaacgacgtgcttgcgctcgaaacgcgcctggctgccgcatcgctggcccccgtggacgcgcgtgaaccaaagaaccaataccgcctggtcaccctcgccgaggcggacaagctcactccgcactttccgtgggaggattttttcgccacccaaggcgtaccggtcggcagcggcttctcgctcgcgcagccacggttttttgccgcgttcgatcaggcattggctagcgcgcccattgcgcagtggcaggcctacctacgcttccatgcgatcgatgacgcatccacgcgcttgagcaaggcatttgccgataatcgctttgcgttctatggcaagacgctgtccgggcagccagagcagctgccgcgctggaagcgcgtgctgcgttcggtcaacggcgcaatgggcgaaggcgttgggcagctctatgtggccaaggtgttcacgccagatgccaagcaacgcgccagcgaactggtcgacaacgttcgcgcggcgctcaagacacgtatcgaacaggtcgactggatgagtgccgagaccaaggccaaagccttggccaagtggcagaccttcctgcccaagatcggctatccggacacctggcgtgactggtcggggttgcagatcacacccggcgactattacggcaacctgcaggcggctgacacgttcaattatcgctacgacattgcgcagatcggcaaacccaccgatcgcggccgttggtcgatgacgccgcagacggtcaacgcgtattacgacccgatgaccaattcgatcaactttcctgcggcgatcctgcagcctccgtatttcgatgccactgccgacgatgcgttgaactacggcggtatcggcgcggtgatcggtcacgaggccacccatgggttcgacgatcagggcagccaattcgatggtgcaggcaacaacgtcaactggtggacggcagaggatcggcgcaagttcgaccaacgtagcaaccagttggtcaaacagttcgatgcgtatgcgcccctgcccagccatccgaccctgcacgtcaacggcaaactcacccttggcgagaacatcgccgacctgggcggcaccaacgttgcctatgacgcgttgcagaccgccttgcagcagcatccggaacgggccaaggccatcgacggctacagccccgaccagcgctttttccttgccttcgcccgcagctggcgtcaacgcgtccgtgatcaacaacagatggtctatctggcgtcggacccgcacgcgccagccaagctacgcgccatcgcatctccctcaaacatgccgcagttcgccaccgccttcgcctgcaagccgggcgatgcaatggtgcgcccggagaaagaccgcgtggtgatctgg

SEQ ID NO: 39889 - DNA, 1929 bp, Xanthomonas campestris; identical to SEQ ID NO: 39508

SEQ ID NO: 39890 - DNA, 2082 bp, Xanthomonas campestris
atccgccaaggccgcccgttcccacgcggcgccatcttcgatggcaagggcaccaactttgcgctgttttccgcgcacgccacgcgtgtggagctgtgcctgttcgacgaacagggcaacgagagccgtgtcgacctgcccgagtacaccaacgagatctggcatggctatctgcccgacgtaaagcccggccagcgctacggctaccgcgtgcacggtccctatgcacccaccgagggacaccggttcaaccacaacaagctgttgctggatccgtatgcgcgcgaactcgatggcgacctggtgtgggccgatgaattgtatggctacacggtcgggcatcctgatggcgacctgagcttcgacgagcgcgacagcgcgccgttcatgcccaagtgcgtggtggttgaagacacctacgactgggaagacgacgcgcgcctgctcaagccgtggaacgagactgtgatctacgagacccacgtacgtggctacaccatgcgcaacgcgcaggtgccggaagccgtgcgcggcaccttcgccggcctggcgcagccatcggtgctgcagtacatcaaggacctgggcattacggcggtggaactgctgccggtgcatgcgtatctggatgatcagcacctgctggacaagggcctgcgcaactactggggctacaacaccatcagcttcttcgcgctgaagtcgcgccacctttccagcggccatcgcgacgagttccgcgacatggtcaaggcgatgcacaagcaaggcctggaagtgattctggacgtggtctacaaccacactgccgaaggcagcgaactggggccgacgctctcgttcaagggcatcgacaacgccagctattaccgtctcgccgaagacaagcgctactacatcaacgacaccggcaccggcaatacgctcaacctgagcaactcgcgggtgatccagttcgtcaacgattcgctgcgctactgggccggcgaaatgcacgtggacgggttccgcttcgacttggccacgatcctgggccgcgagccgagcgggttcgatcaacgcggtggcttcctggatgcctgcaaccaggatccgctgctgtcggaagtcaagctcattgccgaaccatgggattgcggcccgggcggctatcaggtggggcatttcccgccaggttggtcggaatggaacgacaaattccgcgacaacgcgcgcgagttctggaagggcgaggacggcaagctggcagagtttgctactcgcttcaccggctctgcggacctgttcgaccgccgcggtcgccgcccctgggcatcggtgaacttcatcaccgcgcacgacggttttacgctgcgcgatctggtgagctacaacgagaagcacaacatcgacaacggcgaggacaaccgcgacggttcctccaacgatggctcgtgcaactacggcgaagaaggcgaaaccgacaacgccgacatcctgcaacttcgcgagcggcagatgaagaacctgctcgccacgctactgctctcgcaaggcacgccgatgatgctggccggcgacgagcgggcgcagtcgcagggcggcaacaacaacacctattgccaggacaacgagatcacctggctcgactgggagaacgaccccaccgacggccgcctgaccgacttcgtcaaatcactgaccgcgctacgtaaacgttacccgatcctgtcgcgtggccgcttcctcaacgggcagtacaacgaagaagctggcctgcgtgatctgacctggctcaatccgggcggcaccgagatggacgacgcgcactggaccgatgccggcgcgcgctcggtgggactgctgctggaaggcaaggcgcagacctccggcgtcaaggaacgcggcaacgacgctaccttgctgatcgtgatcaatgcctaccacgagggcgtgaccttcaccctgccctcttccgacgaaccggtgcactggaagcttgcgctctccaccgacgaagcgctggaagtggacagcatgccggccggcgccagcgagttcctggcaccgccgcgcagcatcacggtgttcgagtgcaaggta

SEQ ID NO: 39891 - DNA, 873 bp, Xanthomonas campestris; identical to SEQ ID NO: 39141

SEQ ID NO: 39892 - DNA, 1158 bp, Xanthomonas campestris; identical to SEQ ID NO: 39510

SEQ ID NO: 39893 - DNA, 1980 bp, Xanthomonas campestris
ggcctggcctgcattgcgatgctgctctcctactacggccatgaaacgagccttggggagcttcgcaaccgctttacggtgtcaaccagtggggcaacgctcgcctcgctgattgaaatcgctgacgccaacggactcacgacgcgtccgcttcgcttggagctttacgaactgcccaagctgtcgttgccttgcatggtccacctacaccacgggcactttgtcgtgctgacggctgtgaggggagggcatgttcacatcagcgatcccgcaacgggcgtcaaaaaaatcaagctcgatgagttcgatgagctttttagcggcattgcgttggaggcgcatccgggtccggccttcaagaagatcaagagcgtgccatcggtgtcgcttcgcgatctggcaggctcgcttcggtccctggtgcccgcgttctggggtgtgggcatcttggcgctcttcttggaaggctgtgcgctgattgcgccgcaatatctgagactgaccatggatcaggtgctcagcgtcaaggacgatggtctggtcaccacattggctatcggcttttcgatcgtgctcctggtccagctcgtcttgaccgttgccaggaagtggaccttgctgtggatctcttcgaccactggcttacggtggagcagcaacttgttccgtcacctcgtgtcgctaccccagtcgtatttcgtaaagcggcacaccggggatatttcaagccgcttccagtcgatctactccatccagcagtcactcacgacgaagatgatggaagcggtcatcgatggggtgatgtcttttctcatgttgttgctcttgatgagctacgacgcgccgcttgccttcgccttgttggctttcaccattgcctatgtgggttcgcgctacgcctactacgccaaactgaaagaagccaaccttgatcagatcaacattgatgcacgccggcaaagcttgctctacgaaacggtccgaagcatccagcccatcaagctgttcaacaagtcagcgctctgggcgtcgcgcttcacgaactacagcgcgaaagccaccaatgcaaccatcggggccgagcgtatccgcattgggttcgattctgtccagcttctcatccaaggcctgtgccgcattttcgtgatctgggagggcacacggctggtgctcagtggcgatatgacgatcggggtgctgacggtctttttgatctacgcgacccagttcagccaacgcagcatcaatttggccgactacttgatgcagctccggctgcttcgcttgcacaccgagcgcatttcagacatcacgcacagcgagcctgagtcgtttctgcatggcaacggcgcgctggaggatgctgcgccagctattgccattgccaacggctacttccgctactcgtctacggacaagtggatcatgagcgctttgcagctcagggccccggcaggccaagtgattgcaattgtcgggaactcaggcgtgggtaagaccacactcatccgcgttctggcggggcttgaagatcttcaagttggggacttcttagtcaatggagaggatctgcgcaaagtcggtaagtcgagctaccggagcaaggtcagcatcgtcatgcagggagacaatctgttgtccgggacgttgtcggaaaacatctccatgttcgatgagcacattgatcaagagcgtcttgtgcaggctgcgaaattggcatgcatccacgacgatattcagcgcatgccaatgggcttcaacaccagagtcggcgacttgggaaacacgctgtcaggcggtcaaaaacaacggatcttcttggcgagagccttttacaggcgcaccaagttgttgctgatggatgagccaacgactggggttgatgagcagatgggcatccagttgatgaagaacatcaagagcatcggcgcgaccacggtcgtcgtgacgcacgacaagaatatctctcggatgtgcgat

SEQ ID NO: 39894 - DNA, 753 bp, Xanthomonas campestris
atgacggcgtccgaatcccctgtcgtgcaattgtccggtgtccgcatcgatcgcggcggacgcgcgatcctgcgcgacgtgtcgctggatgtcccgcgcggcagcatcacggccgtgctcggtccctccggcagcggcaagtccaccttgctggcggcactgacgggcgaattgcgcccggtggccggccgcgtgaccttgttcggccaggaaattccgcgcggtagccgggcgctgctggagatgcgccgcaatgttggcgtgctgctgcagggcaatggcttgttgaccgacctgagcgtggccgacaacgtcgcgctgccgctgcgcacgcatacccgcctgccggcgccggtgctgcagcgcctggtgcagatgaagctgcatgcggtgggcctgctggccgcggccgatgcctggccgcgcgagttgtccggcggcatggcgcggcgtgtggcactggcgcgcgcgctggcgctggacccgccgctgatgatctacgacgagccgctgaccgggctggacccgatcgcctcgggcgtgatcatgagcctgatccagcgcctcaacgacagcctggacctgaccagcatcatcgtcagccaccacgtgcacgagacgctgccgatctgcgaccaggcggtggtgatcgccaatggcggcatcgtgttcgccggcacccccgagcagctgcaggacagcaccgacccgctcgtgcagcagttcctgcacggccagccggacggcccgatc

SEQ ID NO: 39895 - DNA, 1191 bp, Xanthomonas campestris; identical to SEQ ID NO: 39515

SEQ ID NO: 39896 - DNA, 990 bp, Xanthomonas campestris; identical to SEQ ID NO: 39516

SEQ ID NO: 39897 - DNA, 1485 bp, Xanthomonas campestris; identical to SEQ ID NO: 39146

SEQ ID NO: 39898 - DNA, 4000 bp, Xanthomonas campestris; identical to SEQ ID NO: 39517

SEQ ID NO: 39899 - DNA, 1290 bp, Xanthomonas campestris; identical to SEQ ID NO: 39149

SEQ ID NO: 39900 - DNA, 1269 bp, Xanthomonas campestris; identical to SEQ ID NO: 39151

SEQ ID NO: 39901 - DNA, 1659 bp, Xanthomonas campestris
ggacatgccgcctcgcgcggtaacgcattggggcgcgcccgcgtccgccagagccacacgccggaggtggccgagcaacgcgtgccggccaaccaggtcgaaacgcagctgcagcgtctgcacgcggccattgccgccgcacgcaccgagatgcagcaactgcgcgaccgcctgcatggcgcgctggcccgcgaagtgggcgaattcctcgaactgcatgccctgttgctagacgacccggaactgctgcaggggctagacgatttgatccgcacgcaccgctacagcgccgactacgcgctgcgtgtgcaacgcgatcgcctggcggcggtgttcgacggcatggaagatgcctacctgcgcagccgcatggacgatctggaccatgtgatcgggcgcatccatgcgtttttgcacaagcgcgcgcccgatctcaagggcgtggccggcgagatcctggtgtgcgacaacgtggcaccgtcggaactggcgcagctgcaggcgcaaggcgtggtcggcatcgtcaccaccgccggcagtgcgctctcgcatagcgcgatcctggcgcgcagcctgcacctgcccttggtggtcggcgtggccgacgcggtgcagcgggtcaacgatggcgacgtgctgatcgtcgatgccggctccggccaggtcatcgtcgaccctacgcccgagcatctacgcgactaccgcgagcgcctgcgcacgctggccaaggaacaacgcgaactgggacggttgcgctccaagccgacccgcacgcgcgacaacgtcgacatcaccctgctggccaatgccgagtcgctggaagacgtggccaaggcgcatgcgctgggcgcgagcggactggggctgtaccgcaccgaattcctgttcctgcagcgcaacgagctgccggacgaagacgagcagttccacacttaccgcgacaccgtgctgggcatgagcggccggccggtgacgatccgcacgctggatctgggcgcggacaaggctgaccgcaccgggctcaccctgagcgacgaggacaacccggcgctgggcctgcgtggggtgcgcctgtcgcttgcccggccggcggtggcccaggcacagctgcgcgcgatcctgcgtgcgtccggctacggcccggtgcgcatcctggtgccgatggtcagcgggcgcgaggaaatcctgttggtgcgcaaacagctgaaaaagctcaccgcgcagctgcgcgacgaaggccacgagatcgccgagcacattccgctcggcgcgatgatcgaggtgccggcggcggcattggcgctggactgcttcatcgacgacatcgactttttgtcgatcggcaccaacgacctggtgcaatacctgctggcggtggaccgcaacaacgaagcgctaggcgagctgtattcgccgttgcatccggcggtgctgcgattgattgcgcaggtcatcgccaccgggcgggcgcacaacaagccggtggccgtgtgtggcgaaatcgccggcgacccgcgcttcgtggcgatgctgctggcgttgggcctcaccgagttcagcctgcatccggccaccttgctggaagtacgccgcgcggtgcgcgacctgcatctgggccagttgcgcgtgcacggcgaaaaactgctgcgcgcgcgcgac

SEQ ID NO: 39902 - DNA, 753 bp, Xanthomonas campestris; identical to SEQ ID NO: 39522

SEQ ID NO: 39903 - DNA, 744 bp, Xanthomonas campestris
gactacgcacaaggacatctgccgggtgcgcatttcgccaatctgcacgacgcgctggcggatgtgtcgcgccctgggcaagggcgtcatccgctgccgcacagtgatgtcttcgcggcccagctcggccgctgggggatcacgcccgacagccaggtggtggtctatgacgcggccgacggcagcatggcggccgcacgtgcatggtggatgctgcggctgatgggccatcgccgcgtggcggtactggatggcggcctggccgcctggcgtgcggccgggttgcccgagaccacggcagtgccttcgccggccgacagcggcgcgtacccgggcagtttcgatgcggatgcggtggtggacgccgaggcgatcctggcgcgcctggacgcggcgccgggctggctgctcgacgcacgtgccggtgagcgctttcgtggcgaggtggagcccatcgacccggtggccgggcacgtgccgggcgcggtgagtcgcccgctcggcatgagcctgcgcgatgggcggttcaagccggcggcggagttgcgcgccgagctgggcgcgctgctgtgcgactacgcgccggagcaggccgtggtgatgtgtggctcgggtgtgaccgcctgccatctgctgctcgcgctggaggtggcagggctctccggtgcgcgcgtgtatgccggatcgtggagcggctggttgcaggatcgcagccgcccggtcgcggtcgctagccaattgcag

SEQ ID NO: 39904 - DNA, 1632 bp, Xanthomonas campestris; identical to SEQ ID NO: 39155

SEQ ID NO: 39905 - DNA, 1332 bp, Xanthomonas campestris; identical to SEQ ID NO: 39523

SEQ ID NO: 39906 - DNA, 759 bp, Xanthomonas campestris; identical to SEQ ID NO: 39527

SEQ ID NO: 39907 - DNA, 852 bp, Xanthomonas campestris
ggcagcgagaagggcggccggatcacccgtgaagacgtgcagcgcttcgtcaaggccgcactcagcggcggcgcgccggccgcagccggtgccgcaccggccggtggtggcaacggcctgaacctgctggcctggccgaaggtggacttcagcaagttcggcgaaaccgaaacccagccgctgtcgcgcatcaagaagatttccggtgcgaacctggcgcgcaactgggccatgatcccgcacgtcacccagttcgaatcggccgacatcaccgacctggaagccctgcgcgtggcgctgaacaaggaaaacgagaaggccggcatcaagctgaccatgctcgctttcctcatcaaggccagtgccgcggcgctgaagaagttccccgagttcaacgcctcgctcgatgcggccggcgaaaacctcacgctgaagaagtacatcaacatcggctttgccgctgacaccccgaacggcctggtcgtgccggtgatccgcgacgtcgacaagaagggcgtgctgcagatcgcgcaggaaagtggcgagctggccaagaaggcacgcgacggcaagctgggcccggccgacatgagcggcggctgcttctcgatcagctcgctcggtggcattggcggcaccgcgttcacgccgatcatcaatgcaccggaagtggcgatcctgggcgtgtccaagtcggcgatgcagccggtctggaacggcaaggacttcgcaccgaagctgatgctgccattgtcgttgagctacgaccaccgcgtcatcgacggcgcgctggccgcgcgcttcaccacctatctcagccaggtgctcgccgacatgcgacgcgtcctgctg

SEQ ID NO: 39908 - DNA, 1312 bp, Xanthomonas campestris
ctggagcactacggccgtgactggacgcgccgctggacgcccaatccgctggccatcgcgctgccggggtcggtggaagaagtgcaggcggtggtgcgctgggccaacacgcatgcggtggcggtggtgccctcgggcgggcgtaccggtttgtctggtggcgcggtcgcggccaatggcgagctggtgctgagcctggagcggttgaacaagccgctggccttcgatgcggtggatcgcacgctcaccgtgcaggccggcatgccgctggaagcggtgcacaacgccgcgcgcgagcacggcctggtgtacccggtggatttcgcagcgcgtggttcgtgctcgatcggcggcaacatcgccaccaatgccggcggcatccgcgtgatccgctacggcaacaccccgcgaatgggtggccgggctcagcgtggtcaccggcaccggcgagctgctgcatctcaacaatgcgttggtgaaaaattccagcggctacgacttccggcatctgatgatcggctcggaaggcacgctgggtatcgtggtcgaagcaaccctgcggctgaccgacctgccgccgccgagcaacgtgatgctgctggcgctgccgtcgttcgatgtgttgatgcaggtgttcgcggcgtttcgcgcacagctgcggctggaagcgttcgaattcttcaccgaccgcgcgctggagcacgtgctggcgcacggcgcgcaggcgccgtttgcgcaggtgcacccgtactacgtggtgaccgaattcgctgccggcgatgaggcgcaggaagcggcggcgatggcggcgttcgaggcctgcatggagcagggctgggtgagcgacggggtgatcagccagagcgatgcgcaggcggcgcagctgtggcgcctgcgcgaaggcatcaccgaggcgctggcgcgttacaccccttacaagaacgatgtgtcggtgcggatctcggcgatgccggcgttcctggccgagacgcaggcactgctgcacgatgcttacccgcatttcgatgtggtgtggtttggccatatcggcgacggcaacctgcatatcaacgtgctcaagcccgatgccaccagccaggcagatttcatcactgcctgcgagcaggtcaccaagttgctggcgcagagcctgcagcgtttcgacggcagcatctcggccgagcacggcattggcctggtcaagaaaccgtacctgtggagtacgcgctcggcggcagaaatcgcgctgatgcgcggcatcaaacaggtgctcgacccccatcttttgctgaatccaggcaagctgttcgac

SEQ ID NO: 39909 - DNA, 711 bp, Xanthomonas campestris; identical to SEQ ID NO: 39530

SEQ ID NO: 39910 - DNA, 1122 bp, Xanthomonas campestris; identical to SEQ ID NO: 39531

SEQ ID NO: 39911 - DNA, 3240 bp, Xanthomonas campestris; identical to SEQ ID NO: 39532

SEQ ID NO: 39912 - DNA, 2031 bp, Xanthomonas campestris; identical to SEQ ID NO: 39163

SEQ ID NO: 39913 - DNA, 1680 bp, Xanthomonas campestris
atgagtcaggcacgtccttggttgcaaagttatccggccggagtggccgcggagatcgatctggagcagttccgcaccgtggcggaggttttcgccacatcggtggcgcgcttcgctgatcgccccgcgtatcacagcttcggcaagaccattacctaccgcgaagcagatcagctggtcgaccagttcgcggcctatctgctcggcgagttgcagctgaaaaaaggcgaccgcgtcgccttgatgatgcccaactgcctgcaatacccgattgccaccttcggcatcctgcgcgccggtctgaccgtggtgaacgtcaacccgctctacaccccgcgcgagctcaagcaccagttgatcgactcgggcgccagcgtgctggtggtcatcgacaacttcggcaccaccgtgcagcaggtgatcgccgacacgcaggtcaagcaggtcatcaccaccggcctgggcgacatgctcgggttcccgaaggctgcactggtcaactttgtcgtcaagtacgtcaagaagctggtgccggagtaccgcatcaacggcgcgatccgcttccgcgacgcgctggcactgggccgcaagcaccgcgtcccgaccctgcagatcgagccggacgacatcgcctttttgcagtacaccggcggcaccaccggcgtagccaagggcgcgatgctgacccaccgcaacctggtcgccaacatgcagcaggcgcaccagtggctggccggtaccggcaagctggaagaaggccacgaggtggtgatcaccgcgttgccgctgtatcacatcttcgcgttgacggcgaacggcctggtcttcatgaagatcggcggctgcaatcacctgatcagcaacccgcgcgacatgccgggcttcatcaaggaactcaagaagacccgcttcaccgcgtttaccggcgtcaatacgctgttcaatggcttgctcaatacgcccggcttcgatcagatcgacttttcgtcgttgaagatgaccctcggcggcggcatggcagtccagcgctcggtcgccgaacgctggaagcaggtgaccggcctgactctggtcgaggcttacggcctgaccgagacctcgcccgccgcctgcatcaacccgatggatctggtcgactacaacggctcgatcggcctgccgattccgtccaccgatgcctgcatcaaggacgacgatggcaaggtgctggcgctgggcgagatcggcgagctgtgcatcaagggcccgcaggtgatgaagggctattggaagaaggccgacgagaccgccaaggtcatggacgccgaaggctggctgcacaccggcgacatcgcacgtatggacgaacgtggcttcgtctatatcgtcgaccgcaagaaggacatgatcctggtgtccggcttcaacgtgtaccccaacgagatcgaagacgtcatcgcgacgatgccgggcgtgctcgaagtggccgcagtcggcgtgccggatgaaaagtccggcgaaatcgtcaaggtggtgatcgtcaagaaagaccaggccctgaccgccgaggatgtaaaggcgcactgccgcaccaacctgaccggctacaagcagccgcgcgtgatcgagttccgcaaggaattgccgaaaaccaacgtcggcaagatcctgcgtcgcgaattgcgggatgcggccaaggca

SEQ ID NO: 39914 - DNA, 435 bp, Xanthomonas campestris
gatgcaccgctgctgttgctgccgggccgcggcacgcgcctgaaagggcatgccgatggcctgcagctgctcgccgctgtgcgcgccgccggtctgccggcctggttgtggctgcccggcgcgcgcgagccggggcgtgaggcctatatccgcgaactggaagccgagaaggccaggctgggtgtggccgatgccgtggccttcaccgaacccactgcgcgcatcgccgaggcctacgccgccagcgacctggtgctgcaactctcgcgcaagcccgaagccttcggccgcaccgtgatcgaagcgctggccgtgggccggccggtgctgggctgggcgcacggcggcgctggtgaactgctcgccgaactgcagcccgccggcgcggtgccgccattcgatgcccaggcattggcgcagcaggcgcttgcgtta

SEQ ID NO: 39915 - DNA, 1263 bp, Xanthomonas campestris
cccttctaccgccagttgtatttccaggtggtggtggcgatcgttcttggcgccctgctgggccatttcgagccggccttcgccgaaagcctcaagccactcggcgatgccttcatcaagctggtgaagatgatcatcgcgccggtgatcttcctgaccatcgtcaccggcatcgccggcatgacccacctcaagacggtgggccgggtcttcgccaagtcgatgacctacttcctgttcttctccacgctggcgttgatcgtcggcatggtggtggcgcacgcggtgcagccgggcgccggcatgaacatcaacccggccgagctggaccagagcgcggtcaacacctacgtgcagaagtcgcacgagctgagcctggtcggctttttgatggacatcatcccggccacgctgatcagcgcgttcgtcgatggcaacatcctgcaggtgctgttcgtggcggtgctgttcggcatcgcgctggccctggtgggcgagcgtggccgcccggtgctgagcttcctggaagcgctcaccgccccggtgttccgcctggtgcacatgctgatgaaggccgcgccgatcggtgcattcggtgcaatcgctttcaccatcggcaagtacggtgtggaatcgctggtcaatctggcctggctggtgggctcgttttacctgacctcgctgttcttcgtgctggtgatcctgggcatcgtgtgccggttgtgcggcttttcggtgctcaagctgatccgctacctcaaggccgagctgctgctggtgctgggcacctcctcgtcggaatcggcattgccgtcgctgatggagaagatggaaaaggccggctgtgagaagtcggtggtgggcctggtcgtgccgaccggctactcgttcaacctggacggcaccaacatctacatgaccctggcggcgctgttcatcgcccaggccaccaatgtggacctgaccctgggccagcagatcaccttgctggcggtggcgatgctcagctccaagggcgcggccggcgtgaccggcgccggcttcattacgcttgcggccacgctgtcggtggtgccggatgtgccggtggccggcatggcgctgatcctgggtgtggaccgcttcatgagcgagtgccgctcgctgaccaacttcatcggcaatgcagtggccacggtggtggtgtcgcgttgggaaaatgcgctggaccgcgaccagttgagcctggcattggacggccgtgcgccgccgctgcaggcaccg

SEQ ID NO: 39916 - DNA, 942 bp, Xanthomonas campestris; identical to SEQ ID NO: 39538

SEQ ID NO: 39917 - DNA, 2793 bp, Xanthomonas campestris; identical to SEQ ID NO: 39542

SEQ ID NO: 39918 - DNA, 1212 bp, Xanthomonas campestris; identical to SEQ ID NO: 39172

SEQ ID NO: 39919 - DNA, 1438 bp, Xanthomonas campestris; identical to SEQ ID NO: 39173

SEQ ID NO: 39920 - DNA, 1362 bp, Xanthomonas campestris; identical to SEQ ID NO: 39169

SEQ ID NO: 39921 - DNA, 1362 bp, Xanthomonas campestris
aggatcgaacacgacagcatgggcgaattgcaggtgcctgccgatgcgttgtggggtgcgcagacccagcgcgccgtgcagaacttcccgatttccggccagccgatgccgcgcggtttcattcgcgcgctggggttgatcaaggccgcggccgcaggcgtcaacgccgatctcgggctgctgtccaaatcggtggccaaggtggtgcaggaagccgccttgcaggtggcgcagggcacgcacgatgcacatttcccgatcgatgtgtatcagaccggctctggtacgtcgtcgaacatgaatgccaacgaggtgattgccacgttggccacccgcgccggaaaggatgcggtgcaccccaatgaccacgttaatctcgggcagagttccaacgatgtggtgcccaccgcgattcgcgtctcggcattgctggcggtgcaggagcagctgcagccggcgctcaagcacctacgcaagaccatcgacaagcgcgccaagggtctggacaagatcgtcaagaccggccgcacgcatctgatggatgcgatgccgctgacctttggtcaggagttcggcgcgtggtctgcgcagctcagttcagcgcaggagcgcatcgacgacagcctgaagcggctgcgccggttgccgctgggcggcactgcgattggtaccggcatcaacgccgatgcgcgcttcggcggcaaggtggccaaggccttgtccacgttgagcggcgtcaagttcgaaagtgccgagaacaagttcgaaggcctggcggcgcaggatgatgcggtggaattgtcgggccagctcaatgcgctggcggtggccttgatcaagatcgccaatgacctgcgctggatgaatgccgggccgctggcagggctgggcgagatcgaattgccggcgctgcagccaggcagttcgatcatgccgggcaaggtgaatccggtgattcccgaagcgaccgtgatggtgtgcgcgcaggtcatcgggcaccacaccgcgatcacggtggccgggcagaccggtaattttcagttgaatgtggcgttgccgctgatcgccgcgaacctgctggattcgatcaacctgctcagcaacgtctcgcgcctgctcgccgataccgccattgccggattgaaggtgcgccaggagcgcgtgcgcgaggccctggaccgtaacccgatcctggtgaccgcgctcaacccgatcatcggctacgaaaaggccgccgcgattgccaagcgcgcctacaaggagcagcgcccggtgctggatgtggccaaggaagacagcggtctgagcgaggcagagctgcgccgtttgctggatccggcggcgttgacgcgcggcggcatc

SEQ ID NO: 39922 - DNA, 1920 bp, Xanthomonas campestris
atgggcaagatcattggtattgacctcggcaccacgaactcgtgcgtggcgatcatggacggcggcaaggcccgcgtcatcgaaaattccgagggcgatcgcaccacgccctcgatcgtcgcctacaccaaggacggcgaagtgctggtcggtgcctcggccaagcgccaggcggtgaccaacccgaagaacaccttctacgcggtgaagcgcctgatcggccgcaagttcactgacggcgaagtgcagaaggacatctcccacgtgccgtacggcattctggcgcacgacaacggcgatgcctgggtgcagaccagcgattccaagcgcatggcgccgcaggaaatttccgcacgcgtgctggaaaagatgaagaagaccgccgaggacttcctgggcgaaaaggtcaccgaagcggtgatcacggtgccggcgtacttcaacgacagccagcgccaggccaccaaggacgctggccgcatcgccggtctggacgtcaagcgcatcatcaacgagccgacggctgctgccctggcctatggcctggacaagaacggcggtgaccgcaagattgccgtgtacgacctgggcggcggcaccttcgacgtgtcgatcatcgaaattgccgaggtcgatggcgagaagcagttcgaagtgctggccaccaatggcgacaccttcctgggcggcgaagacttcgacaaccgcgtcatcgagtatctggtcgacgaattcaacaaggatcagggcatcgatctgcgcaaggatccgttggcgctgcagcgcctcaaggacgccgcagagcgcgccaagatcgagctgtcgacctcgcagcagaccgaagtgaacctgccgtacgtcaccgccgatgcctcgggcccgaagcacctcaacatcaagttgacccgtgccaagctcgaagcgctggtggaagacctggtcaagaagtcgatcgagccgtgccgcaccgcgttgaacgacgccggcctgcgcgccagcgacatcaacgaagtgatcctggtcggcggtcagacccgtatgccgaaggtgcagcaggccgttgccgatttcttcggcaaggaaccgcgcaaggacgtcaacccggacgaagccgtggccgtgggcgccgcgatccagggcggcgtgctggctggcgacgtcaaggacgtgctgctgctggacgtgaccccgctgtcgctgggtatcgaaaccatgggcggcgtgttcaccaagatcatcgaaaagaacaccaccatcccgaccaaggcctcgcagaccttctccactgccgaagacaaccagtcggccgtgaccgtgcacgtgctgcagggtgagcgcgagcaggcccgcttcaacaagtcgctggccaagttcgacctctccggcatcgagccggcgccgcgtggcatgccgcaggtggaagtgtccttcgacatcgacgccaacggcatcctgcacgtgtcggccaaggacaagaagaccaacaaggaacagaaggtcgagatcaaggccggttcgggcctgtcggatgaagagatccagcgcatggtcgccgacgcggaagccaaccgcgaagaagacaagaagttccaggagctggtgcagacccgcaaccaggccgatggcttgatccacgccacccgcaccgcgatcaccgagcatggcagcaaggtgggtggcgatgtgatcggcaaggtggaagcggccctggccgacctggaaaccgccatgaagggcgacgacaaggcgcagatcgaagcgcgcagcaagaccctggaagaagccggccagtcgctgtacgccgcggccgccgcggcagagcagggcggcaacgccgatgcggccagcggcaatgcgcaggcctccaaggccgccgatgacgtggtggacgccgagttcaccgaggtcaaggacgataag

SEQ ID NO: 39923 - DNA, 645 bp, Xanthomonas campestris; identical to SEQ ID NO: 39549

SEQ ID NO: 39924 - DNA, 1164 bp, Xanthomonas campestris; identical to SEQ ID NO: 39178

SEQ ID NO: 39925 - DNA, 1008 bp, Xanthomonas campestris; identical to SEQ ID NO: 39550

SEQ ID NO: 39926 - DNA, 1053 bp, Xanthomonas campestris
gtggcgacttggctagtaaccggcggggccggcttcatcggcggaaattttgttctggaggcggtctctcgcgggatccgcgtggtcaatctggacgcgctcacttatgcgggcaatctgaatacgctggcgtcgctggaaggcaatgccgaccatatcttcgtcaagggcgacatcggtgatggagcgcttgtgactcgcttgctgcaggaacatcagccggacgcggtgctgaactttgcagccgaaagccatgtcgatcgctcgatcgaaggccctggcgccttcatccagaccaatgtggtcggcactttggccctgctcgaggcagtgcgcgactattggaaagcactgccggacacgcgccgtgatgccttccgcttcctgcatgtgtccaccgacgaggtctatggcacgctcggcgagaccggcaagttcaccgaaaccacgccgtatgcgcccaattcgccgtactcggcgtccaaggcggcatcggatcatctggtgcgcgcgtttcaccacacctacgggctgccggtgctgaccaccaactgctcgaacaactacggtccgtatcacttccccgaaaaactcattccgttggtcattgccaaggcgctggctggcgagccgctgccggtctatggcgatggcaagcaggtgcgcgactggttgttcgtcagcgaccactgcgaggcgatccgcaccgtgctggccaagggccgggtcggcgagacttacaacgtgggcggcaattcggagcggcagaacatcgaggtcgtgcaggcgatctgcgcgctgctggatcagcatcgcccgcgcgaagatggcaagccgcgtgagagccagatcgcctacgtcaccgaccgccccgggcacgatcgtcggtatgcgatcgatgcctccaagttgaaggacgagctgggctgggagccggcgtacaccttcgagcagggcatcgcattgacggtggactggtatctgaccaaccaaacctgggtccaaggcgtgctggatggtagctatcgactggaacgcatcggcgcaacggtt

SEQ ID NO: 39927 - DNA, 1292 bp, Xanthomonas campestris; identical to SEQ ID NO: 39548

SEQ ID NO: 39928 - DNA, 1344 bp, Xanthomonas campestris; identical to SEQ ID NO: 39553

SEQ ID NO: 39929 - DNA, 1554 bp, Xanthomonas campestris; identical to SEQ ID NO: 39185

SEQ ID NO: 39930 - DNA, 1428 bp, Xanthomonas campestris
gtggacctattccgccatctcaccggccacccgatgcgctatttcaccgagcattttgccggtgcgctgggcaaccgcatcaccgcattgggcaccgccgccgggcagatctatggcggcctggcgtggaagatcctgccgcccatcgtcgacttcatcggcgccatcgtggtgctgttcaccgtggactggcgcatggccgccaccttgattgggtttgtggcggtggtggccgcgatcatcaccggcttcggcatccgcggccgtgccaagcaccagagctttgccgcgcaggccgcacgcgtgggcggcgagctggtggatgcggtgtccaacgtgtggacgatcaaggcctttgctgcacgcgaccgcgagagcgcacgcctggcgcaggaaatcggccacgaggcggtcgcgcaccggcgcagctggatgtatgtggaaaaggcccgcgtcatccacgacatctgcctgtcgatcatggcgggcggcatgctgatctgggcgatcagcgcctggcgcggcggcgcggtgagtgccggcgatgtggtgctggtcagcgccttgacgttccgcatcctgcacggctcgcgcgacctggcattgaccctggtcgacaccacgcagcagctgggcgccatcgccgataccttgcagatcatcctgcagccgcacgccctgcccgatgccgatgcaccactggcgctggccgaaggcgacgtgcgttttgaaggcgtgcgctttgcctacccggaccgccctgcggtgatcgaggcactggacctgcacattcctgccgggcagaaggtgggcatcgttggcccatccggcgccggcaagtccacgctgatcgccttgatccagcggctggacgatgtggaatcgggccgcgtgttgatcgacggccaggacatccgcagcgtgagccaggacagtctgcgcgaccgcattgccgtggtgccgcaggaaaccgcgctattcaaccgcagcatcgccgacaacatccgctacggccgcccggaagccagcgatgccgaggtccacaccgcggcacggcacgccttctgcgatggcttcatccgcgacctgccgcagggctacaacacgctggttggcgagcgcggcgtgatgctgtcgggcggccagcggcaacgcctgggcattgcgcgtgcgttcctcaaggatgcgccgatcctgatcctggacgaagccacctccgcgctggacaccgaatccgaggcagagatccagtccgcactggaccacctgatgcgcggccgcacggtgctggcggtggcccaccgcttgtccacggtgatcggcttcgaccgcatcgtggtgctgcaggacgggcgcatcgtcgaagacggcagcccggccgaactacgcggacgcggcggcgtgttcgacagcctatggcaacgccag

SEQ ID NO: 39931 - DNA, 783 bp, Xanthomonas campestris
aagatggacccgcgcccggatcacggcgaagacagctacgtgggccacgggcaactgaaaggcaagcgcgcgttgatcaccggtggcgacagcggcattggcgctgccgtggccatcgcttacgcacgcgaaggcgcggatgtggccatcgccttcctgccggatgagcaggaagacgcatcacgcatcggtgcgttgatcgaaaaagccggcgtgcgcgcactgctggtgggctgcgacatcagcgaccccaaccaggctgcgtccttgatcgacaaggtcaacagcgagttcggcgggctggacatcctggtcaacaacgccggctaccagaagtacttcgaaaacttcgaagaaatcaccctggacgagtggcgcaagaccttcgataccaatgtgcacgcagtgttcaacctggtgcgcttgtcggtgccgttgatgaaggacggcggttccatcatcaacaccgcttcggtgcaatctaaaaagcccacgccgaacatccttccctatggcgcaaccaagggtgcgctggccaatctcaccatcgggttggccggcgtgttggccgaaaagcagatccgcgtcaatgcggtgctgccgggcccgatctggacaccgttcattcccgccggcatggacgaagactcggtggaaagcttcggctcgcaaacgccgatgggccgccccggccaaccggtggagcttgcatcggcctacgtgatgctggcctccgataccgccagctacacctccggcaccttgctcaccatctccggtggc

SEQ ID NO: 39932 - DNA, 1959 bp, Xanthomonas campestris; identical to SEQ ID NO: 39186

SEQ ID NO: 39933 - DNA, 1059 bp, Xanthomonas campestris; identical to SEQ ID NO: 39558

SEQ ID NO: 39934 - DNA, 1167 bp, Xanthomonas campestris; identical to SEQ ID NO: 39559

SEQ ID NO: 39935 - DNA, 786 bp, Xanthomonas campestris
gtgctggtggatgccaccgccagcgacgtggtggcggattggcatgttgagtggctaacccgcggcgtgcatgtagtgaccgccaacaagctgggccagggcacggcactgtcgcgtgcgcaggacctgtatgccgcgcgtcacgccagcggcgcgtattacggcgacagtgccaccgtgggtgctggcttgcccttgctcagcagcgtgcgtgcactggtggccggcggcgaccagattcattcgatcgaaggggtgttgtcggggtcgttggcatggctgtttcatcgctatgacggcagtgcgccgttctcggcgtgcgtccgcgaggcgatggcggccggctacaccgagcccgatccgcgcatcgatctctccggtgaggacgtgcggcgcaaattgctgatcctggcgcgtgcggccgggcaaccgctggaagccgagcaggtgcatgtggaatcgctggtgcctgccgcgctggcgtccgtggcgccggaagcggtggatgcgcacctggaaacactcgacgcgctggtgcggacacgttggcagcaggcccgcgccgccggccgctgcttgcggttcgtgggccgcgtggacgagcatggcgcaagcgtgggcttgcgcgaattggccctggaccacccgctggcgggcggcgcgggcaccgacaaccgtgtcgccatcagcagcgatcgctaccgcgaccagccgctgttgattcaagggcccggcgcgggggcggaagtgaccgcggcggcgttgctggacgatgtgttgcggatc

SEQ ID NO: 39936 - DNA, 1122 bp, Xanthomonas campestris
gtccgtgccggaatcgaccgggacaccgcctacggcgcggtgacgccgccgatcgtgctgtcgtcgaacttctccttcgacggcttcggcaacaagcgccagtacgactacacccgcagcggcaaccccacccgcgacctgctcggcgaagctttggccgaactggaaggcggcgccggcggcgtgatcacctccaccggcatgggcgcgatcaacctggtgctcaacgccttgctgcagcccggcgacaccctggtggtgccgcacgatgcctacggcggcagctggcggttgttcaacgcgctggccaagaagggccatttcgccctgatcaccgccgacctcaccgacccgcgctcgctggccgatgcactggcgcagtcgcccaagctggtgctgatcgaaaccccgtccaacccgttgctgcgcatcactgatctgcgctttgtcatcgaggccgcgcacaaggtgggcgcgctgaccgtggtggacaacacgttcctgtcgccggcgctgcaaaagccgctggaatttggcgccgatgtggtgctgcattccaccaccaagtacgtcaacggccacagcgatgtggtgggcggcgcagtgatcgcgcgcgatgcggagctgcaccagcagttggtgtggtgggccaacgccctgggcctgaccggttcgccgttcgatgcgtttttgaccttgcgcgggctgcgcacgctcgatgcccgcctgcgcgtgcaccaggaaaacgccgatgcgatcgcggtgctgctggacgaacacgcggcagtgaaccaggtgtatttccccgggctggcatcgcatcctggccatgcgttggcggcacgccagcagaagggcttcggcgcgatgatcagcttcgagctcaatggcggtgaggcggcggtgcgtgcgttcgtcgacgggctgcgttatttcaccctggccgaatcgctgggcggcgtggagagcctgatcgcgcatccggcctcgatgacgcacgcggcgatgaccgccgaagcgcgcgctgcggccggtatttccgatggcttgttgcgtctgtcggtgggcattgaatccgctgaggatctgctgatcgatctgcgcgccggcctggcgcgtgcg

SEQ ID NO: 39937 - DNA, 387 bp, Xanthomonas campestris; identical to SEQ ID NO: 39562

SEQ ID NO: 39938 - DNA, 1569 bp, Xanthomonas campestris; identical to SEQ ID NO: 39191

SEQ ID NO: 39939 - DNA, 1323 bp, Xanthomonas campestris; identical to SEQ ID NO: 39566

SEQ ID NO: 39940 - DNA, 885 bp, Xanthomonas campestris; identical to SEQ ID NO: 39568

SEQ ID NO: 39941 - DNA, 1296 bp, Xanthomonas campestris; identical to SEQ ID NO: 39197

SEQ ID NO: 39942 - DNA, 1287 bp, Xanthomonas campestris; identical to SEQ ID NO: 39193

SEQ ID NO: 39943 - DNA, 1173 bp, Xanthomonas campestris; identical to SEQ ID NO: 39570

SEQ ID NO: 39944 - DNA, 1428 bp, Xanthomonas campestris; identical to SEQ ID NO: 39571

SEQ ID NO: 39945 - DNA, 1017 bp, Xanthomonas campestris; identical to SEQ ID NO: 39572

SEQ ID NO: 39946 - DNA, 1869 bp, Xanthomonas campestris
tcgctactccccaatcccggcgccatcagcacctacctccagcagcacgaatccaaaccgctgctgcgcttcatcacttgcggcagtgttgacgatggcaagagcacgctgatcgggcggttgttgtacgacagcaagcggctgttcgatgaccagctagccgcgctggaaagtgatagcaagcgccatggcacgcagggcgacggcatcgactacgccttgctgatggatgggctggccgccgagcgcgagcagggcatcaccatcgatgtggcgtaccgctacttcgataccgaccaacgcaagttcatcgtcgccgattgccccgggcatgagcagtacacgcgcaacatggccaccggcgcctccaccgccgatgtggcggtggtgctggtggatgcgcgcaagggcgtgctggtgcagacgcggcggcacagctacatcgtctcgttgctgggcattcgccacgtggtgctggcggtcaacaagatggacctggtggactatgacgcgcaggtgttcgccaccatcgtcgacagctatcgcgccctggcggcgcagttgggcattgccgatgtgcaatgcattccgctgtcggcactggccggcgacaacctgtccagcgcgtccacgcgcatgccgtggtaccaggggccgcatctgctgcagcacctggacagcgtgcagctggagacgcccgatgcagtgagtgggttgcgcctgccggtgcagtgggtcaatcgccccagcgcgcagttccgtggctatgccggcaccattgctgccggccaggtacgcaccggcgatgcggtggtggtggtgccgtccgggcgccgcgcgcatgtggcgagcgtgctggatgccaatggcgtggtcgacagcgcacgcgccgggcaggccgtgacgctgaccttgcgcgaagagatcgacatcagccgcggcgacatcatcgccgccgtggacgacccgccggaagtggccgaccagttcgccgcgcacgtgttgtggatggacgatgccgcgttgctgccagggcgcccgtactggctcaagatcggcacccgcacggtcaccgccagcatcagcgagatcaagcacaaggtcgatgtgaacacgcaggagcggctggccgccaagcggctggagctcaacgaggtgggctactgcaacctgtcgctggacgagccgatcgcctttgccccgtatgcgcgcaaccgggtgctgggcggcttcatcctgatcgaccggcagaccaatgccacggtcgcggccggtgcgctggagttcgcgttgcgccgcgccggcaacgtgcattggcagcacctggatgtggaccgcgccgcgcgtgcgcgcatcaagggccaggcgccacgtgtgctgtggttcaccggcctgtccggtgcgggcaagtccacggtggccaacctggtggacaagcgcctgcatgcgctgggctatcacaccttcatcctggacggcgacaacgtgcgccacgggctcaaccgcgatctgggcttcaccgacgaggaccgcgtggaaaacatccgccgcgtggccgaggtggcacggctgatggccgatgccgggctgatcgtgctggtgagcttcatttccccgttccgtgccgaacgccagctggcacgcgagcgtttcgactcgggtgaattcgtcgaagtgtttgtggacgtgcctctggcggtcgccgaggcacgcgacgtgaaaggcctctaccgcaaggcccgcgccgggcagattcccaatttcaccgggatcgattcgccgtacgaggcgcccgagcgcccggaaatccatcttcacgccgatggtgagaacgtagaggcgctggcgcggcatgtcctggaatacctg

SEQ ID NO: 39947 - DNA, 2568 bp, Xanthomonas campestris; identical to SEQ ID NO: 39576

SEQ ID NO: 39948 - DNA, 684 bp, Xanthomonas campestris; identical to SEQ ID NO: 39573

SEQ ID NO: 39949 - DNA, 1671 bp, Xanthomonas campestris
gtcgaagacatcaaatccaccagccgccgcttgcgcggatcgctggagcagagcctggccgatccggtcaccggggcgttgcgcgaggacgatcagacgctgatcaaataccacggcagctaccagcaggacgaccgcgacatccgcgatgagcggcggcggcaaaagctcgagccggcatatcagttcatgatccgcacgcgcacgccaggtggagtgatttcgcccagccagtggctggcactggatggcatcgccacgcgctatgccaaccattcgctgcgcatcaccacgcgccaggcgttccagttccatggtgtgatcaagcgcgagctcaaggccacgatgcaggcgatcaacgccaccttgatcgacacgctggccgcctgcggcgatgtgaatcgcaatgtgcaggtggcggccaacccgctgctgtcgcaggcgcatgccacgctgtatgccgatgccgcgcgcgtgtccgagcatctgctgcccaacacgcgtgcctattacgagatctggctggatgaagagcgcgtgtccggttcgggcgccgaggacgaaccgatctatggcgaccgctacctgccgcgcaaattcaagatcggctttgccgcgccaccccataacgatgtggacgtgttcgccaacgacctgggcttcatcgccatcctgcgcgagggccagttgctcggctacaacgtcagcatcggcggcggcatgggcgccagccacggcgatgcggagacctggccgcgcgtggccaacgtgatcggcttcgtcacccgcgatcagttgctggatatcgccacggccgtggtcaccacccagcgcgacctcggcaatcgcgccgtgcgtaagcgcgcgcgcttcaagtacaccatcgacgaccacggcctggacaccatcgtggcggagatcgaacgccgcgcgggattcagcttgcaacctgcgcagccgtttgcattcgcgcataacggcgaccgctacggctgggtggagggcgaacagggcgattggcatctgacgctgtcgctgccggccgggcgcattgccgacaccgacaccgccgcgcacctgagcgggctgcgcgccatcgcgcagttgcagatgggcgagttccgcatgacgcccaatcagaacctggtgattgccggcgtcccggccgaacagcgcgcgcagatcgaccaactggtggcgcagtacggcctggatgccggcaacctggcgcccaccgcgttggcgcgcggcgcgatggcctgtgtggccttgccaacctgcgggctggccatggccgaggccgagcgctatctgccggatttcagtgctgcgctgcagccgctgctggaacgccacgggctggcgcagacgccgatcgtgctgcgcctgtccggttgcccgaacggctgttcgcggccgtatctggctgaaatcgcattggtcggcaaggcaccgggccgctacaacctgatgctgggcggcgaccgccgcggccaacgcttgaacacgctgtaccgcgaaaacatcaacgaagccgacatcctcgccgcgctcgagccactgctagcgcgctatgccgcagagcgcgaccagcacgccgacgaaggcttcggcgacttcctgcatcgcagcggcctgatcgccctgccgccctaccccacccaccgtcat

SEQ ID NO: 39950 - DNA, 2259 bp, Xanthomonas campestris; identical to SEQ ID NO: 39577

SEQ ID NO: 39951 - DNA, 954 bp, Xanthomonas campestris; identical to SEQ ID NO: 39578

SEQ ID NO: 39952 - DNA, 753 bp, Xanthomonas campestris; identical to SEQ ID NO: 39208

SEQ ID NO: 39953 - DNA, 732 bp, Xanthomonas campestris; identical to SEQ ID NO: 39580

SEQ ID NO: 39954 - DNA, 825 bp, Xanthomonas campestris; identical to SEQ ID NO: 39210

SEQ ID NO: 39955 - DNA, 2212 bp, Xanthomonas campestris; identical to SEQ ID NO: 39582

SEQ ID NO: 39956 - DNA, 423 bp, Xanthomonas campestris; identical to SEQ ID NO: 39213

SEQ ID NO: 39957 - DNA, 744 bp, Xanthomonas campestris
acctacaacgtcaatggcatcgccagccgcctgccgcacctgctgcaatggctgcaacgcgagcagccggatatcgtggggctgcaggaattgaaatccacgcaggaggcatttccggaacaggcgatccgcgatgcgggctacggggtgatctggcagggccagcggtcctggaacggcgtggcactgctggcacgtggcgcggagccggtagagatccggcgcggcctgccgtgggatccggcggacacgcagagccgctatctggaggccgccatccacggggtgatcgtgggttgcctgtacctaccgaatggcaacccgcaacccgggccgaagttcgactacaaattgaagtggttccagcgcctgcttcggcatgcggccacgctggtggcgctgccacatccggttgcgttgatcggcgacttcaatgtggtgcccaccgatgcgcacatctatgaccccaagggctggcgcaaggacgcattgctgcagccggagagccgcgccgcgtacgcgcagttgctggcgcagggctggaccgacagcctgcaggccatccacggcgatgcaccggtctacacgttctgggactactttcgtcagcacttcgcgcgtgaccgcgggctgcgcatcgatcatctcttgctcaatcgcacgttggcggcggggctacgcgatgccggggtcgacaagtgggtgcgtgcgctggagaaggccagcgatcatgcgccgccctgg

SEQ ID NO: 39958 - DNA, 2124 bp, Xanthomonas campestris; identical to SEQ ID NO: 39587

SEQ ID NO: 39959 - DNA, 1185 bp, Xanthomonas campestris; identical to SEQ ID NO: 39212

SEQ ID NO: 39960 - DNA, 4140 bp, Xanthomonas campestris; identical to SEQ ID NO: 39217

SEQ ID NO: 39961 - DNA, 825 bp, Xanthomonas campestris; identical to SEQ ID NO: 39589

SEQ ID NO: 39962 - DNA, 1431 bp, Xanthomonas campestris; identical to SEQ ID NO: 39219

SEQ ID NO: 39963 - DNA, 981 bp, Xanthomonas campestris; identical to SEQ ID NO: 39591

SEQ ID NO: 39964 - DNA, 1443 bp, Xanthomonas campestris
ccacgcgtttccctgttgatcgatggcgccctggttgtctctgccaccacgcactggcaggacgtggtcaacccggccgaccagagcgtgctggcccaggtgccctttgccacaccggccgaggtggacgcggccgtggccgccgcgcagcaggccttcgtgggctggcgcaagacgccgatcggaacccgcgcgcgcatctttctcaaataccagcagctgattcgcgaacacatgcctgagctggccgccatcctcagcgccgagcagggcaagaccctggccgatgccgaaggcgatgtgttccgcggcctggaagtggtggaacacgccgcggcgatcggcaacctgcagctgggcgagctggccaacaacgtcgccaatggcgtggacacctacaccttgctgcagccgctaggtgtgtgcgccggcattaccccgttcaacttcccggccatgattccgctgtggatgtttccgatggccatcgccaccggcaataccttcgtgctcaagccttccgagcaagacccgatggtgaccatgcgcctggttgagcttgcgctggaagcaggcatccccaagggcgtgctcaacgtggtgcacggcggcgaagaagtggtcaacgcgctgtgcgatcaccccgacatcaaggcgctgtcgttcgtgggctccaccaaggtgggcacgcatgtgtatcgacgtgcctcgctggccggcaaacgcgtgcaatgcatgatgggcgccaagaatcacgcggtggtgctgccggacgccaatcaggagcagaccctcaatgcgatggtcggcgcggccttcggtgcggccggccagcgctgcatggccgcctccacgctggtgctggtgggcgaggcacggcagtggattccggcgctggtggccaaggccaggggcttgaaactgggcgccggcagcacgccgggcaccgatgtggggccgctgatttcctgcgcggcgcgcgagcgcgtcgaaggcctgatcgcctcgggcgtggcgcagggcgccaccctggaactggatggacgcacgccgcaagtgcctggtcttgagcacggcaattttgtcggccccaccattttctccggcgtcaccccgggcatgcgcatctatgacgaagaaatcttcgggccggtgctggtgatcctggaagcggccacgctggaagaggccatcgcgctggtcaatgccaaccccaatggcaacggcaccgcgctgtttacgcagtccggtgcggccgcgcggcgcttccaggaagatatcgacgtgggccaggtcggcatcaacgtgccgatcccggtgccggtgccgctgttctcctttaccggctcgcgtgcttccaagctcggcgacctggggccgtacggcaagcaggtggtgatgttctacacgcagaccaagaccatcaccgcgcgctggttcgac

SEQ ID NO: 39965 - DNA, 1131 bp, Xanthomonas campestris; identical to SEQ ID NO: 39594

SEQ ID NO: 39966 - DNA, 495 bp, Xanthomonas campestris; identical to SEQ ID NO: 39595

SEQ ID NO: 39967 - DNA, 1173 bp, Xanthomonas campestris; identical to SEQ ID NO: 39225

SEQ ID NO: 39968 - DNA, 1869 bp, Xanthomonas campestris; identical to SEQ ID NO: 39598

SEQ ID NO: 39969 - DNA, 1305 bp, Xanthomonas campestris; identical to SEQ ID NO: 39228

SEQ ID NO: 39970 - DNA, 939 bp, Xanthomonas campestris
cagctggaaacgctgcgcgtcgcgctgctgggcaagaacggcagcatcaccgcccagctcaagcagctcggcacgttgccggccgaccagcgcaaggcggctggcgaggcgatcaatctggcgcgcgatgcgctgaccacggcgctttccgagcgcaaacaggtgctcgaaaccgcagcgctggacgcccgtctggaaggtgagcgcatcgatgtgacgctgcccggccgacgcggtgagcgcggcggtctgcatccggtgacgcggaccctggagcgcatcgtcgagatctttgcgcggctgggttacgagttgtccgacggcccggagatcgaggacgactggcacaacttcgaagcgttgaacttcccgccgcatcatccggcgcgtgccatgcacgacacgttctacttcggcgatggccgcctgctgcgcacgcatacctccggcgtgcaggtgcgttacatggataccgcagtggccaccaagagtggcccgccgctgcgcatgattgcggccggcaaggtgtatcgctccgattcggatcagacccactcgccgatgttccatcaggtcgaaggtctgctggtggacgagcattccaacttcgccgatctcaagggcaccttgtccgagttcgtgcgtgcgttcttcgagcgcgatttcgaaatgcgcttccggcccagctatttcccgttcgttgagcctggtgcggaagtggatatcgcctggcagcagcccgatggcagcacccggtggctggaagtgcttggctgcggcatggtgcacccgaacgtgctgcgcagcgtcggcatcgatccggagcgctacaccggcttcgccttcggtctgggcgtcgagcgctttgcgatgctgcgctatggcgtcaacgacctgcgtgccttcttcgaaaacgacgtgcggtttctcaggcagttt

SEQ ID NO: 39971 - DNA, 609 bp, Xanthomonas campestris; identical to SEQ ID NO: 39232

SEQ ID NO: 39972 - DNA, 1101 bp, Xanthomonas campestris
gacttgttcgacgtgcgtgcgcagctcagcgatgacgaacgcgcggtgcaggatgcggtggcacgtttcaccgatgcgcgggtgctgcccggcatcggcgaggcattcgacgccgtgcgcttcccgcgcgaactggtccccgagctggcagcgctgggcttgctgggtgccagcctgccggtgagcgagggcggcgccggcctgggcgcggtggcgtacgggctgatctgccaggagctggagcgcggcgatagcggcctgcgcagctttgtcagcgtgcaatcgtcgctgtgcatgtatcccatccatgcctatggcagcgacgcacaacggcgccagtggctgccggagatggcggccgggcgggtgatcggctgtttcggcctgagcgaggcgcaaggtggttcggacccggcggcgatgaccacgcgcgcggtgcgcgacggtgacggttggcggctgcgtggcgccaagatgtggatcaccaacggcagcatcgcggacctggcaatcatctgggcacataccgacgacggcgtgcgtggctttctggtggacacacgcagcgagggtttccgtgcgcaggacatcggccacaagatgagtctgcgcgcctcggtcacctcggcggtgttcctggacgatgtcttcgtgcccgagcagcaacgcttgccggatgcactgggattgaaggcgccgctgggctgcctgagccaggcgcgcttcggcatcgcctggggcgcgatcggggcggcggtcgcctgcctacgcgaggcgctggcttacagcggcgagcgcattctgttcgggcggcccctggcggccacgcaaagcgcgcagatcaagctggccgacatggcgcgccggatcgccaccgcgcagctgctggcgctgcaactagggcggctgaaggaggccggcacgctgcgcccggaacagatctcgctggcgaagtggaataattgccgcatggcactggatgtggcgcgcgagtgccgcgacctgcttggggcggcggggatcaccaccgagcacgtggcgatccggcatgcgctgaatctggaatcggtgattacctgcgagggcaccgaaaccgtgcat

SEQ ID NO: 39973 - DNA, 2028 bp, Xanthomonas campestris
agcacgctgccgctgcactacccgcagttcgacaagatcaaggacagcgacttcgcgcctgccttcgacgccggcatggccgcgcagttgaaggaagtggacgcgatcgccaaccagaaggccaagccgaccttcgacaacaccatcatcgcgctggaaaagagcggcgccacgctggatcgcgccaccacggtgttcttcaacctggtgggcgccgacaccaacgatgcgcgcaagaaactgcaggccgactactcggccaagtttgccgcgcaccgcgatgcgatttcgctcaacggcaagctgttcgcgcgcatccagaccctgtacgaccagcgcagcaagctcggcctggatgcgcagggcgtgcgcctggtcgagaagtactacagcgatttcgtgcgcgatggcgccaagctgtctgacgccgacaagaccacgctcaaggccatgaacgccgagctggccaacctgggcaccaccttcagccagaacgtgctggccgaggtcaacgccgcggccgtggtggtggatgacgtcaagcagctcgatggcttgtctgacgagcagatcgccgccgctgccgaagcggcgaaggcacgcaagctcgacggcaaatacgtgatcgccctgctcaacaccaccggccagccgccgctgacccagctcaagaaccgcgagctgcgcaagaagatctacgccgcctcggtgtcgcgtggcagccatggcggccagtacgacaacaccgccctggtctcgcgcatcatgaccctgcgtgccaacaaggccaagctgctgggattccccacgtacgctgcgtattcgcttgaaaaccagactgccaagacgcctgaagcggtcaacgcgatgctcggcaaactggcaccggccgcggtggccaacgccaagcgcgaagccgccgacctgcaggcgatgatcgacaaggaacaaaaggccgcgcgcaagcccaccttcaagctcgaagcctgggattgggcctactacagcgagaaagtgcgccaggccaagtacaacttcgacgagtcgcagctcaagccgtatttcgagctgaagaacgtgctggaaaacggcgtgttctatgcggccaaccaggaatacggcctgaccttcaagcagcgcaccgacctgcccacctaccgcgacgacatcaccgtctatgacgtgttcgacgccgacggcaagcagctggcgatcttcattgccgacatgtatgcgcgcgaatccaagcgcggtggcgcctggatgaattcctacgtctcgcagtcagagctgaccggtttcaagccggtggtggccaaccacctcaacatccccaagccgccggccggccagccaacgctgctgacctgggatgaagtgaccaccatgttccatgagttcggccatgccttgcacggcatgttctcagacgtgaaatacccgtatttctccggcaccagcgtgccgcgcgactttgtcgagttcccctcgcaggtcaacgagatgtgggccgacgagccgtcgatcctgaagaactatgccaagcattatcagaacggcacgccgatgccgcaggcattgctggacaaggtgattgccgcgtccaagttcaaccagggctttgccaccaccgagtatctgggtgcggccatgctcgaccagaactggcaccagatcagcgccaaccaggtgccggacgccgcaggcgtgatggcgttcgaagccaaggcgctggccgatgacggcatcgcctatccgcccgtgccgccgcgctacaagaccccgtatttcagccacatcatgggcggctatgcggccggctactacgcctatatctggtccgaagtgctggatgccaacacgcagcagtggttcaagcagcacggcggattgagccgcgccaacggcgaccgcttccgtcagaccctgctttcgcgcggcggtagcgtggatgcgatggagctgttccagaacttcgccgggcatgcgccgcagatcgagcccttgctggagaagcgcggcctcagc

SEQ ID NO: 39974 - DNA, 525 bp, Xanthomonas campestris
ttcaccgaccccaaggccttggcactggccttggcggccgagcagggcgatgccgaggaagtgcggcggttgatgaaggtggagggcgtgaacccggacacgatcttctccaaggatggatatccactgttgttctggccgatcttcacccacaacccgaccgggctgaaggcgatgctggacaatggggccgatccgaatgtggccaagccctatcccccggagccgggacgaaatcagaccaatgtcagtaatgccatggtctgggcagccgagcaggacgacccgctctatctcaagttgctgctggatcatggtggtaatccgaatacgcggaacgcgaacaacgagagcctgttattccacgcgtttatcaagcagaacaaatgggacaacataaagcttcttgtcgagcgcggtgcggacataaacgcggttgcgggaatgggaaatagcattacggccgcctatgcaatccgcggtggcttcgacttcgtctactggcttctgcagcatggtgcagat

SEQ ID NO: 39975 - DNA, 762 bp, Xanthomonas campestris; identical to SEQ ID NO: 39609

SEQ ID NO: 39976 - DNA, 1908 bp, Xanthomonas campestris; identical to SEQ ID NO: 39607

SEQ ID NO: 39977 - DNA, 792 bp, Xanthomonas campestris; identical to SEQ ID NO: 39610

SEQ ID NO: 39978 - DNA, 1475 bp, Xanthomonas campestris
accgaggagggagtatggaagccttagccgcgaccctgcgtggcatcgccgcgcgtggaccgtggggtttattcatcgatggtcagtggcgcgccagcaccggcagccagacgctggatgtcatcgcgccgcacaccgaagaacgcctgctgcgctacaccgaaccatcgcatgccgacaccgaggccgcggttgccgcggcgcgcagagccttcgatagtggcccctggccgcagctgccgccgccagaacgcggcgccgcgctgaagcgcattgccgagcatttgcgggcgcgcatgccggaactggcagatgcatggaccgcgcaggtcggcgccgtcatcggtttcagtcggcgcgcctccaagcaggcgccggatctgttcgactactacggcgacctgatcaccacccacccgttcgtcgagccacgcacgcgctccagcggcgggcgcgtgcatgtggtacaggaaccggtcggcgtggtcgtcgccatcacgccgtggaatgcgccgttggtgctgctctgctacaaggtcgccgccgcgctggcggccggctgcacggtggttgccaagccgtctccggaaacgccgatcgacgcctatattctggccgaatgcatcagcgccgccgggctgccggatggcgtgttcaatctgctaccggccgggcgcgaggtgggtgaacagctgatccggcacccttcggtggacaaggtgagcttcaccggctccacccaggcagggcgatcgatcggtgtggcctgcgccgagcgcctggcgcgcgtcgggctggagctgggcggcaagtcggcggcgatcgtgctggaggatgccgacatcgagaaagtgctgcccagcctggtgccctactcgatgccgatcaccggccaggtgtgtttcgcgctcacccgcgtactggtccccgcgcatcggcgcgaggccatcctgcacgcgtattgctcggcgctggccacgctcaaactcggcgacccgtttgccgccgacacgggcatgggcccgctggcactcggccgccagttggaacgtgtgcaaggctacatcgcccagggcagcgccgaaggcgcaaagctggtcatgggcggcgggcggccagagcacttgccacgcggtttctttcttgagccgaccgtgtttgcaggtgtgacgccggagatgaccattgcccgcgaagaaatcttcggccccgtcgtgagttttatcgactatcacaacgaagaagatctgatcgccaaagtcaacgacagcgattacggcctgcatggcaccgtctatagcgacgatcccgaacgcgcctacgcgattgcgcgacgcgtgcggagcggcagccattcgatcaacggcatgtgcgtggatatcgagatgccgttcggtggtgtcaaacactccggcatcggccgcgaaggtggcatcgaaggcctgcacgggtttctcgaaaccaaaacgatctat

SEQ ID NO: 39979 - DNA, 1371 bp, Xanthomonas campestris
tggacctacgccgaactggacgacctgatcggtcgcctggctgccgtgctgcagacacgcggctgtgtcgacggcgaacggcttgcggtgctggcgcgcaattcggtctggcaggttgcgttgcattttgcctgtgcgcgggttggtgcaatctacgtaccgctcaactggcggctgagtggcactgagctggatgccttgttgcagcgtgcagagcctcgcttgctgctgggcgacgatgtcgctgccggacgcgcgcaggtggaaggcttcgcccgcttcatcgacaacgccaagcagcttgcacctgccgaaacaccctacattccgcccgatcgggtcagcctgatcctgttcacctccggcacgtccggccagcccaagggcgtgatgttgagcgaacagaacctgcaacaggtcgcgcacaacttcggcgtcaccacacgggtggaagcgcacagcagttttctgtgcgaggcgccgatgtttcatatcatcggcctggctaccaacgtgcgcccggtgctggcaatgggcggctcgatccaggtctccaatggcttcgagcccaaacgcacgctgggctggctgggcaacccggcattgggcatcacccattacgtcggcgtgccacagatgatgcaggccttccgcagccagccaggcttcgatcctgcagcgctccgtcatctcaccgcgttggtcagcggcggcgcgccgcacgccagcgaggacctgctgggctggctggaggatggcatcccgatggtctgcggcttcggcatgagcgaagccggcaccgtgttcggcatgtcggtggattgcgaggtgatccgcagcaagctcggtgcagcgggaatctcatcacccaccgtgcagacgcgggtcgtggataacgagggcaacgactgtgaggtgggcatgccgggcgaactgctgttgcgcgggcccaacctcagccccggctattggcgcgacccgcaggccactgccgagatgcgcgatggcgcgggctggttccgcaccggcgacatcgtccgacgcgatgccgatgggtttttctgggtagtcgaccgcaagaaagacatgttcatttccgggggtgaaaatgtgtatcccgcagagatcgaagccgtgctggccgaccatccagaaatccgcgagtgcgccgtggtcggcatggccgacgcgcaatggggcgaagtgggctatctggcgatcgtgccagccactgaaaccccggacctggagcggattcgcagctatctgagcgaacgcctggccaagtacaaggtacccaagcacctgcgcgtggtcgcggcgctgccacgcactgccacgggcaaactgcaaaaagcgcgcttgaaggat

SEQ ID NO: 39980 - DNA, 702 bp, Xanthomonas campestris; identical to SEQ ID NO: 39241

SEQ ID NO: 39981 - DNA, 486 bp, Xanthomonas campestris
ctctcgctcatcgtcgccttcgaccgcaaccacgccatcggccgcgacaacgatctgccgtggaagctgcccgatgacctgaagcgcttcaaggcgctgacactgggtaagccgatcctgatggggcgcaagaccgcgcagtcactgggccgtgcgctgccagggcgcctgaatctggtgctgacgcgctcggggcaggtgcctttcgagggcatgcatgcagtggtttcggtagacgaggcgatcgaacgcgcggcgcaggaaggtgcgcaggagctgtgcgtgatcgggggaggcgaggtgtaccgcctgaccatggagcgcgccgatctgctggcggtcaccgaagtggacacggctgtcgagggcgccgatacgcacttcccgccgatcgatccggcggtgtgggtgcccgcagagcgcagcgcgcatgcggcagacgcgcggcacgccttcgctttcagtttcgtggattaccagcgccgc

SEQ ID NO: 39982 - DNA, 429 bp, Xanthomonas campestris; identical to SEQ ID NO: 39615

SEQ ID NO: 39983 - DNA, 840 bp, Xanthomonas campestris; identical to SEQ ID NO: 39618

SEQ ID NO: 39984 - DNA, 909 bp, Xanthomonas campestris; identical to SEQ ID NO: 39243

SEQ ID NO: 39985 - DNA, 1380 bp, Xanthomonas campestris; identical to SEQ ID NO: 39244

SEQ ID NO: 39986 - DNA, 1782 bp, Xanthomonas campestris
gggttcgagcgtccgaccgcaccggtggtgcgtgaagtggcgatcggcgagaccatcaccgtcgccgatctggcgcagaagctcgcgctcaagggcggcgacgtggtcaaggcgctgttcaagatgggcgtcatggcgaccatcacccagagcatcgatcatgacaccgcggcgctggtgaccgaagagctcggccacaaggcggtgcgtgcggacaatgccgacttcgaagatgcgctgctggcgcatgccgaagacgcccagggcgaaaccacctcgcgtccgccggtggtcaccatcatgggtcacgtcgatcacggcaagacctcgctgctggattacatccgtcggaccaagattgcctctggcgaagccggcggcatcacccagcacatcggtgcgtaccacgtcgaaaccggccgtggcgtcatcagcttcctggatacgcccggccatgccgcgtttacctcgatgcgtgcgcgcggcgccaagatcaccgacatcgtggtgctggtcgttgcagccgatgacggcgtgatgccgcagaccaaggaagcggtggcgcatgccaaggcggcaggcgttccgttgatcgtggcagtcaacaagatcgacaaggccggcgcggatccgctgcgggtcaagaacgagttgctggctgaaaacgtggtggccgaagacttcggtggcgatactcagttcatcgaagtgtcggccaaggtcggtaccggtgtggacacgctgctggatgcaatttcgctgcaggcagaagtgctggaactcaaggcagtggccgatggccgcgccagcggtaccgtgatcgaatcgtcgctggacaagggccgcggcccggtcgcgacggtgctggtgcagcagggtgcgctgaagcgtggcgactacctggtgtgcggtattcaatacggccgcgtgcgtgcgttgttcgacgaaaccggccaccagccggcctctgcgggcccgtcgattccggtgcaggtgctcggcttgtccggcgtgccggaagccggcgacgacttcgtggtcgtcgacgacgagcgtctggccaaggacgtggcgcagcagcgcgaaaccaagcgccgcgaatcgcgtctggtcgcctcggccaccaaccgcatggaagacatcctggcccagatgggcaagggcgaaggccagcaggtgttgaacctggtgatcaaggccgacgtacagggttctgtggaagcgctcaagcagtcgctggtggcgttgtccaatgacgacatccgcatcaacgtgatccactccggcgtgggcggcatcaccgagtcggatgcgaattcggcagcggcctccaaggccacgatcatcggcttcaacgtgcgtgcggatgcatcggcacgcaagatcgtcgagtccaacggtatcgatctgcggtacttctcgatcatctatgacgtgatcgaccaggtgaagcaggtggcgtccggtctgctcggcgtggaaatccgcgaagagatcatcggtatcgcgcaggtccgcgatgtgttccgcagctcgaagttcggcgcggttgcaggctgcatgatcatcgaaggtgtggtgaagcgcagcaagccgatccgcgtgctccgcgacagcgtcgtggtgttcgagggcgagctggaatcgctgcgtcgcttcaaggaaaacgtcgacgaagtgcgcaacggcaccgagtgcggtattggcgtgaaggcctacaacgacgtcaaggcgggcgaccagatcgagtgcttcgagcgcatcgaagtggcgcgtacgctg

SEQ ID NO: 39987 - DNA, 1431 bp, Xanthomonas campestris; identical to SEQ ID NO: 39620

SEQ ID NO: 39988 - DNA, 1474 bp, Xanthomonas campestris; identical to SEQ ID NO: 39623

SEQ ID NO: 39989 - DNA, 1482 bp, Xanthomonas campestris
aaatacgtccttgcgatcgaccagggcaccaccagctcgcgcgcgatgttgttcgatcgccagggcaaggtggccggcgtggcgcagcgcgaattcggccagatctttccgcagccgggctgggtggaacacaacccgcgcgagatcatgaccagcgtctacaccaccattaccgagctgctcaacaacgcgcagatcgacgcgcgcgagatctcaggcatcggcatcaccaaccagcgcgagaccgcagtggtatgggacaaggccaccggccagccgatctacaacgccatcgtctggcaatcgcggcagaccaaggacatctgcacccagctcaaagaggccggccatgagcagatggtgcgcgacaagaccgggctgctgatcgatgcgtatttttccggcaccaaggtcaagtggattctcgaccacgtggacggcgcacgtgaacgcgcacgcaagggcgagctcgccttcggcaccatcgatagctggctgatctggaacctcaccggcggcaaggtgcacgtgaccgactacaccaatgcctcgcgcaccatgatgtacaacatccacaccctggagtgggatgccgagctgctggagatgctggacgtgcccgcgcagatgctgccggaggtgcgctcctccagcgaggtctatggcatgacccagacccagtacttctacggggaacaggtacccatcgccggcattgccggcgaccagcaggccgcattgttcgggcaagcgtgctttgaaccgggcatggcgaagaacacctatggcaccggctgtttcatgctgatgaataccggcgacaaggccgtggcctccaaggccggcttgctgaccaccatcgcctggggcatcgacggcaaggtggaatacgcactggaaggcgccatcttcgtggctggctcggtggtgcagtggctgcgcgatgggctgcgcatgttcggcaaggcgagtgattcgcaagcctacgcggagcgtgccggcgacaacgacggcgtgtatttcgtcccggccttcgtgggcctgggcgcgccgtactggcgcagcgatatccgcggtgcggtgttcggcctgacccgcggcaccagcaaggaacacttcgtgcgcgcggcggtggaatcgatggcctaccagacccgcgatgtgctcaccgcgatgcagagcgattcggggatcgaactgaaggagctgcgcgccgacggtggcgcgatcgccaacgacttcatggcgcagttccaaagcgacattctcaacgtgccggtgctgcgtccggaggtggccgaaaccaccgcgctgggcgcggcctacctggcgggcctggccaccggattctggagcagccgcgaagaaatcgccaaacaatgggcggtggatcgtcgcttcgagccgaacatgcccgaagagcggcgcgaacagttgtatgccggctggcagcaggcagtggaagccacgatgggcttccgc

SEQ ID NO: 39990 - DNA, 1476 bp, Xanthomonas campestris
ccgatgggcgagacatacgatcttctggtaatcggcggcggcatcaacggggtcggcattgcccgtgacgcggccgggcgcggtctgtcggtgtgcctgtgcgaacaggacgacctggccgcgcataccagcagcgccagcaccaagctcatccacggtggcctgcgctatctggagcagtacgagttcgcattggtcggcaaggcgctggccgaacgcgaggtactgctgcggctagcgccgcacatcatctggccgctgcgcttcctgctgccgcatcagccgcatctgcgcccggcctggatgattcgcgccgggctgttcctgtacgaccatcttggcggcagcaagcgcagcctgccgcgctcgcgccggctgtcgctgcgcacccatccggttggccagccgctgcaggagtcgctgcgcaccggctttgtgtattccgacgcatgggtgcaggacgcgcggttggtggtgctcaacgcgatggatgcggccaagcgtggcgcgcagatccatacgcgtacgcgctgcgtcggcgcctggcgcgatgccgggttctggtacgcggagctggaaggccgcgacggacgccgccgcaccgtgcaggcgcgtgcgctcgccaatgcggccggtccgtgggcggtgtcgttcctggacaaggtggccgcggtgccgcaccagcatgcgctgcgcctggtcaagggcagccacatcgtggtgcccaagctgttcgaccacgaccacgcgtacatcttccagcaacccgatcgacgcatcgtgtttgccattccctacgagcacgacttcaccttgatcggcaccaccgacgtggactacgaggccgacccgtccgcacccaagatcgacccggccgaagtgcagtacctgtgcgatgcggtgaatctgtatttccagcagcagatcactccgcaggatgtggtgtggaactacagcggcgtgcgtccgctgctcgacgacgccgaagacaacgccgccgaagtgacccgcgactatcagctggaagtgctcaccgacggcgcaccattgctcaacgtgttcggcggcaagctcaccacctaccgcaagctcgccgaagaagccgtcgaccggctgacccaggccctgggcgcgcgcaagccggcgtggaccgcgcgtggcgaagccctgcccgggggcgaacaacgcgacatcgccagcctgctggagcgcgtgcgcactgcgcgtccctggctgccggcggccaccgcacagcggctggtgcgcaactacggcacctgtgccgagcagttgctcggcgatgcgcaggacatggctgcactcggccagcattttggtgcggacctgtaccaggccgaggtggattacctgtgcgcccgcgaatgggcgcagaccgccgacgacatcctgtggcgccgcagcaaactgggcttgcgtgtggatgccgaggggcgcgcgcgcctggaggcgtatctg

SEQ ID NO: 39991 - DNA, 1113 bp, Xanthomonas campestris
atcgatctgctgcgcgaaagcgtggccgccttcgccagccaccatatcgccccgcttgccgcggcggccgatcacgacaacgtcttccccgcgcagttgtggcggctgttcggtgagcagggcctgctgggcctgaccgtggaagaagcatacggcggcagcggcatgggctacctggcgcacgtggtggcgatggaagaaatttcgcgtgccggcggtgcgatcgggctgtcctacggcgcgcactccaacctgtgcctcaaccagctgcgcaagaacgccacccacgaacagaagcagcgctacctgcccaagctgtgcaccggtgagcacgtcggcgcactggcgatgagcgaggccggttcgggctcggacgtggtgtcgatgaagctgcgcgccgaggcacgcggcgaccgctttgtactcaacggcagcaagatgtggatcaccaatggccccgatgccgacgtgctggtggtgtacgccaagaccgaccccagcgccggtgcgcgcggcatcactgccttcatcgtcgaaaagggcatgcccgggttttccaccgcgcagaagctcgacaagctcggcatgcgcggctccaacacctgcgaactggtgttcaccgattgcgaagtgccggccgaaaacgtgctgggcacgctcaacggcggcgtgcgcgtgttgatgtccgggctggatttcgaacgcgtggtgctggcgggtggaccactcggcttgatggccgcggccatggacgtggtgctgccgtacgtgcacgagcgcaagcagtttggcgagccgatcggcaccttccagctgatgcaggccaagctggccgacatgtacgtggggctcaacgcgtgccgtgcgtacgtctatgccgtggcacgcgcctgcgatgccggccgcaccacgcgccaggatgcggctggcgcgattctgtatgccgccgagaaggccacctggctcaccggccaagcgatccaggtgctgggcggcaacggctacatcaacgagtaccccaccgggcggttgtggcgcgatgccaagctgtacgagattggcgccggcacgtctgaaatccggcgcatgctgatcggccgcgagttgttcgaa

SEQ ID NO: 39992 - DNA, 801 bp, Xanthomonas campestris; identical to SEQ ID NO: 39253

SEQ ID NO: 39993 - DNA, 732 bp, Xanthomonas campestris
atcaccggcggcagccgcggcctgggccgcaacgccgcacacgcactggccgccgccggccacgacatcgtgctgacctatcaccgccaggccgacgacgcggccgcagcggtggcccacatccagcaactgggccgccgcgcgcatgcgctgcaactcgataccgcagacgtgtccacgtttgccgactttgctgcgcggctcaaagacgtgctggccagttgggagcggaaccagttcgatgcgctggtcaataacgccggcaccggcttgcacgcgcccatcgccgacaccaccgcggaccaattcgatgcgctggtgaacatccatctgaaagggccgtatttcctgacccagaccctgttgccgttgattgccgacggcgggcgcattctcaatgtctcgagtggtctggcgcgtttcgcgctgccggggtcttcggcctacgccatgatgaagggaggcatcgaagtgtttacgcgttacctggccaaggagctcggcgcacgcggtatttccgccaacaccctggcgccgggcgcgatcgaaaccgacttcaatggcggcagcgtgcgcgacaacgcgcaggtgaacgcgatggtggcctcggtcaccgcattgggccggccggggcagccggacgatatcggcccggtggtcgccgcgctacttgcgcccggcacggcgtggatcaatgcgcagcggatcgaggcatccggcggcatgctgatc

SEQ ID NO: 39994 - DNA, 1971 bp, Xanthomonas campestris
gccaacgccatccgtttcctcgccgccgatgcggtcgaagccgcaaaatccggccaccccggcatgcccatgggcatggccgatatcgccgaagtgctgtggaacgatttcttccggcacaacccgaacaatccgcagtggttcaaccgcgaccgtttcgtgctgtccaacggacacggctcgatgctgcagtacgcgctgctgcacctgtccggctacgacctgccgatcgagcagctcaagcagttccgtcagttgcacagcaagaccgccggccaccccgagcgcagcgaaacgcctggagtggaaaccaccaccgggccgctggggcagggctttgccaatgcagtcgggttcgcgctggccgagaagttgctggcgcagcgctataaccggcccgaactggaaatcgtcgaccaccgcacctgggtgttcatgggcgacggttgcatgatggagggcatctcgcacgaggccgcctcgctggccggtacctggggcctgggcaagctggtcgcgttctgggacaacaaccagatctccatcgacggcaacactgccggctggttcagcgacaacaccccggcacgcttcgaagcctatggctggcatgtgatccgtgatgtggacgggcacgacgccgagaagatcaagacggccatcgaggcggcgctggaaaacagcgacaagcccacgctgatctgctgccgcaccaagatcggcttcggtgcacccaccaagtcgggcaaggaatcctcgcacggcgcaccgctgggcaaagaggagctggaaggcgcgcgcaaggcgctggaatggccgtacggcccgttcgagattcccgaagagatctacgccggctggcgcgcaggtggcaccggcacgctgcgtcaggccgagtgggagcagctgttcgacaagtacgccaagcagtacggcgaacaggccgacgagctgacccgccggtcgcgtggcgagttgccggccgacttcatcgcccaggccgatgcctacatcgccaaggcgcaggaagatggccagaccatcgcctcgcgcaaggcatcgcagctggcaatcgaagcgttcgcaccgctgctgccggagctggtcggcggctcggccgacctggcgcattccaacctcaccttgtggaaggccagcaagtcggtcgccaccgacgacccgaacgccaactacgtgtattacggcgtgcgcgaattcggcatgaccgccattgccaacggcctggcgctgcatggcggcttcatcccgttcgacgccaccttcctggtgttcagcgactacgcgcgtaacggcgtgcgcatgagcgcgttgaatccggcgcatgccatccatgtgtacacgcacgactcgatcggtctgggcgaagacggcccgacccatcagccggtcgaacacctggcctcgctgcgctacatccccaacaacgatgtgtggcgcccgggcgatgcggtggagtcggcggtgagctggaaggccgcgatcactcgcaaggacggcccgagctgcctggtgttcagtcgccagaatctgcagcaccagccgcgcagcgccgagcagatcaagctgatcgaacgtggcggttacgtgttggccgatgccgaaggcggcacgcccgacgtgatcctgatcggcaccggctcggaagtgggcttggcggtggaagcgaagaagacgctggatgcggccgggctgaagacacgcgtggtgtcgatgccgtccaccgacgtgttcgatcgccaggatgccgcgtaccgcgagcaggtgctgcccaatgccgtgcgcaagcgcgtggcggtggaagcgggcgtgaccggcttctggcgcaagtacgtgggcctggacggtgcggtgatcgggatcgacacgttcggcgcgtcggcacccgccgaccagctgtatgcgtacttcaagatcaccgccgagcacgtggtcgaggccgccaaggcgctg

SEQ ID NO: 39995 - DNA, 1227 bp, Xanthomonas campestris
aagatgggcattggcttcgccatcggcctggtgctgggtctggccgtgtactacctggccgggagcgacgccgaatgggtgcggctggtgaccaagtacgtcaccacgccgttctcgcagatcttcctcaatctgatcttcatgctgatcgtgccgctgctgttttcggcgctggtggtcggcattgcggaaatgggcgacatccgcgcgttgggccgggtgggctggcgcacgctgggctacacggtggtgttgtcgggcattgcggtgttgctgggcttggtcctggtcaatgtgctcaagcccggtgcaggcgtggacccgcaactggccaaccagttgatccaggaaaatgccgaccgcacccgcgagatcatctccagctccggcaatcagccgcagggcatggacatgctgctttccatcgtgccgaacaacgtgattgcggcggcctcgagcaatggcgcgatcctgtcattgatgttcttcgcggtgatgtttggcgtgggcatggtgctcactgccgacgaaaaagtggccacgctcaagcgcggcattgaaggcatcttcgagatctcgatgaccttgatcgggctggtgatccgcctggcgccgtacgcggtggcctgtttcatgttcaatctggccgcgttgttcggcttcgatctgctgattcgcctgggcgcctacgtcggcgtcgtggtgctggcgctgggcctgcacatggtggtcagctacgggctggcggtgaagttcgccgggcgttcgccgatcggcttcttccggcagacgcaggaggccacgctgatggcgttctccaccgcctccagcaacgcgaccttgccgactgccttgcgcgtggccgacgagatgggcctgccaccgcgggtctcgcgcttcgtgctcaccgtgggcgccaccgccaaccagaacggcaccgcgctgttcgaaggcgtgacggtgatcttcctggcgcagttcttcaatgtggacctgagcatcggccaacaattcatggtgatgatcgtctgcatcctgggtggtatcggtaccgccggcgtgccctccggctcgctgccggtggtggcgctgatctgcgcgatggtcggggtcaacccggtcggcatcggcatgatcctgggcgtcaatcacttcctggacatgtgccgcaccgcgctgaatgtcaccggcgatctggcgttgacgacgctggtggctaaaggtgag

SEQ ID NO: 39996 - DNA, 1137 bp, Xanthomonas campestris; identical to SEQ ID NO: 39633

SEQ ID NO: 39997 - DNA, 762 bp, Xanthomonas campestris
atggatctgggaatcgccgggcgctgggccttggtatgtgccgccagcaagggcctgggactgggctgcgcacaggcgctggcacgcgaaggcgccaatgtcgtgattgtcgcgcgtggccgcgaggctttggagcagtccgccagcaacttgcgcgccctgcccggcgcgggtgaggtacgcagcgtcgtcgccgacatcaccaccagcgaaggccgtgccgctgcgctggccgcctgcccgcaggtcgacatcctgatcaacaacgccggcgggccgccgccgggcgatttccgtcagtgggagcgcgcggactggctgcgtgcgctcgacgccaacatgctggccccgatcgaactgatccgcgccacggtcgatgcgatgcgcgcgcggcgcttcggccgcatcgtcaacatcacctccagcgcggtgaaggcgccgatcgacatcctgggcctgtccaacggcgcgcgcgccggtctcaccggctttgtggccgggctggcgcgcagcaccgtggccgacaacgtcaccctcaacaatctattgcccggccagttcgccaccgaccggctgcgcggcaacttcgccgcgatcgccgagcaacaaggcaccagcgccgaggcggtggccgcgcacaaacgcgccggcatcccggccgggcgctttggcgagccggacgaattcggcgcggcctgcgcattcctgtgcagtgcccaggccggctacatcaccgggcagaacctgctgattgacggcggc

SEQ ID NO: 39998 - DNA, 2022 bp, Xanthomonas campestris
ggccgtcccaatccactcggtgccacctgggatggcctgggcgtcaatttcgcgctgtattcgcgcaacgccacccgcgtggagctgtgcctgttcgacgagcgtggccgtgagcaggaacgcattcccttacccgaatacaccgacgaggtctggcacggttacctgcccgacgcgcgcccgggccagctttacggctaccgcgtgcatggcccgtacgcacccgatgccggccaccgcttcaaccacaataaattgctgctggacccgtatgccaagcagatcgtgggcgagctcaaatgggcgccgcatctgttcggctacaccatcggtcatcgcgacaaggacctgagttttgaccgccgcgacagcgccgcgttcatgcccaagtccgcagtgatcgacccggcctttacctggggccaggaccgcccgccgcagaccccgtggaaccgcacggtgatctacgaggcgcacgtgcgcggcctgagcatgctgcacccggccgtgccaccggaaaaccgcggcacgttctcggcgctgaagaccgacgagctgatcgatcacatcagttcactcggcgtcactgcggtcgaattgctgcccgtgcacgcctttgtcgatgaccagtacctgctggaaaaaggcctgcgcaattactggggctacaacacgctgggctttttcgcgccgcagggccgttacatgtccacgcgcacggtggccgagttcaagcagatggtggcgcggttgcaccacgccgggctcgaagtgctgctggatgtggtctacaaccacaccgccgaaggcaacgagctcgggccgacgctgtcgttcaagggcatcgacaacgccagctattaccgcctggccgacgatcgccgtttctacatcaacgacaccggcaccggaaataccttcgacctcaccaacgttggcgcgctgcgcatggtgatggattcgctgcgttactgggtgcaggaaatgcacgtcgacggcttccgcttcgacctggccagcatcctcggccgcgagcgctatggattcgatccttcaggcagcttcctggatgccgtacgccaggatccggtgctcagccagaccaagctgatcgccgagccgtgggacatcggccccggcggttatcaggtgggcaacttcccgccaggttgggtggagtggaacgacaaattccgcgacaacgtgcgtgcgttctggcgtggcgatggcggccagctggcagaactggccacgcgcctcaccgggtcggcagacctgttcaaccacagcggccgccgccccaccgcgtcggtgaatttcgtcaccgcgcatgatggcttcaccttgcgcgatctggtcagctacgaaggcaaacacaacctcgccaacggcgaagacggccgcgatggcagcgatcacaatatctccgccaactacggcgccgaaggcgagaccgacaaccccgccatcaagcagctgcggcggcaacagatgcgcaacctgctggccaccttgctgctctcgcaaggcacgcccatgctgctggccggcgatgaattcgggcatagccagaacggcaacaacaacgcgtattgccaggacaacgagctgacctggatcgactggaccgcggccaccaaagccgccgccgccgatcaggccgccttcgttcgccgcctgatccgcatccgccagcggtacccgttgctgcatcgcgcacgcttcttcgacggcaagttcgatgaagcactgggcctgaaggatctgacctggctggcgcccaacggcaacgagatggacgaagccgcctggcacgaccccgaagcccgcgcgctgatgctgcgcctggacggtcgctcgccgaccaccggcctgcgcgagatcgccgccaatgtgacgctgttgatgctgatcaatgccgcgcccaccagcgtcgctttcacgctcccggcgatgcacgacgaacactggcgcgtgctggtggacaccgcgcgtcatggtggccgcgtggtcgccggtggc

SEQ ID NO: 39999 - DNA, 2142 bp, Xanthomonas campestris; identical to SEQ ID NO: 39258

SEQ ID NO: 40000 - DNA, 1386 bp, Xanthomonas campestris; identical to SEQ ID NO: 39259

SEQ ID NO: 40001 - DNA, 594 bp, Xanthomonas campestris
gggtgcatgcgcatgagccagtccgaccagcccgattcatccgttacccaggcccaggccgaagaggccgtgcgcaccctgctgcgctgggccggtgaggatcctgcccgcgaaggcctgctggacaccccgcgccgggtggccgaagcctatggcgactggttcagcggctaccgcgaagaaccgcgcgcctacctggagcgcaccttcgaagaagtggccggctacgacgaattgatcgtgctgcgcgacatctcctacgaaagccattgcgagcaccacatggcgccgatcatcggcaaggtgcacgtgggctacctgccgcgcggcaaggtggtgggcatcagcaagctggcccgcgtggtggaaagctacgcgcgccgcttccaggtacaggaaaagatgaccgcacagatcgcccagtgcatccaggacgtgctgcaaccgcgcggtgtgggcgtggtggtggaaggcgcgcacgaatgcatgaccacccgcggcatccacaagcgcggcgtcagcatggtgacctccaagatgctcggcagcttccgcgaggacgcgcgcacccgcgccgaattcctgcagttcatc

SEQ ID NO: 40002 - DNA, 1611 bp, Xanthomonas campestris; identical to SEQ ID NO: 39638

SEQ ID NO: 40003 - DNA, 2160 bp, Xanthomonas campestris; identical to SEQ ID NO: 39639

SEQ ID NO: 40004 - DNA, 741 bp, Xanthomonas campestris
ttcagtctcgaaggcaaggtcgcactggtcaccggtgccaacactggcctgggccagggcatcgcgctggcactggcagaggcgggcgccgacatcgccgccgccggcatccaggcaccgaccgagaccgaagaaaaggtcaaggcgatgggccgccgcttcgtcgccatcgaagccaacctgatcagcatcgagccggtgcagcgcatcctcgatgaaaccctcgccggcctgggccgcctggacatcctggtcaacaatgctggcctgatccgccgcaccgatgcggtggatttcagcgagcaggattgggacgacgtgatgaacgtcaacctgaaatcggcgttcttcatgtcgcaggccgccggccgccacttcatcacgcagggcagcggcaagatcatcaacatcgcctcgatgctgtcgttccagggcggcatccgcgtgccgtcctacaccgccagcaagtccggcatcgccggcatcacccgcctgctggccaacgagtggggcagcaagggcgtgaccgccaacgccatcgcccccggctacatggccaccgacaacaccgcgcagctgcgtgccgaccaggaccgcaacaagtccatcctggaccgcatcccggccgcgcgctggggtgtgccggccgacctcggcggcgcggcggtgttcctggccagcagcgcctcggactacgtcaacggcgccatcatcccggtcgacggcggctggctggcgcgc

SEQ ID NO: 40005 - DNA, 1017 bp, Xanthomonas campestris
tgggggatgctggccgtgctgctggtgttcacccaactcaccatcttcgcggtgaccttgtacctgcatcgcagccaggcgcaccgcggtgtggatttccatccggtcatcgcgcatttcttccgtttctggacctggctcaccacctcgatgatcacccgcgagtgggtggcgatccatcgcaagcatcacgccaaggtggaaaccgaggaagacccgcacagcccgcagaccaagggcatcggccaggtgttctggcgcggcgtggagctgtaccgcgaagcacgcgcgcagcgggccgacatcgagcagtacggcaagggcgcgcccaatgactggatcgagcggcatctgtacacgccgcacgccaacgccggcccgatcgcgctgttggtggtcaacagcgtgctgttcgggctgcccggtatcgcactgtgggcgatccagatggcgtggattccgttctgggccgccggcgtggtcaatggcctggggcattggtggggctatcgcaatttcgagtccgccgacacctccaccaacctgaccccgtgggcgctgtggatcggtggcgaagaactgcacaacaatcaccatgccttcccgagttcggcgcggttttcgatgcggcgctgggagctggacatcggctggatcgcgatccgctgcctgcaggcgctgggcctggccaaggtgctgcgggtggcgccgtcgctggacattcgccccaacatcgccgtgcccgatgccgacacgctcaaggcactgttgtcgcaccgcttccaggccatgaccgactaccagcgcaacgtgctcaagccggccctgcgcgaagaggccgccgccaccggtgccaagctgcgccagctgctaccgcgccgcctgcgcaagggcctggtggacgatggccgctggctcaagcccgatgcgcgcgaacagttgcaacactgggtggcgcaacgcccgcgcatgcgcacgctggtggaataccgcgcgcgcctcaccgccgtgctggaa

SEQ ID NO: 40006 - DNA, 1248 bp, Xanthomonas campestris; identical to SEQ ID NO: 39643

SEQ ID NO: 40007 - DNA, 711 bp, Xanthomonas campestris; identical to SEQ ID NO: 39266

SEQ ID NO: 40008 - DNA, 801 bp, Xanthomonas campestris
cccggcaccattcatgagctgcagcccaaggccgaccatggcgagcagagctatcagggcttcggccgcctgcagggccgcaaggcgctgatcaccggtgcggactcgggcattggccgcgccaccgccatcgcctatgcgcgcgaaggcgcagacatcgtgctcaactacctgcccgaagaagaacaggatgccgccgaggtggtgcagctcatccaggctgaaggccgcaaggccatcgccgtgccgggtgacctcaaggacgaagccttctgcaaccagttggtggagcgtgcggtgaaagaactcggcggcctggatctgctgatcaacatcgccggcaagcagaccgccatcaaggacatcgccgacatcaccaccgagcagttcgacgctaccttcaagaccaacgtctacgcgatgttctggctgtgcaaggcggccatcccgcatctgccgccgggcgcatccatcatcaacaccggctcgatccagtcttaccagccctcgcccaccctgctcgactacgcctccaccaaggcggccatcgtcaacttcaccaaggggctggcgcagcaggtggccgaaaaaggcatccgcgtcaacgccgtggcgccgggcccggtgtggacgccgctgcagcccagcggtggccagccgccagaaaagatcccggaatttggctcggaaacgccgatgaagcgcgccggccagccggtggaaatggcaccgctctacgtcctgctcgcctcgcaggaatcgagctatgtcaccggcgaggtgttcggcgccaccggcggc

SEQ ID NO: 40009 - DNA, 1473 bp, Xanthomonas campestris
gtcatgccacgtttccccgaccagctgctgtacatcggcggccgctatgttcccgcccgcggcggccacacgttcgaggtggtgaacccggccaccggtgaagtccttgccaacgtccacaacgccggcgccgacgatctggatgcagccgtggacagcgccaaggccggccaacggcactgggccgcactcacggtggtggagcgctcacgcatcctgctgcgtgccgtcgcgctactgcgcgagcgcaacgacgccctggcggagctggaaacgctcaacaccggcaagccgctgagcgaaacgcgcagcgtggacatcgtcaccggcgccgacgtgctggagtactacgccggcgtggcgcaggcgctgcaaggcgtgcaagtgccattgcgcgaaggcagcttcttctacacgcggcacgagccgcttggtgtggtgggtgctatcggcgcgtggaattacccgatccagatcgcgctctggaaagccgcaccggccctggccgccggcaacgcgatgatcttcaagcccagcgaggtgacgccgctcaccgcgctcaagctggctgaaattttcaccgaagccggcctgccggatggcgtgttcaacgtgctgcccggcgacggcgccagcgtgggccacgcactcaccgagcatccggagatcgaaaagatcagcttcaccggtggcaccgcaaccggccgcaaggtgatggccagcgcctccagctcgtcgttgaaggacgtgaccatggaactgggcggcaagtcgccactgattgtctgtgccgatgccgacctggacctggcggccgacatcgcgatgatggccaacttctacagctccggccaagtgtgcaccaacggcacgcgcgtcttcgtgccacgtgcactgcgcactgcattcgaagcgcgcctgctggcacgcgtgcaacgcatccatatcggcgacccgctcgatgagcgcaccacgttcgggccgatggtcagtgccgcgcacatgcagcgcgtgctggaacacatcgagcaaggcaaggccgaaggggcgcgcctgctgtgcggtggcgagcggctgcgcgatggtgcactggcgcagggctgctacgtggcgccgaccatcttcagcgattgcaccgacgtgatgaccatcgtgcgcgaagagatcttcgggccggtgctgagcctgctcacctacgacgacgaagacgaggcaatcacgcgcgccaacgccaccagctatgggctggcggcgggtgtggtgacgccggacctgtcacgcgcgcatcgtctgatccatcgcctggaggccggcatctgctggatcaacacctggggcgaatcaccggcgccgatgccggtgggcggctacaagcaatcgggtgtgggccgcgagaacgggctggccacgctgcaggcctacacacgcaccaagtctgtccaggtcgaactggaacgctacgcgtcggtgttc

SEQ ID NO: 40010 - DNA, 1656 bp, Xanthomonas campestris; identical to SEQ ID NO: 39647

SEQ ID NO: 40011 - DNA, 1107 bp, Xanthomonas campestris; identical to SEQ ID NO: 39645

SEQ ID NO: 40012 - DNA, 2565 bp, Xanthomonas campestris; identical to SEQ ID NO: 39651

SEQ ID NO: 40013 - DNA, 2202 bp, Xanthomonas campestris
tgccccttcaaccacagcgtcgtcggcgccggcaccaccaatcgcgattggtggcccaagcaactgcgtgtggacctgctcaaccagcactcggcccgctccaatccgctggcggcgtcttttaactacgcggaagccttcaagcgcctggacctgcagacactcaagcaggagctgcgcgcattgatgaccgattcgcaggactggtggccggccgacttcgggcattacggcccgctgttcgtgcgtatggcctggcacagcgccggcacctaccgcaccggtgacggccgcgggggcggcggccgcgggcaacagcgcttcgcgccactcaacagctggccggacaacgtcagcctggacaaggcacgccgcctgctgtggccgatcaagcaaaagtacgggcaggcgatttcctgggccgacctgatgatcctcaccggcaacgtcgcgctcgaatccatgggcttcaagaccttcggctttgccggcggccgggaagacacctgggagccggaccaggacctgtactggggccgggaaaccaagtggctgggtggcgatgaccgctacgcgcacggctcgccgggcgtggaccaggcgcatggcgtgctggtcaaggacgacgacagcgaagtgcagcacacccgcgatctggaaaacccgttggccgccgtgcagatgggcctgatctacgtcaacccggaaggcccggacggcaatccggatccgctattggcggccaaggacatccgcgacaccttcggccgcatggccatgaacgacgaagagaccgtggcgctgatcgccggcggccacaccttcggcaagacccacggtgctgccgatgcggcgcacgtggcggccgagccggaagccagcgacctggaaagccagggcctgggctggcacaacagcttcggcagcggcaagggcggcgacaccatcaccagcggcctggaagtgacctggaccaccaccccggcgcagtggagcaacgactttttcgaccacctgttcggcttcgagtgggagctgagcaagagcccggccggtgcgcaccagtgggtggccaagaacgcccaggccatcattcccgatgcgcacgacgcctccaaaaagcgtttgccaacgatgctcaccaccgacctggcactgcgcatcgatccggcgtacgaggccatctcgcgccgcttccacgccaacccggaccagttcgccgatgcctttgcgcgcgcctggttcaagctcacccaccgcgacatgggcccgcgcgcgcgctatctcggcgcggatgtgccggccgaagaattgctgtggcaggacccgatcccggccttaaaccatgcgctgatcgatgcgcaggacgctgccgcgctcaagcagaccgtgctgagctccggcctgagcgttgcgcaactggttgccactgcctgggcctcggcgtccagcttccgtggctcggacaagcgcggcggtgccaatggtgcgcgcattcgtctggccccgcagaaggactgggcctccaacgagcctgcgcagctggcccaggtgctggccacgctggagcgtatccaggccgacttcaatgcacgccagtccggtggcaagcagatctcgctggccgacctgatcgtgctgggcggcaatgccgcagtcgaacaggccgcgcacgccgccggccacgcggtcaccgtgccgttcgcccccggccgcatggatgcctcgcaagcgcagaccgacgtggaatcgttcgcagtgctcgagccggtagccgatggcttccgcaactacgccaaggcccgctacgcggtgtctgccgaagcgctgctgatcgacaaggcccagttgctgaccctcaccgcaccggaaatgaccgtgctggtcggcggcctgcgcgtgctcggcgccaacaccgggcagtcgcacaatggcgtcttcaccacccgtccgggcgtgttgagcaacgacttcttcgccaacctgctcgacatgcgcaccgagtggaaagccacgtccgagaccaaggaaacctacgaaggccgcgaccgtgccaccggtgagcacaagtggaccggcacccgcgtggcatctggtgtttggttccaactcgatcctgcgcgcggtggccgaggtctatgccagcgccgcacgatcagcaaaagtttgtgcaggacttcgtgcccgcgtggaccaaggtga

SEQ ID NO: 40014 - DNA, 1476 bp, Xanthomonas campestris; identical to SEQ ID NO: 39653

SEQ ID NO: 40015 - DNA, 1234 bp, Xanthomonas campestris; identical to SEQ ID NO: 39272

SEQ ID NO: 40016 - DNA, 813 bp, Xanthomonas campestris; identical to SEQ ID NO: 39654

SEQ ID NO: 40017 - DNA, 1764 bp, Xanthomonas campestris; identical to SEQ ID NO: 39655

SEQ ID NO: 40018 - DNA, 1776 bp, Xanthomonas campestris; identical to SEQ ID NO: 39656

SEQ ID NO: 40019 - DNA, 1215 bp, Xanthomonas campestris; identical to SEQ ID NO: 39282

SEQ ID NO: 40020 - DNA, 2547 bp, Xanthomonas campestris; identical to SEQ ID NO: 39663

SEQ ID NO: 40021 - DNA, 1263 bp, Xanthomonas campestris
tggaagcctgaaaccatcgccgtgcacggtggctaccgtcctgatcccaccacccgcgcggtggcggtgccgatctatcagaccgtggcgtatgccttcgacgacacccagcatggcgcggatctgttcgacctgaaagtgcagggcaacatctacagccgcatcatgaatcccaccaacgacgtgctggaacagcgcgtggctgcgctggaaggcggcatcggtgcgctggcactggcgtcggggcaggcggcggtgacctatgcgatccagaccattgccgaggctggcgacaacatcgtctcctccagcgcgttgtatggcggcacctacaatctgttcgcgcacacgctgccgcagttcggtatcaccacgcgctttgccgattaccgcgatccgcaggcgtttgccggcttgatcgacgagcgcaccaaggcggtgttcgtcgagtcgatcggcaacccgcgcggcaacatcaccgacatcgaagcggtggcggcagtggcgcatgcgcacggtgtgccgctgatcgtggacaacaccgtcgccacgccgtcgctgctgcgcccgatcgacttcggcgcggatatcgtggtgcattcgctgaccaaatacctgggcgggcacggcaacagcatcggcggtgcgatcgtggacagcgggcgcttcccgtgggcggcgcacaaggcgcgctttgcgtgtctcaacgagccggacgtgagttaccacggcgtggtctataccgaagccctgggcgaggccgcctatatcggtcgtgcgcgcgtggtgccgctgcgcaataccggtgcggcgttgtcgccgttcaatgcattcctcattttgcaaggcatcgagaccctgccgctgcgcatggagcgcatcaatgccaacacgttggcgattgcccggtatctgcaggaacacgcgcgcgtggcctgggtcaattacgccgcattgccggatcaccccgagcatgcgttggcgcagaagtatctgggcgggcatggctcgggcgtgttgaccttcggactgccgggtggacgcgcggcgggtgcgcggtttctggatgcactgcagctgttcacacggttggtcaacattggcgacgccaaatcgctggccacgcatccggcctccaccacgcaccgtcagctcggcccggccgaactggagcatgccggcgtcagcgaggacaccgtgcggttgtcgattgggatcgagcacatcgatgatctgctggcggatctggagcaggcgctgcag

SEQ ID NO: 40022 - DNA, 2358 bp, Xanthomonas campestris
ggcgggcgcctggtggccgttggtggctcctggtactacgtgctggccggtatcgccgtgctggtggccggtgtgctgctggcactgggcaaacgcgctggcctgtggctgtttggcgctacgttggcggccaccatcgtgtgggcgctgtgggaagtgggcctggatggctggggcctgatcccacgtctggcctggatctcggtgctcggcctggtgctgttgccgttctggggcgtggcgcggcggcgcatgcagccgttgtccgggctcggctatgtcgtggtcaccggcgtgctgccggtgctgggtgcggcgctgatcctgtggccgctgctggtgccgcgcaatgtggaactggccgatgcatccaagcagccggccgatgcggcaacgccgttcagccgtggcagcgtgcccagcccggacgggaacgtggcggccaaccacgatgccagtaactggaccgcctacgccggttccaacctgtccaaccattacacccccggcgcgcagatcacgccggagaacgtcaagggcctcaaggtggcctgggaattccataccggcgatctcaagccgaaggattccaagctgggctatgcgttccagaacaccccgctcaaggtcggcgacctgctctacatctgcaccccgacccagaaggtgattgcggtggaggcggccaacggcaaggagcgctggcgcttcgacccgcagaccaatccgaaggcgatggccggcgtggccgccaccacatgccgcggcgtgtcgtactaccaggcgccggaaggcactgccgagtgcccgacgcggatcttctggccgatggtcgatggccgcctgggtgcgctggatgcgcagaccggcaagctctgcgccagcttcggtaacaacggctatgtggacctcaatgccggcaccggcaacaccaagccgggcttcgtcggcccgacctcgccgccggtggtcatgcgcggtgtggtgatccagcccaccgggcaggtgcgcgacggtcaggaacgcgatgcgccgtccggcgtggtgcgcggcttcgacgcgctcaccggccagctgcgctgggcctgggatctgggcaacccggccatcaccgccgaaccgccggccggccagacctatacccgctccaccccgaacgtgtggtcgctgatggccgccgatgacgagctggggctggtgtatctgcccaccggcaacgctgccggcgacttcttcggcaagggccgcaccccgcaggaagaggaatacaccgcctcgctggtggccgtggatgcggcaaccggcaaggagcgctggcacttccgtaccgtcaatcacgatctgtgggactacgacatcggcccgcagccgaacctggttgattggccggttgccggcggtggcacccgccccgccgtgatccaggccaccaagtccggccaggtgttcgtgctcgaccgcgccaccggccagccgatcatgcctgtcaagcagatcgccgtgccgcagggcaccgaccatggcgactggaccgcatccacccagccggtgtcgccgggcatgcccaacaccgtgggtgcgcccagccgtgactacgagaccatcgttgaatctgacgcgtggggcatgaccccgttcgaccagctcgcttgccgcatcgagttcaagaagctgcggtacgaaggcatgttcaccccgccaagcctgcagggctcgctgtcgttcaccggcaaccatggcggcatcaactggggcggcgtgtcggtcgatctgcagcgcggcatcatggtgatgaacagcaatcgcctgccctataccgagcacgtctacccgcgcacggtgatgaacgagctgggcgtggtgtcggtgttcaacggcagcagcaagaccaagggctacatggcgcaggaaggcctggcctatggcgcgcgcaaggagccgtggatgtcgccgctcaacacgccgtgcgtggcaccgccgtggggctatatctccggcgtggatctgcgcacgcagcaggtgatctggcgccgtccgctgggcaccggttacgaccagggcccaatgggcatcccgtccaagaccaagttcgagatcggcaccccgaacaacagcggctcgctggccactgccggcggcgtcaccttcatcggtgccagcctggacaacttcatccgcggctttgacacccgcaccggcaagcaggtctgggagacccgcgtgcctgcgggcccgcaggccgcgccgctgagctacaccatcgatggcaagcagtacatcgttgccgcggtgggtggccatgtccgcatggaaaccaagtcaaaaaacagcgtctttgcctgggcactgcccgacgac

SEQ ID NO: 40023 - DNA, 1356 bp, Xanthomonas campestris; identical to SEQ ID NO: 39284

SEQ ID NO: 40024 - DNA, 1458 bp, Xanthomonas campestris
ggcgggttcgccgagccctatcgctggaccacgtatgtggagcaattgcagcgtgccggcgtgtcctggcagatctaccaggacatgcgcgacaacttcaccgacaacccgctggccggcttcgacgtcttccgccaggcctacagccagacgcccggccacgatgcgcaactgcgcgcgcgtggggtgagtacgcgtggcgtggagcaactgcgcgaagacgtcatcggcgggcgcctgccgtcggtgagtttcatcattgccgatgccgccggcagcgaacatcccgacccctccagcccggcccagggcgcggcctataccgcacgcgtgctggatgcgctcaccgccgatccgcaggtgtggagccgcacggccttgctgctgatgttcgacgagaacgatggcttcttcgaccacatgccgccgccggcgccgccttcgccggacccacgtgcggctggcggctttgccggtgcgtcgagcatcgccaccgacgacgagtatcaccgccacccggcgccgggcgagcagaaggtggacctgccggagtggcgcgggcgcccatacggcctgggcccgcgcgtgccgctgtacgtactctcgccctggagccgcggcggctgggtggattcgcaggtctacgaccacacctcggtgctgcgcctgctggagcggcgcttcggcgtgccatgcactgcaatcaccccgtggcggcgcgcggtgtgtggcgatctcactgcggcgttcgatttcagccgcacggacacgcgcccgttcgtcggcacgctgccggatatcagcgccaccgccacgcgcgccgccgccctgcaccaacacacgttgccaccgctgccgcccaccttgcagccaccggagcaagctttcggcctccggcgttcgcgcgcggtgccgtatcgcccccgtgtgcaactcgatgtcgtgcaggcccgcggcgaagtggtgttgcgcatggccaatgccggcgcggcggccgtgctgcacgtctacgagcgctacgacctggccgcgattccgcgccgctacaccgtcggcgccgatgcgccgctggacggcacctggacgacctacgacggccgctacgacctgtgggttctcgggccgaacgggttccatcgccattaccgcggcgatgtgggcgtcgcccccttgatcgccgatgttgcgcaagatcccggtgatgcacaggcgctccgcctgacgctgcacaaccccggcaacgtgccggtcgcggtcacgctgcaaccggccgcgtatgccaacgcgcaaccgcgcgagggtgtcaccatcgcgcccgggcagcatcaccagcgcagctggagcgccgcggccaccggcggctggtacgacctgtggatcgaacacgacggcgcaagccaacgcctggccggccgcgtggaaaccggagcagacagcgtcagcgacccggccatgggc

SEQ ID NO: 40025 - DNA, 1446 bp, Xanthomonas campestris; identical to SEQ ID NO: 39291

SEQ ID NO: 40026 - DNA, 777 bp, Xanthomonas campestris; identical to SEQ ID NO: 39673

SEQ ID NO: 40027 - DNA, 2025 bp, Xanthomonas campestris; identical to SEQ ID NO: 39667

SEQ ID NO: 40028 - DNA, 1710 bp, Xanthomonas campestris; identical to SEQ ID NO: 39295

SEQ ID NO: 40029 - DNA, 1002 bp, Xanthomonas campestris; identical to SEQ ID NO: 39671

SEQ ID NO: 40030 - DNA, 261 bp, Xanthomonas campestris
gtgattgatctgtcgcccactgccgatttcgaaaaaggccacatcgccggcagccgcaacgtggcgctggccaagttcgacccagccggcaagttgctcgccaatgccaagtcctcgccggtggtggtggtctgccgcagcggcaacgcctctgccggcgctgccaagacgctgaagaaggccggcttcgagcaggtctactggctggagggtggcattgccgcctggcagatggccgagctgccgctggtcaagggccgc

SEQ ID NO: 40031 - DNA, 1263 bp, Xanthomonas campestris
cgtcccgtcgccatcctgggcggcgttcgtatcccgttctgtcgccagaacaccgcatacgcggacgtgggcaacctgggcatgtcggtgcgcacgctgggcgcgctggtcgaacgcttcgggctgcatggccagcaactgggcgaggtggcgatgggggcggtgatcaagcattcctccgactggaacctggcccgcgaagccgcgctgtcgtcgggcctgtcgccgctgacgccgggcatcaccctgcagcgcgcctgtggcaccagcctggattcggtgatcaccatcgccaacaagatcgcgctggggcagatcgactcgggcatcggcggcggctcggacaccacctccgaggtgccgatcgtctacggcaagaagctgcgggcgcgcctgctggccgccaaccgcgcgaaggcgaccagcgacaagctcaaggcgctgctacgcggtttcaagctgggcgagctcaagccagagttccccggcgtggccgagccgcgcaccggcaagagcatgggcgaacactgcgaagacatggccaaggaatggaacatctcgcgtgattcgcaggacgaatgggcagtggcttcgcaccacaagttggcggccgcgtatgagcgcgggtttttcgattcgctgattgccccgttccgtggcgtgtcgcgcgacaacatcctgcgcgcggacacctcgctggaaaagctggccacgttgcgcccggcgttcgacaagacctccggccgcggcacgctcactgccgccaattccaccccgctcaccgatggcgccgccgcggtgctgttgtccagcgaagcctgggcgctggcccatggccacacgccgatggcctacctgcgcgatgcacaggtctcggcggtggatttcgtgcatggcgagggcctgctgatggcgcccacggttgcggtgccgcagatgctggcccggcacgggctgaccttgcaggacttcgacatctacgagatccacgaagccttcgccgcgcaggtgctgtgcacgctgcgcgcctgggagagcgaggattactgccgcaatcgcctggggctggacgcgccgctgggccgcatcgacccggacaagatcaacccgctgggctcctcgctggccaccggccacccgtttgccgcgaccggcgcacgcgtcgtggctaccgcagccaagcagctggaagaacgcggcggcggacgtgccctgatttcgatctgcaccgccggcggcatgggcgtggtggcgatcgtggaa

SEQ ID NO: 40032 - DNA, 963 bp, Xanthomonas campestris; identical to SEQ ID NO: 39299

SEQ ID NO: 40033 - DNA, 918 bp, Xanthomonas campestris
tctacgctcgctttcgtgtttcccggccagggctcgcagtccctgggcatgctggctgaacttgccgaactgcatccgcagatccgcgagaccttcgtcgaggcctccgatggcgccggcgtcgatctgtgggccctgtcgcagggcggcccggaagagatgctcaaccgcaccgaatacacccagccggcgttgctggccgccggtgtggcggtgtggcgcctgtggaacgcgcagcgcggcgaacgaccggcggtgctggccggccatagccttggcgagtacaccgcactggtcgctgccggcgccttgtcgctgcacgatggtgcccatctggtgcggctgcgcgggcagttcatgcaggcagcggcgcccgccggtgtcggcgcgatggccgcggtgctgggcgccgaggatgcgctggtgcgcgaggtctgtgtcgaggcctcgggcagccaggtggtggtgccggccaacttcaattcgcccggtcagattgtgatcggtggcgatgcggcggcggtggatcgcgcgctggcgttgctggccgagcgtggcgtgcgcaaggcggtcaagctggcggtgagcgtgccgtcgcacactccgctgatgcgcgaggcggccaaccagttgggtgaggcgatggccgggttgacctggcacacgccgcagattccggtggtgcagaatgtcgacgcgcaggtgcacgccggccacgaggcgatccgccaggccctggtcgagcagctgtatctgccggtgcagtggaccggctgcgtgcaggcgctggccgcgcagggcatcagccggatcgccgaatgcggcccgggcaaggtgctgagcgggctgatcaaacgtatcgacaaaagcctggatgcccgttcgctcgcgaccccggccgattacgccggcgcgctg

SEQ ID NO: 40034 - DNA, 726 bp, Xanthomonas campestris; identical to SEQ ID NO: 39676

SEQ ID NO: 40035 - DNA, 225 bp, Xanthomonas campestris; identical to SEQ ID NO: 39677

SEQ ID NO: 40036 - DNA, 1227 bp, Xanthomonas campestris; identical to SEQ ID NO: 39303

SEQ ID NO: 40037 - DNA, 3039 bp, Xanthomonas campestris
ttgcgtgccgccatcaccgctgcctggctcaaggacgaaaccgagcacgtccgtgaattgctggagcaggcgcgcctgccggccgcagagcaggccaaggtgcaggcgctggccgccgacctggtcacccgggtgcgcgcacgtgcccaggatcagggcgcgatcgaagcctttatgcgccaatacgatctgggcagcgaagaaggcgtgctgctgatgtgcgtggccgaagccttgctgcgcattcccgaccaggacaccgccgacaagctgatccgcgacaagctgggcgaggcggactggaaaaagcacgtgggtggcagtgattcggtgctggtcaacgcatccacctggggcttgatgctcaccggcaagctggtgcagctcaacgaccttacccgcgccgatgtgccgggcgccttcaaacggctgatcggccgcgtcggcgagccggtgatccgtttggccgtgcgccaggcgatgaagatcatgggccaccagttcgtcatgggccgcaccatcggcgaggcgctggcgcgttcgcgcaagggtgacaacgccaattaccgctattcgttcgacatgctcggcgaaggcgcgctgaccatgaaggatgcgcagcgctatctgcaggcgtatcgcgatgccatccacgccatcggccgcagtggcagcttcgtcggtaccgacgtgtttgccgcgcccagcatttcgatcaaattgtccgcgctgtatccgcgctacgaacacgccaagcgcgcacgcgtgatggccgagctggttcccggcgtgctggagctggcacaactggccaagtcctacggcatcggctacaccgtcgatgccgaagaggccgaccgcctggagctctcgctggacatcatcgaagccacgttttccgatccatcgctggatggctgggagggctacgggctcgcagtgcaggcgtatcagaagcgcacgccctacacgatcgatttcctcgccgatctggcgcgtcgcgttggccgccgcattccggtgcgtctggtcaagggcgcgtattgggacgcagagatcaagcgtgcgcagatcgacggccaccccgggtatccggtatttacccgcaagcagaacaccgacgtgtcctatctggcctgcgcacgccgcatgttcgcgcacagcgacgcgctgtacccgatgttcgccacccacaacgcacagaccatcgctgcggtgcgcgcgatctcggcagggaaaacctacgagcaccagaaactgcacggcatgggcgatgacctgtatgccgaggtgattccggccgatcggctgggattgccgtgccgggtgtatgcaccggtcggctcgcacgaagacctgttgccgtacctggtccgtcgtctgctggaaaacggcgccaactccagcttcgtcaatcgcatcaccgatgaagacgtcgccatcgaagacctgatccgcgatccggtcgaggcggtgtcctcgtttgcgtccatcccgcaccccaagatcccgctgccggccgacctgctgcgcagccagaaccagaacaggaagaactccatgggcgccaacctcgccaacgacaacgatctgcggcagctggccgaccaactcactgccgcgatcaagccgtggaacgccgcgccgctggtgccgggtgccgtgatcaccacgccaagcgaggccgtgctcaacccggccgaccgccgcgagacagtcggccactggcagcctgcggacccggccaccgtgcagaaggcattggcgtctgccgcagccgcccagccagcgtggaatcgcacgcctgccgccagccgcgccaccattctcgaacacgccgcagacctgctcgaggcccgcatgccggagttcatggcgatctgcgtcaaggaagcagccaagaccctgccggacgccgttgccgaggtacgcgaagccttggacttcttgcgctattacgctgcccaggcgcgtgcgcagtttggtgcgcctgagcgcctgccgggccccaccggcgaatccaatgagctgcagctgcatggtcgcggcgtgttcgtctgcatcagcccctggaacttcccgctggcgatcttccttggccaggtcgccgcagcgctggcggcaggcaacgccgtcatcgccaagccggccgagcagaccaatctggtgggctttgcggcggtcaaactgttgcatgaagccggcgtgccggaagccgctgtgcagttcctgcccggcgatggcgccacggtcggcgccgcgttgaccaacgatccccgcgttgccggcgtcgctttcacagggtccaccgacaccgcccgcatcatcaatcgcaccctcgccgcgcgtgacgccgcgattggcgtactgatcgccgagaccggcggccagaatgccttcatcgccgattcgtcctcgctcccggaagccgtagtcaaggacgccatctccagcgccttcatctctgctggtcagcgctgctccgcagcccgcgtgctgttcgtgcaggaggacatcgccgacaaggtcatgaccatgctcgccggcgcgatgggcgagctgaaaatcggcgacccggccctgctctccaccgacgttggtcccgtaatcgacgccgatgccctgaagatcctggaagaacacgcgagccgcatggacagcgaagcacgcctgatcggcacgaccacgctggacagcgccacggcatatggcagcttctttgctccacgtgcctacgaactgaagtccctggcgcagctgcagcgtgagattttcggccccgtgctgcacatcattcgctggaaagccgaccagctggattcggtcatcgatcagatcaacgccaccggctatggcctcaccctgggcgtgcattcgcggatcgatgagaccatcgatcgcatcacctcgcgcgtggccgtaggcaatgtctacgtcaatcgcaaccagatcggcgctgtggtcggcgtgcagccgttcggtggccagggattgtcaggcaccggcccgaaggccggcggtcctcactacctgctgcgc

SEQ ID NO: 40038 - DNA, 612 bp, Xanthomonas campestris; identical to SEQ ID NO: 39304

SEQ ID NO: 40039 - DNA, 804 bp, Xanthomonas campestris; identical to SEQ ID NO: 39686

SEQ ID NO: 40040 - DNA, 1047 bp, Xanthomonas campestris; identical to SEQ ID NO: 39312

SEQ ID NO: 40041 - DNA, 1269 bp, Xanthomonas campestris; identical to SEQ ID NO: 39688

SEQ ID NO: 40042 - DNA, 474 bp, Xanthomonas campestris
gcgccgctgcaaatccgccccgccacgcccgccgatgcggcgctgctgcacgaactggtcaccgcgctggcggtgtacgagcgcgagcccgacgcggtgaaggccacgcctgaggatctgcgcgccagcctgttcggcgacggtgccaccgcgcacgcgctgctctgcgagcagggcggccaggtgcttgggttcgcggtgtatttcttcaattactccacctggctgggccgcaacggcctgtatctggaagacctgttcgtgcggccgcaagcgcgcgggcagggcgccggcctggcgctgctgcggcatctggcgcagctggcggtggacaagggctgcggacgcttcgagtggtcggtgctggactggaaccagccggcgatcaagttctaccaggccgtgggtgcccgccccatggagtgctggaccgtgtaccggctcgacggcgagcgcctggccgcgtttgctgca

SEQ ID NO: 40043 - DNA, 879 bp, Xanthomonas campestris; identical to SEQ ID NO: 39691

SEQ ID NO: 40044 - DNA, 969 bp, Xanthomonas campestris; identical to SEQ ID NO: 39684

SEQ ID NO: 40045 - DNA, 1851 bp, Xanthomonas campestris
gaatttctggccaccatgagccatgagatccgcaccccgctcaacggcatcatcccgatgctggagctgatctcgcgtggccagctcagcctggaccaacgcgacatgctgcagaccgccaccggcagctcgctgcagctgctgcgcattgtcgacgacatcctggattactccaagctcgaagcgaacaagctcgaactggaaatcaccaccttcaacctgcgcgagctgctcgacggtgtcgcccagctgatgcagcgcaccgccgaaggcaagcaactgcgcctgggcctggacatcgaaccgtcggtgcgcctgctggtgcgcggcgacccgatccggctacgccaggtgctgggcaacctgatcggcaacgccatcaagttcaccgaacgcggcagcgtggacatccagctgcggcgcctgggcgaaacccgcgcccagcacctgctgcgcttccaggtccgcgacaccggcatcggcatcgcagcggaccagcaggcgcgcctgttccgctccttcgcccaggccgatgcctccactacccgcctgtatggcggcaccgggctgggcctggccatctgcaaacgcatcatcgacctgatgggcggccgcatcggcgtggaatcggagcccggtcgcggcgccacgttctggttcgaaatcccgctgctcaaggtcatcggcgacctgcaacagaccaccggcgccgacgccgcacgcgtgatggtgatcagttccgacgcgcgcctgtcgcagcggctcaagcgcctgctcgacagctggggcatctcgcacgtgctgatggaaaccacccaggaagcgctggagcgcgtgcgccgccacaccgacgacgaaggcttccgctgcgtcatcgccgaccacgagacgctgcgctacagcgcgcgcgccgtgcatcgcgccctggcacggccggaagacctcagcggctcacggctgatctggctctacggcgacgagccggtacccgacgaactgcaagccaacgccaccctggtgccgcgccagagcccggacgaaaccctgcgcgcgctggtactgccacccgagcccaagccatctgtggcgcccacgctggcgtccgcgatgatccccgagccactgccgccgccagtggcgcatgcgcgcgacgtgcgcatcctgttggtcgaagacaacccggtcaacctgctggtcgcgcaaaaactgctgggcgtgctcggcttcgaggccgacaccgccaccgatggcgaagccgcgctgagcagcatggagtccacccgctacgacatggttttcatggattgtcagatgccggtgctggatggctatgccgccacccgccgctggcgcgccatggaaaccgaaagcggtggccgcccgatcccgatcgtggcgatgaccgccaacgccatggccggcgaccgcgaacgctgtctggccgcgggcatggacgactatctctccaagccggtcgcccgcgaacagctcaatgcctgcctgcagcgctggctgccgcgccaggccctgttgccaggcccaagcaccggagcccccagcgcggatgccgagagcgctgccagcgccgcacaggcgcgcgcgctgccgatcctggagagcggcgtcatcgacgagttgtacgaggtggcaggcgcggacaccatccgcatcctgcagctgttcctggaagacgcccccggcatcatcgaagggctggaagcggccgccagcaatcgcgacagcatgcatctgcgcgatctggcccacaccctgaagtcctccagcgccaacgtcggcgcccaggcgctagccaacgccgcccgccgcatcgaattggccgcacgcaccggc

SEQ ID NO: 40046 - DNA, 606 bp, Xanthomonas campestris; identical to SEQ ID NO: 39692

SEQ ID NO: 40047 - DNA, 2226 bp, Xanthomonas campestris; identical to SEQ ID NO: 39318

SEQ ID NO: 40048 - DNA, 978 bp, Xanthomonas campestris; identical to SEQ ID NO: 39694

SEQ ID NO: 40049 - DNA, 813 bp, Xanthomonas campestris; identical to SEQ ID NO: 39695

SEQ ID NO: 40050 - DNA, 1503 bp, Xanthomonas campestris; identical to SEQ ID NO: 39696

SEQ ID NO: 40051 - DNA, 540 bp, Xanthomonas campestris; identical to SEQ ID NO: 39322

SEQ ID NO: 40052 - DNA, 897 bp, Xanthomonas campestris; identical to SEQ ID NO: 39324

SEQ ID NO: 40053 - DNA, 1962 bp, Xanthomonas campestris; identical to SEQ ID NO: 39325

SEQ ID NO: 40054 - DNA, 2387 bp, Xanthomonas campestris
ccatcgaacccgaacaacccgggcgctatgacgacggcaagccggtggtgtatgtgctcgaggattacggcctctctaatgccctgatcctggacaaggcctgccgcgaggccggcctgccgtcgccgctggtgccgctgccgggcgacccgctggagcgcaagcgcgcctacctggcgttgtcgcggcgcagcagcagcaactcgctgattcccgaacaacgcggcggcaagacgcattccgattcgctggccaagttgctgcaggcgcaccgcgtgcgcgccgacctggacgtgcatctggtgccggtgtcgatcttcgtcggccgtgcgccggacaagcagagcggctggtttgcggtgctgttttcggaaaactgggcgctggtcggccgcttccgccgcctgctctcggtactgctcaatggccgcaccaccatcgtgcgtttcgcgccgcccatctcgctgcgccagaccatggccgaagggctgccgcccgagcgcacgctgcgcaagttgcagcgcgtgttgcgcacgcatttccggcgcatccgcgaggcggtgatcggcccggacctgtccacccgtcgtctgctggtggaccaggtgctggccgccgattcggtgcgcgaagccatcgccacccaggccaagcgcgacaactccaagccggtcgatgcctggcgcaaggcgcacgcctatgcctgggaaatcgctgcggactattccagcccggtggtgcgctcggccagcttcctgctcactcatgtgtggaaccgcatctacgccggcgtgctggtgcatcacctggacaagctcaaacaggccgcgcccgggcatgaagtggtgtacgtgcccagccaccgcagccacatggattacctgctgctgagctacctgttgtatgagcgcggcatcgtgccgccgcacatcgtggcgggcatcaatctcaacctgccggtggtgggcacgctgctgcgcaagggcggtgcgttcttcatccgccgcagcatccgtggcaatgcgctgtattcggcggtgctgagcgaatacgtggcgcagctggtggctggcggttattcgatcgagtacttcgtcgaaggcgggcgctcgcgcaccgggcgcttgttgcagcccaagggcggcatgatcgcaatgacgctacgcgcgtatctgcgccagccgcgcaagccagtgttgttccagccggtgtacatcggttacgagaagctgatggaaggcaacagctatctcgacgaactcaccggccgcccgaaggaaaaggaatcgatctggggcctgctgtggtccatccccaaggtgctcaagcagaactacggccaggtggtggtgaacttcggcgagccgatcgcgctcaacgacgtgctggccaagcacgcgccggaatggaatgacgaaccgctgccagacgatgaaaagccgacctggcttgcaccggcggtggacacgttggccacgcagatccagacccgcatcaactgcgccgccgacgtcaatccaatcaacctgctcgcgctggcgctgctgtccacgcccaagcatgcgatgggcgaagccgatttgatcgcgcagatcgaactgtgcaagaagctgctggccgaaatgccgtattcggaccgcgtcacggtcacgccgcacacgccggcgcgcatcatcacccacgccgaagagatcaacgtgctcacccgcgtctcgcacccgctgggcgatgtgctgagcgtcagtggcgataccgcggtgttgctgagctacttccgcaacaacgtgctgcatctgtttaccgcctcctcgtgggtggcgtgctgcttccagaacaaccgccgcatgagccgcgccgggttgttgcggctgggccgcacggtgtacccgttcctgcaggccgagttgttcctgccgtggagcgaggaccgcttcgccgaacgcatcgagcagaccatcgacatgttcgtgcgcgagggcttgctgctcaacgtcaccgatgacgatggcggcatcctggcgcgcaacaccgggcagaccgacgaagtgttccgcctgcgtgcgatcggccattcgttgcagcaggcgttcgagcgctattacatcgccatttcggtgctggtgaagaacggccccggcgtgctcggtgccggcgagctggaaagcctgtgccagcaggccgcgcaacgcctgagcctgctgtacgcaccggccgcgccggagttcttcgacaagaccctgttccgcagcttcatccagaaactgcgcgaactgcgtctggtgtggccggacgagaacagcaagctgatgttcgacgagcgcctggacgcgtgggccaaggacgccaagttcatcctcggccgcgagctgcgccacaccatcgaacgc

SEQ ID NO: 40055 - DNA, 2511 bp, Xanthomonas campestris; identical to SEQ ID NO: 39327

SEQ ID NO: 40056 - DNA, 1116 bp, Xanthomonas campestris; identical to SEQ ID NO: 39328

SEQ ID NO: 40057 - DNA, 912 bp, Xanthomonas campestris; identical to SEQ ID NO: 39329

SEQ ID NO: 40058 - DNA, 885 bp, Xanthomonas campestris
ctgctggtggtcaacctcggcacccccgagtcgcccactgccccggccgtgcgccgctacctggccgagtttctcagcgaccgccgcgtggtcgccatcccgccgctgttctggaagccgctgctgtatggcgtgatcctgcccatccgcggccccaagtcggcagaaaaatacgccaaggtgtggctgccggatggctcgccgctggcggtgtacacgcggcgtctgaccgaaggcctgcagcaggtcatgcccgactggcacgtcacctgggccatgcgctacggcgcgccggccctgcgcaaggcgctggacggcctgcgtgcgcgcggcatcaagcgcatcgtggtgctgccgctgtatccgcagtattcgaccaccaccaccgcctcgatccaggacgtggtcgatgcctggcgcccgagcgcgccagagatcgcggtggaggtgatccaggactattgcgaagacgccggctgggtggcggcgatcgccgattccatccgcacgcactggcaggtgcatgggcgcagcgagaagctgatgttctccttccacggcctgccgcagcgtgtggccaacgccggcgacccgtatccgcagcagtgcgaacgcagcgcgcaggcgatcgtcaccgcgctgggcctgggcccggatgcgtggcagatgggctaccagtcgcgcttcggtgcagaacgctggttgcagccgtatgccgaacccacgctgtgggcactggccgagggcggcgtgcgcagcttcgacctggtgtgcccgggctttgccaccgactgcctggaaacgctggaagaagtggcgctgggctttgccgaaacgctggccgaacgcggcgccacgctgagctacatcccctgcctcaacgac

SEQ ID NO: 40059 - DNA, 282 bp, Xanthomonas campestris; identical to SEQ ID NO: 39332

SEQ ID NO: 40060 - DNA, 1425 bp, Xanthomonas campestris
atgcacgccacctctcgcccctgtccacgcacgttctggcaacgcgctcaccagttgctgttgatcgcgctgaccttgttgctgaccaccgccagcgcacaggccgacgtcatcctgcatgcgttcaactggccctacgccacggtagaagcgcgcgccaagcagatcgccgatgccgggtatcgcaaggtactggtcgcaccggcctatcgctccgaaggcagtgcctggtgggcgcgctaccagccgcaggatatccgcctgatcgacaatccactcggcgacaccaccgcgttcgcgcgcatggtgcaggcactggcaaacaacggtgtggaaacctatgccgacgtggtgttcaaccacatggccaacgaagcagcaacgcgctcggacctcaattaccccggcagcgcggtgctggcgcagtacgcagccaatcctgggcgctacgatgcactgcgcctgttcggcacggtgcagtccaactttttgagcgccagtgatttcgggccggcgcaatgcatcagcaactacaacgatgccttccaggtgcgcaattaccgcatctgcggcggcggcagcgatccgggcctgccggatctgctcggcaacgattgggtggtgcagcagcagcgcgcctacctgcaggcgctcaagggcctgggcgtcaccggcttccgcgtggacgcggccaagcacatgaccttcgaccatctcaaccgcgttttcgatgccggcatccgctccggtgtgtacgtgtttggtgaagtgatcaccggcggtggcagcggcaatggcgactacgaccagttcctggcgccgtatctgcaatccaccccgcatgccgcctacgatttcccgctgttcaacgcggtacgcaatgccttcggtgtgggtgcgagcatgcaacagttggtggacccggcgtccaccgggcaggccttgccgggcaatcgcgcagtcacctttgccgtaacgcatgacatccccaataacgcgggcttccgctacgcgattctcgacccggtcgatgaaacgctggcctatgcgtacttgctgggccgcaacggcggcgtgccgatggtctacaccgacaacaacgaaagcggcgacaaccgctgggtcaatgcctatctgcgcgatgatctgcgccgcatgattggcttccacaacggcgtgcagggcagcgacatgcaggtgctgtcatccagtgcctgccacatcctgttccgccgcggcagcctcggcatcgtgggcatcaacaagtgcggcaacccggtcaacaccaccgtcgccatgaacggcagcgtgttgttctggaatgcggattacgtcgatgcactgggttccggcaccgtggtgcgcatctccagtggctcgtacaccttcaccctgccggcgcggcaggcgcgtatgtggcgacgt

SEQ ID NO: 40061 - DNA, 1278 bp, Xanthomonas campestris
atgacgttgtgggtgctcggactgaatcaccagaccgcacctgtggacctgcgcgaacgcgcggcgttcgcaggtgatgcgctgccgcgcgcgctcgaatcgctgcgtgcgctgccccaggtaagcgaggccgcgctgctgtccacctgcaaccgtaccgagttgtatgcgatggccgaggaggcgcacagcctggtcacctggctggaaacccacgcgcccgctctgagcggttatctgtaccagcaccaggaagccgaggcggtgcgtcatctgttccgtgtcgccaccgggctggattcgatggtattgggagaaccccagatcctcggccaggtgaaggacgcctgggcagtggcgcgggcgcacggcacgctgggcagcgggttggaccggctgttccaacagaccttttcggtggccaagcgcgcgcgtaccgacacccgtgtcggcgcaaatccggtgtcggtcgcatccacggcggtgcggctggcacaagactcgtttgcccggctcaacgaatcgacggtgttgctgatcggtgccggcgaaaccatcgaactggcggccaagcatctgagcgaaggccgcgtgcgccgcctgctgatcgccaaccgcaccctggcccacgcgcagacgctcgccagccagcatggcggcttcgccttgccgctgaccgatctggaacgccacctggccgaggcggatgtggtgttctcggccaccgctgcacgtgagccgctggtgacccgcgcacaggtggaacaggcattgcgcgcacgcaagcgcaagccgatgctgctgttcgacctggcggtgccgcgcgatatcgaggcctcggtgggcgaattgagcgacgcctacctgtacacggtggacgacctggaacgcgcggtcgaagacaaccgccgtggccgccgcgaagcggccgaccaggccgaagccatcatcgacctgcaagtggcgcgctatgtcgaaaccttgcaggccaacgcgcgccaggcaccgctcaagcggctgcgcgcctttggcgatagcacccgcgacgagctgctggccaaggcgcgccagcagttgcacaacggcaaaccggccgacgaagtgctggagcagctggcgcatgcgctgaccaaccgcctgctgcatccgcccaccgccgcactacgcgatgccgcgctcaacaacgacctggaattgaccaccgcggccgaccggctgtttccggaaaaaccggggttaccaacatccccccatagctaccccgatcgtgaggaccga

SEQ ID NO: 40062 - DNA, 1287 bp, Xanthomonas campestris
atgaaccattcccgctcccacgccctgttcgcccaggcgcagactttgctaccgggcggcgtcaactcgccggtacgggcgttcaagtcggtcggcggcgagccgttcttcgtggcgcgcgccgatggcccctatctgttcgatgtcgacgacaaccgctatatcgactatgtgggctcgtgggggccgatgattgccgggcacaaccacccggccgtgcgcgaagcggtcgagcagtcgatccgcaacgggctctcgttcggtgcaccgtgcgcagccgaagtgacgatggcgcagaccatcgcccggctggtgccctcctgcgagatggtgcgcatggtcaactccggtaccgaagctacgctgtcggcggtacgcctggcgcgtggcgccaccgggcgcaatcgcatcatcaagttcgaaggctgttatcacggccatggcgattcgttcctggtcaaggccggcagcggcatgctgaccctgggcgtaccgacctcgcccggcgtacccgcagggctgagcgagctgaccgccacgctgagcttcaacgacttcgagggcgccaccgcgctgttcgacgagatcggtgcggaggtggcggcggtgatcatcgagccggtggtcggcaatgccaactgcattccgccgcaggccggctatctgcagcatctgcgcacgctgtgcactaggcacggcgcgttgctgatcttcgacgaagtgatgaccggcttccgcgtcgcgctcggtggtgcgcaggcgcattacggcgtgaccccggacctgaccaccttcggcaagatcatcggcggcggcatgccggtgggcgcctacggcggccgccgcgacttgatggagcaggttgctccggccgggccgatctaccaggccggcaccttgtcgggcaacccggtggccatggccgcaggcctggcgatgctggagctggtgcaggagccgggcttccacacgcgcttgagcgaggccaccagcatgctgtgcgaaggccttgaagatgccgcgcgcgcagccggcattgccgtgaccaccaaccaggttggcggcatgttcgggctgttcttcaccgacgacgtcgtggagagctacgcacaggccacggcgtgcgacatcaccagcttcaaccgattcttccacgcgatgctgcagcggggcgtctacctggcgccctcggcgtacgaagccggcttcatgtccagtgcgcacgacgaggcggtgatcgaagccacgctggcggcagcgcgcgaggcgtttgcggacgtggcgcgc

SEQ ID NO: 40063 - DNA, 1242 bp, Xanthomonas campestris
ggcaaggtggtcgaagtcgtcggcaccatgctcaaggtggccggcgtgcaggtcagcctgggcgaggtgtgcgagttgcgccaacgcgatggcaccttgttgcagcgggccgaagtggtgggcttcagtcgcgatctggcgttgctggcgccgttcggggagctgatcgggttgtcgcgcgagacgcgcgtgatcggattggggcgcccgttggcggtgcccgttggaccggccttgctgggccgcgtgctcgacggcctgggcgagccatcggacgggcaaggcgcaatcgcctgtgacacctgggtgccgatccaggcgcaggcaccggacccgatgcgtcggcggctgatcgaacaccccatgccgaccggcgtgcggatcgtggatggcctgatgacgctgggcgagggccagcgcatgggcatcttcgctgcagcaggcgtcggcaagagcaccttgatgggaatgttcgcgcgcggtacgcagtgcgatgtcaatgtgatcgtgctgatcggcgagcgagggcgcgaggtgcgggagttcatcgagctgattctcggcgccgatggtctggcacgcagcgtcgtggtctgcgcaacctccgatcgctcatcgatcgagcgcgcgaaggccgcctacgtcggcaccgccatcgccgagtatttccgggatcggggcctgcgcgtgctgctgatgatggactcgctgacgcgctttgcccgcgcgcaacgcgagatcggtctggccgccggcgagccgcccacacgccgcggctttccgccatcggtgttcgccgagttgccgcgcctgctcgaacgcgcgggcatgggcgagagcgggtcgatcaccgcgttctacaccgtgctggccgaggacgataccggcagcgatccgattgccgaggaagtgcgcggcatcctcgatgggcacctgattctctctcgcgagatcgcggccaagaaccagtacccggcaatcgacgtgctggccagcctgagccgggtgatgagccagatcgtcccgtacgaccactcccaggccgctggccggttgcggcgcctgctcgccaagtacaacgaggtggaaaccctggtgcaggtgggcgaataccgtcagggaagcgatgccgttgccgacgaagcgatcgacaggatcgatgcgatccgcgactttctcagccaaccgaccgaccagctcagtgcctacgaaaatacgctggaactgctgaccagcgtgacc

SEQ ID NO: 40064 - DNA, 1053 bp, Xanthomonas campestris
gtggcgacttggctagtaacgcgcggggccggcttcatcggcgcaaattttgttctggaggcggtctctcgcgggatccgcgtggtcaatctggacgcgctcacttatgcgggcaatctgaatacgctggcgtcgctggaaggcaatgccgaccatatcttcgtcaagggcgacatcggtgatggagcgcttgtgactcgcttgctgcaggaacatcagccggacgcggtgctgaactttgcagccgaaagccatgtcgatcgctcgatcgaaggccctggcgccttcatccagaccaatgtggtcggcactttggccctgctcgaggcagtgcgcgactattggaaagcactgccggacacgcgccgtgatgccttccgcttcctgcatgtgtccaccgacgaggtctatggcacgctcggtgagaccggcaagttcaccgaaaccacgccgtatgcgcccaattcgccgtactcggcgtccaaggcggcatcggatcatctggtgcgcgcgtttcaccacacctacgggctgccggtgctgaccaccaactgctcgaacaactacggtccgtatcacttccccgaaaaactcattccgttggtcattgccaaggcgctggctggcgagccgctgccggtctatggcgatggcaagcaggtgcgcgactggttgttcgtcagcgaccactgcgaggcgatccgcaccgtgctggccaagggccgggtcggcgagacttacaacgtgggcggcaattcggagcggcagaacatcgaggtcgtgcaggcgatctgcgcgctgctggatcagcatcgcccgcgcgaagatggcaagccgcgtgagagccagatcgcctacgtcaccgaccgccccgggcacgatcgtcggtatgcgatcgatgcctccaagttgaaggacgagctgggctgggagccggcgtacaccttcgagcagggcatcgcattgacggtggactggtatctgaccaaccaaacctgggtccaaggcgtgctggatggtagctatcgactggaacgcatcggcgcaacggtt

SEQ ID NO: 40065 - DNA, 1344 bp, Xanthomonas campestris
atgacgctacccgccttcaaggcctacgatattcgcggccgcgtgccggatgaactcaacgaggacttggcccgccgcatcggcgtggcactggcggcgcagctggatcaagggcccgtggtcctgggccacgatgtgcgcctggcgagcccggcactgcaggaagccctgtctgccggcctgcgtgccagcggccgcgaggtgatcgacatcggcctgtgtggcaccgaggaggtctatttccagaccgatcacctcaaggccgccggcggcgtgatggtcaccgccagccacaacccgatggactacaacggcatgaagctggtgcgtgaacaggcgcgaccgatcagctccgataccggcctgttcgccatccgcgacacggtcgcggccgacactgctgctgcaggcgagcccaccgctgccgagcacagccgcaccgacaagaccgcgtatctggagcacctgctcagctacgtggaccgcagcacgctcaagccgctcaagctggtggtcaacgccggcaacggcggcgccggcctgatcgtcgacctgctggcaccgcatctgccattcgaattcgtgcgcgtcttccacgagcccgatggcaacttccccaacggcatccccaacccgctgctgcaggaaaaccgcgacgccaccgccaaggcggtcaaggaacacggcgccgacttcgggattgcctgggatggcgacttcgatcgttgcttcttcttcgatcacactggccgcttcatcgagggctattacctggtcggcctgctggcgcaagccatcctggccaagcagcccggcggcaaggtcgtgcacgacccgcgcctgacctggaacacggtggagatggtggaagacgccggcggcattccggtgctgtgcaagagtggccacgccttcattaaggaaaagatgcgcagcgagaacgccgtctatggtggcgaaatgagcgcgcaccattacttccgcgaattcgcctacgccgactcgggcatgattccatggctgctgatcgccgagctggtctcgcaatcgggccgttcgctggcggacctggtcgaagcgcgcatgcagaagttcccatgcagcggcgagatcaacttcaaggtcgacgacgccaaggctgcggtcgcacgcgtcatggcgcattacggtgatcagtcaccggagctggattacaccgacggcatcagcgccgacttcgggcaatggcgcttcaacctgcgcagctccaacaccgagccgctgctgcgtctgaacgtggaaacgcgcggcgatgctgcactgctggagacgcgtacgcaggaaatttccaacctgttacgcggc

SEQ ID NO: 40066 - DNA, 1479 bp, Xanthomonas campestris
atgtccatattcaggaccgcaagcacgctcgctttggccaccgccctcgcactggccgccgggccggccttcagctattccatcaacaacagcaggcagatcgtcgacgacagcggcaaggtcgtgcagctcaagggtgtgaacgtgttcggcttcgaaaccggcaaccacgtgatgcatggcctgtgggcacgcaactggaaggacatgatcgtgcagatgcagggcctgggcttcaacgccgtgcgcctgccgttctgcccggccacgctgcgtagcgacaccatgccggccagcatcgactacagccgcaacgccgacctgcagggcctgacctcgctgcagatcctcgacaaggtgatcgccgaattcaatgcgcgcggcatgtatgtgctgctggatcaccacacccccgattgcgccggcatttccgagctctggtacaccggctcctataccgaggcacagtggctggccgacctgcgctttgtggccaaccgctacaagaacgtgccgtatgtactcggcctggatctgaagaacgaaccgcacggcgccgccacctggggtaccggcaacgccgccaccgattggaacaaggctgccgagcgcggctcggccgcggtgttggcggtcgcgccgaagtggctgatcgcggtggaaggcatcaccgacaacccggtgtgctccaccaacggcggcatcttctggggcggcaacctgcagccgctggcctgcaccccgctcaacatcccggccaaccgcctgctgctggccccgcacgtgtacggcccggacgtgttcgtgcagtcgtacttcaacgacagcaacttccccaacaacatgcccgccatctgggaacgccatttcggtcagttcgccggcacgcatgcgctgttgctgggcgagttcggtggcaagtacggcgaaggcgacgcacgcgacaagacctggcaggacgcgctggtgaagtacctgcgcagcaagggcatcaaccagggcttctactggtcgtggaatcccaacagcggcgacaccggcggcatcctgcgcgatgactggaccagcgtgcgccaggacaagatgaccctgctgcgcacgctgtggggcaccgccggcaataccacgccgacgccgactcccacacctacgcccacaccgacaccgacgcctacccccacgccgacgcccaccccgggcaccagcaccttcagcaccaaggtgatcgcctcgccggtggtggggtcggcagcgcgaaaactgccggcggcatcgcggctggcttgccattggccggccagcagcacgggttggagagtctgggtcatcgcggcaccttcggttacgtggaagcgcccgcacgcagcacgggcgatcgaacggcggatgagggtaacgcgcctgcgacgtgccacccgtttgaatcgtggaccactaccggcaccggcccatacaacgcagcacgcaccgcggctgcgc

SEQ ID NO: 40067 - DNA, 2766 bp, Xanthomonas campestris
atgagcgattccttttccacccgcacctcgctagaggtcaacggccagcgctacgactactacagcctgcccaaactgggcgagcgcttcgatgtcgcccgcctgccctactcgatgaagatcctgctggagaacctgctccggcatgaagacggtggcgtcaccgtcggcaaggaccacatcgaagcggtcgccaagtgggacccgaccgccgaacccgatatcgaaatcgccttcatgccggcgcgcgtggtgctgcaggacttcaccggcgtgccctgcgtggtcgacctggccgcgatgcgcgatgcggtggtcaagctcggcggcaatgccgaccagatcaatccgcagattccctccgaactggtcatcgaccactcggtgcaggtggacgtgttcggtaagcccgaggcgctggacctcaacggcaagatcgaattccagcgtaaccaggagcgctacggcttcctgcgctggggccagaaggccttcgacaacttcaaggtggtgccgcccaacactggcatcgtccaccaggtgaacctggagaatctggcacgcgtggtgatgagcgcggacaaggacggcacccagatcgcctatccggacaccgtgttcggcaccgacagccataccaccatgatcaacggtatcggcgtgctgggctggggcgtgggcggcatcgaggcggaagcggcgatgctcggccagccctcctccatgctgattccgcaggtggtgggcttcaagctcaccggcaagctgcccgaaggcgccaccgccaccgacctggtactcacggtcacccagatgctgcgcaagcacggggtggtgggcaagttcgtggagttctacggtgaaggcctgcagcacctgccgctggccgaccgcgccaccatcggcaacatggcgccggaatacggtgccacctgcggcatcttcccggtcgataacgaatcgctgacctacctgcgcctgtccggccgcagcgaggagcagattgcactagtggaggcctatgccaaggcacagggcctgtggcacgacgccgataccccgcatgcgcagtacagcgccacgctggagctggacatgggcgacgtcaaaccgtcgctggccggccccaagcgcccgcaggaccgcgtgctgctggaagacatgcagtccaactaccgcgaaagcctcaagccgttcgccgaggcgcgcagcaagcgcttggccgataccaagcaggaagaccggctcaagaacgaaggcggcggcggcaccgcggtgggcgccaaggcctcgcaggccgaaagcgctggcgacagcggtgcgggctggcagctgcgcgatggctcggtggtgatcgcggcgatcacctcgtgcaccaacacctccaacccggcagtgatgctgggcgccggcctgctcgcccgcaatgccgcggccaagggcttgaaggcgcagccctgggtgaagacctcgcttgggccgggctcgcgcgtggtcaccgactatctgagcaaggccggcgtgctggccgacctggaacaactcggcttctacgtggtgggctacggctgcacgacctgcatcggcaactccggcccgctgccggaagacgtctcggcggcgattgccaaggatgatctggtggtgacttcggtgttgtcgggcaaccgcaacttcgaaggccgcgtgcatcccgaggtcaagatgaactacctcgcttcgccgccgctggtggtggcgtatgcgatcgccggcaccaccgacatcgacctcaacccgcgacccgttcggcaccggcaggacggccagccggtgtacctgcgcgacatctggcccagcaacaaggaaatcggcgacaccatcgccgccaccgtcggcccggaaatgttcaagcagaactacgccgatgtattcaagggcgatacgcgctggaacaccatcgcctcgccggatggcgcgctgtacgaatgggatgccgggtccacctacatcaagaacccgccctatttcgaaggcatgacgatgcaggtgggccacgtcgacgacgtgcatggcgcgcgcatcatgggcttgttcggcgactcgatcaccaccgaccacatctccccggccggcaacatcaagaaggattcgcccgcgggccgtttcctgcaggagcgcggcgtgcagccggccgacttcaacagctacggcagccggcgcggcaacgacgatgtgatggtgcgcggcaccttcgccaatattcgcatcaagaacctgatgttcggtggcgaggaaggcggcaacacgctgtatttcggcaaggacggcgccacgcctgagaagctggccatctacgacgcggcgatgaagtacaaggccgacggcgtgccgctggtggtgctggccggcaaggaatacggcaccggctcctcgcgtgactgggccgccaagggcaccaacctgctgggcgtcaaggccgtggtcgccgaaagcttcgagcgcatccaccgctccaacctggtcggcatgggcgtgctgccactgcagttcctggaaggcgaaaatgcgcaaaccctgggcctggatggctccgaggtgctggacatcaccggcctgcaggacggcgccagccgtcgcgctaccatcgatgcgaagaagtccgatggcagcgtcaagcagttccaggtcaaggtgctgctgctgacgccgaaggaagtggagtacttcaagcacggcggcctgctgcagtacgtgctgcgccaactagccgcccgcaaggcagcc

SEQ ID NO: 40068 - DNA, 2511 bp, Xanthomonas campestris
ttgtcctctccgtcgattgcccccgtcacccccgacctggtgcgcctgcgcgccactgcccgcgacaaggacgacgccattgcccaggccgcccagctgctggtggcagccggatgcgtggcgccgggctacgacgccagcatgcggcggcgcgaaggcctggcgaatactttcctgggccacggcctggcgattccgcacggcgtgggcgaagaccggcacctggtgcgccgcgacggcatcgcggtgctgcagctgcccgagggcgtggaatggaaccccggccagaccacccgcctggtggtgggcatcgccgcccagtccgacacccacatcaccctcgtgcgccggctgacccgcctgatccaggatccggcccagctggaagcgctgttcaccaccgacgacccggccgtgatcgtggccgcgctgaccggcgaccgcgcacccgacaccagcgccgccccggccaccgacctggccgaacggttcgaatggaccatcgcctaccccagcggcctgcacgcgcgcccggccactcgctgggcggagaccgcgcgcggcttttcggcccgcgcccaggtccgcgccggtgaccaggccgccgatgccaagagcctggtcggcctgctgcaactgggcctgcgcgccggcgacagcattacggtctcagcgaaaggcagcgatgcccccgccctgctcaagcgcctgcgcgcggtgatggacagcctgaccgcgcaggaaaaggccgatgccgaacgtgccgcgcaacgccgcgccgcaccggtcatcggctggaccccgccgcaggcgcagccggccatcgtcggcatcggcgccagcccgggcgtggcaatcggcatcgtgcaccgcctgcgtgccgcgcagaccgaggtggccgaccagccgatcggcctgggcgacggcggcgtgctgctgcatgacgccctcacccgcacccgccagcagctggccgccatccaggacgacacccagcgccgcctgggcgcctcggacgcggcgatcttcaaggcccaggccgagctgctcaacgacaccgacctgatcacccgcacctgccagctgatggtcgaaggccacggtgtggcgtggtcgtggcaccaggcggtggaacagatcgcctccggcctcgcggcgctgggcaacccggtgctggccggccgcgccgctgacctgcgcgacgtgggccgccgtgtgctggcccaactcgacgcggcagcggccggcgccggcctcaccgacctgcccgagcagccctgcatcctgctcgccggcgacctgtcgccgtcggacaccgccaacctcgacaccgattgcgtgcttggcctggccaccgcccagggtgggccgacctcgcacaccgcgatcctgtcgcgcacgctcggcctgccggcgctggtcgcggctggcggccagttgctggatatcgaagacggcgtcaccgccatcatcgacggcagcagcgggcggctctacatcaacccgtcagaacaggatctggacgccgcccgcacgcatatcgccgagcagcaggccatccgcgagcgcgaagccgcccagcgcgccctgcccgccgaaaccaccgacggccaccacatcgacatcggcgccaacgtcaacctgcccgagcaggtggccatggccttgacccagggcgccaacgtgggcctgatgcgcacagagttcctgttcctggagcgcggcagcacgcccaccgaggacgagcagtaccacacctacctggcaatggcacaggccctgaatggccgcccgctgatcgtgcgtgcgctggacatcggcggcgacaagcaggtggcgcacctggagtcgccgcacgaagaaaacccgttcctgggcgtgcgtggcgcgcgcctgtcgtcgcgccgccccgacctgctcgagccacagtcgcgggcgctgtatcgcgcggccaaggacggcgcacggctgtcgatcatgttcccgatgatcacctcggtgccggagctgatcagcctgcgcgagatctgcgcagccatccgcgccgaactgcacgcaccggagctgccgatcggcatcatgatcgaagtgcccgccgccgccgcccaggccgatgtgctggcgcgccatgcggatttcttctcgatcggcaccaacgacctcacccaatacgtgctggcaatcgaccgccagaacccggaactggccgccgaagccagcagcctgcatccggcggtgctgcgcatgatccgcagcacgattgacggcgcgcgcaagcacgaccgctgggtcggggtgtgcggcggtctggccggcgacccgttcggcgccagcctgctggccgggctgggcgtgcaggaattgtcgatgacgcccaacgacattccggcggtcaaggcgcggctgcgtggcagggcgctgagcgccttgcagcagctggccgagcaggcgctgcactgcgagaccgcagagcaggtgcgtgcgcttgaagcacagcgcgagggccaggca

SEQ ID NO: 40069 - DNA, 1680 bp, Xanthomonas campestris
atgagtcaggcacgtccttggttgcaaagttatccggccggagtggccgcggagatcgatctggagcagttcagcaccgtggcggaggttttcgccacctcggtggcgcgcttcgctgatcgtcccgcgtatcacagcttcggcaagaccattacctaccgcgaagcagatcagctggtcgaccagttcgcggcctatctgctcggcgagttgcagctgaaaaaaggcgaccgcgtcgccttgatgatgcccaactgcctgcaatacccgattgccaccttcggcatcctgcgcgccggtctgaccgtggtgaacgtcaacccgctctacaccccgcgcgagctcaagcaccagttgatcgactcgggctccagcgtgctggtggtcatcgacaacttcggcaccactgtgcagcaagtgatcgccgacacgcaggtcaagcaggtcatcaccaccggcctgggcgacatgctcgggttcccgaaagccgcactggtcaactttgtcgtcaagtacgtcaagaagctggtgccggagtaccgcatcaacggcgcgatccgcttccgcgacgcgctggcactgggccgcaagcaccgcgtcccgaccctgcagatcgagccggacgacatcgcctttttgcagtacaccggcggcaccaccggcgtggccaagggcgcgatgctgacccaccgcaacctggtcgccaacatgcagcaggcgcaccagtggctggccggcaccggcaagctggaagaaggccacgaggtggtgatcaccgcgctgccgctgtaccacatcttcgcgttgacggcgaacggcctggtcttcatgaagatcggcggctgcaaccacctgatcagcaacccgcgcgacatgccgggcttcgtcaaggaactcaagaagacccgcttcaccgcgtttaccggcgtcaatacgctgttcaatggcttgctcaatacgcccggcttcgatcagatcgacttttcgtcgttgaagatgaccctcggcggcggcatggcagtccagcgctcggtcgccgaacgctggaagcaggtgaccggcctgactctggtcgaggcttacggcctgaccgagacctcgcccgccgcctgcatcaacccgatggatctggtcgactacaacggctcgatcggcctgccgattccgtccaccgatgcctgcatcaaggacgacgacggcaaggtgctggcgctgggcgagatcggcgagctgtgcatcaagggcccgcaggtgatgaagggctattggaagaaggccgacgagaccgccaaggtcatggacgccgaaggctggctgcacaccggcgacatcgcgcgcatggacgaacgtggcttcgtctatatcgtcgaccgcaagaaggacatgatcctggtgtccggcttcaacgtgtaccccaacgagatcgaagacgtcatcgcgacgatgccgggcgtgctcgaagtggccgcagtcggcgtgccggatgaaaagtccggcgaaatcgtcaaggtggtgatcgtcaagaaagaccaggccctgaccgccgaggacgtaaaggcgcactgccgcaccaacctgaccggctacaagcagccgcgcgtgatcgagttccgcaaggaattgccgaagaccaacgtcggcaagatcctgcgtcgcgaattgcgggatgcggccaaggca

SEQ ID NO: 40070 - DNA, 1242 bp, Xanthomonas campestris; identical to SEQ ID NO: 40063

SEQ ID NO: 40071 - DNA, 972 bp, Xanthomonas campestris
atgagcaagcgtattcgcaaggccgtattccccgtcgcaggtcttgggacccgctttcttccggcaaccaagacggtgccgaaggaaatgctgccgatcatcgataaaccgcttatccagtacgccgtggacgaagccatccaggccggttgcgatacgctgatcttcgtcaccaatcgctacaagcactcgatcgccgactacttcgacaaggcctatgagctggagcagaagctcgagcgcgcaggcaagctcgagcaattggagctggtgcgccatgcactgcccgaaggcgtccgcgccatttttgtgacgcaggccgaagcgctcggcctgggccatgcggtgctgtgtgccaaggccgtggtcggtgacgaaccgttcgcagtgctgctgcccgacgacctgatgtggaaccgcggcgatgcggcgctgacccagatggccgatgtggcagaagcctccggcggcagcgtgatcgccgtggaagatgtgccgcacgacaagacggccagttatggcatcgtgtccaccgatgcgttcgacggccgcaagggccgcatcaatgccatcgtcgaaaagcccaagccggaagtggcgccgagcaatctggcggtcgtcggtcgttacgtgctgagcccgaagatcttcgagtacctggagtccacgggcgccggtgcaggtggcgagatccagctcaccgatgcgatcgccgaactgctcaagcaggaacaggtcgatgcgttccgtttcgagggccgtcgcttcgactgcggcgcgcacatcggtttgatcgaggccacggtgcactttgcgctcgagcacgagaagcatggcgcaccggcgaaggaaatcattcgcagcgccttggccgcggccgacgcacgcgtgagtgttcggctagcagtgttgcaacgaacggcgccattggcgccgttttgggtccgcgcgttagaagagtggtgccatgct

SEQ ID NO: 40072 - DNA, 1305 bp, Xanthomonas campestris; identical to SEQ ID NO: 39228

SEQ ID NO: 40073 - DNA, 1335 bp, Xanthomonas campestris
atgcgagttgcgatctttggtaccggctatgttggtcttgtcaccggtacctgtctggcggaagtaggtcatcacgttatctgcgtggatatcgaccaggcgaaagttgatggtctcaatcgtggggtgattcccatctatgaacccggcctggagccgatggtgaaaggcaaccacgcctctggccggttgcgcttcaccaccgacgcggccgaggcgattgcgcacggcgaaatcaccttcatcgccgtgggcacgccaccggacgaggacggcagcgccgacctgcagtacgtgctggcggttgcgcgcaccgtgggccgtcatatcgacgggccgtcggtgatcgtcaataagtccacggtgccggtccgtaccgccgacaaggtgcgcgcggccatccaggaagaactggatgcacgcggcgtggaccatgagttcgacgtggtttccaaccctgagttcctcaaggaaggcgacgcggtggccgactgcatgcgcccggaccggatcgtgatcggggccaagaagccggcagcgattgcacgcatgcgccgtctgtatgccccgttcaaccgcaaccgcgatcgcatcgtggaaatggatgtgcgctcggccgagctgaccaagtacgcggccaacgcgatgctggcgaccaagatcagtttcatgaacgagatcgccaacattgccgaacgcgtcggtgcggacgtcgagcatgtgcgtaacggcattggttcggatccgcgcattggctggcacttcatctatccggtgccggctacggctcgtgcttcccgaagatgtgcaggcgctcgcaagaccgcgcacgagtacggcatgcagccgaccctgctcaacgcggtggaaagcgtcaacaacgcgcagaaggggcatctgttcgaactggtgcagcgtcactatgccgatggcaacggcagcatcgccggcaagacctttgcggtgtggggcctggcgttcaagcccaataccgatgacatgcgtgcagcctccagccgtcgcctgatggccagttgtgggaagccggtgccaaggtgcgcgcgtacgaccccgaagccacgcacgaagccaagcgcatcttcggcgagcgcgacgacctggcgttctgcgacgacgccttcgccgcactggaagcgccgacgcgctggtcgtggtcaccgagtggaagcagttccgcagcccggatttcggcaagatcaagcaggctctgaaggacgacgtcgtgttcgacggccgcaacctgtacgacccgcaggagatcgaagccgcaggtctgcgtactacgccatcggacgaggccgttcgctgcatgca

SEQ ID NO: 40074 - DNA, 1794 bp, Xanthomonas campestris
atgctgcgtaccactcttgctcccctggtcctggccctggcgctcgcgctgcccgccgctgccgcgacgcccgagtcctggcccaccttcggcacccagggcacgcaattcgtgcgcgacggcaagccgtaccagctgctgtccggcgccatccatttccagcgcattccacgcgcctactggaaagaccgcctgcaaaaagcgcgcgccctgggcttgaacaccgtagaaacctacgtgttctggaacctggtggaaccgcagcaaggccagttcgatttctccggcaacaacgacgtcgccgccttcgtcaaggaagccgccgctcaaggcctcaacgtgatactgcgccccggcccctacgcctgcgccgaatgggaagccggcggctacccggcctggttgttcggcaagggcaatatccgcgtccgtagccgcgacccgcgctttcttgccgccagccaggcgtatctggatgcgttggccaaacaggtgcaaccgctgctcaaccacaatggcggtccgatcatcgccgtgcaggtcgagaacgaatacggctcctacgccgacgatcacgcctacatggccgacaaccgcgccatgtacgtcaaggctggcttcgacaaggccttgctgttcacctccgatggcgccgacatgctcgccaacggcaccttgcccgacaccctggcggtggtgaacttcgcgcccggcgaggccaagagcgcattcgacaagctgatcaagtttcgccccgatcaaccgcgcatggtcggcgaatactgggccgggtggttcgaccattggggcaagccgcatgccgccaccgatgccaggcaacaggccgaagagttcgagtggatcctgcgccagggccactcggccaatctctacatgttcatcggcggcaccagtttcggcttcatgaatggtgccaatttccagaacaatcccagcgaccactacgcgccgcagaccaccagttacgactacgacgccatcctcgacgaagccggccaccccacgcccaaattcgcgttgatgcgcgatgccatcgcccgcgtgaccggcgtgcaaccgcccgcattgccggcgccgattacgaccaccacgctgccggccacgccgctgcgcgaatcggcctcgctctgggacaacctgcccaccccgatcgccatcgacaccccgcagccgatggaacagttcgggcaggattacggctacatcctttaccgcaccacgatcactggcccacgcaagggcccgctgtatctgggcgatgtgcgcgatgtggcgcgcgtgtacgtggatcaacgaccagtcggcagcgttgagcgacgcttgcagcaggtgtcgctggaggtggagattcctgcaggccagcacaccctggatgtgctggtcgaaaacagcggccgcatcaattacggaacgcgcatggccgacggccgcgccggcctggtcgacccggtgttactggacagccagcagctcaccggttggcaggccttcccgctgccgatgcgcacgcccgacagcatccgcggttggaccggcaaggcggtgcaaggcccggcgttccaccgcggcaccctgcgcatcggcacgccgaccgacacctatctggacatgcgcgccttcggcaagggctttgcctgggccaacggcgtcaacctgggccgccactggaacatcggcccgcagaccgcgctgtatctgcgcccttccagcgcaagggtgacaacacggtggtggtcttcgacctggacgatgttgcaccccagcgtgcgcggc

SEQ ID NO: 40075 - DNA, 1020 bp, Xanthomonas campestris; identical to SEQ ID NO: 39079

SEQ ID NO: 40076 - DNA, 1680 bp, Xanthomonas campestris
atgaccactctgcaaatcagcggcatgacctgcgcatcctgtgccgaccatgtaaaagatgccttggagaagattcccggcgtgcaccaggcggatgtttcctacgccagcgggaaggccgaattgacggtcgacaagcgtgtaaaccatgaacaaatgcaggccgccgtcgaggctctggggtatcgagcggcgttcgaggacgccacgctacaaccccgtccgggcctgctcgaccaggcgccgggctggttgagcggtggcattggcgccgggaaagaggacgtcaggctccacgttgcggtcatcggcagcggtggcgccgccatggcagcggcgctcaaggcggtggaaggcggtgcccgcgtcaccctgatcgagcgcggcatcatcggcggaacctgcgtcaacgtgggctgcgtgccgtcgaagatcatgattcgtgccgcgcatgtggcccatctgcgccgcgagagtccgttcgacggcggattgtccgccacgacgccgacagtcctgcgcgagcgactgctcgcgcagcagcaaggccgtgtcgacgaattgcgccacgccaaatacgaaagcattctggagagcaccccagccatcagcgtgctgcgtggcaccgcccgtttccaggatggccacacgctcagcgtggaactggccgagggtggcgagcgcatcgtagccttcgaccgctgcctggttgccaccggcgcaagcgcggccgttccgtctattccagggctgaaagacacgccgtactggacctcagacgaggcgctggtgagcgacagcattccgcaacggctcgccgtgatcggcgcctccgtagtggcggtggaactggcgcaggccttcgcccggctaggtagccgcgtcacgatcctggcacgcagttcgatgttctttcgcgaagacccggccataggtgctgcggtgacggaggtcttccgtatggagggcatcgaggtgctggagcaaacgcaagccagccaggtgtcccagcccaacggcgagttcgtactgagcaccaaccatggtgagctgcgtgccgaccaactgctcattgccaccgggcgcttgccgaacacccaaggcatgaacctggacggcgccggcgtgacgctggacgagcgcggtggcatccagatcgaccggggcatgcgtaccagcgcacgggatatctatgcggctggcgactgcaccgaccagccgcagttcgtctatgtggcggcggcggccggcacccgtgcggcgatcaacatgaccggcggcgaggcgacactcaatctcgacgtcatgccgtccgtggtgttcaccgatccccaagtggccaccgtcggctacagcgaagccgaagcgcataacgccggcctcgaaacggacagccgaacactcactctggacaacgtgccgcgtgcactggccaacttcgacacacgaggttcatcaagctggtgcgccgaagcaggctcaggccggttgctgggcgtgcaggcggtcactcccgaagcgggtgaactgatccagtccgccgtcatcgccatccgcgcccggatgacggtacaggaactggccgaccagttgttcccctacctgactatggtcgagggcctgaagctcgccgcgcaaaccttcaccaaggacgtcaaacagctttcctgctgcgccggc

SEQ ID NO: 40077 - DNA, 2106 bp, Xanthomonas campestris
atggccaagtcccccagcaaatccgcgcaggtccctgcccttgcacctgtcagcgccaccgtcgatggggcgcgcggtactggcgatgagttgcaccagaaggcaggcggcacgcacccgcaactgaccaccaaccagggcattccggtcggtgacaaccagaactcgctccgcgccacgccgcgcggcccgacgttgctggaagatttcatcctgcgcgaaaagatcacccacttcgatcacgaacgcattcccgaacgcatcgtgcatgcgcgcggcagtgccgcgcacggctacttcgaactcaccaagtcgttgagccagtacaccaccgccaagatctttaccgaggttggcgaaaaaactccgttgtttacgcgtttttccactgtcgcaggtggcgccggctcggtggatacgccgcgcgatgtgcgcggcttcgcggtgaagttctacaccaaggaaggcaattgggatctggtcggcaacaacatcccggtgttcttcatccaggatgcgatgaaattcccggacctgattcatgcggtgaagatggagccggaccgtggtttcccccaggctgccagcgcgcacgacacgttctgggatttcatttcgctgacacccgaatcgatgcacatggtgatgtgggcgatgagcgaccgcaccatcccgcgctcgctacgcatgatcgaagggttcggcatccacagcttccggttcctcaatgacaagggcgaaagcaccttcgtcaagttccattggcgccccaagctgggcctgcaatcgaccatctgggacgaggcggtcaagatcgccggcgccgatcaggatttccaccgccgcgacctgttcgaagcgatccagaacggcgatttccccgaatgggaactcggcgtgcaattgttcaccgaagcgcaggcagcaacgttcccgttcgatcatctggattcgaccaaggtcattcccgaggagctggtgccgttgcagatcgtcggccgcatggtgctcgaccgctggccggacaacttctttgccgaaaccgagcaggttgcctactgcccggccaacatcgtgcccggcatcgacttcagcaacgacccgctgctgcaaggccgcctgttctcctatctggatacgcagctgagccgtctgggcgggccgaatttccatcagattccggtcaacgcgccaaagtgcccgttcgccaacaaccagcgcgatggtcacatgcagatgggcgtgcccaagggccgcgttgcctatgagcccagctcgctgcaggccgatgcgccgcgtgaagcgctgcgtggtttccccagccacgcaactcctgccgaagaaggtgccaagggccgcgtgcgcgcagaaagcttcgccgatcactacagccaggcgcgcctgttcttccgcagccagaccgcaccggaacaggcgcatatcgcctcggcattggtgttcgaactgtcgaaggtggagaccgctcacgtgcgcgaggccatcgtgggtcatctgcgccacatcgaccaggaactggcgcagcgtgtggccgatggcatgggcatgacggccctgccgccagcccccccggcggcagtggcgccgatcgacatgccgctctcgcctgccttgcaggtcatcggcaagatgaaggacaccttgaaagggcgcacggtgggcatcctgatccacgacggctcggacgcagcagcgatcaaggcagtccgcaaggcggccgaagctgcaggcgcgacggtcaagatcgttgcgcccaaactcggcggcgccaagcttagcgacggcaagcagcttgccgccgatgggcaactggcgggcacgccctcggtggtcttcgatgcggtggcggtgctgctgtcctcggaagcggccaagctgctgacacgcgaatcggcggcactgaattttgtgagctttgcctgggcgcatctgaaggccatcgcattcgacgaaggcgcgcaggtgttgttgaaggccggcaacgtgggcaaggatgcgggcgtcgttcccgctgccgataccaaggcattcatcaccgcagcaaaaacccgccaatgggcacgcgagccgaaggtgcgcatgctggcg

SEQ ID NO: 40078 - DNA, 1578 bp, Xanthomonas campestris
atgtcttcgtcctgccgtttccgcccgttgtcgttcctgctcgccgccgcgctcggcgcatccgcggcgttcgcgccgtccgtgcatgccgccgatgccgcgcctgccactccgcggtccgaaggctccggcgtgtggtacgagatcttcgtgcgcgcctggtacgacaccgacggtgacggcatcggcgatctcaacggcgtcaccgccaagctcgactacctgcaatcgctcggcgtcagcggcatctggctgatgccgatcaatccgtcgcccagctaccacggctacgacatcaccgactacgaggggatcaacccgcagtacggcacgatggccgacttcgagaagctggtgagcgaagcgcacaagcgcggcatcgaggtgatcctcgacctggtgatcaaccacaccagcgaccagcatccatggttcaaggcggcgctggatccgaaggacgcgcatcgttcctggtacacctgggcaggcccgggtacgaacctgaaggcggtcagcgcggtgggcggcccggcgtggcatgccaacggcaagcagcactacctgggcgatttcaccggcgccatgccggacctcaactacgacgagccagcggtgcgccgcgagatgatcgcggtcggcaagttctggctggacaagggcgccgatggcttccgcctggatgccgcgcgccacatctatgacgatctggaaagcgacaacggccagcccgccgtgatcgccaggaatgcccagtggtggaacgagttccgccagggtttgcggcaggtccgtccggacgtctatctggtcggcgaggtctcggccaagcagccgggcgagctggcgccgtatctgccggcactgggctcggtgttcgactttccgctggccgagcagctgatcgccagcgccgggcaggaaaaggccggcaagctgccggcgctgctcaccgaaacgtacgcggccttccgtgccgccgcgggcgacgactacgccgacgcgccgttcctttccaaccacgatcaggagcgtgtgctcagccagctcggcggcgatctgcgccacatgcgcacggcggcggcgatgctgctgaccttgcccggccggccgtacctctactacggcgaagagatcggcatgctcggccgcaagccggacgagaacctgcgcgaacccatgcgctggcagcgccaggccggcgcgccgggcgacagccgctggaagccgtacagcgtgaagcagggcggcgaagtgtcggtgcaggccgagcaggatcggcccgattcgctcctgagcttctaccggacgctgatccattggcgcgtggaggtgccggcgctgcgcgacggcgcgctgcgcgtggtcgataccggcgccccggcgctggtggcctacgagcgcgtcacggcggacagccgcgcgctggtggtgcacaacctctcgggcaagccggcgagcatgaagctcggcgccgaccgcgccaaggccttcgccgccatccgcctgcacagtgcgcctggcgcgacgctgacggagggccggctcaccgtgccggcgtacgccaccgtggtgttgcag

SEQ ID NO: 40079 - DNA, 2370 bp, Xanthomonas campestris
atgctgatcgcgctggtggggctgatctttctgctgggtggcgcgaggttggccagcctgggcggcagctggtacttcctgctgatgggcctggcgaccgctttggccggtgtcttgatcgtgctgcgtcggccggccggtgcgctggtgtacggcgtcgccttcgcgctgacgctggtgtgggcgctgtgggatgcggggctggagttctggccgctggtctcgcggctgatgctgcctgcggcgttcgccgtgctggtggcactggcctggccagcgctgcggcgcagccgggcgttgccgaccgggcgcaccgcctatggcgtggcgacggtgctggcgctggcggtagtggccgggatcggcggcatgttcgtgccgcatccgccggtcgcaggcaacgcggggccgggcatgacggcggtgccgcctggaagcgtgcaacagaactggtccgcctacggcaataccgatggcggcagccgctttgctgcgctggaccagatcaaccgcagcaacggtcgaccggctgcagggtcgcctggacctaccacaccgggggagatcgccaacagcgacggcaacggtgccgaagaccagttgaccccgctgcaggtgggcgagaaggtgttcctgtgcacaccgcacaacaatctgattgcgctcgacgccagcaccggcaagcagctgtggcggcgcgagatcaatgcgacctcgtcggtctggcagcgctgccgtggcctgggctacttcgacgccgacgcggcgttgccggcaccgagcgtggccaatccctcgccgatcgccgcagtgaccgtggcgcagggcgccaactgccgtcgccgcctgttcaccaacaccatcgatggtcgcctgatcgcggtggatgcggacaccggcgcgttctgccagggcttcggcagcaacggtcaggtcgatctcaaggccggcctgggcgctgcgccggatccgttctaccagctgacttcgccgccactggtggccggcaccaccgttgttggtgggcggacgcgtgccgacgacaacgtgcagaccgacatgcctggtggcgtggtgcgcggttcgatgtggtcaccggtgcgcagcgctgggcttgacccgggcaatccgcacgatcgccaggcgccggccgccggcagcagctatgtgcgcagcacgccgaacgtatgggcaccgatgtcttacgacgcggcgatgaacaccgtgttcctgccgctgggcgggccgtcgaccgatctgtacggcgccgagcgcaccgcgctcgatcatcgttacggcgcctcggtgctggcgctggatgccaccaccggtgcggagaagtgggtctaccagaccgtgcacaacgatctgtgggacttcgacctaccgatgcagcccagcctgatcgacttccccaaccaggacggcagccacaccccggcggtggtcatcggcaccaaggccgggcagatctacgtgctcgaccgcgccaccggcaaaccgcttaccgaggtcagggaagtgccggtgaaaggctcggatattgcacacgagcagtacgcaccgacccagccgctgtcggtcggcatgccgcagatcggcaccaagcacctgaccgaatcggacatgtggggcgccactgcgatggaccagatgctgtgccgcatcgcgttcaagcagatgcgttatgaaggcttgtacaccgcgccgggcaccgatgtctcgctgagtttccccggctcgctgggcggcatgaactggggaggcctgtcgaccgacccggtgcatgacgtcgtcttcgccaacgacatgcgcctgggcttgtgggtgcagatgattcctgccgacacccgcaaggccgaggcggccggtggtggcgaggccgtcaataccggcatgggcgccgtgccgctgaagggcacgccgtatgcggtcaacaagaaccgcttcctgtcggcgctgggcattccgtgccaggcgccgccgtacggcacgctcagcgcgatcgacctcaagacgcgcagcatcgcctggcaggtgccggtggggacggtgcaggacaccggcccgttcggcatcaagatgcatctgccgatcccgatcggcatgccgacgctgggcggcacgctgtccacccagggcgggctcgtgttcatcgccggcacccaggactactacctgcgcgcgttcgacagtgccaccggcaaggaactctggaagggccgcttgccggtcggcagtcagggcgggccgattacctacgtctcgcacaagaccggcaagcagtacgtggtgatcagtgccggcggtgcgcggcagtcgcccgatcgtggcgattacgtgatcgcctacagcttgcctgacgcgcac

SEQ ID NO: 40080 - DNA, 1218 bp, Xanthomonas campestris
atgacccgtgcagtgcgcgaagcccggcacgccaaccaggccaagagccgcttcctggccaatatgagccatgagttccgcacgccgctcaacgggctgtcgggcatgaccgaagtgctggcgaccacgcgcttggacgccgagcagaaggagtgcctcaacaccatccaggcatcggcgcgcagcctgctgtcgctggtggaagaggtgctggatatttcggcgatcgaggccggcaagatccgtatcgatcgccgcgacttctcgctgcgcgagatgatcggctcggtcaacttgatcctgcagccgcaggccagggggcgccggctggagtacggcacgcaggtggccgacgacgtgcccgatctgctcaagggcgacaccgctcatctgcgtcaggtactgctcaatctggtcggcaatgcggtcaagttcaccgagcacgggcatgtgttgctccgggtcacgcgtgtgtccgggagtgccgaggacgccgtccggttgcgcttcgatgtggaagacaccggcatcggcgtgccgatggacatgcgcccgcggctgttcgaggcctttgagcaggccgatgtcgggttgtcgcgccgttacgagggcaccggcctgggcaccaccatcgccaagggccttgtagaggcaatgggaggcagtatcgggttcaaggaaaatcagccaagcggcagcgtgttctggttcgagctgccgatggcgatcggcgagccgctgaaatcttcgaccgtacgggtgccgaccggggcgttggtggatgctcccgaggagttggaatcttccaacatcatcgctttttccaacccattcctgcgtcatcgcgcacgtgtgcgcagtatgcgcatgctcgtggccgacgaccacgaagccaaccgcatggtgctgcagcggttgctagagaaggctgggcataaggtgctgtgcgtcaacggcgccgagcaggtgctcgatgcgatggccgaagaggattacgacgcggtgattgtggatctgcacatgccgggcatgaacggcctggacatgctcaagcaattgcgggtgatgcaggccagtggcatgcgctacacgccagtggtggtgctcagcgccgacgtgacgcccgaagcgattcgcgcctgcgaacaggccggcgcgcgtgcgtttctggccaagcctgtcttggcggccaagttgctcgacaccctggccgatctg

SEQ ID NO: 40081 - DNA, 894 bp, Bacillus thuringiensis
atcaatgtatcttttggtgaaactgtgggggattgtaccactgttggattttctcctgtgtatggtacagatgcagaattcaaatcagatatttcttatttaaaaagtaaaggaaagaaaatagttctttcaataggtggacaaaatggggtcgttttacttcctgacaatgccgctaaggatcgttttattaattccatacaatctctgatcgataaatacggttttgacggaatagatattgaccttgaatcaggtatttacttaaacggaaatgacactaacttcaaaaacccaactacccctcaaatcgtaaatcttatttcagctattcgaacaatctcagatcattatggtccagattttctattaagcatggcccctgaaacagcttatgttcaaggcggatatagcgcatatggaagcatatggggtgcatatttaccaattatttatggagtgaaagataaactaacatacattcacgttcaacactacaacgctggtagcgggattggaatggacggtaataactacaatcaaggtactgcagactacgaggtcgctatggcagatatgctcttacatggttttcctgtaggtggtaatgcaaataacattttcccagctcttcgttcagatcaagtcatgattgggcttccagcagcaccagcggcagctccaagtggtggatacatttcgccaactgaaatgaaaaaagctttaaattatatcattaaaggagttccattcggaggaaagtataaactttctaaccagagtggctatcctgcattccgcggcctaatgtcttggtctattaattgggatgcaaaaaacacctttgaattctctagaaaccatccaacatattttgatggtctttccttgcaa

SEQ ID NO: 40082 - DNA, 210 bp, Bacillus thuringiensis
gagcctacagtggggatagatccgcttcttagaaaaacaatttgggaaaaattttatgttcttaaaaacaaaggcgcgtcgattattgtaacaacgcacattatggatcaagatgaattttgtgagcgtctagggttaattacagaaggtaaactagttgcggttggcacaactgaataattgaacacacgcgtttcatctggtcggatt

SEQ ID NO: 40083 - DNA, 786 bp, Bacillus thuringiensis
atgacacaacaaacttttacacagtatgattttaaaccatttttaatagatgcagttcgtgaactacgctttacagagccgacaggaattcagcagaaaattttcccggtcgtgaaaaaaggtgtaagtgtaattggacaatcccaaacaggttctgggaaaacacatgcatacttacttcctacattaaacagaattaatgcaagtcgtgaagaagtacaacttgttattacagcgcctactcgtgagttagcacaacaaatttacgaagaaatcgtgaaattaacaaagttttgtgcggaagaccaaatgattacagcacgttgtttaattggtggaactgataaacaacgctcaattgaaaagttgaaaaaacaacctcatatcgtagttggaacaccaggacgtattaaagatttagtagaagagcaagcattatttgttcataaagcaaatacgattattgtcgatgaagcagacttaatgcttgatatgggattcattcatgatgtagataaaattgcagcacgcatgcctaaaaacttgcaaatgttagttttctctgcaacaattcctcaaaaactaaaaccgtttctgaagaagtatatggagaatccagagcatattcatatcaatccaaaacaagttgcagctggaaacattgaacactatttagtgccttctaaacatcgtaataaaattgatttagtgcataaaatgctacttcaatttaaaccgtatttagcagttgttttcacgaatacgaaaaagatggcagaccaagtt

SEQ ID NO: 40084 - DNA, 462 bp, Bacillus thuringiensis
catacaaaacaaatgattgaatacggtacgaaaattgtcggtggtgtaacaccaggtaagggcggcactgatattgaaggtgtaccagtatttgatacagtagaagatgcagtgaaagcaacaggcgcaaacgcttcagttgtatacgttccacccgcttttgcggcagatgcaattatggaagctgttgatgcagaaattgatttagtagtatgtattactgaagggattcctgtattagatatggtaaacgtaaagagatatatggcgggtaaacatacacgtttacttggaccaaactgcccaggtgtaatcacaccggatgaatgtaagattggtattatgccaggatatattcataaaaaaggtcatgttggtatcgtatctcgctctggtacattaacgtatgaagctgtacatcagttaacacaagaaggtattggccaatctactgctgtaggt

SEQ ID NO: 40085 - DNA, 906 bp, Bacillus thuringiensis
tcgtcaaaacgatccgctgtttagttagtaagattcaaaggacgagagataattataaaagaggcaaaaacaactagctttgaaggtgtagatattgccttttttagcgctgggggagaagtatctagacaatttgtaactcatgcagtttctagtggtgcgattgtaattgataacacaagtgagtaccgaatggcacaaggtgtaccgctcgttgttccggaagtgaatgcgcatactttaaagcagcataaaggtatcattgcagttccaaattgttcagcattacagatggtaacagcacttcagccgattcgaaaatcattcggtttagaaagaattatcgtttcaacatatcaagccgtatcgggttctggcattcatgcgattcatgaattacaagagcaggctaagtctatgcttgctggtgaagaagtgaaaagtaatatattaccggcgaaaaaagataaaaaacattacccaatagcgtttaatgtactgcctcaagtagatatatttacagacaatgattttacttttgaagaagtaaaaatgattcaagaaacgaagaaaatattagaagatgaaaacctgaaaatggcagctacttgtgtacgtgttccagttgtatcagggcattcagaatcagtttatatagaactggaaaaagaagcaaccgttacggaaattaaggaagtattaatggatgcaccaggtgttattttgcaggataaccctagtaaacagctgtatccaatgccattatatgcagaagggaaaatagatacatttgtcggaagaatacgtaaagatcctgatatgccaaacggattccacctctggattgtttctgataacctattaaaaggtgcggcttggaattcagttcaaatcgcagagacttta

SEQ ID NO: 40086 - DNA, 824 bp, Bacillus thuringiensis
atgaaagctatcgtacatcaatataaaactggatttgacggtgtagaatataaaatatcacctgagagagcacttaatgatggggaagttaaagtgaagttaaaatcagcaggcttaaatcatcgggatttatttattgtgaataatagaaaagaaatgcaattgcctttaatcttaggatcagatggtgcaggtattgttacggaaattggaaacggtgtttctgataacatattacatacagaagttattattaatcctagtattggatgggaacatgctactgaagtaccggagttaccggaagtgctaggtggaccgaaagatggaacgtttgctgaatatgtaattgtaccagctgaaaatgtagtagaaaggccgtcatatcttacttgggaagaatcaggtgttttatctttatccgcattaactgcatatagagcgctttttacaaaagggagattgaagtgcggcgaacacgttttaattccgggaataggcggtggtgttgctacatttgccatgttattcgcgaaagcaattggcgcaaaagtgagtgttacttcaagggtagagaataaaagggaacttgctgcaaaatatggtgcagatatttcttttcatagtgccggaaattgggaagagggcttacaaggtgaaaaagtagatttaataatagatagtataggtccagcaacttttttgaaatatttgatgtattaaaaccaaacggaagaatcgggaattttggtgcaggctcaggagataaaattgaattaccattacgcgcgctattttacaatcaaattgatattatgggaaca

SEQ ID NO: 40087 - DNA, 414 bp, Bacillus thuringiensis
attataatgataaaacttgtacttattcgtcacggacaaagcttatggaatcttgaaaatcgctttactggatggacagatgttgatctatcagagaatggattaagtgaagcgagagaagcaggagcaatattaaagaaaaacggatatacttttgatgtggcttatacatctgtattaaaacgcgcaattcggacgttatggattgtacttcatgagatggatcttacttgggttccaatacataaatcttggaagctaaatgaaagacattatggtgcattgcaagggctgaataaagatgaaactgctcaaaagtatggtgaggagcaagttcatatttggagaagaagtgttgatgtaagaccaccggctcttactgaagacgatcctcgatatgaagcgaccgatcca

SEQ ID NO: 40088 - DNA, 717 bp, Bacillus thuringiensis
tttcagctttatgaatctttagaaacatatacgaaagcagattttcttactaatccttcaaagaaaacacctgtatttgtacggttctcaaccgttcaaggttctaaaggatccaacgacacagtaagagatgtacgcggattcgccacaaaattttatacagatgaaggaaactatgatttagtgggtaataatatgccagtattctttatccaagatgctattaaatttcctgattttgtccatgcagttaaaccagaaccacataatgatattcctcaaggagctagcgctcatgataccttttgggactttgttgcgcataatcctgagtccactcatatggtcatgtggcaaatgagcgaccgagctattccgcgtagtttacgaatgatggaaggttttggagttcacacatttcgactcattaacgcagaaggaaaagcccatttcgtaaagtttcactggaaacctaccctcggggttcattcattagtatgggatgaagctcaaaagattgccgggaaaaatcctgattttcatcgtcaagatttatacgaagcaattgaaaaaggggattatcctgaatgggagcttggattacagctaattccagaagaagatgaacataaatttgattttgatattttagatccaacgaaattatggccagaagaagaagttcccgtaaaattagttggtaaaatgacactgaac

SEQ ID NO: 40089 - DNA, 351 bp, Bacillus thuringiensis
catattaaagacacgcttccccatcgttatccatttttaatgattgataaagtaacaaatgtaaaacaaggtgaatccgttacaggatataaactcattacaaataacgaatggtttataaatgatagtcaaaaacatatgcctcatatgttaattgtagaatcacttgcccagcttagtgcatttgtacatacaagtgattctgaaggactaggatttctctcctctttagatggagttgaattccacggaaaagcatatcccggtgataaacttgatttacattatgagctaacgcgcaatcgccgaggttttattcttggtaaaagtattgcaactgtaaacgaccag

SEQ ID NO: 40090 - DNA, 1035 bp, Bacillus thuringiensis
tttccacatgattttttattcggagctgcttcagcttcttatcaagtagaaggtgcatggaatgaagatggaaaaggtgttacgaattgggacgagttttcaaaaattcctggcaaaacatacaatggaacaaatggtgatgtagctgttgatcattatcatcgatataaggaagatgttcgcttaatggctgagatgggattagaatcgtatcgtttttctatttcttgggcgagaatattgccgactggagatggaaaggtaaatgaaaaagggattgaattttataacaacttaattgatgaatgtttaaaatacgggattgtgccgtttgtcactttatatcattgggatttaccattaccgttagaaaaagatggtggatggacgaataaaagaacagcagaggctttcgtaaaatatgcagaaacttgttttaaggcatttggtgacagagttaagcattggattacttttaatgagaccgtaatgttttgtggattaggttatttaaaaggtgcacatccaccaggaatacaaaatgatgttccaaagtattttcaagctactcattatgtattttatgcacacgcgaaaacagttgcggtgtacaagcagctgaaacaatatggtgaaattgggattacacatgttttcttaccagcttatagtgtggatgatcaaaaagaaaatatacaagcagcaaatcatgcgaatgaatatgaaacgtattggtattatgatccaattttaaaaggcgagtatccgtcttatgttgtacaacaattaaaggaaaaaggatggactcctaattggacggttgaagaattagaaatcattaaacaaaatgcagaagaaaatgattttattggcttgaattattatcaaccaatacgagtagaaagatacgatttggatataaagagtgaggaacattctcgagaaaactcaacgcttgcttcaggtaacttttcttttgatggtttttatcgaacaggtaaaatggatgataaaaccttatacaaatggggttgg

SEQ ID NO: 40091 - DNA, 1068 bp, Bacillus thuringiensis
ttacacgaattattgaacggaagcaatgcacagattcaactaagtgttccgcaattagtggaaaaagtattaatgcgaaatgaagggaaattaacttctactggtgccgtttctgcttcaacaggaaaatatacaggacgttctcctaaagataaatttattgtgaaagaagcatcggttgctgacaaaattgcttggggagctgtgaaccaaccgatttctgaagaacattttaataaattatatactaaagttttagaatacttaaaagaaaaagaagagttattcgtcttcaaaggatttgcaggcgctgaccgcaattaccgcctaccaattcaagttattaacgaatatgcatggcacaatttatttgtacatcaattattcattcgtccaactgaagaagaattaacgactcatgaatcagagttcacaattgtttctgcaccgaatttcaaagctgatccagctgttgacggtacaaactctgaagcattcattatggtttcattcgaaaaacgcatcgtattaattggtggtacagaatacgctggagaaatgaaaaaatcaatcttctctattatgaacttcttattacctgaacaagatattctttctatgcactgttctgcaaacgtaggtgaagaaggcgatgtagcattattcttcggtttatctggaacaggtaaaacaacattatctgctgatccaaaccgtaaattaattggtgatgatgagcacggttggtctgataacggtgtattcaatattgaaggcggttgctacgcgaaatgtgtaaacctttctcacgagaaagaaccacaaattttcgatgcaatcacatttggatctgttttagaaaacgttatcattaatgaccaaacgcgtatcgcagactataacgatactactttaacagaaaatactcttgctgcataccctatgcatgcgatcgacaatatcgtactgtcaagtggtgctggacacccaaatacaatcattttcttaactgctgatgcatatggcgtattggcttcaatccgttagttatcaaaagaacaagctatg

SEQ ID NO: 40092 - DNA, 1004 bp, Bacillus thuringiensis
tgtatatcaggatacggacaagtaggcagagagtttataaaattattaatgaaaaatattcatatatatatgaaacatatgggattcaattagttgtaagtggcgtattagggagaaatattgcaatacataatgaagacggcttatcacttcatcatttattgatgtatggtggcggtaccgctgcaattgaaaaatatttagagtatcatccgaaggaacgtgcaacaactagcataagtggtactgtattggtagaatcaacagttacaaatcttaaagatggaaatccagggaaacaatatatgaaacaagcgattgagaaacagatggatatagtagcaatttctaaaggggcgctcgttacaaactggagagaaataaatgaagcagcaagaggcgcaaatgtacgaattcgatatagcggtgcaacagccgctgcattaccgaccctagatatcggacaatttagtttagccggttgcagtattgaaaaaatagaaggaatattaaatggaacaactaattatattcttacgaaaatgtatgaggaagatatgacatttgaagaagcattgaaagaagcacaagataaaggaattgctgagacaaaccctatattagatataagtggctcagatagggcgtgaaaattggtacttatgacaaacagcttaatggaaacagagaaaacacttactgatatacatataaaaggaatcgagcacgttacaaaacagcaaattagaaatgctaaggaacaacataaaattattaaattaatagcatcaacatataaggatgagggtggcaatgtgaatttaaatgttgaaccgtgcgaaatagaaaaagatcatccgttagcaaaagtaaatgggaccgaaaaaggaattacgttctttacagatacgatgggacaagttactacaattggtggggcttctaatccacgaggcgctgcagctgcagctttaaaagatgtgattaacttatatcgaaaagat

SEQ ID NO: 40093 - DNA, 807 bp, Bacillus thuringiensis
atttcagaaatcctaaaagatgcagaagattttgcgaatggaaaagagagcaaaacgacagagcaaacttttgttgcgaacttgttctttgagaatagtacgagaacgagatttagctttgaagttgctgagaagagattaggacttgatgttttaaacttttcagctgatgcatctagcgtacaaaaaggagaaactttatacgatacgataagaacactagaatcaatcggaacaaaagcagtggtcatccgccacgagcaagatcgctacttcgatgaactaaaagatcaggtgaatattccaatcttaaacgctggagatggatgcggaaaccacccaacgcagtgcctactcgatcttcttacaattaaacaagagtttggaagatttgaaggtttgaagattgcaatagtaggagatgttcgtcatagccgagtagcacgttctaatgcagaagcattaacgaagcttggtgcaacaatttactttgcaagtccagaagagtggaaagatgaagacaacacatttggaacatacaaaccattagatgaacttgttccagaagttgatgtaatgatgttactccgtgtacaacatgagcgtcatgatcattatgaaacagacattatgaaagaatatcatgagaaacacggattaacagtagaaagagaaaagcgtatgaaagaaggaagcattattatgcatccagctcctgtaaaccgtgatgttgaaattgcaagtgaacttgttgagtgtgagcgttcacgcatatttaaacaaatgggaaatggagtttacgtaaga

SEQ ID NO: 40094 - DNA, 1144 bp, Bacillus thuringiensis
ggttattttcaacgaaaatattcgatgtctgaacatactaaattaagttttttacaaaatttctaatgagaaagttcttgttatggtgcgattttcgttagctgttagtacgaaaggaacaccggatactgctagaaatgtacgcggtttttctacaaaattttatacaaaagaaggcatttttgaccttttatgtaatcacattcctgttttttctgtccgtgatccgatgcgtttccctgaaacgattcaagcattattgccttcacctaaaaataacttaatagaccctaatagattttggagttttgtcgctaaagcacctgaatctattcattttgttgtccgtttatactctaataatggtacggccaaaagtcttcgccacattccaggacatagtgttaatacatatgtatggagaaatgcggaaggtaatcgaaagtatgtaaagtatcattggtacccgtttgaaggtgtacagtacattactagtaaagaagcaattaaactagctgccgaaaatcctgattatagcgggaaagatttatatgatgctattgaaaatggtaaaccagtggagtatggtttatacgtccagctcatggatccgaaagatgaagcgcacctttcttatgatcctttagatgacacaaaagtatgggatgaacaaacgtatcctctcataccagtcgggaaaatggtattaaataaaaatcctgaaaattttatggaacaagtagaaaaagtcgcattctccccttctaatttactggatggtgcagaactatcagatgataaaatgctgcaagggcgcgctaacatttacagtgattcacaaagaagaagaattggtcccgaatttcgtaaattaacgattaaccagcagcaagattggacacctgctaatcaaattacaaccggtgaagaaaggtacgttgaaggtaaacttgaaagaccttctataacgaaacaggataactttacgcaggctagtgaattttatacgaagttacagccaatagaaaaagaacatctcgctgaaaacttagctagtgatttgaaagttatatccgatgatattaggaagatcgttttggggtatttcaatcgagtatccactgatttgaaaacaaacattgag

SEQ ID NO: 40095 - DNA, 1203 bp, Bacillus thuringiensis
acagttcagttaaaccgtaagtatgcaaagggtttcactaatgatatcggtggactttcatctcactctgcaattatggctcgttctatggaaattccaactgttgttggtacgaaagttgttatggagaaaatccaaaacggcgatatcgttatcattgacggtttagatggagaagtaattgtaaacccatcagaagaaactcttcgttcgtttgaagaaaagaaagcgaaatttgaagagcaaaaagctgaatgggcaaaattaaaagaccaagctactgtaacaagtgacggacatcacgttgagcttgttgcaaatatcggaacaccaaatgatgtacaaggtattatcgataatggcggagaaggcgttggcttataccgtacagaattcttatacatgggccgtgacaatcttccaacagaagaagagcagttcgaagcgtataaagcagttcttgaaggtgtaaaagaaggtcaaccagtcgttgttcgtacacttgacatcggtggagataaagagcttccatacttacatttaccaaaagaaatgaatccattcttaggataccgtgcaattcgcttatgtcttgatgaacaagatgtgttccgtacacaacttcgtgcattacttcgtgctagcgtatacggtaacttaaaaattatgttcccaatgattgcaactcttgatgagttccgtcaagcgaaagcgattttattagaagagaaagcgaaacttgtagaagcgggtacaactgtttctgattctattgaagttggtatgatggttgaaatcccagcttcagcagtattagcagaccaattcgcgaaagaagttgacttcttctctatcggaacaaatgatttaatccaatacacaatggctgcagaccgtatgaacgaacaagtatcttacttataccaaccatacaacccatctattttacgtcttgtaaaaatggttatcgatgctgctcataaagaaggcaaatgggctggtatgtgtggtgagatggcgggcgattcacttgctatcccattattattaggattaggtttagatgagttcagtatgagtgcaacatctattcttcctgcaagaacgcagctaagcaagttgtcaaaagcagaaatggaaacattagcagaaaaagcattaaagatgtcaactgctgaagaaaatgttgaactagttaaaagc

SEQ ID NO: 40096 - DNA, 975 bp, Bacillus thuringiensis
gttacaaaatcgttgtatctgccgtttcattttttaaacccagttgcaattgagtatgctaagaaattagtggattgctcattaaaaaacggaaaggtcttttttacaaactcaggtacggaagcgacagaaacgacgttgaaattaattgataaatatagagctaatatgaatgaagaatgtgaaggaattgtattgctaaagaatagtgtccatgggcgtacgttaggggcactacattttacgagacatgaaagtgtatatcaaaatttccctgaaacatcgattcctgtatacgaagtagagcgcgaaaatatagaccaattagaagagactattattaaagaaaacccaattgcgattatgctagagcctgtattaggaagtggggggatttatcctttatcaagtgaatatttgcatggtattcaatatttatgtgaaaaatataatgtacttcttgtcgttgatgaagttcaaagtggtatggggagaaccgggaaactgtttgcgtatcaaaattttaatattacaccggacattattcaaattggtaaaggagcaggaggcgggataccgctagggggaattattgtaggtgaaaagttatgtgatgtattttcaccaggagatcacgggacaacatttgctcattcatcaatgggaacagctttaggtttaactgtattaaatacattacttgatgaggggttaatgcaagaagcttatgaaacgtcactatatttgaatgacaaactgcaagacattcagaaagaaaattcttattatattcaggaagtgcgtcatgctggcatgatgtttggaattagtctgaatgatacgaatgaaaatgtgaagaaattacaggttgagctaatgaataaaggaatgttagtcgatgtaacacaagggaatattattcgattacttccgccgtatattattacaaaagaggaaattgatgcatttattaat

SEQ ID NO: 40097 - DNA, 1443 bp, Bacillus thuringiensis
agcattccaaatgatgatgttggtaactttttctgctttccatttattcatgcagatgatgtattcaaagcaccatcttggattaaagacaccatttggtatcagattttccctgagcgattcgctaatggcgatagtacgctgaatccagaaaatacccttccttggggaagtgcgaatccaactccaactaattttttcggcggagatttttctggtgttattcaaaaccttgattaccttgttaagcttggcatttccggaatatatttcacacctattttcaaagctcattcaaaccataaatatgacacaattgactatatggaaattgacccacaatttgggacgaaagaaacttttaaagagctcgttgaagaatgtcataagcacggtataaaagtaatgctcgatgctgtgtttaatcatagtggatactttttcgagaaatttcaagacgtactagagaatggtgagaagtccgcatataaagagtggttccacattcatgaatttccgattataaccgaaccacttccaaattatgatactttcgcctttacaccgtatatgcctaaattaaatacagctcatccagatgtaaaagaatacttacttgaagtaggacgttattgggtacgagaattcaatatagatggctggcgccttgatgtcgccaatgaagtcgatcacaacttttggagagaattccgaactgaaataaagacactaaatcctgaagtatatattttgggagaaatttggcacgatgcccttccgtggctacaaggcgatcaatttgatgctgtcatgagctatcctgttacaaatgctctactttcttactttgctaacgattccattaaagcaagtgaattcatgaagcaaattacagaatctgtacattcctactctatgaatgtaaatgaagcagcatttcatttattagacagccatgatactccaagaattttaacaacatgcaacggagataaaaataagttgaaattgctctatgtattccatctttctttcatcggctctccttgtatttattacggggatgaaattggtatggatggcggcatggaccctgattgccgtaaatgtatgatttgggatactaaagaacaagatcatgcattatttacccatatacaaacattgattttattacgtaaacaacataaagcatttggaggacatggtacttttcaattcatcgaagcaaatgatgaacataattatatttcttatacgaaaacatatgaggatgaaactatctttttcgttttaaaccctactaatagtgaagttacagtttcactccctcttcatgttactggtaagaaaataattaacatttatacatacgaagaattttcagcggaagcatgtgtattacaagctacacttgctccatatggattctccatattaaaa

SEQ ID NO: 40098 - DNA, 1872 bp, Bacillus thuringiensis
atgagcgtttcaaaacgattgtttcaatacgcgatgaaagtgaaagggacgatttttgctgcgatgttaatgttatttattttcgtcatcgcagagcttgctggtcctttcgtcgctaaaacgatgattgacgatcatatcgtcgggatagagaaaccttggtatgaaacagaacagagtgaagatgctgtttcgtataatggggctttttataagcgaagtgatcgctttgaacaaggcgagaaaaaagggaaagaagtacgcgtgatgcaagtcggttttcaatattattttgtaccgaataaagtaaatgcggaaggatcacgtactgtaaaaggggatatgattaccgttcaaaatggtaaggcggtgcaagtgtataaagcgaaagcattgacgaaagaagaagtgtttgcgttttataaaccagaaataagccgtttactcctacttggtggtggctattttgctttattagtagtcgtatcattatttgcatacggaaagcagttcttcttgcaaaaggcagcgaacaaaattattcaaattatgagggaagatgttttttctcatattcaaacgttgccaattcgttatttcgatcatttaccagcagggaaaattgtgtcgcgtgtgacgaatgatacggaagccattcgtgatctatacgtaacggtacttgcgacattcgtttcgagtatcatctatattattgggatattcgctgcgctatttttacttgatgtaaaattggcgacgttatgtttactcattatcccgattttaatcgcttgggcaattctttatagaaaatacgcgtctgtatacaatcataaaatgcgctctcgtttatctgatattaacggaacagtaaatgaatccattcaagggatgccaattattcaagcgttccgtcaagagcgtgaaacgaaaaaagagtttgaagaattaaatggcgattattttaagtatcaaaataaaattttgaatttaaatgcagcaacttctcataatttagtatccgtattaagaaatatcgctttcacaggtgtgatttggtatttcggtggcgcttcattaagtgctacaggcgtcatttctctagggatactgtatgcgttcgttgattatttaacacgattgttctcaccgattacgaatatggtgaaccagcttgctaacttagaacaatcgcgtgttgcatcagagcgtgtttttgaattgttagaggaaaaaggagaagcagtagaagaagagcgtatgcctcgcttacaaggaaatgtgaagtttgataatgtatcgttttcttataatgggaaagatgaagtgttaaaaaatatttcttttgaagcgaaacaaggggagaccgtggcacttgtcggtcatactggatcaggaaaaagttctattatgaacgtactctttcagttttacgagtttgaaaaaggaaagcttacgattgatggtcatgatgtaaaagagatgccgaaacaagcaactcgtgaacatatgggaattgtactgcaagatccgtttttatttagcggaacagtagcatctaatgtaagtttagaaaatgaaaaaatttcaaaagagcgcatcgtaaaagcattgcgtgatgttggtgctgaaagatttgcgaacaatataaatgaagaaattacggagaaaggaagtactctttcaaccggagaacgtcagcttatatcgtttgctagggcgctcgcttttgacccagccattttaattttagatgaagcgacatctagtatcgatacagaaacagaggcgatgattcaacaagcgctagaagttgtgaaaaaaggaagaacgacatatattatcgctcaccgactttcaacaattaaaagc

SEQ ID NO: 40099 - DNA, 123 bp, Bacillus thuringiensis
tctgcagtgcaatatgcggattggattctcgttatggatgaaggcgcagttatagaagaaggtacgcatgctcagcttatccaaaagggaggctggtatgctgaacagtttgaaagacaacaa

SEQ ID NO: 40100 - DNA, 1422 bp, Bacillus thuringiensis
atgatgaatgtaccgctaacaattagttctatgatggaaagagcagagaaactgttttcgaagaaagaaattgtttcacggacacatgatacagttacaacgttaacatataagcagttaggggaaaggacgagaagactttccagtgcgttgaaaaagcttggaattaaagaaggtgaacctgtaggaacattagcgtggaaccatcatcgacatgtagaagcgtattttgctattccaggtattgcttctgttttgcacacgattaatattcgtttatctcctcaacatatttcatacattattcagcacgcagaagaccgaattctacttatagatgaagatctcgtaccgctcgttgaaaatattcaatcacaattatcaactgtacaagcttacattattatgactgataaagatgaacttccaaatactatgctggagcctgtatatcattatgaaaagctattagaagaaggcgatcccaatttccaatttgtaaaagatattgatgaaaatacacctgctggtatgtgttatacgtcagcgactacaggaaacccaaaaggtgttgtatatacgcatcgtagtactgtattgcattgtatggcactcggtttagctgatacagctgctttatcggaaagtgacgcagcaatggcaatcgtcccgatgtttcatgtgaacgcttggggacttccttttgcggctacttggtttggatcaaaacaagttcttcctggaccgatgtttaccccgaaaattttattagagatgattcaatcagaaaaagtgacgttagctgcgggtgtgccgacaatttggctcggcgtattacaagagttagaaaataatagttacgatttatctagtatgacgagaatactatgcggaggtgcagctgcgccgaaaagcgttattaaagcatttgaacagaaacataatgttccattcatacatgcatatggtatgactgaaacgagcccactcgtaacacttgcacgtttaaaaagttatgaaacagaattatcgtatgaagagcaattagaaattagatcaaaacaagggtatcttgtccctggtgtagagatgaaagtagtcggtacaaatggtgaagtgaagtgggatggtacggagatgggagaactatgtttacgagcgccatggatcgctgaaagctattataacgataatcgtactgtcgaaggttttcgtgatggttggttatatacaggagatgtcgttacggttgatgaggaaggctgcgtgaaaattgttgaccgtacgaaggatgttattaaaagcgggggagaatggatttcttcggtcgatcttgaaaatgctttaatggcacatgatgctatatttgaagcggccgtcgttgcgattcctcaccatcagtggcaagagcgaccaattgcc

SEQ ID NO: 40101 - DNA, 642 bp, Bacillus thuringiensis
ttccaatatgaaaaaaatagtccgcttattttacgtgatttatcagtttcgattgaaaaaggaaaatgggtagcactcgttgggaagaatggtacaggtaagtctacactgttaacgattttagcaggattacaaaaagcgagaagagggaaagtaaagtggaacggaaaagtaatacataaaattgattcgaaagaacgttttaaaagtattgggtatgtatcgcagcatccgtattaccattttacatttgatacagtatgggacgaggtttatgaacgtgcgcgtgaattatatggagaacaaggaaaagaaatagcagaagatacgctaaaacagttttggttgtactcgcttaaagaacgccatccgcacgattgtagcgggggagagcaacaacttcttgcattatgtacaacgttattatcaaagccgactttattattacttgatgaaccgacaaagggattagatccatggaagaaagaaagagtaggagagctatttaggaagctacaaaaagaaggtacaacaattgtaatggcaacgcatgatattgagtttgcagcgaaatacgttgatcaatgtatgatgttatttgatggaacagtcattatgaatgatgcaccgaaagaatttttt

SEQ ID NO: 40102 - DNA, 1173 bp, Bacillus thuringiensis
tcgaagcgcaaactactttgtatagctgggcttggatggctatttgatgcaatggatgttggaatgctttcatttgtaatggtagccttgcaaaaggattggggattaagtacgcaagaaatgggctggataggcagtattaactcaatcggtatggcagtcggagcgcttatttttgggatactatcagataaaatagggcgaaaatcagtctttattattacattattattattttctatcggtagtggtttaactgcattaacaacaacacttgcgatgtttctcgttttacgctttttaattggtatggggcttggcggagagcttccggttgcctctacactagtatcagagagtgttgaagcgcatgaacgtgggaaaattgttgtgttattagaaagtttttgggcaggtggatggctaattgcagctcttatctcgtattttgttattcctaaatatggttgggaagttgcgatggtattgagtgcagttccagcattatatgctttatatttaagatggaatttaccggattccccaaggttccaaaaagttgaaaaaaggccatctgttattgaaaatataaaatcagtttggtctggggaatatcgtaaagcaacaattatgctatggattctatggttttgtgttgtcttttcctattatggaatgttcctttggttaccgagtgtaatggtgctaaaaggatttagtttaataaaaagtttccaatacgtacttattatgacattagctcaacttccaggatatttcaccgctgcttggtttattgaacgtctcggtcgtaaatttgttttggttacgtatttaattgggacagcttgcagtgcttatttgtttggggttgcggattcattaacagtattaatcgtggcaggtatgttactatccttctttaacttaggtgcttggggagcattatacgcctatacacctgagcagtatccaacggttattcgtggtacaggtgcaggaatggcagcagcatttggtcgtattggtggtattcttgggccactattagtgggatatttagttgcttcagaagcttcactatcattaatatttacgattttctgtggatcaattttaattggtgtattcgctgtaataatacttggacaggaaacgaagcaacgagaatta

SEQ ID NO: 40103 - DNA, 930 bp, Bacillus thuringiensis
aaaatgttagagattcgtaagtttgaagataaggtacatgaattgttcgcgcaaggcgttttgccaggtttcgttcatttatacgcaggtgaagaagcggtagcagttggtgtatgtgcccacttaacggatagtgacagtattacaagtacacatagaggtcatggacattgtatcgcaaaaggttgtgatttaaatggtatgatggctgaacttttcgggaaagcgacaggattatgtaaaggtaaaggcggttccatgcatattgcggatttagataaaggaatgcttggtgctaatggcattgtaggcgggggtttcccacttgcttgcggttcagcattgacagctaaatataaaggaacaaaagatgtaagtgtttgtttcttcggtgacggagcaaataatgaaggaacattccatgaaggggttaatttagcggcgatttggaagttaccagttatttttattgcagaaaataacggttacggtgaagcaactacatttgaatatgcttcaagttgtgattctattgcggatcgtgcaaaagcttataatattccaggcgttcaagtagatggaaaagatcttctagctgtatataaagctgctgcagaagcagtggaacgtgcgcgtaatggtgatggtccaacaattattgaatgtatgacatatcgtaattacggtcattttgaaggtgaagcgcaaacatataaaacatcagaagaaaaagaagaacatttaaatgaaaaagatgcgattgtgaatttccgtaagcatttaattcatgaaggtttattaacggaatctgaacttgttgatatggaaaaagcagtagatgatgcagtacaaagatccattgaatttagtgaaaatagtccatacccagacgatgaagaattattaaaagatgtatacgtttcttacaaa

SEQ ID NO: 40104 - DNA, 1194 bp, Bacillus thuringiensis
ctaattgaaacgattccggaaaacggatctaatccaaaagaattacttcattttcttaataacaatgtgtttaatcaaattactcatgtggatcatcctcattttatggcttttgtgccaggtcctaataattatgttggtgtattagcagattttttagcaagtgggtttaatgtattttctacagcttggatagtaggtgcaggtgccgaacaaattgaattaacgacaattaactggttaaaatcaatgctaggattccctgattcagctgaaggactatttgtcagtggtggttccatggctaatttgactgcacttactgtagcgagacaggtcaagctgaataatgacatagaaaatgcgattgtttatttttctaaccaaactcatttttctgtagatcgagcacttaaagtattaggttttaaacagcatcaaatttgccgaattgagacagatgaagacttaaaaatttcagttagtactttaagaaaacaaataaaagaagatcgattaaaagggaaaaaaccattctgtgttattgctaatgcagggacaacgaattgcggagcggtggactccctcgatgaattggctgatgtatgtggtgatgaagatatatggctacacgtggatggggcttatggggctgcagcaattctcagtgaaaaaggaagggagttattaagtggaattcatcgtgccgattctttaacgttagacccgcataaatggctttttcagccttatgatgttggttgtgtacttattcgaaatagccaatatttaagtgaaacattccgtatgatcccagagtatattaaggatacagaaactaatatagaagaaaaagtgaattttggggagcgtggaattgaactttctcgtagatttagagcattaaaggtatggctttcttttaaagcattcggagttacagcttttcgtgaggcaattgatcatggcattatgctagctgaacaagttgaagagtttttaaggaaagaaaaagattgggaagtagtaacacctgcccaattaggaattgttacttttcgttatattccatgtgagctaacatctacagatacaattcatgaaataaacaaaaaattggtggaagaaattaatcaaagaggatttgctatgctaagtacgactaaattaaaagaaaaagtagtaattcgactt

SEQ ID NO: 40105 - DNA, 1182 bp, Bacillus thuringiensis
ggatatggtttcttgtcagaaaggattcaattcgctaaacgttgtgaagaagaaggaattatctttatcggtccgaaaagtaagcatttagatatgtttggagataaagtgaaagcaagaacacaagcgcagctagcacaaattccagttatacctggtagtgatggtccagtaaattcattagaagaagtcgaaaaatttgctgaaaagtatgattacccgattattattaaagcatcccttgggggtggcggtcgtggtatgcgtattgtgcgtactagtgaggaattaggagaatcatataatcgagcgaaatcagaagcgaaagcagcttttggtaatgatgaagtttacgtcgaaaaattcgttgaaaaacctaaacatatagaagtacaaattttagcagatgaagaaggcaatgttgttcatttatacgagcgtgactgttctgtacaacgtcgtcatcaaaaagttgtagaaattgcaccgagtgtatcactttcagatgatctgcgtcagcgtatttgtgatgctgctgtgaagttaacgaaaaatgtaaactatttaaatgcaggaacagtagaattccttgtaaaagatgatgagttttactttattgaagtaaatccacgtgttcaagtagaacatacgattacagaaatgattacgggagtagatattgttcaatcacaaattttaatagcggatggacattcattacatagcaaaatggtaggtgttccgaagcaagaggaagtagttgtacatggatttgcaattcaatctcgtgtaacaactgaagatccgctaaataattttatgccggatacaggaaaaattatggcgtatcgatcaggtggtggttttggtgtgcgtcttgatacaggaaatagcttccaaggtgcagttattacaccgtactacgattctttacttgtaaaagttacaacttgggcacttacttttgagcaagctgctgcaaaaatggaacgtaacttaaaagaattccgtattcgtggtattaaaacaaatattccattcctagagaatgtagtaaagcataaaaacttcttatcaggagaatatgatacttcatttatcgatgcgtcacctgaattgttcttgttcccgaaacgtaaagaccgtggaacgaaaatgttaaattacattggtacagtaact

SEQ ID NO: 40106 - DNA, 989 bp, Bacillus thuringiensis
agcgggaaatctacgctagttcgtatgttaaatcaattgattaaaccaactgcaggtcatatatacatagatggtgaagacatcgcaacgatgggaaaagaagagttacggagagtaagaagaacgaaaatgagtatggtatttcagaaattcgctctatttccgcatcgtacagttatacaaaatgttgcatatggtttagaaatacaaggagttccggttgaagagcgagagaaaaaagcgttagaatcgctacagttagtaggactcgatcatcataaagataattacccaagtcaacttagtggtggtatgcaacagcgcgttggaatcgcaagggcactaacgaataatccagatgtattactaatggacgagtcattcagtgcattagatccacttattcgaaaagaaatgcaagatgaattgttagagttacaagataaaatggaaaaaacgattatatttattacgcatgatttagatgaagcgcttcgaattggagatcgtatcgcattaatgaaagatggagaaatcgtccaaattggaacaccagaagaaattatgatgagccccgctaatgaatttgtagaaaagtttgttgcggatgtgaatttaggaaaagtaattacggcggagtctattttaaaacgaccagaaactttattaattgatcgtggacctcgtgtagcccttcaaattatgaggaatgcaggtgtttcaactgtatatgttgtaaacaaaaagtatgagtttttaggtatattaactgcggatgatgcgagtaaagcagtacaaaaacagtggccgattgctgatttattacttaatgatattccgcatgtgtatttggatactttactggaagagacatatgcaaaaatggcagagatgaaatattccgtaccagtaatcgatgagaagaaaaggctaagaggaattattaaacgtgaaagtgtcattcaagctctgcaggaaacattgagaag

SEQ ID NO: 40107 - DNA, 1536 bp, Bacillus thuringiensis
agcataatggaaaaacaatggtggaaagaaagtgtagtatatcaaatttatcctcgtagctttatggatagtaatggtgatggtataggagatcttcaagggattatttcaaagctagattacttaaaagagttagggattgatgtgatttggttatcaccagtctatgaatctccaaatgatgataatggttatgatataagcgattattgtaaaattatgaacgagttcggaacaatggaagattgggatgagctattacatgaaatgcatgaacgtaatatgaaacttatgatggacttagttgttaatcatacttcggatgaacataattggtttattgaatcacgtaaatcaaaagataataaatatagagattactatatatggcgccctggaaaagaagggaaagaaccgaacaactggggagctgcttttagtggatctgcatggcagtatgatgaaatgacggatgaatattatttacatctgttttctaaaaaacagccagatttaaattgggataatgaaaaggtaagacaagatgtttatgaaatgatgaagttttggttagaaaaaggaattgatggcttccgtatggatgttattaattttatttctaaagaagagggattaccagctgttgaaacagaagaagaggggtatgtttcaggtcataagcattttatgaacggtccaaacattcataaatatttacatgaaatgaatgaggaagtattatcgcattatgatattatgacggttggtgaaatgcctggtgtaacgacagaagaagcgaaattgtatactggagaagaacgaaaagagttgcaaatggtattccaatttgaacatatggatttagattcaggagaaggtggaaagtgggatgtaaaaccatgctcacttcttactttaaaagagaatttaacaaagtggcaaaaagcattagagcataccggatggaatagcctttattggaataatcatgatcagcctcgcgttgtatctcgttttggtaatgatggaatgtatcgcattgaatcagcaaaaatgttagcgacagttcttcatatgatgaaaggaacgccatatatttatcaaggagaggaaattggaatgacgaacgttcgattccaatcaattgatgaatatcgagatattgaaacgttaaatatgtataaagaaaaagtgatagaccatggtgaagatatagaaaaagtaatggaatctatttatataaagggtcgtgataatgctagaactccgatgcagtggaatgatcagaatcacgctggatttacaaaaggtgaaccttggattactgtaaatcctaactataaagagattaatgtgaaacaagcaatccaagatgaaggttcaattttttattactataagaaattaattgaactacgcaaaaataatgaaatagttgtgtatggatcatatgatttaatattagataatgacccttctatttttgcttatgtaagaacatatggagatgaaaaactacttgtcattgcaaacttt

SEQ ID NO: 40108 - DNA, 956 bp, Bacillus thuringiensis
tggcataaaagtgtagtatatcaaatttatccgaagagctttaatagttattacaatagagaaaccggtgatataaaaggggttacagagaaactagattatttaaaagaactcggagtggattatatttggttaacaccgatataccaatcaccacaaaatgataatggatatgatgtaagtgattattacagcattgatccatcttacggaacgatggaagagtttgaagaacttttagcagaagcgaaagtacgtaacattgaaattatgcttgatattgttgtaaatcatagttcgactgaacataagtggtttaaagaagcgaaggaagataaaaatagtccatatcgtaattactatatttggcgtgatgaaaaaaataattggcagtctaagtttggtggatctgcttggaaatatgatgagaagacggagcaatattatttacatctatttgatgaaacacaagctgatttaaattgggaaaatgaaaaactgcgtgaagaagtatatgatatgatgcgcttttggctggataaaggggtaacgggattccgattagatgtcattaacttaatttcaaaagaccaatgttttttaaacgatgaaggtagtactgcgacaagtgatggacgcaagtattatacagatggcccgcgtgttcatgaatatttacaagagatgaaccgaaatgtttttgcaggaaaagatgtcattacagttggagaaatgtcatctacgacaattgataattgtattaaatattctaatcctgagcgtaatgaattaagcatgacgtttagtttccatcatttaaaagtagattatccgaatggtgataagtggacgaaagcagagtttgattttattaaattaaaagagattatgtctaactggcaaattgaaatgcaaaagggcggaggatggaatgcgtattttggtgtaatcatgac

SEQ ID NO: 40109 - DNA, 846 bp, Bacillus thuringiensis
atgagcctattttcttttacaaaaatgcatggtcttggcaatagttatatatatgtaaatatgtttgaagagcacattcctgaagaagatttagcccttgtggccgaaaaggtttcaaatattaatactggtattggagcagacgggatgattttaatttgcccttcagacgtagctccggtgaagatgcgtatgtttaataatgatggttctgaaggaaagagctgtggtaacggtttacgctgcgtagcgaaatatgcgtatgagcataaactagtagaagaaacagttttcacaattgaaacgttagctggtattgtaacggctgaagtaacagtagaagatggtgtcgtgacattagcaaaaatcgatatgggagcacctcgtctaacacgtgcagaaataccaatgcttggtgaaggtgaaacaccatttattcgtgaaaacttcttatacaataatcatcgttatgcatttacagctgtttcaatgggaaatccgcatgcggttatttttgttgatgatgtagaaaaagcacctcttacaacacttggaccagttctcgagacacatgaaatgttcccagagcgagtaaatgttgagtttatcgaaattttgaataatgacgagatgaacttccgcgtttgggaacgtggatctggtgtaacgcaagcttgcggaacaggagcgtgcgctgcagttgtagctgctattttaaatggaaagatggaacgtggtaaggaaattacagtccatttagctggcggcgatttaatgattgcgtggactgaagaaggaaacgtgttgatgaaaggacctgcggaagtaatttgccgcggagtgtat

SEQ ID NO: 40110 - DNA, 960 bp, Bacillus thuringiensis
gatgaaaatgtaattttaataggtgaagacgttgcaggcggtgcacaagttgatcatctgcaagatgatgaagcttggggtggtgttcttggtgttacgaaaggacttgtacaagagtttggccgaaatcgtatattggatacaccaatttctgaagcgggttatatgggagctgcgatggcagctgctgcaactgggttacgtccgatagctgaattaatgtttaatgattttattggtagttgtcttgatcaagtattaaaccaaggtgcaaaattccgctatatgtttggtggtaaagcgaaagtgccagttacggtacgtacgatgcacggtgcaggttttagcgcagctgcacaacattcacaaagtttgtatgccttatttacgagcattccaggtataaaagttgtcgttccttctactccatatgacgcaaaaggcttattattagcggcaattgaagatgacgacccggtaatcttctttgaagataaaacactttacaatatgaaaggtgaagtgccggaagggtattatacaatttctttaggaaaagcagatattaaacgagaaggttctgatgtaacaattgtcgcaatcggaaaacaagttcatacagcacttgcagctgcaaagcaattatcgaaaaaggggcttgaagtagaagtaattgatccacgatctttatcaccgcttgatgaagatactattttatcatctgttgaaaaaacaaatcgtcttatcgttattgacgaagcgaatccaagatgtagtatcgcaacagatattgcggcaattgtagcggataaaggttttgatttgttagatgcacctattaaacgaattacagcaccacatacacctgttccgttctcaccaccacttgaaaagttgtatttgccaacgccagaaaaagtaattgaaactgtatcagaaatgattggagaccaatcttta

SEQ ID NO: 40111 - DNA, 765 bp, Bacillus thuringiensis
aaaacttttcatgtcgctgtagttggagcaaccggcgcagttggtgaacaaatgttaaatactttagagaaacgagaatttccaatcgggaaattaacgttactttcatctaaacgatctgcaggtaagaaacttgtatttaaaggcgaagaatttacagttcaagaggcaactcctgaaagctttgaaggagtagatatcgcactatttagtgctggtggatctgtatcgaaacaattagcgccagaagcagcaaaacgcggtgcgattgttgttgataatacaagtgcattccgtatgacagaaaacgtgccacttgttgtacctgaagtaaatgaaaacgacttaaaagaacataatggtattattgcaaatccaaactgttctacaattcaaatggtagtagctcttgagccagttcgtcagcaatatggtttaaaacgagtaatcgtttccacatatcaagctgtatcaggtgctggtgcggcagctattgaagcactgcatgaacaatcacaagcaatcttaaatggcgaagaagttaaggcaaatgttcttcctgtatcaggtgataagaagcatttcccaattgcttttaatgcgattccacagattgataaattccaagataatggatttacgtttgaagaaatgaaaatgattaacgaaacgaaaaaaattatgcatatgcatgaattccaagtagcggcaacatgtgtacgtttaccaaatgtatcaggacactctgagtctgtttacatcgaa

SEQ ID NO: 40112 - DNA, 1299 bp, Bacillus thuringiensis
atggaaataacaattgaacatgtagtaaatgaattaaaaggcatacttcctgaagatcgagtagtaataaatatgacagtacgagagttacatagtaaagatgaatcttaccatagtagtagtttacctgatgtagttgtttttccaaaaacgaccgaagaagttagcgcgataatgaaaatagcgattcagcacggaacagctgtcgttccatttggagtagggtccagtttagagggacatgtaattccttacgaaaaaggaattacaatggacttttctcttatgaacaaaatacttgaaataagagaaaaggattttcttgtgagagtacagccaggggtgacgcgctctcagcttaataaagaattgaaaaagtatggattattttttagtgtagacccaggagctgatgcaacgttaggaggaatggctgctacaaatgcgagcggaacgacagcggtaaagtatggggtaatgcgtgatcaagttcgagatttagaagtcgttcttgctgatggaggagtaatacataccgggaatttagcggcgaagtcatcatcaggttatcatttaaatggtattttcgtaggctcagaaggaacacttggatgtttcacggagttaactttaaaagtatacggtataccagaacatgttatggctgcgagggcatcgtttccaactataaatgatgcagtagaagctgtaattaacatattacaagcaggtattccaatcgcgagaattgaactcgttgatgaattatctatgaaacaagtaaattattacaatgaaacaagttacagagaagaaccgacactgtttttagagtttcacggcaatgaagcagggttaaagcaagatattgaatttacgaaagaaatcgttcttgatcataaatgtatagaaattgcgtttgagacggaaacagcagcgagaaataagctgtgggatgcaagacataacttagcgtactcttacgtgcatagttatcctggtaaaaagctaatgagtacacacgtatgtgtaccaatttcggaattagctggagcgattcaacatgcgaaagaggtattacataaagtagggcttattggcggtattctcggtcatgttggggatgggaatttccatgtactcttaatgattgacacaaatgataaggaggaagtgaagaaggcagacgaaataaatgaaagtatcgttcagtatgctcttaaacgaggaggaacgtgtacaggagaacatggcgttggaatcgggaaacgaaagtatcaagaagaagaacatggggag

SEQ ID NO: 40113 - DNA, 1134 bp, Bacillus thuringiensis
gatgcacattataaatttgtaccgaatcgtaatttttactacttaacgggaatcgatgaaccaaatgttatttttatgctgaaaaaggttggaagtagtgttgaagaaacacttttcattgaaaaggcagatccagtaatggaaaaatgggtcggtaaaacagtttctaacgaagaagcagagaaaatttcaggtataaagaaagttatatatttagatagctttgaaaagacaatgtcaaatatactttttacagaaaatgcgaagcatctatatttagatatagaacgtcgtgattggaatggtacggagacaaaaacattagcatttgctaaacatgtaagagaaaaatacccacacgtaacaattggtaatgtatatccgaacatttgtgaattacgagtatttaaaacagaggaagaaattgaaattattaaagaagcgattgctataacgaaagacggtatttacaacgtacttaagcatgcaaaagcaggcatgatggagtatgaattagaagcacaatttgattttacactgaagtcatctggaattaagtaccatgcgttcaatacaattttggcgagtgggaaaaatgctacagttcttcattatgaagataatgatgcacaaattcaaaatggtgacttagtattactagatttaggtgctcaaaaagactactataacgctgatattagttatacattcccagcaaatggaacattctctagtcgccaaaaacaaatttataatattgtattaaaagcattaaaagaaacaacagagattattaagccaggattaaagttcgctgcattaaatgagcatacaaaaaaggtactggcagaagagtgtaaagcaattggtttaattcaagaagatgaagagttatcaaaatactattatcatggtgtcagccatttccttggtttagatacacatgatgtaggaacatataaagatagagtgttagaagaaggtatggttataacaattgaacctggtctttatattgaaggagaatcaattggaattcgtattgaagatgacattcttgtaacgaaagacgggtatgaaaacttgtcaaaagatatcattagggaagttgaagaaattgaagaatttatgagt

SEQ ID NO: 40114 - DNA, 711 bp, Bacillus thuringiensis
atgaaaaagtatgcgttagtaactggagggagcggagggattggctctgctatttcgaaacaattaattcaagatggatatacagtttatgttcattacaataacagtgaagaaaaggtattggaattgcagaaggcatggggagaagttatccctgttcaagctaatttagcttctagtgatggagcagaacgattgtggggacaaattgaacatcctatcgatgttattgtatacgcagctgggaagagtatttttggactagtaacagatgtaacaaacgatgaattggattatatggtagaacttcaagtgaagaacgtatataaattactttctatggcacttccgcctatgatcgggagaagaagtggtaatattgtaattgtttcatctatatggggacaaataggggcttcttgtgaagtactttattcaatggtaaaaggggcgcaaaattcatatgtgaaagctttagcgaaagaagtttctttaagtggattacgtgtgaatgcagtagcaccaggagcaattgaaacggaaatgttaagtgttttttctgaagaagataaaatgggaattgctgaagatataccattaggtagaataggattaccagaagaagtagcgaaaacagtttcatttctcgtatcaccaggagcgtcttacataactggacaaattatcggagtgaatggcggttggcactgc

SEQ ID NO: 40115 - DNA, 567 bp, Bacillus thuringiensis
atggcaaaagttaatttagaacaaattgaacatgcagtacgccttattttagaggcgattggggatgacccaaatcgtgagggagtacttgatacaccaaagcgtgttgcaaaaatgtacgcagaagtgttctcaggtatgcatgaagatccgaaagagcatttgcataaagtattcggagaagatcacgaagagcttgtactagtaaaagatataccattttattcgatgtgtgagcatcatttagttccattctatggagttgctcacgttgcatatattccgcaaggtggaaaggtgacagggttaagtaaattagctcgtaccgtagatacaattgcacgtcgcccacaactgcaagaacgtattacatcaacagtagcgaactctattatggaagtactagagcctcatggtgtaatggtagtagtagaagcagaacatatgtgtatgacgatgcgtggtgtaaaaaaaccaggtgcgaaaacagtaacgacagcagtgcgtggtgtgcttgaaaatgatgctgcagcgcgcagtgaaattttatcgtttattaaaacgaag

SEQ ID NO: 40116 - DNA, 1614 bp, Bacillus thuringiensis
gtgaataaacaagagttagatgtgatcgtaattggtggagtcattactggttctggtattgcattagatggagcatctcgcgggttatcaacaattgtgtttgaaatgcaggactttgcagcaggtacatcaagtcgttcaacgaaacttgtacacggtggtctacgttatttaaaacaacttgaagtgaaaatggtagcagaagtaggtaaagagcgtgcgatcgtatatgagaacggtccccatgtaacaacaccagagtggatgttacttccattccatacaggcggtacgtttggatcatttagtacatcaattggtcttcgtgtatacgacttcttagcaggtgtaaaacgaagcgagcgcagaaaaatgtttaaccgtgaagaaacgctgaagaaagagcctcttgtaaaaaaagaaggattaaaaggcggcggttactacgtagaatatcgtacagacgatgcgcgtcttacaattgaagtaatgaaagaagcaattgaacgcggtgcaaaagctgttaactacgcaaaagtagatggtttcttatataaagatggaaaagtatgtggtgtacgtgtaatcgatttactagacggtgaagtatatgaagtttacggtaagaaaattgtaaacgcagcaggtccttgggtagatacacttcgtgaaaaagataactcgaaaaaaggaaaagtacttcagttatcaaaaggtgttcacttagtaattgatcaaaaacgtttcccattaggccaagcgatttacttcgatacaccagataaacgtatggtattcgcgattcctcgcggcggaaaaacttatgtaggtacaacagatacgttctacgataaagacgcagctgtaccacaaatgacaacagaagatcgcacatacatcattaatgcgattaactacatgttcccaagcgtaaaaattacggaaaaagacatcgagtcaagctgggctggtgtacgtccgttaatttacgaagaaggtaagagtgcatctgaaatttctcgtaaagacgaaatttggacttctgaatctggtttaattacaatcgcaggtggtaaattaacaggataccgtaaaatggctgaaatggtagtagactacgtaacgaacttactacaaaaagaaggtcatagcgcatatccgaagagcgacacgaaacatatgccaatctctggtggacatgtagatggttcacacggattcccagcatttgttgcgaaaaaagctggcgaaggtacgaaatatggtttaacaacagcacaagcagaagaattcgcgaaattctacggctctaacgttgacgtactatttgacttagcgaaaaaacataaagacgaagcgaaagaatacaacatgccgcttgacgttctaatccctcttgtatacgcaatggattacgaaatgacagcaaaaccagttgacttcttcgtacgccgcagaggcactgtattcttcaatatccactgggtatacgagtggaaagaagcagtaatcaactacatggctgcgaaactaggctggagcaaagaagagcaaatgaaatacacagcagaattagaaaaagcattaacagatgctgtaattcctgtagatcaa

SEQ ID NO: 40117 - DNA, 1482 bp, Bacillus thuringiensis
atgttaaagacaaatattgagctgaaaccaaaagtggaagcgtttttaaatgaagaaattaaaatgtttattaatggcgaatttgtttctgctattggcggaaagacgtttgaaacgtacaatccagcaacagaagaggttctagcagtcgtatgtgaagcgcaagaagaggatattgatgctgcagtaaaagcggcaagatctgcatttgaatctggcccgtgggcagaaatggctactgctgaaagagcgcatcttatttataaattagcagatttaattgaagaacatagagaagaattagcgcaactagaagctttagataatggaaagccatatcaagtagcacttgatgatgatatttcagcgactgtagaaaattatcgttattacgcaggatgggctacaaaaattattgggcaaacaatcccgatttcaaaagattacttgaattatacgagacatgaacctgttggtgttgtaggacaaattattccgtggaattttccgcttgttatgtcttcttggaaaatgggagctgcactggcgacaggttgtacgattgtattaaagccagcagagcaaacgcctttatctttactatatacagcgaaactctttaaagaggctggatttccaaacggcgttgtaaactttgtatcaggctttggtcctgaagcaggggctgcaattgtaaatcatcatgacattgataaagttgcttttacaggatctactgttacaggaaagtatattatgcgtcaatctgcagaaatgattaagcatgtaacgttagagcttggcggaaaatcaccaaatatcattttagaagatgcggacttggaagaagcgataaatggtgcattccaaggtattatgtataatcacggtcaaaattgtagcgcaggatcacgtgtatttgttcatcgtaaacattatgaaactgtagtagatgcacttgtgaaaatggcgaacaacgtaaaacttggagcaggtatggagaaaggaacggaaatgggtccactcgtatctaagaaacaacaagagcgtgtgttaaattacattgagcaagggaagaaagaaggtgctacagttgcggctggtggcgaacgtgcgcttgaaaaaggttatttcgttaagccaactatattcacagatgttacagacgatatgacaatcgttaaggaagaaatatttggaccagttgttgtcgtacttccatttgattcgacagaagaagtaattgaacgagcgaacaactcatcctatggccttgctgcgggtgtatggacgcaaaatatcaaaacgggtcatcaagtagcaaataaattaaaagcaggaacagtgtggattaatgattataacttagaaaatgcagctacaccatttggtggatataaacaatctggtattggccgcgaattaggttcatatgcgcttgataattatacagaagtgaaaagtgtttgggtaaatataaag

SEQ ID NO: 40118 - DNA, 882 bp, Bacillus thuringiensis
acacaacaacaaagggaacaacattttgaactattgaattcaacacaaattgttattagtgaagcgttagaaaaattgggttatccaaacgaagtatatgaattattaaaagaaccaattcgtatgatgacagtgaaaataccagttcgtatggatgacgggactgttaaaatatttacaggatatcgtgcacaacataatgatgctgttggtccaacgaaaggtgggattcgcttccatccgaatgtaacagaaaatgaagtgaaagcactttcaatctggatgagtttaaaatgtggtattgttgatttaccatatggtggaggtaagggtggaattatttgtgatccacgtgaaatgtcattccgtgagttagaaagattaagtcgcggttatgtacgagcaattagtcaaatcgtaggaccgacgaaagatattccagctccagatgtattcacaaactctcaaattatggcatggatgatggatgagtatagccgtattgatgaatttaattcaccaggatttattacaggtaaaccgcttgtattaggtggatcacatggacgtgaaacagcaacagcgaaaggtgtaacaatttgtattcgcgaagctgcgaaaaaacgtggcattgatattaagggtgcacgcgttgttgttcaaggattcggtaatgctggtagcttcttagctaaatttatgcatgatgcaggtgcgaaagttattgcaatctcagatgcttacggcgcgttacatgatccaaatggattagatattgattatttattagaccgtcgtgatagcttcggtacagtaacaaagctatttaacaatacaatttcaaacaaagaattgttagaacttgattgcgatattttagtt

SEQ ID NO: 40119 - DNA, 879 bp, Bacillus thuringiensis
caaccactcgcacatcgaatgcgccctacaaatattcaagaaattattgggcaacaacatttagttggtgaaggaaagattttatggcgaatggtccaagccaatcattttcaatctatgattttatacggtcctccaggtacaggaaaaacatccattgccagtgcaattgctggaagtaccggtaccccgtttcgtctattgaatgctgttactcacaataaaaaagatatggaagttgtcgtacaagaagcgaagatgcatcgacacctcgttttaattttagatgaagttcaccgtctagataaagcaaagcaagactttctattacctcacttagaaagcggacttcttactttaattggtgcaacgacaagtaatccattccatgcaataaactccgctattcgaagcaggtgtcaaattttcgaattacacgcactaacagaagatgatattttaattgggttaaaaagagctttagaagataaagaaaaaggccttggagaatatgctgtaacggtaacagatgaagcactacatcactttgcaaacgcctctggtggtgatatgcgttccgcttataacgcacttgagcttgctgtattatctagctttactacagacgatcaagcggctgaaatcacactcgagattgcagaagaatgcttacaaaagaagagcttcgttcacgacaaaggcggcgatgctcattatgacgtattatcagcatttcaaaaatcagtgcgcggaagtgatgtaaatgcagcgctccattatttagcacgccttattgaagcaggtgatttacaaagtattggcagacgcccttttattatggcttatgaagatattggacttgctagcccacaagctggg

SEQ ID NO: 40120 - DNA, 1056 bp, Bacillus thuringiensis
tttatttctatcggacttggtgcggccggccttggagatccgaaccaacttggaagaatcggtttaaaatcaatttcattctttctcgtaacaactgcggttgccatctctatagcggttacatttgcacttattataaaaccaggagctggcggtaattttaaaacagaaggtcttaagtatgaaggtgcaaaaactgaaacatctttcgttgacacattgctaaatatcgtaccagataacccagcaaaagcgatggctgacggaaacatgttacaaatcattgcctttgccgtattgattggactcggtatagctattttaggaaaacgagttcaaggtatccattcattacttgaacagggcaacgaattaatgatgtatcttgttaatctcgttatgaaattagccccaattggaacattcggtttgctcgcttcatccgttggtaaaatggggcttgcaggcgtcgctgcgatgttcaagtatatgattgtcgttatgttagtactcattattcacggggtctttgtatatggtggcttattaaagatattagcaaaagaaagtattgttcgtttctttaaacatttcgggccagtaatggcaattggatttagtacatctagctctaatgcatcgcttccatttgcaatgaaaacagcacaagataagcttggcgttccaaaagcgataagctcatttgtacaaccactaggggcaactattaatatggatggtactgccattatgcaaggagtagccactgtatttatcgctcaagtatacggagttgaacttacattaccgcaattagctatggtcgtattaactgctgtactcgctagtatcggtactgctggtgtacctggtgttggacttgtaatgcttacaatggttttaaatcaagtaaatctaccagtagaaggtatcgctttaattatcggtattgaccgtattctagatatgtctagaacagctgtaaacatttctggcgatgcaatttgcgcaatgattgtcgcaaaatcagaagaaaaatataatacggatcaatcg

SEQ ID NO: 40121 - DNA, 960 bp, Bacillus thuringiensis
attatgactcgtgtggcaattaatggatttggacgtattgggagaatggtatttcgtcaagcaataaaagaaagcgcattcgaaattgtagcaatcaatgcaagctatccatctgaaacgttagcacacttaattaaatatgatacagttcatggcaagtttgacggaacagtagaagcatttgaagatcacttattagttgatgggaaaatgattcgccttttaaacaaccgcgatccaaaggaattgccttggacagatttaggtgttgaagttgtaattgaagcaactggtaaatttaattcaaaagaaaaagcaattcttcacgttgaagctggagcgaaaaaagtaattttaacagcgcctggtaaaaatgaagatgtaacaattgtagttggtgtgaacgaagaccaattagatattacaaaacatactgttatttcaaatgcatcttgtacaacaaactgtttagcgcctgttgtgaaggtgttagatgagcagtttggaattgaaaacggtttaatgacgacagttcacgcctatacaaatgaccaaaaaaatattgataacccacataaagatttaagaagagcacgtgcttgcggacaatcaatcattccgacaacgacaggtgctgcgaaagcgctagcaaaagttcttccacatttaaacggaaaacttcatggtatggcacttcgtgtaccaacaccaaacgtgtctcttgttgatttagtagtagatgtaaaacgcgatgtgacagttgaagccattaacgatgcattcaaaactgttgcaaacggtgcgttaaaaggtattgtagaattcagcgaagagcctttagtatctatcgactttaatacaaatacacactcagctattattgatggtttatctacaatggtaatgggtgatcgtaaagtgaaagtacttgcttggtatgataacgagtggggctactca

SEQ ID NO: 40122 - DNA, 828 bp, Bacillus thuringiensis
gaaatgcctctaattcttggtaatgacttttccggtgtcatcgtgaaggttggatcgcaagtaactcgttttaaagtcggcgatgcaatatatgcacgtccaagaaaaaataagatcggtactttcgcggaatatatagccattcatgaggatgatatagctttaaaaccaaaaaatttaagttttgaggaagcggcgtcgattccactcgttggcttaacatcctatcaagcactacatgatattatgcatttacaaaaaggacaaaaaatattaattcacgctgggtctggtggtgttggtactttcgcaattcagttagcaaaaataatgggcgctaccgttacaacaactgctagtgaagctggttctgatttagtaaagtctcttggcgcagatcaaattattaattacaaaacagaaaaatttgaagaaatactcaaaaattatgatgcagtatttgatacaatcggcggaacaacacttgaaaaatcattcaatattataaaaagcggaggaaacattgtttccgtttcaggtatgccgaatgctcgcttcggtaaagaatttggttcaggcttctttaaaactctcttattttcattagccagcaaaaaacttactgcacttgaaaaaaagcataatgctcaatattcatttttatttatgaagccaagcggggatcaattacgtactattgcaaactatattgaagccggaaaaatcaaaccggtaatcgatcgagttttcccttttgaagatgctcaaaaagcaatggaatattcagagtctggaagagcaaaaggaaaaataattgcaaaaattaat

SEQ ID NO: 40123 - DNA, 579 bp, Bacillus thuringiensis
gtactagggttacttggacgaaatggtgcagggaaaacaacaacaatcaaaatgcttctcggattattaacgcctaatgaaggttcgattacatgggatggaaaagcatttggaaatagtggtgtaacaattgggtatttaccagaagaaagaggtttatatacaaaaagtagagtaatagatcagctgcgatattttggtagattagaaggaatgtcgaagaaagaagtggatcacgctattgatcactggttagagcgtttagcgataccagaatataaatttaaaacggctggagagctttcaaaagggaatcagcaaaaaatccaattaattgctgctcttcttcataatccggaacttctcattttagatgaaccattcagcggccttgatccagttaatgctgggatgttagctagtattattgaagaacaagtacagagcggaaagacgattattttatcaagtcatcgtatggaacaagtagaggctttttgccaacatgtatgtattttgaaaaaaggtgaagcagtcgtaaaaggacagctaagtgatattaagaaagaatacggtttc

SEQ ID NO: 40124 - DNA, 798 bp, Bacillus thuringiensis
catacggattttaaagagaatatgacgtatggggaatatttacaattagatagtttactatcttctcaaaaaagattatcagaccatcatgatgaaatgttatttatcgttattcaccaagcaagtgagctttggatgaagctcattttacatgagctaaatgcggcgattgaatctattaaacaagataaattacaaccagcttttaaaatgttagcacgtgtatcaaaaattcagtctcaaattattcaatcttgggatattcttgcgacattaacaccatcagaatatattgagtttcgtgattcactcggtcaagcttcaggttttcaatcgtatcaatatcgtatgattgagtatgcacttggctataaaacgccacatgcattaaaaatttatgaaaaggatccagaattacatgcacgacttcataaagcgctacatgcaccaagtctatatgatgtcgcgattcaagcattagtaaaagaaggattccctattcataaagatgtgttaaaccgtgatattacgcagccttatgaagaagatgcaacagtagaagcagcatggttagaagtgtatgcggatgtgaaaaaatattggaatttatatcagcttgctgaaaaattgattgatattgaagactggctacaacaatggcgtttccgtcatatgaaaacagtagaaagaattattggacataaaatgggtacaggtggatcctccggtgtttcttatttaaagcgagtacttgatcaacaattcttcccagagctttggaatgttcgtacgaaatta

SEQ ID NO: 40125 - DNA, 1365 bp, Bacillus thuringiensis
ttagttgtaattggaggcggaccagctggatatgtagcggcaattaccgcggctcaaaatggaaaagaggtcactcttattgatgaagctgaccttggcggaacgtgtttaaatgttgggtgtatgccgacgaaatcattgttagaaagtgcagaagtgcatgacattgtgagaaaagcgaatgattatggggttacgcttaatacaggaagtatatcaattgattgggatcaaatacaggcaaggaaatcacaaatcgtaatgcaactcgtccaaggaatacaatatttaatgaagaaaaataaaattaaagttgtaaaaggaaaagcgaaattcgaaacggatcatcgtgtgcgagttgtacaaggaaataaagaagaagtagtggatggagagaggtttattatcgcagctggttccgaacctacagaattaccattcgctccgtttgatggaaaatggattttaaatagtagccatgcgatgtctcttgagagtgtaccatcttcattgttaatcgttggcggtggtgtaataggatgcgagtttgcaagtatttatagtcgccttgggacaaaagttacgattgttgaaatggcaccgcaattattaccaggtgaagatgaagatatcgcacatattttaagagagaaattagaaagtgatggcgtagaaatatttacaggagctgctttaaaaggattaaataattataagaagcaagcttcatttgaatatgaaggtagtatccaagaagctaacccggaatatgttctcatttctgtcggccgaaaaccacgtgtacaacaattagatttagaaaaagcaggggttcagttttcaaataaagggattgctgtgaacgaacatatgcaaacgaacgtatcacatatttacgcagctggtgatgtgatcggtggaattcagcttgctcacgttgccttccatgaaggaacgacagcagcattacacgcgagtggagaagatgtaaaagtaaactaccatgctgtacctcgctgtatttatacagctccagaaattgctagtgtcggtttaacagaaaaagatgcaagagagcagtacggtgacatacaaattggagaatttccttttacagcaaccgaaaaagcgcttattattggcgaactaatgggtaaagtaaaagtcattgtggaacctaaataccaagaaattgtagggatttgtattattggtcctcatgccactgatctgattggacaaggaactgtaatgattcatacagaagttaccgctgatataatgagagattatattgcagcacatccaactttatctgaggcgattcatgaagcgttaatgcaagcagtaggacatgctgtacat

SEQ ID NO: 40126 - DNA, 1854 bp, Bacillus thuringiensis
atgtcagatttcctcgtaatcgtggagtcgccttgtaaggcgaagaccattgagaaatatttagggaaaaaatacaaagttgtcgcgtctatgggacatgttcgcgatttgccaaaaagtcaaatggggatagaagtaaagaacaacttcaccccgaagtatattaccattcgtggtaaaggtcccgtcttaaaagatttaaaatcagcggccaaaaaagcaaagaaagtctatctcgcggccgatccagaccgtgaaggggaagcgattgcttggcatttagcgaatacgttaaatgtggacgttgaatcagattgtcgggttgtgtttaatgagattacgaaagatgcgatcaaagaatcatttaaacatcctcgtgcaattaatatggatttagtggatgcacaacaagcaagacgtatacttgatcgtcttgttggttacaatattagtcctttattatggaagaaagtaaaaaaaggattaagtgcaggacgtgtacaatctgtagcagttcgtttaatcatcgagcgtgaaagggaaattcaaaactttgaacctgaagaattctggacaattaaaacagaatttgtaaaaggaaaaagacacatttgtagccaagctttttccggtgtagatggtgaaaaagttcaattaacaaatgaaacgcaagtgaatgaaataattgaacagatgaaagacaatgcgttttcagttgaaaatgtaacgcgcaaagagcgaaaacgtaaccctgcattaccgtttacaacatcttccttgcaacaagaagcagcccgtaagttaaacatgcgagcaaagaaaacaatgatgcttgcacagcaattgtatgaagggatagatcttggaaaacaaggaactgtaggtcttattacgtatatgagaactgattcaacacgtatctcagaaacagctcaaacagaggctcgtacttacatcactgaagcgtatggtacggaatacataggaacagaaaagaagaaagaaacgaaaaagtcaaatgcacaagatgcgcatgaggcaattcgtcctacttcggtaatgagaaagccagaggaactaaaaagtttcttaggtcgtgatcaacttcgattatataaattgatttgggagcgatttgttgcaagtcaaatggcgtctgctataatggatactgtgacagcgagactcattaataacaatgttcagttccgtgcaagtggatcggttgtaaagttcccgggatttatgaaagtgtatgtagagtcaaaagatgatggtgctgaagaaaaggataagatgttgccgcctttagaagtaggggaaactgtattttcaaaggatttagaaccaaagcaacattttacacaacctcctccgcgctatacagaggctcgcctagtaagaacacttgaagaacttggaattggaagaccgtcgacatatgtacctacacttgaaacgattcaaaagcgtgggtatgtaggcttggataataaacgcttcgttccgactgaacttggtgaaatagtaattgaacttattttagagtttttcccagaaattattaacattgaatttactgccaatatggagcaaagccttgatgaagtagaagaaggaaatgcgaattgggtaaaaattgttgatgatttctacgtaggttttgaaccgcgtttagaaaaagcggaaaaagaaatgcgtgaagtggaaattaaagatgaaccagctggggaagattgtgaattatgtaatcacccaatggtctttaaaatgggtaaatacgggaaatttatggcttgctcgaatttcccagattggcgtaatacaaagtcgattgtgaaagaaatcggtgtt

SEQ ID NO: 40127 - DNA, 868 bp, Bacillus thuringiensis
agttctcaaaatcctaatttaatgggatgggttgtcgcagatagtaaaaagcacaaggtcatttgattctgctactgatgaagatttagatattgcgtattctcttcttcttgctcataagcagtggggatctaatggaacagttaattatttgaaagaagcacaagacatgattacaaaaggtattaaagctagtaatgttacaaataataaccgactaaatttaggagattgggattctaaaagttcacttgatacgagaccatctgattggatgatgtcacaccttagagcattttatgaatttacaggtgataaaacttggcttactgttattaataatttgtacgatgtttatacgcaatttagtaatacatactctccaaatacaggacttatttcagatttcgttgtaaaaaacccaccacaacccgcacctaaagacttcttagatgagtcagaatatacaaatgcatattattacaatgctagtcgggtaccattgagaattgtaatggactatgcgatgtacggcgagaaaagaagtaaagtcatttctgataaagtttcttcgtggattcaaaataaaacgaatggaaatccttctaaaattgtggatggttatcaattaaatggatctaatattggtagttattcaactgctgtatttgtttcaccgtttattgctgcaagtataacaagtagcaataatcaaaagtgggtaaatagcggttgggattggatgaagaataagagagaaagttattttagtgatagttataatttattaactatgttatttattacaggaaattggtggaaacctgtacctgatgatacaaaaatacaaaatcaaataaatgatgca

SEQ ID NO: 40128 - DNA, 1344 bp, Bacillus thuringiensis
atgataaaaaaagtattaatagccaatcgtggggaaattgctgtacgaattattcgtgcttgtaaagaaatggatattgaaacagttgcaatttattcagaagcagataaagagtcacttcacgtacagattgcagacgaggcgtattgtgtaggaccaacgatttcgaaagaaagctatttaaatttgacgaacattattagcgttgcgaagttaacaggctgcgatgctattcatccgggatacggatttttagcagagaatgcagatttcgcagaattatgccgtgaatgtaacttgatttttatcggtccaagtccagaagctatttcaaagatgggcacaaaagacgttgctcgtgatacaatgaaagaagcaggggttccgattgtaccaggttcacaagggattattaaaaataccgaagaagcgatcgagcttgctaatcaaattggatatccagttattattaaagcgactgcaggtggcggcggaaaaggtattcgtgttgcacgccatgaagaagagcttataaaaggaattcaaattacacagcaagaagctagtaccgcttttgggaaccctggtgtatacttagaaaagtacgttgaagatttccgccatgttgagattcaaataatggcagatacacacggaaatgccattcatttaggagagcgtgattgtacaattcagcgccgtttgcaaaaactactagaagaaagtccatcacctgcacttgatgaagatattcgcaagcagatgggtgaagcggcagttaaagcggcggtagcggttgattatacaggtgctggtacggttgagtttatttatgaatataaaacgaaaaccttttatttcatggagatgaatacgagaattcaggttgagcatccggttactgaaatggtaacgggaatggacttaattaaagagcaaattcttgttgcttcaggagaaaagttatcgttacagcaagaagaagtacaatttaatggttgggcaattgaatgtcgaattaatgcggaaaaccctgccaaaaaatttatgccatctccaggtaaagtagaaatgtacttaccaccaggaggatttggtattcgcgtcgattcagctgtatatccgggatattcaatcccacctttctatgattcgatggttgctaaattaattgttcacggaaaaacacgtgaagaggcaattgcaaaaatgaagcgcgcacttagtgaatttgtcattgaaggcgtacatacaacaatcccgttccatttgcaattgctagatcatcctgattttgtaaaaggtgagtttaatacgaaatttttggaagagcatgaacttgtg

SEQ ID NO: 40129 - DNA, 948 bp, Bacillus thuringiensis
atgtcaacaattattgatgtttatgctcgcgaagtccttgactctcgtggtaacccaactgtagaagtagaagtttacacagaaagcggcgctttcggacgcgctatcgtaccaagtggtgcatctactggtgagcacgaagcagtagaattacgtgacggtgacaaatctcgttaccttggtaaaggtgttgttaacgcagtaaacaacgttaacgaaattatcgctccagaaatcgctggtttcgatgtaactgaccaagctggtatcgaccgtgctatgatcgaattagatggcactccaaacaaaggtaaactaggcgctaacgctatccttggtgtatctatggcagtagctcacgcagcagctgacttggtaggtcttacattataccggtaccttggtggattcaatgcaaaacaattaccaactccaatgatgaacattatcaacggtggatctcacgctgataacaacgttgacttccaagagttcatgatcttaccagttggtgctccaacattcaaagaatcaatccgtatgggtgctgaagtattccatgcacttaaagctgtattacatgacaaaggtcttaacactgcagtaggtgacgaaggtggattcgctccaaaccttggttctaaccgtgaagctttagaagtaatcatcgaagctatcgaaaaagctggttacaaagctggcgagaacgtattcttaggaatggacgttgcttcttctgagttctacaacaaagaaactggtaaatatgaccttgcaggcgaaggccgtactggcttaacttctgcagaaatggttgatttctatgaagagctttgcaaagacttcccaatcatctctatcgaagatggtttagacgaaaacgactgggatggtcacaaattattaactgagcgtatcggtgataaagtacaattagttggtgacgat

SEQ ID NO: 40130 - DNA, 1053 bp, Bacillus thuringiensis
acagcgttaattcatcacggttatacatctgaggaacataaaggaagtttaacaccacctttatttcaaacttctacatttacatttgagactgcgcagcaaggagaggcgagttttgcgggagtggatccatcttatatttactcacggcttggaaatccaactgtgaaattatttgaagaacgtatggcggtgttagaaggaggagaagaggcacttgccttcggatctggtatggcagctatttcagcgactttaatcggttttttaaaggctggagatcatattatttgttcaaatggattatacggatgcacgtacggttttttagaagtgttagaagaaaaatttatgattacgcattcgttttgtgatatggagacagaggttgatattgaaaataaaattcgcccaaatacaaagcttattttcgttgaaacaccaattaatccgacaatgaaattaattgatttaaaacaagtgattcgggttgcgaagcgaaaaggcttacttgttattgttgataatacgttttgttcaccttatttacaaaggccgcttgagcttggctgtgacgctgttgtgcatagtgcgacaaaatatattggtggtcacggtgacgttgtagcaggtgtaacaatttgtaaaacgaaagcattagctgaaaagattcgcccgatgcgaaaggatatcggcggtattatggcgccgtttgatgcgtggttattattacgtgggttaaagacgttagcagtaagaatggatcgtcattgtgataatgcagaaaaaattgtatcgttcttaagaaaacatgatgcggtagaaggtgtttggtatccagaaggggagttagcatctcgtcaaatgaaacgcgggggcggtgttatttctttttcagtaaaaggcggaaaagaagagacgcaagcgtttattaatgatcttcactttattacaattgcggtgagtttaggagatacagaaacgttaattcagcatccagcaacgatgacgcacgctgcgattccagcggaactaagaaaagaaatgggcatt

SEQ ID NO: 40131 - DNA, 477 bp, Bacillus thuringiensis
tatgcatacgtaccagaacatccaacatactatgattacttgacgctctgggaacatattgaattattaatggcagctcgtggaagtgaaatgggaagttgggaagaacgagcggaacaattattacatacttttcgaatgaataagcataaacatgagtatttatcaaaattttcaaaaggcatgaaacaaaaatcgatgctaatattggcgtttttaactgagccagatttttatatcattgacgaaccttttatcggtttagatccggtagctacgaaagagtttttaaattatttatataaagaaaaagagcgcggggcaggaattttattttgtacgcacgtattagatactgctgaaaaaatttgtgaaagatttttactcatttcacaaggtacattagtcgcagatggacatttagaatctattcaaatattagcggaaatgccgggtagttcattattagactgcttt

SEQ ID NO: 40132 - DNA, 1440 bp, Bacillus thuringiensis
gtaatcgggattgatatcggtaccacaagtacaaaaacggttgtgttcacagaaaaaggaaaagtcattgcatcacatgcaatcgattacccaattattcaaccgaatgtaggatgggctgagcaagatcctgatgtaatatgtgccgctgtatacaaaagtgtaagcgttgccattgaaaaaggtaatgtattaccagaagatatttcttcaatcggtattagtacagctatgcacgcattaattgcagtagatgaaaatggtgcgccattaacgcgttctatcatttgggcagataatcgaagtacgaagcaatcagaaaaattattacaacaaatgaatgggcatgaaatttatagacgtacaggtacaccgattcatccgatgtcaccactttctaaattgttatggatgaaagaagaggaaccagagttatatacaagtgcctataaattcattccatttaaagagtatgtgatttaccaattattttcacgctacgtagttgattattcgattgcttctgctacggggttatttaatttagaaacattaaactgggataaagatgttttaactatgttacatatgtcaccagaaaaattatcaacccctgtaccaactacatatattttatcaggtatgaagccagaattagcacagaagatggggataagtgcagaaacaccaattgtcatcggagcaagtgatggggttcttgcaaatgtaggagttggtgcgatatcaccgggtgcggctgcaattacgattggaacgagtggtgcggttcgaacaatctcatcaaatataaatacagatgagaaagggagaacgttttgttacgcattaacagatgagcactgggtaatcggtggtccaacgaataacggcggaatattactgagatggttacgtgatgaatttggtagtccagagcaagaagtagcaagaaagctcggcattgatccttatgatttattaattaaatatgcagaaagcgtaccagctggagcggatgggctattgttcttacctttcttatctggagaacgcgcaccttactggaatgcaaatgctcgtggtacattctttggaatcaatcttcaacataagcgagaacattttatacgtgcagtgatggaaggtgtttgtatgagtgtatattcagtagcactcgcaatcagggattgtacagggccacttactgaaatacgagtttcaggagggtttgcaaaatctgcattttggagacaaatgttgtccgatatgatgggaaaagaattgcttgtacctgaaagtcatgaagcatctgcgcttggggcagcggcagttgctttgtatgctgtaggaaaaattgattctcttgaagaggtaaaggattggattgataatgtccatcatcatgtaccgaataaagaaaatacggctatatattatcgc

SEQ ID NO: 40133 - DNA, 966 bp, Bacillus thuringiensis
tctattatggaaatgagtcatcgatcttcttattttcaaagtattatagaggaagcgagtaacttacttcgtgaattaatgagcattcctgatgagtatgatgttttatttttacaaggcggtgcgtcattacaattttctatgataccactgaacttaatgaatacgtataaaaaagctggatacgtactaactggctcatggtctaaaaaggcactgcaagaagccgaaaaagttggggaagtacaagtgattgcttcttccgagcaagagaagtttactacgattcctaaactggacggtttactaagcgatgaaaaactagattatgtacatattacaacgaataatacaattgaggggacaaaatatgtggatattccacatatagaaagagtgccgctcgttgcggatatgtcttcaaatattttgtcagaacaatatgatgtttcgaagtttggtcttatatacgcgggagcacaaaaaaatttaggaccagcgggcttaacgattgctattataaaaagagatttaattgggggagcagatcgctcttgtccgacaatgttaaattatgaaacttacagtaaaaataactccttatataatacaccgccatcctttagtatttacgtaacaaaacttgtactagagtggttgaaagagcaaggcggagtatctgcgattgaagaacaaaatagaatgaaatcttcacttatttatcattttttagatgaatctaaattgtttacttcaccagttgatcctgcgtatcgatcacttatgaacattccatttacaacaccgtcagaagaacttaacaatgagtttttacaaaaagcgaaggaacgcggccttgttacgttaaaaggacatcgctcagttggcggtatgcgtgccagtatttacaatgcgatgccagcacacggcgtaaaacgattagtagattatatgaaggaatttgag

SEQ ID NO: 40134 - DNA, 1191 bp, Bacillus thuringiensis
gagaagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgacgttcaagaagaatttgcaaacgaatatgcattgatggcgatgcaagcacacacattatacgaaggaaaataccctcttgtctctgcattatctcgtccgcttattgcgaagaaattagtagaaatcgcagaacaagaaggcgcaactgcagttgcacacggatgtacaggaaaaggaaatgaccaagttcgttttgaagtttctatccaagcattaaatccttacttagaagtgattgcgcctgtacgtgaatggaaatggtcacgtgaagaagaaattgcatatgcaaaagaaaacgatgtaccaattccgattaatttagatagcccgttttcaatcgatcaaaacttatggggacgcagcaacgaatgtggaattttagaagatccatgggcagcgccgccagaagatgcatatgagatgacattagcgttagaagatacaccgaataaaccagagtttgtagaaatcggatttgaagcgggcgtaccgactactttaaatggcactgcatattcacttgcagaattaattaaaacgttaaatgcgcttgctggaaaacacggcgttggacgtattgatcacgtagaaaatcgtcttgtcggtattaaatctcgtgaagtatacgaatgcccagcagcaatgacgttaatcactgcgcataaagagttggaagatttaacacacgtaaaagaagtagcgcattttaaaccagtgattgaacagaaaataacagaacttatttataacggtttatggttctcacctttaaaacaagcgcttcatgcatttttacaagaaacgcaaaagaatgtaacaggtacagtgcgtgtgaaattatttaaaggtcatgcgattgtagaaggacgtaaatctgaatactctttatacgatgaaaaattagcaacatatactgcccaggacgaatttaatcatgatgcagcagttggattcatttcattatttggtttaccgacgaaagtatacagccaagtgaatcaaaagaag

SEQ ID NO: 40135 - DNA, 891 bp, Bacillus thuringiensis
gtgagcaaactttggggcggacgttttactgaagaagcggaagcgtgggttgaagagtttggagcatccatctctttcgatcaacaattagtaaatcaagatataaacgggagtattgcacacgtaacgatgctagcaaagcaaggcatcgttacgaaagaagaagcagagaaaataaaggtaggtcttcaatatttattgaaagaagcaaaagagaataagctacaatttttagtagaagcagaggatattcatttaaacatcgaaaaaatgttaattgaacaaattggcgaagtaggaggaaaacttcacactggccgaagtcgtaatgatcaagtagcgacagatatgcatttgtatttaaaagaaaaggtagaacatattataaaagctacaaaacaattgcaaactgttcttgttcatcaagcagaaaataatattgaaacgattatgcctggctatacgcatttgcaacgtgctcagccgatttcatttgctcatcatattctcgcttacttttggatgttagagcgtgatgtaaatcgttatgaagattcgttaaagcgtattaatatctccccattaggagcaggagcgctagctgggacgacattcccgattgaccgagaatatagtgcggagcttcttggatttaatggaatatatgaaaatagtttagatgcagtaagcgatcgtgatttcatcttggagtttttaagtaactcatctatgcttatgatgcacttatcgcgcttttgtgaagaacttattttatggagtagccaagagtttcaatttattgaaatgagcgatcaatacgcaactggaagcagcattatgccgcacaagaaaaacctcgatatggcggaactaatccgtggtaaaacaggc

SEQ ID NO: 40136 - DNA, 1134 bp, Bacillus thuringiensis
atggaatttactctaactcgcgaaaaacaaatgattaaagaaatggtacgtgactttgctgaaaaggaaatcgcaccgaaagctgtatattatgacaaaactgcagagtttccatatgaaacatttcaaaaaatgggcgaactaggattattaggcatcccattcccagaagagtatggaggttcaggtggcgatactgtatcgtatgcgttagcagttgaagaaattggtcgcgcttgtggtggcactggtttaagctatgctgcaacaatttcattaggtgcttctccaatttattatttcggtacagaagaacaaaaacaaaagtatttagttccaatggcgtcaggtaaaacattaggtgccttcggattaacggagccgaatgctggatcagatgcaggtggtactcaaacgaaagcggtactagatggcgatgagtatgtaatcagtggtgagaagtgttggattacaaacgcagagtatgcaaataccattattgtaaccgctgtcaacggtgttgaagagaatggtagaaaacgcatttcagcatttatcgtacctactactagtgaaggattaacgatttctagtccttacgataaaatgggcgttcgcgcttctaatacttgtgaaatcgtacttgatggtgttcgtgtaccgaaagaaaatattcttggtgatgtaaataaaggttttaaacaatttttatatacacttgatggaggacgtatttcaatcgcagcattggcagttggtattgcgcaatcagcctttgaacgtgcattgcaatatgcgaaagaacgtcaacaatttggaaagtcaatctctaatttccaagcgattcaatttaaattagctgatatggcgactgaagtagagctagcacgcaatttagtacataaagcagcttggttaaaagataatgataaacctttcggcaaagaagcggcaatggcaaaactatttgcatcggaagcagcaagccgtattgcgaatcaagcagtacagattcatggtggatatggttatatgcgtgaatatgaagttgaacgacatattcgtgatgcgaaactattagaaattggtgaaggaacttctgaaattcaacgtctcgtaattgctagacattta

SEQ ID NO: 40137 - DNA, 537 bp, Bacillus thuringiensis
atgaaggaaaatacgaagaaagaattattctcatgggctaaaacgatagggtttacccttgtattaattgctattattcgcggtgttttatttacaccttctttagtacaaggtgaatcgatgatgcccactttagaaaataacgaacgagttctcgtgaataagattggttatagtataagtggattagatcgctttgatattatcgtcttccacggaaaagaaggttacgatttagtaaaacgagtaattggtttgccaggcgatacagttgagtataaaaatgatgttttatatgtaaacggaaaagcgatggaagaaccatatttaaaacagtttaaagaaaaagcagtaggccgtgtattaactccagactttacgttagaacaaatcacagggaaaacgaaagtgccagaaggccaagtatttgttttaggggataatcgtgaagtttctaaggatggtcgcatgtttggctttatttcagaagatgaaattgttggaaaaggacaagctgttttctggccgttgaaacaa

SEQ ID NO: 40138 - DNA, 1443 bp, Bacillus thuringiensis
gaaattaaacgagtaaaaaatcacattaacggtgagtgggttgaatcgacaggtacggaagtagaagcagttccaaatccagcgactggaaaaattatcgcttacgttccactatctccaaaagaagatgttgaaaaagctgttgaagcggcaaaagcagcattcgaaacatggtctaaagtaccagttccaaatcgttcaagaaatttatataaatatttacagctattacaagaaaataaagatgagcttgcaaaaatcattacgctagaaaatggtaagacgctaacggatgcaacaggtgaagtgcaacgtggtattgaagcggtagaacttgcaacatctacgccaaatttaatgatgggtcaagcacttccgaatatcgctagcggaattgatggatcgatttggcgctacccaatcggagttgttgctggtattacgccatttaacttcccgatgatgattccgttatggatgttcccacttgcaattgcttgcggtaatacattcgtattaaaaacatctgaaagaacgccacttttagcggagcgacttgtagaattattctatgaagcaagtttcccaaaaggcgtattaaatttagtacaaggcggaaaagatgttgttaatagcattttagaaaataaagatattcaggctgtttcgttcgttggctctgagccggtagctcgttacgtatatgaaacaggtacgaaacacggaaaacgtgtacaagcgttagcaggtgcgaaaaaccatgcgattgtaatgccagattgcaatcttgagaaaacagtacaaggtgtaattggatctgcatttgcaagtagtggagagcgctgcatggcatgctcagtagtagcagtagtggatgaaattgctgatgaattcattgatgtattagtagcagaaacgaaaaaattaaaagtaggcgatggctttaacgaagagaactatgttggaccattaatccgtgaatctcataaagagcgcgttttaggctacattaatagcggtgtagcagatggggcaactttattagtagatggccgtaaaattaatgaagaagttggagaaggttactttgtaggtgcgacaatctttgatggcgtgaatcaagaaatgaaaatttggcaagatgagatttttgctccagtattaagcattgtacgagttaaagatttagaagaaggtattaaactaacaaatcaatctaaatttgcaaatggtgcagttatttatacatcaaacggtaaacatgcacaaacgttccgtgataatatcgatgctggtatgatcggtgtaaacgtaaatgttccagcaccaatggcattcttcgcatttgcaggaaataaagcgtcattctttggtgatttaggtacaaatggcacagatggcgttcaattctatacacgtaaaaaagttgtaactgagcgctgg

SEQ ID NO: 40139 - DNA, 1513 bp, Bacillus thuringiensis
attcaaacaagtaacttaggttatccacgtatcggactacaacgagagtggaaaaaaacattggaagctttttggtccaataaaatcgatgaagaacaatttttaacaacaatgaaagaaattcgccttcaacacgtaaaagtacagcaagaaaaagggattgaactcattccaattggcgactttacatattatgatcacgttttggatactgcctatatgctaggatttattccatcacgtttttctgagtttacatcttaccttgatgtatatttcgcaatggcgcgtggctctaaagatcacgtagcttccgaaatgacaaaatggtttaacacaaactatcactatatcgttcctgaatatgaagagggattacaaatctctttaaaagataatcgcccacttcgcttatacgaagaggcaaaacaagaattaggagtagatggaaagcctgttattttaggaccatatactttcttaaaattagctaaaggctatacacaagaacaatttcctaacattttaaaacagttagttgcaccttatgtacaactgctttcagaactacatgcagctggggcacaagccattcaagttgatgaaccgattttcgcttctttaactaaaaaagaagttcaacaagcaaaagaaatttatgaagctattcgtaaagaagttccaaatgcgactcttcttttacaaacatattttgatagcgtagaagaaaactatgaagaaattattacattcccggtatccggtattggattagatttcattcatggtaaagaaggtaatctaaatgctatttcaaaatatggattcccagctgataaaactttagctgtcggttgtatagatggccgtaacatttggagagctgaccttgatgaagttcttgagttatttacaacgttacaaaaacaagtccaaacgaaagatatcatcgttcagccttcttgtagcttattgcatacaccaatcgataaaacagaagaaactcacttatcgactgagctgtttgatgcgttagcatttgcaaatcaaaaattagaagagttagttcttattcattccgctctcactcaaggtacagaaagcattagtaatgagctggaaacatatcgaaacgtacatcatacaattcgttcatctgctgcacgtaaccgagaagatgtcaaagcagcacgaacagcactaaaagaagaagatttttcacgttctcttccatttgaaaaacgatacgaattacaacaagttgctctagagttaccgctattaccaacaacgactattggtagcttcccgcaaacaactgaagttcgtcaaacgcgaaaagaatggcgtaacggtgttatttcaaatgaccaatatgaacaatttattgaaaaagagacagaaaaatggattcgttaccaagaagaaattgggcttgatgtacttgtacatggtgaatttgaaagaactgacatggtcgaatatttttggtgagcgccttgctggtttctca

SEQ ID NO: 40140 - DNA, 1224 bp, Bacillus thuringiensis
ttgattaaaaaatatacttgtaaaaatggtgtaagaatagttatggagaatataccaactgtaagatcggttgcgattggtatttggatccatgcgggatcaagaaatgaaaatgaaaaaaataacgggatttctcactttttagagcatatgttctttaaagggacagaaacacgtagtgcacgcgaaattgcagaatcatttgatagtattggtgggcaagtgaatgcttttacttcaaaagagtacacttgttactatgcaaaagtgctagatgaacatgctaaatatgctttagatgtattagctgacatgttctttaattcaacatttgatgaagaagaattgaaaaaagagaagaatgtcgtatgtgaagaaattaaaatgtacgaagatgctccagacgatattgtgcatgatatgttaacgaaagcaacatatgaaacgcatccgcttggatatcctattttaggaacagaagaaacacttgatacgtttacaggtgatacgctacgccaatatattaaggatcattatacacctgaaaatgtagttgtttcagttgcaggaaatattgatgaagccttcttacaaacggtagagcaatatttcggtagttatgaaggaacaacaaatcgcgaacaagtacatagtccaattttccattttaacaaagtagcacgtaaaaaggaaacagaacaagctcatttatgtttaggatataaaggcttacaaatgggacacgaagatatttataacttaattgtattaaataacgttttaggcggtagtatgagtagccgtttattccaagaagtacgtgagcaacgtgggttagcttactcagtattttcttaccattcttcttatgaagatacaggtatgttaacactgtatggtggaacaggtagtcaacaattagatacactgtatgaaacaatgcaagaaacattagaaacattgaaaaatacaggtattacagaaaaagagcttattaatagtaaagagcaattaaaaggaaacttaatgttaagtttagaaagtacgaatagtcgtatgagccgtaatggtaaaaatgaattgctacttcgtaagcatcgttcacttgatgagattatcgaaagtgtaaacactgtaacaaaagaaaatgtagatgggttaattcgtaacatgtttacagatgaattctctgcagcattaattagtccagatggaaaacttcca

SEQ ID NO: 40141 - DNA, 1410 bp, Bacillus thuringiensis
atgaaaaagcatttatatataaatggagattggaaatctgtaaacacgtataaaccattatatgcaccatattctgaagaaacattagcggaaattgcacaaggcacggaagaagatgtaaaagaggctgttaccgctgcaaaaaatgcaatgacaaaaatgaatacattatctgcatatgatcgtgcgactattttagagaaagttgcacaaaaaatggatgaaagaagagaagaatttgcagagattattgcaaaagaagctgcaaaaccaatacgtgctgcaaggggagaagtagatcgtactgttcaaacatacaaatttgcagctgaagaagcgaagcgtatatatggtgagacattgccattagacgccgcacctggtgcagatgggcgtattgcatatacaatccgaaagccgattggggttataggggctattacaccatttaatttcccattaaatttagtagcgcataaagttggaccagcaatcgctgccggaaatacagttgtattaaagccagctgatcaaacgccattatcatcttatgcattagttgagttatttgaagaggcaggattgccaaatggagctttaaatatcatttctggtcctggctccacggttggtgaggcaatcgtcaaaaatgattacgttgcttctattacttttaccggaagtccaaaagttggaatcggaataaaacaaaaggctgggctaaaacgagttacgttagaactaggctcaaatgctgctgttatcattgatgaagatgtagagttaacagatgaaataattgaacgtgtaaaatggggagcatttgttaataatggacaagtttgtatttcagtacaacgtgtttttgtacatgaaacgaaaatgcatgaatttctttcgaagctaaagaaagcgatggaatcagttgttgttggtgatccactgcttgaggaaacggatgtatcagctttaatttcaaaaagagatgtagagcgaattgatatgtgggttcaagaagcaattaaggaaggagcaactgttttatgcggtggtaagaagcgggatgcacgaatttttgaaccgactgtattaaaaaatgttccaaatcatgtatctgtgcagtgccaagaagtattcggtccactcatgacagtaaatacatttaaagaatttgatgaagcgattgagcaagtaaataattcgcgttacggcttacaggcaggagtatttacaaataatttatttaaagcaatgcgtgcaattgatgagctagaggttggtggtgtcatgattaatgatattccaacgttcagagtagatcatatgccttatggtggcgtgaaagaaagtggcacggggcgtgaaggaattaaatatgcaatagaagaaatgacagaaatgaaattagta

SEQ ID NO: 40142 - DNA, 789 bp, Bacillus thuringiensis
attaaagtaattatcgccggaccaagaggacgtatgggacatgaagcagttcttcttatggaaagaacggaacattttaatttagtagcagcagtggattataagcatggtggtgagaagatttctgatttacctggcatgccagcattacatgcaccgatttacgctgatttacatacttgtttagatgaagtagaagcagatgtgttgttagatttaacaacaccagaagtggggaaacaacacgttacacttgcagttgagcgtggacttcgttcggttattggtacaactggatttacagaagaagaattggcacgtttaacagagaatgcaaaagaaaaagcagtaggaacaattattgctccaaactttgcaattggtgcagttcttatgatgaaattctcacaaatggcagcgaaatatttccaagatgttgaggtaattgaattacatcatgatcaaaaattagacgcaccatctggtacagctgtaaaaacggtagagttaattcgtcaaaatcgtgaatcaaagcagcaaggtcatccaaaagaagtagagcaactagcaggtgcacgtggtgcaaatgtagacggtattcacattcatagtgtacgtttgccagggcttattgcacaccaagaagtaatgttcggtggagatggacaaatgttaacagttcgtcatgattcattcaatcgtgcatcatttatgtcaggtgtaaaactatcaattgagacagtaatgaaccttgatcatcttgtgtacggtttagaaaatattatcgac

SEQ ID NO: 40143 - DNA, 969 bp, Bacillus thuringiensis
cagcaaagtacaggagatcgattagctgaaattaagcaacataaacaagagttagatgcgaaattacagcaacaaaaagaaaacgtggatcaaacattaaacgaacttaacaaagttaaggaaaatgttgatacgaaggtgaatgaactacatgaacgtaaacaagttgctgatgaaaaaattaacgaagttaaacagcataaacaagaactagatgcaaaactgcagcaggacatacaaattgccgaagataaaatcgctgaaattaaagagcataaaaaacaagtagaagataaagttgctgaagtaaaagaacataagcaaaatatcgataacaaagtgaatgagattaaagaacataaacaaactgtcgatgaaaaagtgaatgaaatgaagcaacataaagagaacattgatcaaaaggttaatgaacttaaggaagttaaaaaacaagtagatgaaaaattagctgagttaaaaaaagcgaaacaaactgctgaggacaaactcgctgaactaaaagaaaacaagccgaataccggtaacacgttagaggaacttaagaaaattaaaggcaatttagacagtctttccgctaacttagaattagctaaacaagatgtaaaaaacaaactagctgttttacaagaagctagacaagatttaattaataaaattaacgaaattaaacaatcgaaacaaactgtttcagatgatttatcaaagaaaaaacaagacttagatattaaaatcaacgactttaagcatactgagaaaaaaattgacgacaaattagctgagttacatacaacgaagcaaaatgttgacaacaagattaatgaagtatcacagtctaaacaaacgcaagcagataatggtactaaaaacaataacgctaaagaacttcctaacgctggtagcgagcaatcaaacaatatggctctaggaatgctatctgtattaggcggt

SEQ ID NO: 40144 - DNA, 1656 bp, Bacillus thuringiensis
atgaataagacatggtggaaagaagcggttgcttatcaaatttatccacgaagctttatggattcaaatggtgatggtattggagatttacaaggtattattgcaaaactggattatttaaaagatttaggtatagatgtaatttggatttgtccaatgtataagtcgcctaatgatgataatggttatgatattagtgattatcaagatattatggatgagtttggtacaatggcagactttgatgctttactagatgaagttcataagcgtgatatgaagcttattattgatttagttattaatcatacgagtgatgaacatccatggtttattgaatcacgttcatctaaagataatccgaagcgtgattggtatatttggcatgatggtaaagatggtgcggagccaaacaactgggaaagtatttttaatggttcggcatgggaatatgatgaagaaacagaacaatattatttacatctattctcacgtaaacaaccagatttaaactgggagaataaagaagttcgcgaagtactatatgatacggttaattggtggcttgataaaggtattgatggtttccgcgttgatgcgatcagtcatattaaaaaagaagaaggcctcaaggatatgccaaatccaaaagagttaaaatatgtgccatcgttttgataaacatatgaatgtgaaaggtattcaacctttattagaagagctaaaagaaaatacattctctaagtacgatattatgactgttggtgaagcaaatggtgttaagattgaagatgctgagctttgggttggagaagagcaaggtaagttcaatatggtattccagtttgaacatttaagtttatgggatgcagagaagaagaaagaccttgatgttgtaggattgaaaaaagtattaacgaaatggcaaaaaggattggaaaataaaggatggaacgctttatatattgagaatcatgataaaccacgtatcgtttcaacatggggagatgacaaacaatattggcgtgaaagtgcaacagctctaggagcgatgtatttctttatgcacggtacaccgtttatttatcaaggacaagaaattggtatgacaaatgttcagttgccaaatattgaagattacgatgatgtagcaattaaaaatttatatcgcgagaaaattgcagagggcgtaccacatcaagatatgatggagattatatgggcttcttgccgcgataattcccgtacacctatgcagtggaatgatgagatgaatgctggtttcacaacgagtacaccttggtttagcatgaatccaaattacaaagaaattaatgttgagaagcaaaaaaatgaagaaaagtctattttcaatttctataagaaaatgattgctctgaaaaaagagcacgatgtactgaactatggtacgtacgatttacttttagaagaagatccacaaatttatgcatatacacgtacgttacaggatgaaaaagtcattgtaattagtaatatctcaaaagaggaagctgtgtataatgagggttcatttgcactaaaacgcaaacgtttgcttttaaataactatgaagttgccgaacatgaagaagtaacaacaattgctaaaaaaccttatgaaacaagggtttatcg

SEQ ID NO: 40145 - DNA, 1149 bp, Bacillus thuringiensis
tttcgtatgccaaagtcggtattatatggaaggaattcgcttgaaaaactgggagaacaatcaaaaaagttagggaaaagagcttttatagttactgatacaattatggagaaattaggatatgttgaaaagtgtatgcaacaactaaataagaaaggtattattgttagtacatataataaagtggatgctgagcctacaaatatacacgtattagaagcgttatctctttgtaaagaggaaaagtgcgattttattatcggtattggtggtggaagttgtattgatgctgcgaaagcggtagcggttttatatacaaatggtggagaagttgaggattatgtccaaaaggatattgaaatagaaaacaatccactaccacttattgcaattccaacaacttctggtactggttcggaagttacaagtgtagcagtaattacgaataaaaaaacagatgtaaaaatgatgatgaagcatcctagttttataccgaaagtagcaattatagatccagttttgacaagttcgttaccaccacaaattacggcagcaacaggaatagatgcgttatgtcatgcgattgaagcttatatttctaaattttcacaaccacttacagatgtacttgctctttcagctattgaaagtattatgaaatatttacgtatagcatatgaagatggacataatatggaggcaagagaagcgatgatgattgcttccttacaagctggaattgcattttcgaatgcatcagttacattagttcatggaatgtcaaggccagtgggagcattatttcatgtaccgcatggaatatcaaatgccatactattacctacagtgttagagtttacaaaaacaagtgcagtgaaaaggttagcaaaaattggacgtaacttaaataaggatttgtattcgaattctgatgaggaagtagcagactacacgattggggaaataaaaaagctttgctatgatcttcgtattccaaatttaaaagaatacggtatcgatgaaattgaatttgaaaatgctatctctaaaatggcatcagatgcaattgaaagtggtagcccagctaataacccacgtgttccatcatatgatgaaatcaaagagttgtatcgagagtgttttaattat

SEQ ID NO: 40146 - DNA, 1470 bp, Bacillus thuringiensis
atgattacgttaacaggacatacattgacagttgaagaaatgaagaggttattactggaaggagaaggtgtaacagcttgtccaactagtatgcaaaaggtagcggagtgccgcgaagtagttgagaaaattgtagaggacggaaaagtcgtttacggaattacaactggatttggaaagtttagtgatgtgcttatccaaaaagatgatgtaaaggcacttcaacataatttaattcagtcacatgcatgtgggattggtgatccattcccggaagaagtatcgcgtggaatgttaattttacgagcgaacacgatgcttaaaggagtatctggtgttaggccgcttgttgtaaatatgcttcttgagtttgtaaaccgtaaaattcatccagtcgttccgcaacaaggttcacttggtgcaagtggcgatttagcacctttatctcatcttgcgctcgtattattaggcgaaggtgaagtgttctataaggggaaacgcgttcatgcaatggttgctcttacagaagaagggcttgagccaattgaacttgaagcaaaagaaggtcttgcgttaattaatggtacgcaggcgatgacagcacaaggagttctttcttatatagaagcagaagcaacggcgtatcaagctgaactaattgcttcgatgacaattgaagggttacaaggcattattgatgcatttgatgaaaatgttcataaagcacgtggttataaagagcaagtggaagtagcgagcagaattcgtgacattcttcatgatagtaaattaacaacaaaacaaggagaactacgtgtacaggatgcctattcacttcgctgtatcccgcaagtacacggtgcttcttggcaagttttaaattatgtgaaagaaaaattagaaattgaaatgaatgcagcaacagataatccgcttatctttgatggtggggaaaaagtaatttcgggcgggaatttccatggtcaaccgattgcgtttgcgatggacttcttaaaagtaggaatggcagaacttgcaaatatttcggagcgccgtattgagcgtttagtgaatccgcaattaaatgatttaccaccatttttaagtccagaaccaggacttcagtctggtgcaatgattatgcaatatgctgcagcgtcactagtttctgaaaataaaacgttggcacatccggcgagtgtagattcaattccgtcttctgctaaccaagaagatcatgtaagtatgggaacaattgcttcacgccatgcacatcagattattcaaaatgcaagacgtgttctttctattgagatgatttgtgcgatgcaagcagcagaatatcgcggaattgaaaacatgagtacagtgacgaagagcttctaccatcaaggtcgtcagcaggtgccatctattaaaaatgaccgtatattctcaacagatattgaaaatattgcgcattggttaaaa

SEQ ID NO: 40147 - DNA, 921 bp, Bacillus thuringiensis
cgcacattaggtaaaactggaataactgtttctgaaataggttttggcgcatgggcaatcggtggtgatgaatggggacctgttaacgataaacaatctataaccgctataaaaaaagcaattgagtgtggtgtgaattttattgatactgcggatgtgtatggtttaggacatagtgaaaagttggtagctaccgcgattaaaggacatcgtaatgatattatcctatcaacgaaaggtggtttaatcggacatcactacgaccctaatggagttcctgtatatgatactcccgaaaaaatcatcgccgtattcgaaacaagtttacaacgtcttcaaacagattatattgatctttatttttgtcatatttggtggcataatcgtagagaaacagaagcatttctacgtgcatttgacatattaaaacgtgatggcaaagtaagagcagtcggtgtttcgactcatgatttacaatacattcatcatttcaataacaacaacgaaattgatatcgtacaacttgattacaatatattaaatcgaaaaccagaaaaagatatattaccattcttacaagagaaaaatctaggagctgttattcgtggtccattaaaaatgggcattttaactggaaaattcacaaataaaacaatttttccagatggagatttacgcaaagattggccaaatgaaatttggtttcaagaagacttacaaaccgtagagaaacttcggctgctctcaaataaaaatcagatcctagggcaacttgcacttcgctatgtactctctcatccggcagtaagtgttgtaattcctggtgcaaaaacaggaacacaagcacaagaaaatgcaaatgcatctgttcgccctattttgagtgatgaagagcttaactatattcattcaatataaaaa

SEQ ID NO: 40148 - DNA, 972 bp, Bacillus thuringiensis
aatttagctaaattcccgagaaaaaaatatacagaatcatatacaccaattgaaaagttaaacaacttttctgaagcacttggtggcccgactatttattttaaacgagatgatttacttggtttaacagctggtggcaataagacgagaaaattagaatttttagttgcagatgcacaggaaaatggtgcagatacgttaattacagctggtggtattcagtcaaatcattgccgcctgacacttgctgctgcggtaaaagaaaaaatgaaatgtatccttgtattagaggaagggcttgagccagaagagaagagagactttaacgggaactatttcttatatcacttattaggtgctgaaaatgtaattgttgtaccgaacggagcagatcttatggaagaaatgcataaagtagcaaaagaagtaagtgaaaaagggaatacaccatatgtaattccagttggtggatcaaaccctacgggtgctatgggatacgttgcttgtgcccaagaaattatggcgcaatcatttgagcaaggaattgatttcagttcagttgtttgtgtaagtggaagcggcggtatgcatgccggtttaattactggtttttctggaacgcaaagccagattcctgtaatcggaattaacgtaagtagaggaaaagctgagcaagaagagaaagtagcaaaacttgtagatgaaacttcagcacacgttggtattccaaactttatcccgcgcgacgctgttacgtgctttgatgaatatgtagggccaggatatgcgttaccaacgccggaaatggtagaggcagttcagttacttgcgaaaacagaaggtattttacttgatccagtgtatacaggtaaggcggtagcgggattaatcgatttaattagaaaaggtaaatttaataaggaagacaatattttattcgtacattcaggtggttcaccagctttatatgcg

SEQ ID NO: 40149 - DNA, 822 bp, Bacillus thuringiensis
gcgatacgtgaatcaggaattccaagagaagatatatttataacaacaaaagtatggaacgacgatcaaggatatgaggagacactcgaggcgtttgaaaagagtttgaaaaaattacaaatggactatgtagatttatatttaatacattggccggtaagagggaagtatgttgatacgtaccgagctttggagaaattgtatgaagaaggtaaagtgcgcgcgattggtgtttctaattttcataaacatcatttagaactattattaccaaattgcaaagtgaagccgatggtaaaccaagtggaacttcatccgatgttgacgcaatttgagttgcgcaattattgtcaagatgagcaaattcaaatggaagcatggagtccgttaatgaggggcggagaagtattccagcatccaatcattcaggctattgctaacaaatatgaaaaaacacctgcacaagttatattaaggtgggatattcaaatcggaattgttacaattcctaaatctgttacaccatctcgtattgaagaaaactttactatttttgattttgcactaactgaagaagagatacgtcaaattaacacgttgaatcgtgatttacatgtaggaacgaatcctgataaatatgatacgttataaaaaagactgtctcctaatactggagacagtcttctgtttatcggtaattcgatatttttaacgatgcaaagcatatgtgtcatatttaacaatcttttgaagttgtatatattcttctttcgttaaaggtaactgttggctagctcgtatattttcctgtaattgttgaag

SEQ ID NO: 40150 - DNA, 691 bp, Bacillus thuringiensis
tatttagaggatgtactactcttagctatggaaaaaggcttttattctattaatataaataccgaaaaactgacacatatttttgaccctgaaccacatttaatagaaaatcgtttcaatgatggaaaatgtgatccagctggtcgtttctgggcaggttctacagatacatacggtatgaatactgcaggttccttgtattgtttacatcataatttaagtgtagagaaaaaagtttcacatgtaaatacatcaaatggaattgcttggtcacctgatcatacatacttttactttatagatacacctactaaaaaagtggttcgctatcaatataatatacgtactggagacattcataatccaattgatgtaatcattttctctgaaaatgatggtctacctgatggtatgacaattgacgaagacggctgtttatggattgcacattggggaggttcaaaaataactagatggaatccctctactggagaaaaaatattaagcattccaattccagctttatatgtaacatcatgtacatttggaggacctaatttaacagatttatatatcacaacagccagaacaagaatgactgatgacgaattaaaagagtatccacatgctggtggtatttttcgaattcaaacaaatgttaaaggctgtcccacctattcattttgcaata

SEQ ID NO: 40151 - DNA, 762 bp, Bacillus thuringiensis
gtgaaagaaaaggtagttattataacaggtggatcgagtggaatgggaaaaggaatggcgactcgttttgcaaaagaaggggcacgagttgttattacaggacgtacaaaggaaaaactagaggaaacaaagttggaaattgaacaatttccagggcaagtattacctgtacaaatggatgtaagaaatacggatgacattcagaaaatgattgaacagattgatgagaagtttggtagaattgatgttttaataaataatgcagctggaaactttatttgtccagcagaagatttatctgtgaatggctggaattcagtcattaatattgtattaaacggtacattttactgtagccatgctgtcggaaaatattggattgaaaaaggtataaaagggaatatcattaacatggtagcaacatatgcatgggatgctggtccaggagttattcattcggctgcagcgaaggcaggagtattagcgatgacgaagacgctcgctgttgagtggggacgtaaatatggaatacgagttaacgctatcgcgccaggaccaattgaacgtacgggcggtgctgataaattatggatttcagaagaaatggctaaacggacgatacaaagtgttccgcttggaaggctgggtacgccagaagaaatcgctggtctagcttattatttatgttcagatgaagctgcgtacataaatggaacttgcatgacaatggatggaggacaacatttacatcaatatccattt

SEQ ID NO: 40152 - DNA, 1215 bp, Bacillus thuringiensis
cgtctcatgtacaagttagctgatttaatggaagaacataaagaagagctcgcacagctcgaaacattagataacggaaagccaatccgtgaaacaatggcagcagacatcccacttgcaattgagcatatgcgctattacgctggctgggctacgaaaatcgttggtcaaacaattcctgtttccggtgattactttaactatacacgccatgaagctgttggtgtcgttggtcaaattattccttggaacttcccgcttcttatggcaatgtggaaaatgggagcagcgcttgctacaggatgtacaatcgttttaaaacctgcagaacaaactccactatctgctctatacttagctgaattaattgaagaagctggattcccgaaaggtgttattaatatcgtacctggattcggtgaatcagctggacaagctctcgttaatcatccactcgttgataaaattgcatttaccggttctactcctgtcggtaaacaaattatgcgacaagcatccgaatcattaaaacgcgttacacttgagttaggcggtaaatcaccaaatatcatcttgccggatgctgatttatctcgcgcgattcctggtgcactttctggtgttatgtttaaccaaggacaagtatgctctgctggatcacgcttatttgttccgaagaaaatgtatgataatgtcatggctgatctcgtcctctattctaaaaaactaaatcaaggtgtcggtcttaaccctgaaacaacaattggtcctctcgtttctgaagaacaacaaaaacgtgtaatgggctacattgaaaaagggattgaagaaggcgctgaagtactttgcggaggaagtaatccattcgatcaaggctacttcgtttctcctacagtattcgctgacgtaaatgatgaaatgacgatcgcaaaagaagaaattttcggtccagttatttctgcaataccatttaacgatattgatgaagtaattgaacgtgcaaataaatcacaattcggcttagcggctggtgtatggacagaaaatgttaaaacagcacactatgttgcaagcaaagtacgtgcaggtacagtgtgggtaaactgttataacgtttttgatgcagcatctccatttggaggatttaaacaatctggtcttggccgtgaaatgggatcttatgcattaaataactatacagaagtaaagagcgtt

SEQ ID NO: 40153 - DNA, 723 bp, Bacillus thuringiensis
ttaaatgggaaaacagctgttgtaacaggagctgcacagggaattggaaaagagattgcaagggtttatgcaaagctaggggcgaaagtattaattagcgatgtaaatgaagagacgctacaaaaaacgacacgtgagttatcagatgaaggatatgaagtgtgctcatatcgatgtgatgtgagtaatcaaaatgaagcaaagtcgttaattgaatatgcggttcaaaaatttggtacattacatattttggtgaataatgctggaattacaagagacgcaatgttacataaaatggagaaatctgcttgggaacaagtattacaagtgaatttaactggagttttttattgtatgcaaccagcgcttctttatatgagacaacaaggatatggaagaattattaatatttcttctataagtagagaggggaatattggacaggcaaattatgctgcaacgaaagctggagttgtaggattaacgaaaacagcagcgaaagaagttggaagtttcggtattacttgtaatgcgatttgtccggggtttatggatacagatatgaccaaaacgataccagataaagtgaaagaaaagatggttggcgctattccagttggtagaattggaacgccagaagatattgcgaacgcagcagcctttttagcatcagaatacgcatcttatattacaggtgaagtattaaatgtgagcggaggactg

SEQ ID NO: 40154 - DNA, 1099 bp, Bacillus thuringiensis
atgaaaagacaacttatcttagaagatggaacagtattaattggaacaggtttcggaggcgaaatcgaaaagtcaggtgaggttgtatttacaacaggaatgactggatatcaagaaacattatctgatccatcatattgcggtcaaatcgtaacattcacgtacccattaatcggaaactacggcattaaccgtgacgattttgaatccattcacccatctgtaaatggtttaatcgtaaacgaaatttgtgatcatccatcaaacttccgtaatgaaatttcgttaaatgattacttgaaagaaagaaatatcccaggattagcagggattgatacgagaaaattaacgagaaaaattcgtcaatacggtacattacgcggacgcctttgtaatatggatgcagatgtagagtacattgtaagtcaattaaaagcgacagtatttacagatcatgtaaaacgcgtatcaacgaaagatccatacccaagcccaggtcgtggtcaccgagttgtactagtagacttcggtatgaaacatggtattttacgagaattaaataagcgtgactgtgatgtaattgtagttccttacaacacaacagcagaagaaattttacgccttagcccagatggaattatgttaagtaatggacctggagatccgaaagatgtatcagaagcaattgaaatgttaaaagacattatcggtaaagttcctttattcggaatttgcctaggacatcaattgttcgctctagcatcaggtgcaaatacaagtaagttgaaatttggtcaccgtggtttaaaccatccagtaaaaaatcttgcaactggaaaagtagcaattacatctcaaaatcacggatacgcagtagaagaagaatcagttgaaaatacagatcttgaaattacacatgttgctttaaacgatggaacggtagaaggtcttcgtcataagaagttcccagcatttacagtacaataccatccagaagcttcagcgggaccagaagatgcaaatgatttattcgaagattttcttaacaatgattgaaaacttcaagaaagaaggggaagagttatgccaaaacgcctag

SEQ ID NO: 40155 - DNA, 294 bp, Bacillus thuringiensis
ggacaaaaacaacgtgtatcaattgcaagggctcttgtgagaaaaccaccgattctcatattagatgattctacatcagcagttgatgcaaaatcagaggctactattcaaacagctttaaaaacaaaatataaaggcacaacgacattattaatcgcgtccaaaatttcttccataatggatgcggataaaatacttgtattagataatggtgaattagttggcaatggtacacatgaacaattgttagaacgaagtgaggtttatcaggaaatttatctttcccaaggtggt

SEQ ID NO: 40156 - DNA, 1701 bp, Bacillus thuringiensis
cggatatggaactatatgggctatcaaaaagctgctctaatgtttgttatatttctagtcgttgttactactttacttggattattaggtccctattttatgggagtcattatagatcaatatattgtaccgaaagatttaagtggtacagcaagaatgtgtatgttacttatcgcgatttacggtgtaactgtacttttaacatggttacaaacatttgtcatgattaacgttgcattaaaaacaattcaaaaaatacgacaagatatttttgagaaaatccaaacgctttctttacggttctttgatgtgcgttctcaaggtgatttaatgagccgtgtgacaaatgatatagataatttgaaccaagctttgacacaaagtgttgtacaaattatttcatcagcgctaacttttataggtgtaacgattgcgatgttcgccttaaattggattttagcaattgtaactttaattacagtacctattatgttttacgttacaaaaaaactagttgcatatagtggtaaaaactttgcgaagcgtcaaaaagatttaggtgaattaaatggatttattgaggaagcaattacaggtgcggatgttacgacgttgtatggaaaagaaaaagaaactgtacaaaatttcaataaaattaatgaacagctaagagtttcagctacgaaggctgatacattttcagcttttatttttccaagtatgaactttattaataacttaggtatggggcttgtcattgggactggatcagttatggtcttaaacggaatgacaacagtgggtgttattgcggcttttattaattattctcgtcaattctcaagaccgttaagtcaatttgcgactttaatgaatacaattcaagcggcagttgctggtggagaacgtgtttttgagattatggatgaggtaccagaaattcaaaataaaaaagacgcatttgttgtacaaaatttacaagggcatgttgcacttgagaatgtttcatttggctatgcagagaataaaacgattttaaaagaagtgagtcttaaagcgcagccaggagagacaattgctttagttggcccgactggatcagggaaaacaacaatcattaatttgttaactcgcttttacgatatacagcaaggacaaattcatattgatggaaaagatataaaagattatgatattaattctttacgaagtaaaataggagtagttttacaggatacgtatttatttgctggttcgattatggataatatccgttatggacgcttagatgctactgatgaagaagttatcactgcagctaaggcagcatctgcacattcttttattaagcatttgccaaatcaatatgaaacagaaattgcttcagaaggatcgaatttaagtcaaggacaaaaacaacttcttgcgattgcacgagcaattttagcagatgcagatatattaattctcgatgaagcgacatctaatattgacacaagaacagaattacaaatacaagcaggactaaataatttaatgagaggtcgcacaagttttgtaatcgctcaccgacttaaaacaattgaaaaagcagatcaaatccttgttataaaggatggaagaattttagaaagagggaatcatgagtctcttatggaagatagagggttttattttgatctgtatacgagtcagtttaaa

SEQ ID NO: 40157 - DNA, 750 bp, Bacillus thuringiensis
aagaaaatagcaattgtaacaggggcaactcgtctgaatggaattggtgcagctgtatgcaaggtgcttgctcaaaaggggatagacatttttttcacgtactggccaaagtatgataaagcgatgccatggggaatgagtgatcaagaaccctttttgctgaaaaaggaaattgaaagttacgatgttcgatgtgaaatggcagaaatcaatttatcgcagtcttattcgccaaatcgtttgttttatatggtatcagaacggttaggtgatccatctattctagttaataatgcagtgtattctaatcatacgaggattgaggaattagatgtagagcagttggatgaacattatacagttaatgttcgggctactatgctattaagttcaatgtttataaaacattattcacttaaaacgggcgggagtattattaatcttacttcaggacagtcagtaggcccaatgccagatgaactagcatatgcagcaacgaaaggggcaattgaagcatttacaaagtcagtagcaccagttgcaatggagaaggggattacagtgaatgctgtagatccaggaccgacgaatacaggatggattacagaggagctgaagcatcatttagtatggaaattcccgcaaggtaaagtaggagaaccggtggatgctgcgcgcttaatttcttttttagtaagtgaagaagcgaaatgggttactgggcaagtcattcactcgaatggtggttat

SEQ ID NO: 40158 - DNA, 786 bp, Bacillus thuringiensis
gcacttcgaaatgtaaatattgaggtgaagcaaggagagatattcggattccttggaccgagtggatctggtaagacgacaacagtaaaaattttaacttctcaattgcttcatagtgttggaacggtaagagtattagggaaagatattacaggaccaagtagcatcgattacaaacgaattggtattttaacagataacagcggcttatatgaaagacttagcatttatgataacttactattattttgtgacttatacgattgcaaaaaagaacgaatcgatgaagtactagcacaagtgaatttattagatgataaaaaaacaccagtaaaaaaattatcaaagggaatgaagcaacgcgtcacactagcaagagcaatccttcataaaccagatatcctcttcttagacgaaccaacatctgcacttgatccagtaaacgtacaaaacattcataaaatcttaaaagacttaaataaagaaggaacgacgattttcttaacgactcacaacatggacgaagcagaaacgctttgtaaccgcattgccttcctgtgtggcggagagattgtagcacttgatacaccggagaaccttcgcttacaatacgcgaaagatcaaatacaagtcgtgttaaaggataagaagaaagaaacggtacaaaaagatgaattaggtgcaaaacgtatttcagaatggatgaacaaaggagaattactatccattcattcacacgaaccaactttaggcgatatctttattgaagttactgggaggggatta

SEQ ID NO: 40159 - DNA, 819 bp, Bacillus thuringiensis
cttcggatagaaaatatatcatttcaatatcctggggcagccacttatgcattaaaagatgtttcattttccttatatgagggagaatgggtatctattattggacaaaacggttcaggaaagtctacacttgcaaaattattgaatggtttgtttttgccagaagcagggactattacagtaaatgatacaatggttttatcagaggaaacggtatgggatgttcgaaaacaaattggaatggtatttcaaaatccagataatcaatttgttggaacaacagtgcaagatgatgttgtatttggcttagagaatatcggaatgccaagagaacaaatgattgaaagattagaacaggccttgcgacttgtccgtatggaagattttcttaatgatgagcctcattccttatctggtgggcaaaagcagcgagtggcaatagcaggcgttttagcacttcaaccatctattttaatattagatgaagcaacgtcaatgctagaccctcaagggagacgtgaagtagtagaaacggttagacaacttgttactcaaaaaggtattaccgtgttatcgattacgcacgatttagaagaagcggcacagtcagatcgtgtcattattttaaataagggagaaatattagaggaagggactccagaaaaaattttcaaatcctctcatatgctccaagaaattggcttagatgtaccgttttcagtgaaaatagcagaattattaaaaagaaatgaaattctcttgcaaaatacgcatcttacaatggaaagcttggtgaacgaactttggagattacattcc

SEQ ID NO: 40160 - DNA, 495 bp, Bacillus thuringiensis
gaaatgaaatctatatacataaccggctacatgggagcagggaaaacaacaattggaaaagcgttaagtaaagaacttcaaatggatgttgtagatactgatcaaaaaatcgaagagaagcaagagaaggcaattcgaaaaatttttgccgaagaaggcgaaatggcttttcgggaatatgaaagcgaaatgttacgtgcgctaccagtccataatgttattattacaactggtgggggaattattgaacgagcggaaaatcgcaagtggatgaaagagaacggaactgtcgtgtatttatattgtgatccgcatgtaattgcagaaaggcttcgtgaagatacgacacgtccactatttcaaaagaaagatatagatgcattcgtaaagaaatttgaatcacgccgagcttattatgaagaggctcatattcatatcgatacgacaaataagtctgtaaagcaaattatgaatgaattaaaggaaaagattaat

SEQ ID NO: 40161 - DNA, 972 bp, Bacillus thuringiensis
tctaaatctcgtattactgcaattggtacttatgttccagatcaaatattgtctaataacgatttagaaaagatggtccatacgaatgatgaatggattgtacaaagaacaggaatgaaggaaagaagaatcgctagcgaagaagaatattcctcaaacttagccattaaagcaattaaaaatttatgtacaacatataagaaaaacttagaagatgtcgactgtatcattgtcgctactactactgctgattacgttttccctagtgttgcttgccaaatacaacaatacttcaacatacctcatacactagcttttgatttaaatgcaacttgtgctggttttacatatggactacacgtcggtaatagcttaatcacttctggatcacatgaaaaaatacttgtcgtagcgacagagacattatctaaagttactgattataccgatagaacgacctgtattttattcggtgatggtgctggagctattttattagaaagagatgaagacatcccaagctttatcgctgctcacatgggaacaaacggtgatggcggcattcatctatatagcacaaacttatctactactatgaatggcacaccactgcaaacaaatgaaaaaatcgttcaaaatggaagagaagtatataaatgggcaacacgaacagtgccaaaaggcataaaaaatttattacataacgcaaatatgcaaggggatgatatagactggttcataccccacagcgctaacttacgaatgattgaatctatttgcgaaaaatctcaaattccaatacaaaaaacattaacgagcgtggaatatatggggaatacctcttcagtcaccattccactcgctctagatttagctataaaagaaggaaagttaaataatggagacacacttttactatacggattcggtggtggtcttacacatttagggcttattgtagagtggaattta

SEQ ID NO: 40162 - DNA, 3117 bp, Bacillus thuringiensis
caaatccttacctatcactaacaagagcgtcgaggtgtatttgaagaagcggcaggcgtactaaaatacaaacttcgcaaaaagaaagctgaagggaaactagcagaaacacaagaaaacttaaatcgtgtacaagatataattcatgaattaagtagtcaagtagaacctttagaaagacaagcttctattgcgaaagattatcttgagaataaagaagaattagagaaagtagaagctgcgcttattgttcatgaaattgaagaattgcatgagaaatgggaagcgcttcgaaatcagtttgggcataataaaaacgaagaagctaaaatgtcaacgaatttacaaaaaagtgaagaagagcttgaggaattacgaggacaattacaagcggtagacgagtctgtagactcgttgcaagaagtacttcttctttctagtaaagagctagaaaaactagaagggcagcgtgagttgttaaaagaaagaaagcaaaatgctacgacgcattgtgcgcaacttgagcagttaattgttgaattaactgagaaagctaaaagttacgatggtgagattgagtcaagtacagaatctttaatgcaatttgtgaatgaagtaaaagagttggagcaaaaattgcatgataatgagcaactgcttgctacttttgctgacaatttagaggaacagattgagaatttaaaaggtgactatattgagcttttaaatcaacaagctagtcatcgtaatgaattatctatgattgaagaacaatcgaaacagcaaacgtctaaaaacgagcgtctagatgaagagaatgcgaaatatgtagaaatgcgtatggaaattacagcgaaaaagacgaaacttgtagaaagttacgaacaagcgaaagaaaaagtagctggcattctctcaaatatacagaagacagaggcggcgcttgggaaatgtaagacgcagtatagtgaaaatgaaacaaaactgtatcaagcatatcaatttgtgcaacaggcacgttctcgaaaagaaatgcttgaagagatgcaagaagattattctggattctatcaaggtgtacgtgaagtattgaaagctagagaaaataggttgcaaggtatcgagggtgctgttgcggaactgttaacggtaccgaaagaatacgaagttgcaatggaaatcgctctaggtgcagcgatgcagcatattgttgtacaaacagaggaacatgctcgtaatgcgattgcatttctaaagcaaaataaacatggacgtgcaacgtttttaccgcaagctgttattaaaagcagatcgttatcatttgagcaattacgcattgcaaatcaacacccatcgtttgtaggtgtggcggcagaacttgtgcagtacaacaataaatatgaaaatgtagtttcaaatttattaggtactgttattgttgcgaaagatttacgtggagcaaatgagttggcgaaacaactgcaataccgttatcgcattgtaacaatcgaaggcgacgtagtgaatcctggcggttctatgactggtggggcggtaaagcaagcgaaatcttctttattaggacgccaacgtgaactggaagagtggactcgcaagttaactgatatggaagaaaaaacaacgaagttagaaaactttgttaaagcagtaaaacaagagattcaagaaaaagaagtgaaaatacgcgaactaaggcaaactgtagaagcagatcgtgtagatgagcagaaattaagagaagagattaatcgtttagaattagaagaacatcgtattaatgatcggttgtctatttatgatttagagattgaagggtttttacaagatcgagtaaaaatgcaagggcgtaaagaggagttagaaggggttttaacgaatcttcaagctgaaatcactaagttagatagtaaaattgtagctttaacaaaacaaaaaagtgagcaacattcttcgaaagaaaaagttcaaaaagaaatgactgagttaaaagtgctggcagctgaaaagcaacaacgcttatctaatcaaaaagaaaaagttgaacgattgacgaaggaaaaagaagaaacggatgcgacacttgtaaaaacgaaagaggatttagcgttcttaaaacaagaaatgacatctaattcaagtggtgaagagcaaattacgaatatgattgagaagaaagcatatgatcgtaatcaaacttcagaattaattcgctctcgtcgtgaacaacgtgtatcgttgcaagagagagtagaacatttagagcgcaatttgaaagaaacgacaggtaaacataaatatgttcttgaaatgttgaaagatcaagaagtgagaataaatcgactggatgtagagttggaaaatagattacaacatttacgtgaaacatatacgatttcatttgaagcggcaaaactaaaatatacaatgacaatgcctgcagaagatgcgcgtaagaaagtaaaattaatcaaattatccatagaagagttaggtacagtgaacctaggggcaattgatgaatatgaacgtgtagcggagcgtcatacattcttactagagcagagagacgacttagaagaagcgaaagcgacattgcaccagcttattaccgaaatggatgaagaaatgaaaaaacgcttttctactacgtttgaaggcattagaatggagtttcaatcggtattctctgaattatttggaggcggtagagcggatttagtaatgactaatccagaggatttactaaatacgggtattgatattgtagcacaaccgccagggaagaaactgcagaacttaggtttactttcaggtggagagcgtgctttaacagcaattgcgcttttatttggtattttaaaagtacgcccagtaccgttctgtgtactagatgaggtagaggcagcccttgatgaggcgaatgtagctcgttttgcacagtatttaaagaaattcagtgatgagacgcagtttattgtaattacacatagaaaaggtacaatggaagagtctgatgtgttgtacggtgtaacaatgcaagaatcgggggtatctaaacttgtttcggttcgtttagacgccggagaagaacttatt

SEQ ID NO: 40163 - DNA, 1017 bp, Bacillus thuringiensis
atgggaaacatacatattcaaacgaaatcaaaagaatatgatgtacatgttggtaaagaagcgttgtcaaacttaacaacgatcgttcaaaatatgcagccagcggtatctaacgtaatgatcatttcagatgaagctgttgcatcactacatttacagacagttatcgatgcattacaagtagagcagcacgtgttttcgtttgttgtaccaagtggcgaaaaagagaagtctttcgaaaatttctatgcggctcatacgtcagctcttgaaaataaattagatagaaattctttaattcttgcacttggaggcggaatgattggagatttagctggttttgttgctgcatcgtttatgcgtggtattcgctttgtgcaggttccgacaactttattagcgcacgatagcgctgtgggtgggaaagtagcgattaaccatccgttaggtaaaaatatgattggtgcattccatcagccagaagcagttgtatatcatacaccgtttttacagtctcttcctgaaaaagagtggcgttcaggttatgcagaggtgataaagcatgctcttatcggtgatgtggagctataccattggttaaaagaagaagtgcaaacattagcggatcttcatgatgagaagttaatccatatattaacgaaggcgattcctgtaaaggcaaatgttgtgtcacaagatgaaacagagaagggtgtacgtgctcatttgaactttggacatacgttaggacatgctcttgaaaaagagctagggtatggaaatattactcacggtgacggtgtagcggttggaatgttattcgccatatttttaagtgagcaagtgtacaaggttgatcttgcttatgaagatatgaagcagtggttcttgaaatacggctatccaaaaatgccaagggatttgaatgtagagcgcctcgttcaattgatgaaacaagataagaaagcaaatgcaggagcaattcatatggtgcttatgcaggaatatggggtagtg

SEQ ID NO: 40164 - DNA, 1752 bp, Bacillus thuringiensis
atggaagttagaaatgaaataaagaaaaaagggagttggaggcagtttttacgccttattcaagatacaaatcctccgaaaggaattttagtttttgcgttgttaatgagtttgctttctacgggagcgagtttatttattcctatgctgacaaaaggattagtagataatttttcgctttcttcaattagtgcaggacaaattgttgggttaattgctttctttgtaatgcaaactattgcggcagggttgtctatatatttactaaattatattgggcagaagattgtagcgggactaagagaacgtttgtggaaaaaggtacttatcttgccggtatcttattacgatcaaaatagaacaggtgatacgattagccgtatgacgaatgatacaggtgttgtgaaaacgttaatttctgagcatttgtcaaacttattaacaggtggtatttcaattgttggatcgttaattgtattatttgttttagattggaaaatgactgcgttacttttaacggttattccgttgtctgtgttaattttagttccacttggacgaaaaatgtataagatttcaaaagcacttcaagatgaaactgcatcttttacaagtgtgttaacgcaagtgttatcagaaattcgtttagtgaaatcttcaaatacagaaaagagagaatatgaaacgggtaatacaggtatacaaaagttattacaatttggtttgaaagaaggaaaagtgcaagcattaatttcgccagttatgtcgtttgttttaatggcactacttgttattatcgtagggtatggcgggatgcgagtttctagcggtgcattaacaaccggtgaacttgtagcgtttattttgtatttagttcaaattgtaatgccaatgagtcaattatctatgttctttacacaattccaaaaggcaattggtgcaacggaaagaattagtacgattttagaatatgaagtagaagatcatgaaactggtgtgaaagtgacaaatgctaagcaaccgatcgttcttgaaaatgtacattttgagtataacgaagaagagcaagttttgaaaaatattgatttcacaattgaatctggaaaagtgacagcgattgtaggaccaagtggtagtgggaaaacaactttattctcattattggaacgtttttatgagccaactagtggcgccattaaattaggggaagaatcaattacgagttattcattacagtcatggcgacgtcaaatcggttacgtatcacaagatagtccgttaattgatggaacaattcgtgataatatttgttatggcgtcgagggcgaagtaacggatgaagaaattgaaaaagtagcagcaatggcatatgttgatgcatttattcatgacttaccaaacggttatgcaacagaagttggagaacgcggtgtgaagctttctgggggacaaagacagcgaattgccattgcccgagcgttacttcgaaatccgcaaattcttatgctagatgaggcgacttcaagcttagatagtaaatctgagtctgtcgttcaaaaagcgttaaataacttaatgaaaggcagaacaacgttagtgattgcgcatagactttctactgttgtagatgcagataaaattgtctttattgaaaaagggaatcttacaggtagtggtacgcatgatgaattattacagacgcatgatatgtatcgtgagtttgcaacgcagcaattgaaaattaaagagggt

SEQ ID NO: 40165 - DNA, 936 bp, Bacillus thuringiensis
atgaaaaaaggtattaaccgtgttgtattagtaggaacaggagcagttggatgtagttatgcttactgcatgattaaccaagccgtagctgaagaatttgttttagtcgatgtaaatgaagcaaaagctgaaggggaagcaatggatttaagtcatgctgttccattcgccccagctccaactagagtatggaaaggcagctacgaagattgtaaagatgctgaccttgtagttattacagctggattaccacaaaagccaggcgaaacacgtttagatttagttgagaaaaacgccaaaatctttaaacaaatcgttcgcagtattatggatagcggatttgatggcatcttcttaatcgcaacaaaccctgtagatattttaacttatgtaacttggaaagaatctggtttaccgaaagaacgtgtaatcggttctggtacaacgcttgattctgctcgtttccgctatatgttaggtgagtacttcgatattggtccacacaacattcacgcttatattatcggagaacacggcgatactgaacttccagtttggagccatgtttccgttggtatccaaaaactacaaacactgcttgaaaaagacaacacgtataatcaagaagatttagacaaaattttcataaacgtccgtgatgcagcttaccatattattgagcgtaaaggcgcaacttattatggtatcggtatgtcacttctacgtgttacaaaagcaattttaaacgacgaaaatagtgtattaactgtatcagcttacttagaaggtcaatacggtcaaaaagatgtttatatcggggtacctgctgttttaaatcgcggcggtgttcgtgaaattttagaggttgaattaagtgaagatgaagaattaaaattcgaccactctgttcaagtattgaaagaaacaatggctccg

SEQ ID NO: 40166 - DNA, 1194 bp, Bacillus thuringiensis
atggaaacaattgttcaaaaatttggtggcacttctgtcggaagcgtcgaacgcattcaacatgtagcaaatttaattattgaagaatatgaacgaggtcatagcattgtctctgtcgtttcagcaatgggaaaaagcacagatgaacttgtcgcactcgctaacgctatcacagaaaatccaagtaaacgtgaaatggatatgcttctatctacaggagaacaagtaactatttcattattaacaatggcactgcaagcaaaaggctatcatgcaatttcattaacagggtggcaagcaggtattacgacagaatctgtacatagtagtgcacggattactgacattcatacagatcgtattcaatcttatcttgctgaaggtacgattgttatcgtagctggtttccaaggtataagtgtagaaaatgaaattacaacgcttggccgtggtggctctgatacgactgctgtcgcattagctgctgcacttaaagcaaaaaaatgtgatatttatacggatgtgacaggtgtatatacgacggacccacgagttgtaaaagatgcttacaaattagacgaaatttcttatgacgaaatgttagagcttgctaatctcggtgctggcgtattacacccgcgcgctgttgagtttgctaaaaatcataatgtagttttagaagttcgctcaagtatggaacaagaaaacggaacaattgtaaaaggagaatgtaacatggaacaacaatcaatcgttaaaggtattgcatttgaggataacattacacgtgtcacaattaaaggattagaacaaggctcgctttcaacagttttctctacattagcagcagcacacattaatgtagatatcatcattcaaagtattacaaatgaaggaactgtacacctctccttctccattcattcgaatgatttaagagaaactttagaagttttggaacaaaatcaagaaactcttcactatgaatctgtagaacatgaaaatcacttagcaaaagtatcaatcgtaggatctggcatggtatctaacccaggtgtcgctgcaaatatgttcactactttaaaagaagaagatattcatattaaaatggtaagtacatcagaaattaaagtgtctgtcgttattgaccgccttcatttagtaacaggcgttgaggcgctgcatcaatcattt

SEQ ID NO: 40167 - DNA, 480 bp, Bacillus thuringiensis
atgattgtttcatttatggtcgcgatggacgaaaatagagtaattggtaaagataataatttaccttggcgtttaccgagtgaattacaatacgtgaagaaaacaacgatgggccacccgcttattatgggaagaaagaactatgaagcgattggtagaccactgcctggaagacgtaatattattgtaactcgtaatgaagggtatcatgttgaagggtgtgaagttgttcattctgtagaagaagtatttgaactatgtaaaaatgaagaagagatttttatttttggcggagcgcaaatttacgatctctttttaccttatgtagacaagttatatataacaaaaatccattatgcatttgaaggagatacattcttcccagaaatggatatgacaaattggaaagagatttttgtagaaaaaggtttaacggatgaaaaaaacccgtatacgtataaaaaccatgtatatgagaag

SEQ ID NO: 40168 - DNA, 612 bp, Bacillus thuringiensis
aaatatattgtttttgactttgatggcacattagtagactcacaaaatatatttgtaccgatttataatcaacttgctgaaaaacatgggtataaagcagtaaaggaagacgaaattgaacatttacgtaaattaacgatgccagagagatgtaaacaacttaatgtaccactgtataaattaccgatattagcgttggaattttataaattatatcagccggctataaaaaatctcgttttgttccatgggatgaaagaagtattagatgaactacataaaaaaggctacggaattgcagtcatatcatcgaactcagaagagcatattcgggcgtttttacaaaagaatgatatagaaaatatacaagaagtgtattgttctaaaaatttgttcggtaaagataaaatgataaaaagatttttgaaatcaaaaaaaataacagagaaagatatgttatatgtcggtgatgaacagcgagacgtagcagcgtgtaaaaaggctggagtgaacgtaatttgggtatcttggggatatgatgttattgaaacagtgaaaaaagatgcaccagattacatggttcataagccgatggaaattgtgcaagtagta

SEQ ID NO: 40169 - DNA, 1437 bp, Bacillus thuringiensis
atggcaacattaactgaagttaaaaatggtgttcgaattgaaaaagattttttaggtgaaaaagaagtaccaaactatgcatactacggcgtacaaacaatgcgtgcagttgaaaacttcccaattacaggatacaaaatccatgaaggtttaattaaagcgttcgcaattgtaaaaaaagctgcagcgcttgcgaatacagatgtaggaagattggaattaaacaagggcggtgcgatcgcagaagctgctcaagaaattcttgatggaaaatggcatgatcatttcatcgtagatccaatccaaggcggagcgggtacttcaatgaacatgaatgcaaatgaagtcattgccaatcgtgctcttgaattattaggaatggaaaagggagactatcattatattagtccaaatagtcatgtaaatatggcccaatcaacaaatgatgcattcccaacggcgattcatatcgcaacgttaaatgcattagaaggcttattacaaacgatgggttatatgcatgatgtatttgaattaaaagccgaacagttcgatcatgtgattaaaatgggacgtacacatttacaagacgctgtgccaattcgccttggacaagaatttaaagcgtactcacgtgtacttgaacgtgatatgaaacgcattcagcaatcacgtcaacacttatatgaagtgaacatgggagcaactgcagttggtacaggcttaaatgcagatccagaatatattgaagcagttgtaaaacatttagctgcaattagtgaattaccgcttgttggtgcagaagatttagtagatgcgacgcaaaatacggatgcttatactgaagtatctgcagcgcttaaagtatgtatgatgaatatgtctaaaattgcgaatgaccttcgcttaatggcatcaggtccgcgtgttggtttagcggaaattatgttaccagctcgtcaaccaggttcatctattatgccagggaaagtaaaccctgttatgccagaagtaattaatcaaattgcgttccaagtaattggtaatgaccatacaatttgccttgcttcagaagcaggacaattagaattaaacgtgatggaaccagtacttgttttcaacttacttcaatcgattagcattatgaataacggtttccgtgcctttacagataattgcttaaaaggaattgaagcgaatgaagatcgcttaaaagagtatgttgagaaaagtgtaggaattattacagccgggaaccctcatatcggttatgaagcagcagctcgcgttgcgaaagaagcaattgcaacaggccaatccgttcgagaactttgtgtgaaaaatggtgtattgtcacaagaagacttagagttaattctagatccattcgaaatgacacacccagggattgcaggagcaactcttttaaagaaaaat

SEQ ID NO: 40170 - DNA, 1065 bp, Bacillus thuringiensis
aagcttgggaaactgggtggtaagacaattctttatttcgaaattattacgacgattgctattttaatgggattacttgcagcgaatatattccaaccaggtactggtgttgatatgagtaatttacagcaaagtgatatttcttcttataaacaaactgcagatgcaacagagaagaaaggttttgctgagacaattgttcacattgtaccgaaaaacgtatttgaatcgattgcacaaggtgacctattaccgattatattcttctcagtattattcggcttaggagttgcggcaattggggaaaaaggaaagcctgtctttaacttttttgaaggcgtactcgaagccatgttttgggttacaaatcaagttatgaaatttgcaccatttggtgtattcgcattaattgccgttacggttgcaaaatttggtgtagcaacactacttccgctaggaaaactagtgctagctgtatacgtaactgttatactattcgttgtgattgtattaggtattaatgcacgaatggttggagtaaacatttttacattaataaaaattttaaaagaagaattgattctttcatttacgacagcaagttcagaagctgttttacctaatataatgagaaaaatggaagagttcggttgtccaaaggcagttgcctctttcgtaattccgacaggttatacatttaacttgactggatcggctatttatcaagcgttagcggcattgtttgttgcacaaatgtacggtgtgcacatgtcactaacggagcaaataacgttattattcgttctcatgttaacatccaaaggtatggcgggagttccaggtgcatcgttcgttgttgtattagcaacgttaggttcaatggggttaccactagaaggtatcgcattaattgcgggaattgaccgcattttagatatgattcgctcatctgtcaatgtattaggaaatgcattagcggccattgttatgtcgaagtgggaaggcgaattcgataatgagaaagcaaaacaatatgtagaaacagtcaaagaaacaaaagcagca

SEQ ID NO: 40171 - DNA, 798 bp, Bacillus thuringiensis
atggataaacaaattggattcatcggttgcggaaatatgggaatggctatgattggcggaatgataaacaaaaatatagtatcttcaaatcaaattatttgttcagatttaaacactgctaatttaaaaaatgctagtgaaaaatatgggctaactacaactaccgacaacaataaagtagctaaaaatgctgatattttaattttatcaatcaaaccagacctatattcatcaataattaatgaaataaaagaagtaatcaaaaacgatgctatcatcgttacgatcgctgctggaaaaagtattgaaagtactgaaaatgcctttaataaaaaagtaaaggttgtaagagtaatgcctaatactcctgctcttgttggagaaggaatgtctgcattatgccctaatgaaatggtgacagaaaaagatttagaagatgtactaaacattttcaatagttttggtcaaacagagatcgtaagtgaaaaattaatggatgttgtcacatccgtaagtggttcttcaccagcttatgtatatatgattatagaagcgatggcagatgctgctgtactagatggtatgccaagaaatcaagcatataaattcgctgctcaagctgtgttaggctctgcaaaaatggtactagaaacaggaatacatccaggtgaattgaaagatatggtttgttctcctggcggaacgacaatagaagctgtagcaacattagaggaaaaaggattacgaacagcgattatttcagctatgcagcgttgtacgcaaaagtctgttgaacta

SEQ ID NO: 40172 - DNA, 1245 bp, Bacillus thuringiensis
atgaatgaagtgttagcaaaggggataaaagcaaaagaggttgctagagaacttgtgcttaaaactacagatcaaaaaaatgaagcacttgctgcaattgctaatcagctgatagtagaaacagcttatattttagaagaaaacaaacgggatattgaagaaggtaaggagaaaggattttctcattcactccttgatcgccttttgctgaatgaacaacgaattgttgatatgacagagggtattaagcagttaattgaattacgtgatcctattggagaatgtgtaagtgcatgggaacgaccaaatggactatctattcaggagatgcgcgtaccacttggtgttgtcggaatgatttatgaggcaagaccgaatgtaactgttgatgctgctacaatttgtttaaaaacaggaaacgcagtaatactacgtggtagttcttctgctatacattctaacaaagctatcgttagcgttattcaccgggcgcttaagcaaactagcttgccttcagaaagtgtacagctcatagaagatacaacgagagatagtgcaaaacagttgtttacattgaacgagtacttggatgttcttataccaagaggcggtaaacaattaattgatacagtagtgagagaagcgtctgttccagtacttgaaacaggtgcgggaaattgtcatatattcattgatgaaacagcagataaacaaatggcgtttaatattattataaacgcaaaaacgcagcgtccatctgtatgtaatgcaattgagacgattgtacttcatgagaattgggcagagcaatatggtagcgagttgttttcttccttgaaggaaagaggagtggagctacgtggtgataataaagcagtggcgattgatccttctatcttacttgcgacagaagaagactgggaaactgagtttttatctctcacactagcagtgaaagtggtttccactgttgaagaagcgattcatcatataaatacgtatggatctatgcattctgaagcgattattactgaaaacgaggaaaacgtcagcaagttttttacttctgtagatgccgcggcactttatcataatgcatcgactcgttttacagatggatccgaatttggattcggagcggaaattggtatcagtacacaaaagttacacgtaagaggaccaatggggcttccagcattaacttctacaaaatatgtgattcgtggaaatgggcaaattcgaaaa

SEQ ID NO: 40173 - DNA, 1285 bp, Bacillus thuringiensis
tttttagaattaggaattagtgaaacttttaatcatacattacgtgaaaatggaattacagaagcaacaccaattcaagagcaggcaattcctgttattatgtctggtaaagatattattgggcaggcaaaaacaggtacgggtaaaacgttagcattcgtgttaccgattttagaaaaaatcgattcagagtctagtgatgttcaggctttaattgttgcaccaacaagggaactagccctgcaaattacaactgaaattaaaaaaatgcttgttcaaagagaagatattaatgtactagcgatttatggtgggcaagatgtagcacaacaattgagaaaattaaaaggtaatacacatattgttgttgcaacaccaggacgattattagatcatatacgccgtgaaacaattgatttaagtaatctttcaacgattgtactagatgaagcggatcaaatgctttattttggtttcttatatgatattgaagatattttagatgagacaccaggtagtaaacaaacgatgttattctcagcaacgatgccaaaagatattaaaaaattggcgaagcgttatatggatgaaccgcaaatgattcaagtacaaagtgaagaagtaacggttgatacaattgagcagcgtgtcattgagacgacagaccgtgcaaagccagatgcacttcgttttgttatggatcgtgatcagccatttttagctgttattttctgccgtacaaaacttagagtaagtaaactgtatgataatttaaaaggactaggttataattgtgctgaacttcatggtgatatacctcaagcgaaacgtgaaagagttatgaagagtttccgcgaagctaaaattcagtacttaatcgcaacggatgtagcagctcgtggacttgatgtagatggtgtaacgcacgtatttaactttgacatccctgaagatgtagaaagttatattcaccgtattggccgaacaggacgtgcaggtggatcaggtcttgcaattacgttcgttgcagcgaaagatgaaaaacatttagaagaaattgaaaaaacgcttggtgcaccaatacaaagagaaataatcgaacaaccgaagataaaacgtgtagatgaaaatggaaaaccggtaccaaagctggctccgaagaaatcaggtcaaaatcgtcaaagagatagccgcgaaggttcaagaagtgaatcaagacgtgattcaagaaatagctcaagaagtgattcaagaaatagttcgagaaatagttctagaaatgaaa

SEQ ID NO: 40174 - DNA, 774 bp, Bacillus thuringiensis
tttcgcaatttgcgacgtacattatatcgacttatgatagaacttacaaatggtcgctttacttcttatatattacgtaaatttgcacaatctcgtttgagctctatcattattccatcgtacgcgaaagtttttcaaattaatcaagatgagatggaaaagggtttgaaggaatatagaacattgcatgaattatttacgcgtaagctaaaagaaggaaagcgtagtattgatacagatgcatcgagtatcgttagtcctgttgatggtgtttttgcagatcatggtcctattgaggatacaaaaacatttgatattaaaggaaagcgctattcaatcgtggatatgctaggtaatgaagaacgtgcaacgcgatatgcaggcggtacatatatggtaatttatttgagtccaagtcattatcatcgcattcatagtccgctttctggttctgtgactgaaagatttgtactcggtagaaaatcatatccggtaaatgcagctggtatggaatacgggaaagaaccactgtcaaaaaattatcgttctgttacagaagtaagcagtgatggcgagcatatggctcttgtaaaagtaggtgctatgtttgttaatagtattgagcttttgcatgagagagacactgttcaaaaaggtgaagaaatggcatactttacatttggttcaacagttgtgttattgtttgaaaaagatatgatagaagtagtgcaggaattaaagagtggacaagagcttcgtcttggtgaaaaaata

SEQ ID NO: 40175 - DNA, 777 bp, Bacillus thuringiensis
ctgggaggatatatcatggaactattacaagggaaaacatttgttgttatgggcgttgcgaaccaaaaaagtattgcatggggaatagctcgctctttgcataatgcaggtgcaaaattaatattcacatatgcaggagaacgtttagaaagaaacgttcgtgaattagcggacacattagaaggacaagaatcacttgtattaccttgtgatgtaacgaatgatgaggaacttacagcttgctttgaaacaattaaacaagaagtaggtactattcacggtgtagcacattgtattgcttttgcaaatcgcgatgacttaaaaggtgaatttgtagatacttctcgcgatggatttttacttgcacaaaatattagcgcattctctttaacagctgtagcaagagaagcgaagaaagtaatgacagaaggcggaaatattttaacattaacataccttggcggcgagcgcgttgtgaaaaattataacgttatgggtgttgcgaaagcttcattagaagcgagcgtgaaatatttagcgaacgatttaggtcaacacggtattcgtgttaacgctatttctgcaggaccaattcgtacgttatctgcaaaaggtgtaggcgatttcaactcaatcttaagagaaattgaggagcgcgcaccacttcgtcgtacaacaacgcaagaagaagttggcgatacagcagtattcctattcagtgatttagcacgcggtgtaacaggagaaaacattcatgttgattcagggtatcatatc

SEQ ID NO: 40176 - DNA, 1098 bp, Bacillus thuringiensis
aaccccaaggttttaatattaactgcacattacggtaatggtcatgtgcaagtagcaaaaacattagaacaaacatttcgccaaaaaggaattgaagatgttattgtatgcgacttgtttggagaatcacatccatttataactgacattacaaaatatctatatttaaaaagttatacaataggaaaagaattatatcgtttgttttattacggggtagaaaaaatttatgataagaaaatagcatcttggtatgcgaactttggaaggaaacgtttgaaaacacttttacaggtggagaaaccagatattgtaattaatacatttccaattatcgctgtaccagaattaaagaaacaaacaggtatttcaattcctgtctataacgtattaacggatttttgcgtgcacaaaatatggattcatcgagaagtagatcgttattttgttgcaacggatcatgtgaaagaattgatggttgatatcggtgtacctgcggaacaaattgttgaaacaggaattccaattcggagtagttttgagttaaaggtaaatccagaaatcatatataataaatatcagttatgtaagaataaaaagattttactaattgtagcaggtgctcatggggtattaggaaatgtaaaagaactatgccaatcatttatgtcagtgcctaatttacaagtagttgtcgtttgtgggaaaaatgaagctttaaaacaggatttattaagtttacagaagcaaaattccgatgcattaaaagtgtttgggtatgttgaaaatattgatgaattattccgtgttacttcttgtatgattacgaagccaggcggaataacattaagtgaagcagcagcgttgcaagtacctgtcattttatataagcctgttccaggacaagaaaatgaaaatgcgatgtactttgaaagaaagggagcagcagttgtcattcgcgatgatagtgaggtttttgcaaaaacagaggcattattacaagatgatgtgaagcttcttcaaatgaaagaagcaatgaaaagcatctatcttccagagccagctggccatattgtagatgcaattttggcggaaaat

SEQ ID NO: 40177 - DNA, 1389 bp, Bacillus thuringiensis
tttgattttcaacgaaattacttattgaaagatatgtttcaagtgcataaagcacatattacgatgctgacggaagaaaatttaatgaaaaaggaagaagctaaagttatattacacgcattaaaaaaggtagagggaattccagaagagcaattgctctatacagagcagcatgaagatctcttttttttagtcgaacatttaatttctcaagaagcgaaatgcgattttgtaagtaatatgcatattggtagaagtagaaatgatatgggcgtaacgatgtatcgcatgagtttaaggcgatatgtattacgattaatagaacatcatttgttattgcaagaaagtgtactgcaacttgctgctgatcataaggaaacgatcatgccagcttatacacatacacaaccagcacagccaccaacatttggtcattatacgttagcaatttatgatacgatgcaaagagatttagaacgaatgaaaaaaacgtaccagcttttaaatcagtctccaatgggggcggctgcactctctacaacaagtttcccgattaaacgagaacgagttgctcatctacttggatttacaaatgtaattgagaactcatatgatgctgttgctggagcggattatttattagaagttagctcgctacttatggtaatgatgacgaatacgagtagatggattcatgactttttgttgttagcaacgaaagaatatgacggtattactgttgcaaagtcatatgtacaaatcagtagtattatgccgcaaaaacgaaacccggtttcaattgaacatgctcgtgcaattacgagtagtgctttaggagaagcatttacagtatttcaaatgattcataatacaccatttggtgatattgtcgatacggaagatgacttgcagccatatttatataaagggattgaaaaggcaattcgtgttttttgtatgatgaatgcagtgatccgaacgatgaaagtagaagaagaaacgttaaaaagtcgttcctataaacatgcaataacgataacggatttcgccgatgttttaacaaaaaactatgaaattccatttcggcatgctcatcatgcagcaagtgctattgcaaatatgtcattggagcagaaaaaagaactacatgaattacacttcaaagaggtaaatatgtacttgcaagaacattttaaaataaatttattagaaaaagagtggaaagaaattatatcgccagaagcttttattcaaaaaagaaatgtatacggtggaccgagtaaaaaagagatggagcgcatgatcaaaaatcgaaaagagtcatttcaaaaagaagaagatgtatttgaaaaggaaaaacagagaattttacaagctgaaaatgctttg

SEQ ID NO: 40178 - DNA, 1053 bp, Bacillus thuringiensis
atggcaaatcatgaattagatcaattacgtaaacaggtagatgaaattaacttacaactattacaccttttaaacaaacgtggtgaaattgttcaaaaaattggagagcaaaagcaagtacaaggcacgaaacgctttgatccagtacgtgagcgtgaagtacttgatatgattgcagagcataacgaaggaccattcgaaacatcaacagttcaacatattttcaaaacgattttcaaagcaagcttagagttacaagaagatgataaccgtaaagcgttactagtatcacgtaaaaagaaacaagaaaatacaattgttgatgtaaaaggtgaattgattggaaacggaacacaaacgttcatcatgggaccttgtgcagtagaaagtttagaacaagttcgtcaagtagggcaagcgatgaaagaccaaggcttaaaattaatgcgcggtggtgcattcaaaccgagaacttctccatatgatttccaaggtttaggagtagaaggacttcaaattttacgtcaagtagcagacgagtttgacttagcaattattagtgaaattttaaatccgaacgatgttgaaatggcattagactacgttgatgtaattcaagttggcgcacgtaacatgcaaaacttcgatttattacgagctgtaggtaaagttaacacaccagtattattaaaacgtggattagcagcaacaattgatgagttcattaacgcagcggaatacatcattgcgcaaggtaacgatcaaattattctttgtgagcgcggtatccgcacatacgaaagagcaacacgtaacacattagacatttctgcagtaccaattttaaagaaagaaacacatttaccagttatcgttgatgtaacacattcaactggacgcagagatttattattaccaacagcgaaagcggcacttgcaattggcgcagatgcagtaatggctgaagttcatccagatccagcagttgcattatcagattctgcacaacaaatggacattccagaattccatagattcatggatgagttaaaa

SEQ ID NO: 40179 - DNA, 1092 bp, Bacillus thuringiensis
atgagatacattacagctggagaatcacatggaccgcagttaacagttattttagaaggtgtaccagcaggtttgacacttacggcggaacatattaataaagaattattaagaagacaaaaaggtcatggacgcggaagacgtatgcaaattgaaacagatacagttgaaattgtaagtggtgttcgtcacgggatgacacttggatcaccgattacgttaattgtaaaaaatgatgatttcaaacattggacgaaagtaatgggtgcagagccaatttcggaaaaagaaagtaaagacatgaaacgtacaattacaaaaccacgtcccggacatgcagatttaaatggagcaattaaatatggtcatcgtgatataagaaacgtattagagcggtcatctgcaagagaaacgacagttcgtgtagctgctggtgcagttgcaaaacaaattttaagcgaattaggcgtgggaattgcaggacatgttcttgaaattggtggagtaaaagcaaaacatatttcaaacttatcaattgaagaaattcaaacaattactgaaaactcaccagttcgatgtttagataaagaagtagagcaagaaatgatgaatgcgattgacaacgcaaaaagtagtggagattcaatcggtggtattgtggaagtcattgcagaaggtatgccgattggcgttggtagttacgttcattacgatcgtaaattagatgcaaaacttgctggtgcaattatgagtataaatgcatttaaaggtgctgaaatcggcgtaggttttgaagcggcacgacaaccaggaagcaaagtgcatgatgaaattctgtgggatgaaaaaaaaggatacacgagaaaaacgaataatgccggcggtttagaaggcggtatgacaacaggtatgccaattatcgtaagaggcgtgatgaagccaattcctactttatacaaaccgttagcaagcgttgatattgatacgaaagaagcattccaagcgagtattgaaagatctgatagttgcgcagtaccagcagcgggtgtagtagctgaatctgttgtggcatgggaacttgcagatgcacta

SEQ ID NO: 40180 - DNA, 1053 bp, Bacillus thuringiensis
gtgcaagtaaaagatcaactatcatcattacaaccatataaaccaggtaaatcaccagaacaaatgaaagaagtgtacggagatcattcgtttgtgaaattagcatcgaatgaaaatccatttggttgttcaccgagagttttagaagagttgcaaaactcttggttggaacatgctttatatcctgacggaggtgctacaacgctccgtcaaacaatcgcagataagttgcatgtgcaaatggaacaagtactttgtggtagtggtttagatgaaatcattcaaataataagccgcgccgtattacgagcgggagataacattgtaacagcaggtgcaacattcccgcagtaccgccatcatgcgattattgaagggtgtgaagtgaaagaaattcctttaaataaaggtgtatacgatttagacgaaatttcgtcagcggtaaataataatacgaaaatcgtatggatttgtaatccaaacaacccgacgggcacatatgtgaatgagcaaaaattaactcgatttattgaaggcattagtgaaaatacgttaattgtcattgatgaagcgtactatgaatacgtaacagcaaaagatttccctgagacattaccgcttttagaaaaacataaaaacattcttgtacttagaacgttttctaaagcatacggattagcttctttccgcgttggatatgcgatcggacaggaagagctaattgagaaattaaatgtcgtacgtttaccatttaacgtatcttcattagcgcaaaaagcagcgacgattgcttttggtgatgacgagtttattaaagaaatagttcacatgaatacagaaggattacagcaatacgagagtttctgtaaggaaaacggtataccattttattcgtcacaaactaatttcatcttcttaccggtagataatgctggagagatttatgaagcttgtgcacatgcaggatttattattcgtccgttcccgaatggtgtccgtattacagttggaacaagggagcaaaatgaaggggtgatttcagtgttaaaacaa

SEQ ID NO: 40181 - DNA, 1251 bp, Bacillus thuringiensis
ttgaatggcaatattacaatcccaggtgataaatccatttcacaccgtgctgttatgttcggctctattgcagaagggaaaacaataattagaggtttcttgcccggtgcagcctgtttaagtacgatttcatgttttaaagaaatgggagtagaaattacgcacaacggtgatgaggttactgtagttggtaaaggattagaaggtttacaagaaccgaaagctgtattagatgttggtaattctggtacaacaatccgattaatgtcaggtatattagctaacacaccatttttctcttgcgtacaaggtgatgaatctatcgcaaaaagaccgatgaagcgtgtaacaaacccattaaaacaaatgggcgcaaacatagacggccgagaagaaggaacatttacaccgttaacaatacgtggcggcgatttaaaagcaattgaatatatttctcctgttgcaagtgcacaagtaaagtcggctattttacttgcaggtcttcgtgcagaaggtgtaacagctgttacagaaccacatatttcacgcgaccatacggaaagaatgctcgaagcatttggtgttaaagtaactcgcgaagggaaaacagtgaagctgtcaggtggacaaaaattaacagcaacagacattcaagtgccaggtgacgtatcatcagcagcgtttttcttagtagcaggtgcaatcatcccaaatagtaaactagtattacaaaatgtaggaatgaatccaacccgtacaggtattattgatgttttagaaaaaatgggtgctacgttcactgtagatctaattaacgaagaggcatcagaaccagctgcaaatattacaatcgaaacatcttcattaaaaggaattgaaattggcggagatattatccctagattaatcgatgagattcctgtaatcgcattagcggcaacgcaagcagaaggaattacagtaattaaagatgcacacgaattaaaagtaaaagaaacaaaccgtattgatacagtcgttgctgagttaacgaaactaggagctcgcatagaagcaactgatgacggtatgatcatttacggaaaatcagctctaaaaggcaatacagtaaatagttatggtgatcaccgtatcggaatgatgcttgcaattgctggctgtttggcagaaggaaaaacaattattgaagatgcagaagcagtaggtgtatcatatcctacattctttgacgaacttcaaaagttagctaaa

SEQ ID NO: 40182 - DNA, 714 bp, Bacillus thuringiensis
atgattgaaattacgaatgtgtcaaaaagttataatgggtctacctatgcagtaaaagacttaagtttatctgtacctagcggcgaaatctttggatttttaggaccgaatggtgcgggtaaatcaacgacaattaagatgattactggcattcacggggtggacaaagggactattacgattaacggaaaaaatattatggaagagccgatggaagcgaagaagacgtttggttatgtaccagatagtccagatatgtttttacgattaaaaggaattgaatatttaaactttatggccgatatgtatgaagtgccgaaagaagtacgacaagaacgaatagagtctttagcgaagaagtttgatctttataatgctttatctgatcaaattcaaagttattcgcacggtatgagacaaaaaatcgttattattggtgtgctcgtacatgagccagatgtatggattttagatgaaccattaactgggcttgatccgaaatctgcatatattttaaaagaaatgatgagagagcatgcggataaaggaaagattgtatttttctctacacacgtattagaagtagcggaaaaaatatgtgaccgggttgctattattaataaggggaatttacagtttaaaggaaatttagatgaaatgagagatcattttaaatccaatgaatcacttgaaaaaatgttcttggagatgacg

SEQ ID NO: 40183 - DNA, 1005 bp, Bacillus thuringiensis
agaatcaaaatagaaaaaagaagtttttaggttaaggtgaacaatatgaagttacaacttatgtactcttttttacgatcggatattaatgtgatagaaaaagaattaaaaaagacagtcgcttctgaacagccattagcagaagaggcagcattacagcttattgaagctggtgggaaacgaattcgccctgtatttgtgttgcttgcagggaaatttggagattataagttagatgcgattaaacatgttgctgtggcgttagaacttattcatatggcttgtcttgttcacgatgatgttattgatgctgcatttttacgacgcggcagtgcgactgtgaatgcgaaatggggagatcgtattgcgatgtatacaggggactatctgttcgctaagtctcttgaatgtataacaaatatcgaaattccagaggcgcatcaagcgttatcacatactattttagaagtctgtaaaggtgaaattgaacaaattaaagataaatacaattataaccaaaatttaagaacgtatttaagaagaataaagcgaaaaacagcattattaattgccgcgagttgtcaattgggagcgattgctgctggtgctaatcgtgatacggtaaatcgtctattttggtatgggtattttgtaggaatgtcttatcaaattattgatgacattttagacttcgtttctacagaagagaaacttggaaaacctgctggcggagatttactacaagggaatattacacttcctgctctatatgcgatggaagatcccgtacttcgtcagaaaatcacatctgtacatgaaaattcaacagcaagtgaaatacaagaaattattgatgctgtaaaaaatagtacagcaattgatcaagcatttgcatttagtgaacgttatttacataaagctttagaaataataaaaccactcccacgtggaaaagcaaagtacgcattacaaaatgttgcaaagtatattggaaaacgaaaattt

SEQ ID NO: 40184 - DNA, 444 bp, Bacillus thuringiensis
atggaaaaaacatttctaatggtaaaaccagacggtgtacaacgtgccttcattggggaaattgtagctcgttttgagaaaaaaggctttcaattagttggtgcaaaattaatgcaagtcactccggaaattgctggacaacactacgctgagcataaggaaaaacctttctttggtgagttagtagactttattacatctggacctgtgttcgcaatggtatggcaaggtgaaggtgtagtagatacagcgcgtaacatgatggggaaaacaagaccacatgaagcagctcctggaacaattcgtggagatttcggtgtaactgttgcgaaaaacattatccatggttctgattctttagaaagcgcagagcgcgagattgctattttctttaaagaagaagaattagttgactactcaaaattaatgaatgaatggatttac

SEQ ID NO: 40185 - DNA, 636 bp, Bacillus thuringiensis
atgcgatatattacagctggtgaatctcatggtccacaacttacaacgattatagaaggtgttccggcaggattgtctttagtagcagatgatataaacgaagagttagctagaaggcaaaagggatatgggcgcggtagacgcatgcaaatagaaacggatcaagtgcaaattttaagtggtgttagacatggagaaacattaggttcccctattgcacttgttgttgaaaatcgtgattttgcacactggacaaaaattatgggggcggagcctttaactgagcaagaagaaaaagagatgaaaaggaaagtgacaaaaccaaggcctgggcatgctgatttaaatggtgcgattaaatatggtcatagagatatgaggaatgtactggaacgttcgtcagcgcgcgaaacgacggtgcgtgttgctgctggtgcggttgctaaaaaggtgttagcagaacttggtattaaagtggcgggccatgtaattgaaattggcggtgtacaagctaaggagattacgtatagttcaattgaagaattaaagagtattacagaagcatatcctgtacgttgcttagatgaagaagctggtaaccaaatgatgaaagcgattgatgatgcgaaagcaaat

SEQ ID NO: 40186 - DNA, 741 bp, Bacillus thuringiensis
atgatgaaattagcatctccgaaaccatttacatttgagggtggagaccgcgctgttttattactacatggattcacagggaactcagctgatgtacgtatgttagggcgtttcttagaaaagaaaggctatacttgtcatgcgccaatttataaagggcacggtgtaccaccagaagagcttgttcatacagggcctgaagattggtggcaagatgtaacggaggcatatcagcttttaaaagataaaggttttgagaaaattgctgttgttggattgtcacttggcggcgtattttctttaaaattaggttatacagtaccggttttaggtgtagtaccaatgtgtgcaccgatgtatattaagagcgaagaaacgatgtaccaaggtatattggcatatgcccgcgaatataaaaaacgtgagcaaaaatcacctgaacaaattgaacaagaaatgttggaattccaaaagacaccgatgaatacattaaaagcattacaacaattaattgctgacgtacgtaacaatgtggatatgatttatgcgccaacatttgttgtacaagcacgtcatgacgaaatgattaatacagatagtgctaacattatttataacggtgtagaatctacgttaaaagacattaaatggtatgaagactctacgcatgtcattacacttgataaacaacgtgacgagctacatgaggatgtatataacttcttggagcaactagattgg

SEQ ID NO: 40187 - DNA, 1419 bp, Bacillus thuringiensis
aaaaaagtgcccaaatatcggcagataatagactatatgaaagaaaaaattgaaaacggagaatggccaattggaagtaaaatccctagtcagcggcagttagcaaaattatttcatgtaaatcgaagtactgtaataactgcgctagatgaacttatggcagatggtttaattcaaggacaaatcggagcaggaacaattgtaacaaataatacatggtcattattagcaactaatcccccgcctgattggagtgaatatgtaaaggccggtattcataaaccaagtaagttaatggtgcgagaaataaatgaagcagaagcaaataaaacgcttatccatcttagtaaaggtgaacttgcacctcatctttttccgctcgaaactatgcaatctataataaaaaacgtcagtgaggaattagattatttcggatacgaagaacaaaaaggtttttatccgttacgtgaagcaataagcaaatacgtaaaatcatttggaatacatgcatcaccgggttctatattaatagtctcgggtgcactccaagcattacaattaatatcaattggtcttttacatagaaaatcaactgttttacttgaacaaccttcttacttatattcacttcatgtttttcaatcagcaaatataaacttatccggtatatcaatggatcatcacggtattttacctaacgacttgttaaaacgaattaaatatagtcaaaagaataatattttatattcaatcccttgttttcaaaatccaacggggatattgatgtccaaagagcgaagaaaagaaatattaaaaatatgtaaaaaagagcagttgcctatcatcgaggatgatatttaccgagagttatggattgatgaatcacctccagctcctttaaagtcaatagataaacatggacatgtattatatattggtagtctctctaaaacacttagccctggacttagaattggatggataattggaccagaacctgttattgatagattgtcagatataaaaatgcaaacagactatggatcaagctctttatctcaaagagtagctgctgaatggataaatgaaggtttttatgaagaacatgtagcaaacgtaagaatgcacctgaaaaaacgaagacaaataatgatacgagctttaaataaatattgtgcagatattgcatcgtgggatattcctagtggtggagtttttatatggctaaaggttgtacataacattccgatgaaaaaactattttcagaggcactatcaaaaggaattcttttaaacccgggacgtatttatgaagaagaatcagatcagtacattcgtttatcatatggatatgcttctccagaacaaatgactaacggaattaaattgctcagtgaattaattcggaagttaacggca

SEQ ID NO: 40188 - DNA, 659 bp, Bacillus thuringiensis
gcagcgatttctataaaaggcttgaaaaaatcctttaaagacaaggaagttttaaaaggagtagattttgaggtgcagcgtggagaaattttcgcgctgctaggctcaaatggagcgggaaagacgacaacggtcaacatcctttcgacactcatgaagcaagatagtggtgaagtaagtatttgcggatttgatgtacagcgtcaaccaaatcatgttcgtcaaagtatcagtttgacagggcagttcgcagctttagacggtatgctgactgggagggaaaacttgataatgattgctaggctacgtggtgtttccagtcccgctcaagttgctgacaatctacttgcaagatttagcctgactgatgcggcaaaccaaagggcagatcagtattcaggcgggatgaagcgccggcttgatatcgcgatgagtttcccggggcgccagcagttatttttcttgaaaaaccaacgactggactcgatcctgaagcgcggattgaagtgtgggatacagtcaaggaactagctgatagtggtacagctattttgcgtacgagtcagtacttgaagcaagcagaacaactggctgatcgtatcgcaattatgcatggtgcaataattattacggcaggtactcttactgaaaaaaaagag

SEQ ID NO: 40189 - DNA, 531 bp, Bacillus thuringiensis
atgagcaatgggattgtagcaaaacgttatgctgtcgctctttttaaaattgctaaagaaaaacacgtattagaaatgtttgaagaggaattacgccttgtacaaaacgtttatgtaaagaacggagaactacatagctttttaacgcaaccgaacatttcaaaggaacaaaagaaaacgtttcttgcaaacgtattcggatctgtttctgaatctattttaaatacgttatatattttaattgataacaaacgcattgatatcttacctgaaattgcagatgaatatgttgttcttgctaatgaagaacgtaacgtagcggatgcaactgtatattctactcgtcttctatcagaagaagagaagcttaacattgctgaagcatttgcaaagagaacgggaaaagatgcaattcgcgtgaaaaatgttgtagatgaagatttactaggcggaattaaagtacgtattggaaatcgcatttatgacggaagtttacaaggaaaattagcacgtattcagcgtgaattaatg

SEQ ID NO: 40190 - DNA, 1884 bp, Bacillus thuringiensis
aatgtttttttaaacgaaaaacaattagaagccgtgcgcacaacagaaggtcctgttcttacactagctggtgccggaagcgggaaaacatctgttttaacaactcgcgttggttatttagtaaatgtaaaacaagttcatccacgaaatattttattacttacatttacacaaaaagcagctgaagaaatacgaagtcgtgttgcgaagttaccaggtatgaatcatgcagcaagtagctacgtagttgctggtacattccactctgttttcttaaaattacttcgtagtcaaggttataatcagcaaattttagcaaatgaaaaacataaacaaattatgataaagaaaatcttaaaagaattgcgtttaaaagacgattatgatgctgaaacgatgctcgcgatgatttcacttgagaaaaacaaattaaatcgtccgaaagatgtaaaagcgaaaacaccagtcgaacaagaatttaaagaagtatacgaacgttttgaagaggtaaaacaaagatacaattatattgatttcgatgacatcttattggaaacatattatatgttagaaaataatgctcctttactaactcaattacaacaacgttttcactatattgaagtagatgagtttcaagatacatcgtatgcacaatatgaaatcgtaaaattgttagccacgccaagaaataatttatttatcgcaggtgatgacgaccaggcgatatacggctggcgaggagcaagtcaccaaattattttatcttttccaaaagaatttgataacacaacaatcattgcactaaatacgaattatcgatccaatccctttatcgtcgggcttggaaatgaagttataaaattaaatcaagaacgttttgataaagagctatactctgttcgtgaggaaggtgtacaacctttttatgcaagacctgctacgactcttgatgaagcaaatcaaattttgcagcttattcaagaaaaagtagagagtggtgaacgtaactttaaagatttttgtttactgtatcgcacacattctgtaagtcgttcgttacttgatcagcttaccattcataaaatcccgtttattaaacacggagcgagccaatcattttatgaacattctttaattaagcctgtattagatcatttaagactcgtgattgagccgtttcgactagaatcactttcaaacatattgccgacgatgtatatcggacgtgatgattgtatttcatttattgaacgtgaacaatggaaatatggtgaggggcgcttcccttctcttcttcatttcttactattaaatccaagcttaaaaccttttcaagtgaaaaaggtaaatgagcgcatcgattttattaagtttattaaagaattagaaccgaaaaaagcattaaaagaaatcattcatggtaaaggaaaatatttagagtacttacaaaataacgatcgttcttcctttacaatgcataaagacatacaagaagaaatgttggaagaattaatggagtctgcaactcgtttcaccgatattccagcttatttacaatttatcgacgaggcgattcaaggtcaaaaagaaatggaagcattaaaaacaatgccgcaaaaagatgccgtttcacttatgtcaattcataacgcaaaaggccttgaatttccatgtgtctttttacttggagcgagtgatggaatcctgcctcatacttcttctttaaaagatgcaaatgatcgtgttacggaaacttctgaagcgttagaagaagaacgccgattactttatgttgccattacacgtgcgaaagaagaactttacatttcttctccgcaatttttcagaggaaagaaattagatatatctcgttttttatat

SEQ ID NO: 40191 - DNA, 963 bp, Bacillus thuringiensis
atgaaagcactttgtttcgaaacattcggagatgctgatgtacttcaatataaagaaatccctgatccaatcattaatccaaatgaaattcttatcctcacgaaagcaatcggtctaaatttcgcagatatttatagacgccgtggtgattatcacctcgctggtaaccctccttatatattaggttatgaaggcgctggtatcgttgaagaagtaggtgctaacgttactactatcaatcctggagaccgtattgcatttgctgacgttccattcgcaaatgcagaattagttgccgttccagcagaaaaagcaatcccgcttccagattcaatttcttttgaaacagccgcttctatcttattgcaaggtctaacggcacattatttaacgaaagatagctatcaaataaaacaaggtgatacagctttagtccatgctgcggctggtggcgttggtcaacttcttattcaaatgattaaactactaggcggaaaagtaatcggtcttacgtcatcaaccgaaaaaaccaaagtagccacgttagttggggctgatcacgtatttttatatactgaaaaatggcattcaaaagtacttgaaataacaaatggtactggagtaaatgttgtatatgaatcagtaggctctacactagagaaaagttttaacgctactaaaatcggtggtactgtcgtattttacggaatggccggtggtaatcctgcgcccattgatccacgtatgcttatggatacttcgaaaactttaactggcggagacctttggaacgtacttactacttttgaagaacgtaagcagcgctctactcaattatttgattggatcgctactggaaaattgaacattgcaagtcctactacattctctttacaagacggtgcccgtgcacatgaattattagagagcagaaaaagtactgggaagattttattgatccca

SEQ ID NO: 40192 - DNA, 1014 bp, Bacillus thuringiensis
ttgttaaaccaaaactttaataatgctttttacggaaaaagaattttaattactggacatactggttttaaaggttcttggttatccctatggttgaatgaattaggtgctactgtaatcggatattcattagattctaaaaataaaaatgataactttaacattactaaccttcaaaataatataattgatattcgtggagacattagagattttaataaattaaataacgtttttacagattataaacctgaaattgtattccatttagctgcccaacctctagttaagtattcatatgaatatcctagagaaacatacgaggtaaacgttgtaggaactatgaatgtactagaggcaattcgattacatgaatcagctaaaataggaattatggtgacaagtgacaagtgctatgaaaataaagaatggccttggggttatcgtgaaattgaccctatgggcggccatgacatatatagctcaagcaaaggatgctgcgaacttttaatttcttcctatcgtaattcttacttttcagaagaaaaattttctcaacataagaaaataattgcaagtgttcgagctggtaatgtaattggtggtggtgattggtcaatagatagaattattcccgattgtatacgagcattagaatcaaacaaaaagattattattagaaatcctactgctattagaccctggcaacatgtactagaacctttaagcggttatttactccttacagaaaaaattataaataatggtatccttttttcaggagcatggaacttcgggccatccctaagcaatattgtttcagtagaaaaattagtgacaagtttactagatatttggggctgcggggattggacagcagaaaatataggtccaataaattttcatgaagcaaatttactaaaccttgacattagcaaagcaaaattcaatcttaattggcagccaaaatggtccctacaacagactttagaaaatacaatagaatggtataaa

SEQ ID NO: 40193 - DNA, 732 bp, Bacillus thuringiensis
aagtataaacctaacacattaactatacgttctttcgataaattaaatttaaaaggttatgaatatatgaatgaaccatctagtcataaatgggcaattgtagttcatggatatagtggtagagcatcggaaatgacgaaatatattcgtaacttttatgaacaaggctataatgtcatagcaccagaccttcgtggacacggaaatagtgaaggggattatgttggtatgggttggcatgatcgtaaagatgttttaatttggattcaacaaatcttaaagaaagaccctaatgctgaaatagctctatttggtgtttcaatgggcggggcaactgtaatgatgacttcaggagaagatttaccttctaatgttaaagttattattgaagattgtggatattcaactgttattgatgaatttacttatcaactaaaagatttattccacttaccaaagtttcctgttatgaatgcggcaaatacggttactaaattaagagctgggtatgatttagaagaggcctcagctgtaaaacaagtagcgaaaagtaaaacacctatgctgttcattcatggggatgctgatacattcgttccttttgaaatgttagatgaagtatataatgctgcaaaagtagaaaaagagaaattaattgttccaggtgctggacatggggaagcggagaaagtagattcgaataaatattggaatactgtatggaagttcgta

SEQ ID NO: 40194 - DNA, 1077 bp, Bacillus thuringiensis
atgagagtgaaagagcaattgttaactttgagagcgtatgtgcctgggaaaaacattgaagaagtaaaaagagaatatggtttatcaaaaattgtgaaattagcatccaacgaaaatccattcggttgttcagcacgtgtgacagaagcattaacttctttagcgagccaatatgccctttatccagatggatatgcctttgaacttcggacaaaagtagcggaacatttaggtgtaaaagcagaacaactactatttggtagtggattagatgaagtcattcaaatgattagccgagcgttactacatgaaggaacaaacgttgtaatggcgaatcctacgttttcacaatatcatcaccatgctgttattgaaggagcagaagttcgtgaagtatcacttaaagatggtattcacgatttagatgcaatgctagagcaagtagatgagaaaacgaaaattgtctggatttgtaatccgaataatccaacaggtacatatgttgagaaacaaaaattactttcatttttagaatcagttcctaagtcggctctcgttattatggacgaagcatattatgaatacgcggaagcagaagactatccgcaaacattaccacttcttgaaaagtatgaaaatcttatggttttacgcacgttttcaaaagcatatggtttagctgcttttcgtatcggatatgcgattggggatgcgaagttaaacggacagctagaagtagctaggttaccattcaatacatcaactgtagcccaatctgtagcactcgctgcattagaagatcaagcctttttacaagattgtgtgcaaaagaatgctgaaggtttaaatcagtattatgcattttgtaaagaatataacgtattctattatccatcccaaacaaatttcattttcttaaaacttggtataccgggtaatgaagctttcgaacgattaatgaaaaaaggatatatcgttcgttctggtgctgcatttggtatcgatgatggtattcgtattactgtcggtttgaaggaagaaaatgatgaaattatagagttgctgaaagagcttgta

SEQ ID NO: 40195 - DNA, 1905 bp, Bacillus thuringiensis
gtttggtttccaacagaagagtacaaggaaaaaacacgtttatatggttggatgaaatcattgggatatgaagattatgaaactttttataataaatctattgaggaaacagcttggttttggggagaggcagaaaaagcagttggctatcaatggatgaaaccttatacagaagtattagatttagaaaatggtacaccgtttgcacagtggtataatggtggaacatgtaacgttgtagaatcagctttatcccgctggcttgcggatgaagagacgagaatacagccagcacttcagtatgaaggggaaaatggaacttcaaaatcatttacatatgaagagcttgataactgggtaagccgtgttgccaatggtttgaaacacgcgggtattgaaaaaggtgaccgtgtaacaatttatatgccaatgattccagaaacagttgttgcgatgctagctgtaatgaaaattggagcaattatttcaccaatattctcaggctttgcgtctgatgcagttatgacacgtgtgcaagcggcaggttcaaaaatgattattaccgcagatggattttcacgccgaggtaaaattgtttctttaaaagatgaagtagataaagcttgtgaacattgcccaactgttgaaaaagtggtaatcgttcgtcatgcaggaaatgattttacaccacataactatgacttttcgtggagtacgctagaaaaagaaaaaccattcatacatgccgaagaaatgcaaagcgatgatccattaatgctcatttatacatcaggaacgactggtaagccgaaaggaacagtacacacgcatgcaggatttcctttgaaagcagcctttgatgcaggatttggaatgaatattaaacaaggtgatcgtgtattatgggtaactgatatgggctggatgatggggccatttctattattcggttcactcattaatggagcaacgatggttatgtacgaaggtgttccagacttcccagaagcagaccggttatgggagacagttgataaatatgaaattactcatctaggtatttcgccaacgttaatccgagcattaatggcaaaaggtgatgagtatgtcaataaacattctttaaagagtttggaagtattcgcatcaacaggagaaccttggaatcctgatccatggatgtggctgtttgaaacagttggaaaaggaaatgttccaatctgtaactactcaggtggaactgaaatctctggtgggattttcggtaatgttcttattaagccaatcgcaccgattagttttaacgcatctttaccaggaatggcagctgtcgtactggatgatcaaggtaaaccaattcgagatgaagtcggagaattatgcttagagaaaccttgggtaggtatgacgaaaagcttctgggaagatgatgaacgttacgtgaacacatattggtcacgttttgaaaataaatgggtccacggtgactgggtcatttacgatggtgaacaatatatcatcacagggcgttcagacgatacgttaaatattgcaggtaaacgtattggacctgctgaatatgaatctattcttgtgaaacataacgatgtaattgaagctgctgcaattggtgtacctgacgaagtaaaaggtgaagtttgtcattgttttgtagtattaagagatcatgtaacattcacaggagaattaaagaaagaattaatgagtttagtaaactctcatattggaaaagcgttgtgtcctaaagatatccacgttgtagaagatttaccgaaaacacgtaactctaaagtaatgcgccgtgttattaaagcagcttacttaggaaaagagttaggtgatttatcatcgcttgtaaatcctgaagtagttccgtttattcag

SEQ ID NO: 40196 - DNA, 870 bp, Bacillus thuringiensis
ttgaaactacctaattttgctgtcattaaagaagtcgggccacgtgatggcttacaaaatgaaaaaaagattgttggcacaaaagataaagtaaaatggattcaactacttacagaagcaggattgtcgtatgttgaagtttcctcattcgttcacccaaaatgggtccctgcattagcggatgcaaatgatgtattttctgagctaaaaagggatccaaatgttacatatgctgcgcttgttccgaatcaaaatggtttggaacgagcttttttgcaaaatgtagatgaggtgaatgtttttttatcagcaagtgaatctcataataaaagtaatattaataaatcgattaaagaagcattagttgtaattgaagatataacaaaacaggcattattcgaagggaaaaaggtaagaggctatgtttctactgtatttggatgtccttatgaaggggatataagtgtcgcagcagttgacgaattatgtaatcaactattttcatacggcatttatgaagtttctcttggggatacaatcggtgtagcgaatccattacaagtagaacaagtattagaacatctattaaagaagtatgatgcttcgcagtttgccatgcattttcataatacgtatggaatggctctagcgaatgtagttaaatcattagaatacggtattacaacgtttgatagttcttgtggtggactcgggggctgcccttatgcaccaggagcatcaggtaatgttgccactgatgacctagtacatatgctccataaattaggagtccaaacgaatatagacgaagaaaagttattgagagctagtcaatttattcaaagtaagttgaatatccaattaccgagt

SEQ ID NO: 40197 - DNA, 885 bp, Bacillus thuringiensis
atgagtttactaattaaagatttaacaaagaaatttgacgagcatgttgcagtggataatttgaatatcgagataccaaaaggtgaaatatttggattcttgggcgggaatggagcaggtaaaacgactacatttcgaatgatacttggacttttatcgaaatcaagtgggaccatttcatggaatggtaaacctataaattatggtgttacagataaaattgggtatttaccggaagaacgtggtctttatgcgaaaatgactgtcaaagaacaagttaacttttttgcaaaactaaagaacatgaaaagtaaagatgcagaaaaagaacttcactattggctggagcgttttaatattactgagcatctgaacaaaaaggtaggagaactttctaaagggaatcagcaaaaaatccagctgataacagcgattatacataagcctgaactcttaattttagatgaaccatttagtggtttagacccagtaaatgttgaaatgttaaaagacgctgttcttgatatgcaaaaacaagggtcgtcaattctttttagttcacatcgtatggaacatgtggaagagttatgccaacacatttgtattatgcacaaaggtgtacctgttgttcagggtgacattgccaaaattaaaagtgattttggtaaaaagaacgttgtaatcgttggcgatcatgactttgaccatttgaaagaaataaaaggtgtagaaagtatgaagaaacgtaaaaatgcagttactcttaaaatttcatatgaagaagtgtcacatgttttatttaaagagataacaaaattagggtatgttaaaaagtttgcagtagaagagcctacattaaatgatatctttattgcgaaagtaggt

SEQ ID NO: 40198 - DNA, 1296 bp, Bacillus thuringiensis
atgattagtcgttatacacgcccagaaatgggtgcaatttggacggaagagaacaaatttaaagcatggttagaagttgagattttagcttgtgaagcatgggctgagcttggcgatattccaaaagaagatgttaagaaaattcgtgagcatgcatcatttgatattgatcgtatttatgaaattgaaaaagaaacacgtcatgacgtagttgcattcactcgtgctgtatcagaaacgccagcattaggtgaggaacgtaaatgggttcattacggtttaacatctacagacgtagtggatacagcattatcttacatcttaaaacaagcgaatgaaattatattaaaagacttagagaactttgtaagcattttagctaacaaagcgaaagagcataaatacacaatcatgatgggaagaacacatggtgttcatgcagaaccaacaacatttggtttaaaacttggtctttggtatgaagaaatgaaacgtaacgtagagcgtttcaaacaagctgctgatacagttcgtgttggtaaactatctggtgcggttggtacatatgcaaatatcgatccattcgtagaaaaatatgtttgtgaaaacttaggattagaagcagcaccaatttcaacacaaacattgcaacgtgatcgtcacgcacactacatgtcaacacttgcactaattgcaacatctatcgaaaagatggcagttgagattcgtggtttacaaaagagtgaaacacgtgaagttgaagaagctttcgcaaaaggtcaaaaaggttcttctgcaatgccacataaacgtaatccaattggttctgaaaatatgactggtttagctcgtgttatccgcggttatatgatgacggcttacgaaaatgttccattatggcatgagcgtgacatttctcactcttcggcagaacgcgtaattttaccagatgctacaatcgcgttaaattacatgttaaatcgctttggtaatatcgttaaaaacttaactgtatacccagagaatatgaaacgcaatatgacaagaacatacggcttaatttattctcagcgcgtaatgcttacactaatcgacaaaggtatggtacgtgaagaagcttatgatatcgtacagcctaaagcgatggaagcttgggaaacacaagtacaatttaaagagcttgtagaagctgatgagcgtattacaagcaagttaacacaagaagaaattaatgaatgcttcaactatgagcatcatatgcaacacgttgatacaatctttgaacgccttggatta

SEQ ID NO: 40199 - DNA, 1359 bp, Bacillus thuringiensis
agtatttcctctattgtaagtaggcaaaaggaatattttttaaaagggcatacgagaagcatcgaaatgagaaagaataatttgaagaagctttatgaaggcattcagcgttttgaagaagaaatatttcaggcattgaaattagatttaaataagtcagttcacgagtcgtttacaacggaagttggatatgtattaaaagagatttcctttcaattgaaacatatgtcatcgtggagtaaaccgaaacgagttcgaacagcacttactcattttggatcaaaaggaaaagtagtgccagaaccgtatggtgtgacgcttattattgcaccgtggaactatccttttcaattagcaattgcaccacttgtaggagcactggcagctggaaatacaatcgttttaaagccgtcagagttaacgccaagcgtttcaaaagtgcttaagagaatgttagatgaatcattcccggaagagcttgtagcggtagtagaaggtggcgttgaagagagtacatctttgctgaaggaaccgtttgattatattttctttactggtagtgttggcgttggaaaagttgtaatggaagcagcagcgaaacagttgacgccgctcactttagaacttggcgggaaaagtccttgtattgtacataaagatgcaaagatagagatgacagcaagaagaattgtttggggaaagtttttaaatgcagggcagacgtgtgtagcgcctgattatatgtacgtgcattcttccgtgaaagaaaagctaattgaggcactgcgacatgaaattacagagcagtatagtaaagaacctttacaaaatgaaaattacgtgcgtattgtaagtgagcgtcattttgaacgattatgtggattcttacaagatggtcaagtcgtaattggtggaaactatgagaaagatactttacatattgaaccgacagtactagcggatattacatggcaagatgctgttatggaagatgaaatttttggtccgattttaccaatcatagagtacgacaatatagaaaatgtaattggcacaatccagcaacatccgaagccgttagcgttatatgtattttctgaagataaagaagtacaaaagaaagtgacgagtaatatttcatatggtggaggctgtattaatgatgttgtctatcaccatgctacgccatatttaccttttgggggtgttggaagtagtggattagggggttatcatgggaaagaaagttttcggactttttcacattataaaagcattttagcccaatctacagcattcgacatgaaaattcgttactcttctacaaaaagtgctttaaaattcatacgaaagttgtta

SEQ ID NO: 40200 - DNA, 753 bp, Bacillus thuringiensis
ttaaaagggaaagtagcgttagttacaggagcaagccgaggaattggacgagcgatcgctaaacgtttagcaaatgacggtgcattggttgctgttcattacggtaatcgaaaagatgacgctgaagaaactgttcatgaaattcgatcagatggtggccaagctttttctatcggcgcaaatttagaatccttacacggtgtagaaaacctttataacgctttagatactgaattacaaaagcgcactggtgaaacacaatttgatattttaataaacaatgctggcattggtcctggtgcttttattgaagaaacgactgaacaattttttgatagaatgttttcagtaaatgcaaaagcaccattctttatcattcaacaagcactgccacgtttacgtgacaatagccgaattattaatatttcatccgctgccacccgcatttctttacctgattttgttgcatatagtatgacgaaaggcgctattaatacaatgacttttacgctagcaaaacagcttggagcacgaggaataacggtgaatgcaatacttccaggatttattaaaacagatatgaatgcagaactcttgagcgacccgatgatgaagcagtacgctactactatttccgctttcaatcgcttaggtgaagtagaagacattgccgatactgctgcattccttgcttctccagacagccgctgggtaactggacaattaattgatgtgagcggaggatcttgttta

SEQ ID NO: 40201 - DNA, 930 bp, Bacillus thuringiensis
gtgaacgtgggcattttagggatcggaagatatgtgccagaaaaagtagtcacaaatcacgatttagaaaaaataatggatacatccgatgaatggattcgtacgagaacgggaattgcagaaagacgcattgccgatgatacaatagatacttcatatatggccgtagaggctgcaaaaaaagcacttgaagatgcaggggttagcggagaagatatcgatcttattttagtggcgacagtaacaccagatcgtgcgtttccagcagtagcttgtgtcattcaagaagcgattggagcgaaacatgcagctgcaatggatgtaggtgcagcatgcgctggttttatgtacggaatgattacagcgcagcaatttattcaaacggggacttataaaaacgtattagtagttggtagtgataagctatctaaaattgtagactggaatgatcgaaatacagcggtattatttggagacggagccggtgctatcgtaatgggagcagtttcagaaggaagaggcgttctatctttcgaattaggagcagacggaagcggcggtaagcatctatatcaagacgagtatgttatgatgaatggcagagaagtctttaaatttgccgttcgtcaacttggtgaatcttgtcttcgcgtgctggataaggctggtcttacaaaagaggatgtggatttcttagtaccgcatcaagcgaatattcgtattatggaatctgcaagagagagattaaatttaccacaagaaaaaatgagtatgacaattgaaaagtttggtaatacatcagcttcttcaattccaattgcaatggtagaggaattgcaaaatggacgtattcaagatggtgatttaattatacttgttggttttggtggcggattaacatggggagcagtcgctcttcgttggggtaaa

SEQ ID NO: 40202 - DNA, 234 bp, Bacillus thuringiensis
aaaaatggtggatatcttattgatgttcgagagcctaatgaactaaaacagggaatgattaaagactctattaatattccgttagatgaattacgtgatcgattggatgaagtgccaatggacaaagaaatatatatcacttgccaacttggtatgagagggtatgttgcagcgcgcatgttaatggaaaaaggatataaggtaaagaacttagatggtggctttaaattatac

SEQ ID NO: 40203 - DNA, 780 bp, Bacillus thuringiensis
gtccgtataatcgattgtcgttttgatttagcgaatcctaattggggtagagaaaagtatgaagaaggacatattcctcatgcgttatattttgatttgaatttagatttatcaagtcctatagcagaacatggtggccgccatcctttaccaaatattgaggagtttgcagacaagctttcgaaggctggtattgatgaacatacgacagtaattgcgtatgacagtcaagccggtgcaaatgctgctcgtttatggtggttatgtaactatgtaggacatgagaaagtatatatattagatggtggtttccaggcttggaaagagaatggactaccgacaacagcggaaattcctgttgctatacgaaaaacattcaaagctaatatacaagatcatatgcttgtaacgatggaaacggtcagagagaatatccgtgcaggtgcggatgttacattaattgattcaagagagcccaaacgttatgctggtgtagaggaacttgtcgatcataaagcaggacatattccaacagcggtaaaccatttttggaaggatggaatgttgcaatcaggacaatttaagaataaagctgggcaacaagaacgattccaaaatctgtcgaaagataaggaaaccattgtatattgtggttctggtgttacggcatgtccaaatatcgtcgcattaaaattggctggattccaaaatgttaaattgtatgcaggtagctggagtgattggatctcttatccagaaaatcaaattgcaaaagaagaa

SEQ ID NO: 40204 - DNA, 1272 bp, Bacillus thuringiensis
atcacattgacgacaggtgaaaaaattactgtaactaatggtgttatgaatgtaccaaacaatccgattattccatttatcgagggagatggaattggtcctgatatttgggcggctgcatctcgcgtactagaagcagcagttgaaaaagcttatgatggtgagaagaaaatcgtttggaaagaagtgcttgcaggggaaaaagcattcaaccaaacaggcgagtggttaccagaagaaactttaaacttaattcgtgaatatttaatcgcgattaaaggtccacttacaactccagttggcggtggtattcgttctctaaacgtagcacttcgtcaagaattagatttatatgtatgtctacgtccagttcgttattttgaaggtgttccttcacctgtaaaacgtccggaagatactgatatggttattttccgtgaaaatacagaagacatttatgctggaattgaatatgcacaaggatctccagaagcagaaaaagttcttgctttcttaaaagaagcaatgggtgttaataaaatccgcttcccagaaacatctggtattggtattaagccgatttcagaagaagggacaaagcgtcttgttcgtgctgcaattcaatatgcaattaacgaaaaacgctcttctgttacattagttcataaaggaaacattatgaaatttacagaaggtgctttcaaaaactggggttacgaagtagcggaacaagaattcggcgacaaagtatttacttgggctgaatacgatcgtatcgttgaaaaagatggtaaagatgcagcgaataaagcgatggcagacgctgaagtggctggaaaaatcatcgtaaaagattctattgcagacatcttcttacaacaaattttaactcgtccacgtgagttcgatgttgttgcaacaatgaacttaaatggtgactatatctctgatgcacttgctgcacaagtaggtggaattggtattgcacctggtgcaaacattaactatgtgactggacatgctatctttgaagctacacacggtacagctccaaaatatgcaggtttagataaagtaaacccatcttctgttcttctttcaggtgtattattattagaacacttaggatggaacgaagctgcgaaattagtaactgcttctgttgagaaaacaattgcttcaaaagtagtaacttatgatttcgcacgcttaatggaaggtgcaacagaagtgaaatgttctgagttcgctaatgaacttattaaaaacatg

SEQ ID NO: 40205 - DNA, 936 bp, Bacillus thuringiensis
atgacaatcaaacgcaagaaggtttcagtcatcggtgcaggatttacaggagcaacaacttttttcttattagcacaaaaagaactggcagatgttgtattagtggacattccacaactggaaaatccaacaaaagggaaagcgttagatatgttagaagcgagcccagtacaaggttttgatgctaacattattggaacatctgattacgcagatactgctgattctgacgttgtcgttattacagcaggtattgcacgtaagcctggtatgagccgtgatgacttagtagcaacaaactctaaaattatgaaaagtattacgcgcgacattgcaaaacattcaccaaatgcaattattgttgtgttaacaaatccagttgatgcaatgacatattctgtatttaaagaagcaggattcccgaaagagcgtgttatcggtcaatcgggtgtattagatacagctcgtttccgtacattcatcgcacaagaattaaatctttctgtaaaagatattacaggatttgttcttggtggacacggtgacgacatggtacctcttgtgcgttattcatatgcaggcggtattccgttagaaacgttaattccgaaagagcgtttagaagcaatcgtagaacgtacacgtaaaggtggcggtgagattgtaggcttattaggaaacggtagtgcatattacgcaccagcagcttctttagttgaaatgacagaagcaatcttaaaagatcaacgccgtgtattaccggctattgcgtaccttgaaggtgagtatggttatagtgacctttacttaggggtaccagtaattctaggtggtaacggaattgaaaaaattattgaattagaacttcttgcagatgaaaaagaagcgttagatcgctctgtagaatctgtacgtaacgtaatgaaagttcttgtt

SEQ ID NO: 40206 - DNA, 1002 bp, Bacillus thuringiensis
atgacaaaaatcacagtagtaggagcaggtagctggggaacagcgttagcgatggtattagctgacaatggacatgatgtacgtatttggggaaatcgcccagaacttatggatgaaattaatacgaaacatgagaatagtcgatatctcccaggcattacattgccaagcacaatcgtagcctactcttctttagaagaagcattagtagatgtaaatacagtactgttagtagtaccaacgaaagcgtacagagatgtattacaagagatgaaagaaattgttactgaaccaattacttggattcatgcgagcaaaggaattgaacctggtacgtcaaaacgtatttcggaagtgattgaggaagaaattccagagcacttaattaaagatgttgttgtactgtctggaccgagtcatgctgaagaagtcggtttacgacaagcgacaacagttacgtctgcagcaaagcgtatggaagcggctgaggaagtacaagatttatttatgaatagttatttccgtgtatacacaaatccagatatcgttggagttgaacttggtggtgcgttaaaaaatattatcgcattagctgctggtataactgatggtcttggattaggtgataatgcaaaggcggcattgatgacacgtggtttaacagagattgctcgtttaggaagaaaaatgggcgggaatccgttaacgtttgctggtctaactggtatgggagacttaattgtaacgtgtacaagtgttcatagccgaaattggcgcgctggaaatatgcttggaaaaggacactctttagaagaagtgttagaaagcatgggtatggttgtggaaggtgtaagaacaacgaaagctgctcatgaattggcagagaaaatggaagttgaaatgccgattacagctgctttatatgacgtgctgttcaatgggaataacgtaaaagatgcggtaggctcattgatggggcgtgttcgaaaacatgaagtggaa

SEQ ID NO: 40207 - DNA, 903 bp, Bacillus thuringiensis
gcaaagtttattgatcgtgaagtgacgaaatggagtgagatgattaaagattgggaggaaggtgtggaaatattcggtgctgccttaattggagcacccctttctaaaccgtctattagtcattcaggagcgagttttgcgccaaaaacaattcgtgcgatgttagatgcatatagcacatatgcaattacagaagaacacgatatgaaagaaagtgtcttatatgattgcggcgatattacgatgcatgtgacggatataaaagaaagtcataaacgaattgcgaaaacagttgggcatgtaacgaaagtaaacccgaacgtgataccaatcgttcttggcggtgaccactcgattagttttccgagtataacaggttttgcaaacagtaaaggaaaggtcggaattattcaatttgatgctcatcatgatttacgtaatttagatgatggaggcccgtcaaatggtacaccattccgtagtttactagaaaatgatgtcattactggaaaacaacttgttcaaattggaattcgtaatttttctaatgcacgtgcgtaccatgaatatgcaatagagcatggtgtaacagtgtatacaatgaaagacgtacgagagcgagaaataaaagatattatcacggaaagtattgaagtattaagaaatcaaggtgtgacttctatttatatttctcttgatatggatgtgctagaccaagcgtttgcaccaggttgtccagcaattgggcctggtgggatggatagtacgactttactagatgcgattgaattccttggtaaagaatcgctcgttcaagggatggatatagtagagattgatccaactcttgatttcagagatatgacgagtagagtagcagcgcaagtgattatgagttttctt

SEQ ID NO: 40208 - DNA, 1086 bp, Bacillus thuringiensis
gcacaaatggaggacttttttccagtacgtgatgtagatcatttggaattttacgtagggaatgcaaagcaatcgagttattatcttgcgagagcgttcggattcaaaattgtagcttactctggattagaaactggaaaccgtgaaaaggtatcttatgttcttgtgcaaaaaaatatgcgtttcgttgtgtctggagctttaagtagtgaaaatcgtattgcagagtttgtaaagactcatggtgatggcgtgaaggatgtggcactacttgttgatgatgttgataaagcatactcagaagcagtgaaacgtggtgccgtcgcaattgctccaccgcaggaattaacagatgaggacggtacattgaaaaaagcagttattggtacgtatggtgatacaattcatacgcttgtagagcgtaaaaattataaaggggcatttatgccaggattccaaaaggtagaatttaatattccatttgaggagtctggtttaattgctgttgatcatgtagttggtaatgttgaaaaaatggaagagtgggttagttattacgagaatgttatgggctttaaacaaatgattcattttgatgatgacgatattagtacagagtattcggcgttaatgtcaaaagttatgacgaatggaagtcgtattaagtttcctattaacgaaccagcagacggaaagagaaagtcacaaattcaagagtatctagaattctataatggagctggtgtacaacatcttgctttattaacaagtgatattgttaaaacagttgaagcgcttcgtgcaaatggggtggagtttttagatacacctgatacttattacgatgagctaactgcacgagttggaaaaatcgatgaagaaattgataagttaaaagaattaaagatcttagtagatcgtgatgatgaaggttacttactacaaatctttacgaaaccaattgtagatcgtccgactttatttattgaaatcattcaacgtaaaggttctcgtggatttggtgaaggaaactttaaagcgttattcgaatcaattgaaagagaacaagagcgtcgcggaaactta

SEQ ID NO: 40209 - DNA, 1575 bp, Bacillus thuringiensis
tggaaaaaaattattcctgccgttgctgttttaagcaccattactttttcaagcgtatttgccgctcccccatctcagaatccagctgaacaaaaccgctacatagacgtacaaatgcttggtattaatgatttccatggacaactagatactgttaaaaaaatcaataataaagaagctggtggcgctgattacttagctacttatttaaaagaacgtaaaaaacaaaaccctaatacacttctcgtacatgctggtgatatcgtcggagctagtccaccagtttcagcattattacaagatgaaccgacaattgaatttttaaatgacttaaaatttgatgtcggtacaatcggaaaccatgaatttgatgaaggtattgatgaaatgcaacgcctcatttacggtggatatcatgaaaaaacagggaatttcaaaggggctaacttcccctatgtagctgctaacttctacaacaaatcaactggccgcttatttttaccaccgtttactgtaaaaatggtagatggtgttcctgtaggattcattggggttgttacaactgatacaccaaatgtcgttatgcctacgatgcttaacaatgtacaaattactgatgaagtagaagcaattaataaatcaacacaacaattaaaacgtctcggcgttaaatctatcgtcgttcttgctcatgtcggtggaacaaccgatgagtctggggtaacaaatggcgatcttactcgaattgcaaatgaaacagacccagaagttgatgttattttcggtggacatagtcatacgtatgtaaatggtacagtaaataataaactaattgtccaagcaaattcatacggaacggctttctcagacgtggatgtaacaattgatcgtaaaacaaaggatattgtaaagaaaaaagctgaagttgttacaccctatcatgaaggtgtagaacctgataaacaagtaaagaaaaaactagatcaatataaagaaaaaattgcaccacttgtaaatgaagtagtcggaaaatctacagcacctatcgaccgtaaacaaaatgatgctggtgagtccactcttggaaatttagttgccgatgctcagcgtcaaacgatgcaaactcaaatcgccctcatgaatcctggtggcattcgtaatgacttagatgctggtgatattacgtggggtgagttatacggcattcaaccttttggaaatcaattaattaaagtagatttaacaggtcaagacattcgcgatattttaaatcagcaatggcaaaaaggaacaacaagaatgcttcaaatttcaggtattcaatatacgtgggatgcaaataaaccaaacggtgaaaaagttacaaatatacgtttaacaaacggagaagaattatctccatctaaaatgtatagcgtagttgcaaatgccttcttagcttctggcggtgacggattcgtatcatttaaaaatggtaaaaatgcagaaactggtccaaacgactttgaagcgttagtcgattacgtaaaacaattaaaagaaccaattcagccagttattgatggaagaattcaa

SEQ ID NO: 40210 - DNA, 573 bp, Bacillus thuringiensis
atgaaagtattacaagaaaagattttgaacgaaggaaaggttttatctggtgacgtattaaaggtagatgcttttttaaatcatcaaattgatccagtacttatgcaagaaatcggaaaagaatttgctaaacgttttaaagaagagaacattacaaaaatcgtgacgattgaatcttcaggcattgcaccagcagttatggctgcattagagcttggtgtaaaagtaatttttgcacgaaaacgtaaatcgttaacgttacaagataatatgtacgttgcaaacgtatattcatttacaaaacaagaaacaaatgaaatttcattatctcgaaatcatatcgatgaaaatgatcgtgtattaatcatcgatgactttttagcaaatggtcaggctgctttaggtttaatgagtttagtagagcaagccggagcgagtattgcaggaattggaattgttattgaaaaagcatttcaagatggaggaaagaagcttcgtgaacaaggcgttcgtgttgaatcactagcagaaattgcatcacttgataacggcacagttacatttgtacagcaa

SEQ ID NO: 40211 - DNA, 1665 bp, Bacillus thuringiensis
aaggtggaaaaaccatggttgaaaagttatccagaggaaattccgagtacgatttcttatgatattcagccgcttcatagatatgtagaacagatggcttctcgctacccagaaaagaaagcgcttcactttttagggaaggatattacgttttcggacttccatgataaggtgaagaggtttgcaaattatcttcaaaagctcggtgtggaaaagggtgatcgagttgctattatgttgccgaattgtccgcaagctgtaattggttattacggcacattacttgcgggaggtatcgtagtacaaacaaatccactgtatacagagagagaattagaatatcagcttcatgactcgggagcaaaagtaattctttgtctcgatttagtgtttccaagagtaacgaatgttcaatctgctacaaaaattgagcatattatcgtaactcgtattgcggactttttaccattccctaaaaatctattgtatccatttgtgcagaaaaaacagtcaaatttagttgtgaaagtatcagagagtgaaacgattcatctttggaattcagtagaaaaagaagtgaatacggatgttgaggagccttgtgatcctgaaaatgatctagctcttttacagtacacaggaggaacaaccggatttccgaaaggcgttatgttaacgcataaaaacctcgtctctaacacgttaatgggagttcaatggttatataattgcaaagaaggagaagaagtcgttcttggggttcttccatttttccacgtgtacggcatgacggctgttatgaatttgagtgttatgcaaggatacaaaatggtccttattccaaagtttgatatgaaaatggtttttgaagcgattaagaagcataaagtgacactatttccaggggcaccaactatttatatcgctcttttaaatagcccacttttaaaagaatacgatatttcttctattcgtgcttgtattagtggatcagcaccactgccagtagaagtacaggaaaagttcgaaacagttacaggtggtaaactagtagagggatatggtttaacagaatcctctccagttacacatagtaattttttatgggaaaagcgagtgccaggtagcattggagttccgtggccagatacagaagcaatcattatgtcacttgagactggtgaggcattaccgccaggagaaataggggaaattgtagtgaaaggtcctcaaattatgaaaggatactggaataagccagaggaaacagcggctgtattgcaagatggctggctccatacaggtgatgttggctacatggatgaagatggatttttctatgtaaaagatcgcaagaaagatatgattgtcgcgagtggatttaatgtgtatcctcgtgaagttgaagaagtattatatgagcatgaaaaagtgcaagaagtagtgacaattggagttccagatccgtaccgaggagagacagttaaagcatttgttgtgttaaaagaaggtacggagtgctctgaggaagaattaaatcagtttgcacgtaaatatttagcggcttataaagtgccgaaagtatatgagtttagagatgaattgccgaaaacgacagtagggaaaattttgcgccgtgttctaatagatgaagagaagagaaag

SEQ ID NO: 40212 - DNA, 1302 bp, Bacillus thuringiensis
atgaatattgctattttcggaacaggttatgtagggctagtaacaggggtttgtttatcggatattggacatcgtgtaacttgtattgatattaatgagaataaagttgcgaaaatgaaagaaggtatttcaccaatatatgaacctggtttagatgagttgatgagtaaaaatattaatgataatagattgttatttacaaccgattgtcgccaagggattgaagaagcagatgttatttatatagcagtaggtacgccacaacaaacagatggttcggctaatttacaatatattgagcaagttgctttagatattgctaataatctaaaaaaagattcgattgtagtaattaaaagtacggtcccagttggtacaaatgatcatgttaaaaatttaattcagcaaaatttgaaagcagatgtgaaaatcaacatggtatcgaatccggaatttttaagagagggttctgcaattcatgatagtttctatggagatcgtatagttattggggctgatgatgctaaaactgctgatgttatggaagaagtgaataaaccttttaatgttcctgtttttaaaacaacaattagaagttcagaaatgattaaatatgcagcaaatgctttcttagctacaaaaattagctttattaatgaaattgctaatatttgcgaaaagttaggtgcggatgtagagcatgtagctaatggtatgggattagataaaaggattggtacacaatttttaaaagcaggtatcggatatgggggctcttgtttcccaaaagatacacatgctttaatacaaattgctggtaatgtcgagcatgattttgatctgttaaaatcagttattacagtaaataataatcagcaggcatcgctcgttgaaaaaataaaaaatgtattaggtgatatggaaggaaaacaagtggctatgcttggtttagcttttaaaccaaatactgatgatatgagagaagcggcatctattgttattgcaaatgatttagtaaaaatgggtgcgaaggtcgtagcttatgatccaattgctactgaaaatgcaaagaaagtattacctaatgaggttcaatatgtgccctctgttgcaggagcagttaaaaatgccgatgtaacacttattgtaactgaatgggatgatataaaagaattccctattgaacagtatatcaaattaatgaaacaacctattatttttgatggtcgtaattgccatggtttagaatatgtgaaaaagtttaatgtagactattattccgtaggaagaccagctgtagtt

SEQ ID NO: 40213 - DNA, 1056 bp, Bacillus thuringiensis
atgtataaaggactattaaaacaatatgcgtcttatttaccggtgaatgaaaatacacctgatgtcagcttaatggaaggaaacacaccacttattccattattaaatatatcaaaacaattagggattcagctatatggtaagtacgaaggagcgaatccgacaggttcttttaaagatcgtggtatggtcatggcagttgctaaggcgaaagaagaaggttcagaagcaatcatttgtgcatcaacaggtaatacatcagcgtcagctgcagcatatgcggcacgtcttgggatgaaatgcattatcgtaataccagaaggaaagattgcacatggaaaattagcgcaagcggtcgcttatggagctgaaattatttcaatagaagggaatttcgatgatgcgcttaaggctgtaagaaatattgctgcagaagagccgattacgttagtaaactcagtaaatccttatcgaattgaagggcaaaaaacagcagcgtttgaaatttgtgaccaattgcaaaatgcaccagatgttctagctatccctgttgggaatgcagggaatattacagcgtattggaaaggcttctgtgaatatgagaaagaaaaaggttataaaaagccaagaattcatggctttgaagcggaaggagcagctgcaattgtaaaagggcatgtaattgaagagcctgaaacaattgcaacagcgattcgcatcggtaacccagcaagttggtcgtatgcagtagaggctgccgagcagtctcgtggtgaaatagatatggtatcagatgaagaaattttacatgcgtataggttattagcaaaaactgaaggagttttcgctgaaccaggatcaaatgcttcattagccggcgtaattaaacatgttcaatctgggaaaatcaaaaagggagaaacagttgttgcggtattaactggaaatggtttgaaggatcctgatatcgctatttcttcaaatcaactagacatcgcaagtgtgtcaaatgatatagaacaaattaaagatcatattaaaggggtgattatgtcg

SEQ ID NO: 40214 - DNA, 1263 bp, Bacillus thuringiensis
ataaatgttggggtattaggtttaggtacggtcggaagtggtgttgttcatattttgaaagaacattataaaaaaatcgcacttgatacaggatacgaagtgaaagtgaaaacagtcgttgtacgtgatttggaaaaagaacgcgatgtttgtattgatggaattgcagtaacaagtcatgcagatgaagttctaaatgattcaaatattgatattgtagtagaggtaatgggcgtaattgaagaagcaaatcagcatattgttaaggctttacgaaataaaaaacatgtcgtaacagcaaataaagatttaatggctgtatatggtgcagagcttcttcaactggcgaacgataatgattgtgatttatgttacgaagcgagtgtagcgggcggtattccagtgttaagaggactaactgatgggttagcatcagatcaaattgaaaaaataatgggaattgtaaatggtacaacaaattatatgttaacaaaaatgagtcaaaatggatggtcttatgaagaggctttacaggaagcacaaaaattaggctttgcagaatcggatccgacagcagatgtagatggactagatgcggcgagaaaagtagcaattcttgcaaacttaggtttttcgatgaatgtttcattagatgatgtgcaagtaagagggattcgaaaggtcgaaaaagaagatttacaaatggctgaaaagttaggatttactatgaagttaattggtaaagctgaaaaacaaggaccagccattcatttaagtgtagaaccgacgcttttaccgagccagcatccattatcaaatgtgaataatgaatttaatgcggtgtatgtccatggccaagcggtaggagaagtgatgttttatggacccggagctgggaagttaccgactggttctgctgtagtaagtgatattatttcaatcgttaaaaatatgaatcaagttccgaaaaataaaagtgcgttaaaagaaccagttccttatgaattacaaggtgatgaagaagtagtttcgaaatatttcttacgcatttcattacaagatgagcctgggatgttacaaaaaataacagaatgtttcgttaattattctgtaagtttaaaagaggttattcaattacctttaaaccgtgaactggcagaagtcgttgttgtgacacatcgaacttccaagtatcaatttgaacgagttttagaagcgatagaagctgtcgcaagtgaaataaacagttactacattattgag

SEQ ID NO: 40215 - DNA, 1455 bp, Bacillus thuringiensis
atgtataacactgaaatggatgaagcgttaaaagttatagataaaggattgaagaagacgataagcccaaaacagattattgtagtgggagctggtatggctgggttagtttcagcatctttattaaaggctgcaggacatgatgtgaaaatttttgaagcaaataaccgggtaggtggccgtatagaaacagtgagaatggaagataccggattatatttagatgttggagcaatgagaattccgtattcgcatacattaacgatggcatatataagaaaatttgggctacaggtgagtccttttattaataggaatgagacggatattatatacgtaaatggacggaaaacgacgttaaaacaatatgaaaaagatccaagtattctaagatatcctgtggaaatgaatgaagttggaaaaacgtcagaggaattattattgttagcggtacagcccattataaattttataaaaaagaacccagaaaaaaattgggatattgttgtaaaggattttgggagatactctactggacaatttttaaagtatcatccttatcagtataatacttacttttcgccagtaacaattgagatgattggtgttttattagatttagaaggttttttggaacggtcgtttgtagagactttacgctttctatacattatgcaagaggagagcggattttgtgaaattgtgggcgggaatgatagattgccaaagtcatttttaccgcaattagaagagaatattatatataatcaaaaattaatgaagttacatcaacacgataatggtgtgacagctttctatcggaacgaggaaacttttgaatatagtagtattacaggagatttagttattgttaccattccgttttcgacaatgcgttttgtagaagtagatccgtttgattctatatctcatgaaaaatggaaagcaattcgtgaattacattatatgcctgcgacgaaaataggaattcaatttaaaagccgattttgggaagaacaaggacaattaggtggcagaattataacagatttgccaattcgttatgcctattatccaaattatggaattggggagaaaggaccggctatgatgttaggtagctatacatggtcttatgacgcgttgttatgggatggtttatcaaaaggggatcgtatttattacgcattacacaacttagcaacaatattaggtggtcaagtgtatgatgagttcatatctggaatttcaaaaagctggacattggatccgtatgcgcttggaggatttgcactttttcaagcaggtcaagaatctgagctgcaaccagcgattgtcaaaccagaggggagaatattcttcgctggagatcatacaacgctatatcacggatggattcaaggtgcgattgaatctggaattcgtgtagcggtggaagtgaatgagtaaaaggtt

SEQ ID NO: 40216 - DNA, 1170 bp, Bacillus thuringiensis
acagaatcaaaccgctacatagatgtacaaatgctcggtattaacgattttcatgggcaactagacactgtaaaaaaaattaacaataaagatgcagggggaattgagtacttaggggcttatttacgtgatcgtgaaaaacaaaatccgaatacattaaaggtacatgctggagatgttgttggagcaagtactcctgtttcagcattattacaagacgaacctacgattgaatttctaaatgatttgaaattcgatgttggaacgatagggaatcatgaatttgatgaaggtgttgaagaaatgaaccgccttatttatggtggataccatgagaaaacagggaattttaaaggagcaaaattcccatatgttgctgcaaatttctataataaatccaccggtcgtttatttttaccaccattcactataaaaaaggtacaaggagttcctgttggatttatcggagtcgtaacaacggatgttcctaaccttgttatgcctactatgctaaagaatgtagaaattacagatgaagttgaagctattaacaaatccgtaaagcaattaaaaaaactaggcgttaaatctatcgttgttcttgcacataacggaggtataacagatgggaacggcgtaacaaatggtgatatcgtccgattagcaaatgagactgatccagaagtcgatgttatttttggtggccatagccacacttatgtaaatggaactgttaataataaacttgtcgtacaagcaaattcatatggtatggcttttgctgatgttgatgtaaagattgatcgtaaaacacaagatattgttgagaaaaaagcagaaattgttacaacttatcatgaaggcatagagcctgataaaaaaataaagaagaagatggagaaatatcaagcaaaaatcgcacctcttgttaatgaagttgtaggtaagtctattgcgccactagatcgcaaactcaatacggctggtgaatctactcttggaaatttaagtgctgatgcccagcgtacaacaatgcaatcccaaattgcacttatgaatcctggtggtattcgtaatgacttagatgctggtgatattacaatgggagagatatatggtattcaaccattcggaaatcaattaataaaagtaaatttaacaggtcaagac

SEQ ID NO: 40217 - DNA, 2427 bp, Bacillus thuringiensis
atgatgtttggaagatttacagaaagagcacagaaagtattagctttatctcaagaggaagcaattcgcattgggcataataatattggaacagaacatattttacttgggcttgtacgcgaaggtgaaggaattgcagcaaaagcgttaattgctcttggattgagcccggagaaagtgcaaaaagaggtagaagcgttaattggacgtggaacagaagcttctcaaactgtacattatacacctcgtgctaaaaaagttattgaattgtctatggatgaagcgcgtaagctaggacattcttacgttggaacagaacatattttacttggcttaatccgtgaaggtgaaggtgtagcggcacgtgttttaaataatttaggcgtcagccttaacaaagcaagacaacaagtgttacaacttcttggaagtaacgaggcaagttcaggtcaccaaggtggttcatcgacaaatgccaatacaccgacactagacagtttagcgcgcgacttaacagttgttgcacgtgagaatcgtttggatcctgttattggacgtagtaaagaaattcaacgtgtaattgaagtgttaagccgtagaacaaaaaacaatccagtgttaattggagagcctggtgtaggtaaaacagcaattgctgaagggttagcacagcaaatcgtaaataatgaagttcctgaaacgttaagagataagcgtgttatgacactagatatgggaacagtggtagctgggacgaaatatcgtggtgagtttgaagatcgtttaaagaaagtaatggatgaaatacgtcaagcagggaatattattctatttattgatgaacttcatacattaatcggtgcaggtggagcagaaggtgcaatcgatgcatcaaatattttaaaaccatctttagcacgcggagaattacaatgtattggtgcgacaactttagatgagtatcgtaaatatattgaaaaggatgcagctttagagagacgtttccagccaattcatgttgatgagccgagtctagaagaatcaactcaaatcttgaaaggtttacgcgatcgttatgaggcccatcaccgtgtgtctattacagatgatgcaattgatgcagctgtgaaactttccgatcgttatattacggatcgtttcttaccagataaagcaattgatttaattgatgaagctgcttcaaaggttcgcttacgttcttatacaacaccaccaaacttaaaagagcttgaagtgaatcttgaggaaattcgaaaagaaaaagatgcggctgtacaaagtcaagagtttgaaaaggctgcttccttacgtgatatggaacaacgcttacgtgagaaattggaagatacaaagcgtcagtggaaagaacaacaaggaaaagaaaattcagaggttacggtagaagatattgcaaatgtcgtttctacatggacacgtatccctgtttctaaacttgcacaaacagagactgataaattattaaacttagaatccattcttcatgatcgtgtcatcggccaggatgaagcggtagtggctgtagcgaaagctgttcgtcgtgcaagagcaggactgaaagatccgaaacgtccaattggttcatttattttcttaggaccaacaggtgtaggtaaaacagaattagcaagagcattggcagaatctatgttcggtgatgaggatgcaatgattcgcattgatatgtctgagtatatggagaaacattcaacttctcgcttagttggttctcctccaggatatgttgggtatgaagaaggcggacaattaacagagaaggttcgtcgtaagccgtattcagttgtcctattagatgaagtagagaaggcgcatcctgatgtatttaatattttactacaggtattggaagatggtcgtttaactgattctaaaggacgtacagttgacttccgtaatacgattgttattatgacgtctaacgttggtgctgaggcgttaaaacgtaacaaacatcttggatttaacgtacaagatgaaagtcgtgattattcggatatgaaaggtaaagtaatggatgagctgaaaaaggcatttcgtccagaattcttaaaccgtattgatgaaattatcgtattccatatgcttgagaaaaaacatattcaagaaattgtgactcttatggtaaatcagttagtgaatcgcttaaaagaacaagaaattgaattgcaattaacagaaggggcgattgcagctattgctgataaagggtttgatcgtgaatatggtgctcgtccactacgtagagcaattcagaagcatgtagaagatagactatcggaagaacttttaaaaggtgctattgagaaaggacaaaaagttatctttgatgtagaaggggaaacatttgtcattcatagtgctgaaaag

SEQ ID NO: 40218 - DNA, 1410 bp, Bacillus thuringiensis
atggtagtaggagatttcccaattgaattagatacagtcgttgttggtgcaggtcctggtggatacgttgcggcaattcgtgcagcacaattaggtcaaaaggtagcaatcattgaaaaagctaaccttggtggcgtatgcttaaacgttggatgtattccttcaaaagcgttaatcaatgcaggtcatcgttatgagaatgcaatgcattctgatgacatgggtattactgcagaaaacgtaaaagttgactttacaaaagttcaagaatggaaaaacggcgtagttaagaaattaactggcggtgttgaaggccttcttaaaggtaacaaagttgaaatcattcgcggtgaagcttacttcgtagatgctaatacattacgcgttatgactgaagatgcagctcaaacttatacgtttaaaaatgctgttcttgcaactggttctacaccaatcgaaattccaggattcaaatactctaaacgtgttatcaactctacaggtgctttaagcttacctgaaattcctaaaaaacttgttgtaatcggcggcggttacatcggtatggaattaggtactgcatatgctaacttcggtacagaagttactgtagtagaagctggcgacgaaatcttagctggtttcgaaaaagctatgagctctgttgttaaacgtgctctacagaaaaaaggtaacgtaaatatccatacaaaagctatggctaaaggcgttgaagaaacagaaactggcgtaaaagttagctttgaagttaaaggtgaaatccaaactgtagaagcagattacgtattagtaactgtaggtcgtcgtccaaacactcaagaaatcggtcttgagcaagttggagttaaaatgactgaccgcggcatcatcgaaatcgatgagcaatgtcgtacaaatgtaccaaacatctatgcaatcggtgatatcgttcctggaccaccattagctcacaaagcttcttacgaaggtaaagtagctgtagaagcaattagtggccatgcatcagctatcgattacatcggaattcctgcagtatgcttcactgatccagaactagcatctgttggttacactaaaaaacaagctgaagaagctggaatgactgtaactgtatctaagttcccattcgctgctaacggtcgtgcattatcattaaacagcactgacggtttcctacaacttgtaacacgtaaagaagatggtcttcttgtaggtgctcaagttgcaggtgcaggtgcttctgatattatttctgagattggtttagctatcgaagctggaatgacagctgaagatatcgctcaaacaatccatgctcacccaacattaggtgaaatcacaatggaagcagctgaagttgctcttggaatgccaattcacattgtaaaa

SEQ ID NO: 40219 - DNA, 1289 bp, Bacillus thuringiensis
gtggcatttgaatttaaactaccagatatcggtgaaggtatccacgaaggtgaaatcgtaaaatggtttattaaaccaggcgatgaagtaaacgaagacgatgtacttcttgaagtacaaaatgataaagcagtagtagaaatcccttctcctgttaaaggtaaagtacttgaagtacttgtagaagaaggaacagttgcaatcgtaggagatacattaattaaatttgatgctcctggatacgaaaaccttaaatttaaaggtgacgatcatgatgaagctccaaaagctgaagaagcagcagtagaagctccagcagcggaagctactccagcagcaactgcagaagtagtaaatgagcgcgtaattgctatgccatctgttcgtaaatacgctcgtgaaaaaggtgtagacattcataaagtagctggtactggtaagaatggccgtatcgtaaaagctgacatcgatgcatttgcaaatggtggacaaactgtagcagcaactgaggctccagcagcagtagaagctactccagcagcagcgaaagaagaagcaccaaaagcacaaccaatcccagctggtgaatatccagaaactcgtgagaaaatgagtggtatccgtaaagcgattgcgaaagcaatggttaactctaaacacacagctcctcacgtaacattaatggacgaagtagatgtaacagaacttgttgctcaccgtaagaagttcaaagcagtagcagctgacaaaggtattaaattaacttaccttccgtacgttgttaaagctttaacatctgcattacgtgaatacccaatgttaaacacttctttagacgatgcatcttaagaagtagttcataaacattacttaacatcggtatcgcagctgatacagacaaaggtctattagtaccagttgttaaagatacagatcgtaagtctatcttcacaatctctaacgagatcaatgatcttgctggtaaagcacgtgaaggtcgtctagctccagctgaaatgaaaggtgcttcttgcacaattacaaacattggttctgcaggtggacaatggttcactccagttatcaaccacccagaagtagcaatccttggtatcggccgtatcgctgaaaaaccagttgtgaaaaacggtgagatcgttgcagctccagtattagcattatctctaagctttgaccatcgtttaattgacggtgcaactgctcaaaaagcgttaaaccaaattaaacgtctattgaatgacccacaattattagtaatggaggcgtaa

SEQ ID NO: 40220 - DNA, 975 bp, Bacillus thuringiensis
atggctcaaatgacaatgattcaagcaatcactgatgctttacgcgttgaaatgaaaaatgaccctaacgtacttgtatttggtgaagacgttggtgtaaacggcggtgtattccgtgctactgaaggtttacaagctgaatttggcgaagatcgtgtaatggatactccacttgcagagtctggtattggtggacttgcagttggtcttgcacttgaaggattccgtccagttccagaaatccaattcttcggtttcgtttatgaagtaatggattcaatttctggtcaattagctcgtatgcgttaccgttctggtggacgttggactgctccagtaacagttcgttctccattcggtggtggtgttcatactcctgaactacatgctgatagcttagaaggattagtggctcaacaacctggtctaaaagttgttattccatctactccatacgatgctaaaggtcttttaatctctgcgattcgtgacaacgatccagttatctacttagagcatatgaaattgtaccgttcattccgtcaagaggtaccagaaggtgattacacaattgatttaggtaaagctgatatcaaacgtgaaggtacagatgtatctgttatcgcttacggtgctatggttcacgctgcattaaaagctgctgaagaacttgaaaaagaaggtatctctttagaggttgttgacttacgtacagttcaaccattagatatcgaaacaatcatcgcttctgttgaaaaaacaggtcgcgtagttgtagttcaagaagctcaaaaacaagctggtattgcagctaacgttgtagcggaaattaacgaccgtgcaatcttaaacttagaagctccagttgtacgtgttgcagctgctgatacagtattcccattctctcaagcagagagcgtatggttaccaaaccacaaagatattgttgaagctgtaaacaaagtaatgaacttc

SEQ ID NO: 40221 - DNA, 1140 bp, Bacillus thuringiensis
agctattctatagatacactcttactacacaaccaatataaacatgactcgcaaacaggcgctgtgaacgttcctatttataacacatcaacttttcaccagtttgatgtagatacgttcggaaaatatgactatagcaggtcaggaaatccaactcgtgaagctcttgaagatatcattactttattagaaggcggaacaaaaggattcgcctttgcatcaggcattgcagcgatttccactgcattcctccttctttcacaaggtgatcacgtactcatttcagaagatgtgtacggaggcacttaccgagtgataactgaggtactctcccgttacggtgtttcacatacatttgttgatatgaccaatttagaagaaataaaacaaaacatgaaaccaaatacaaagctcttttatgtagaaacaccttctaacccacttttaaaagtgacagatattcgcgaggtttctaaactcgcaaaatctattggcgctcttacttttgttgataatacatttttgacaccactattccaaaaaccacttgaacttggagctgatgtcgttcttcatagtgctacaaaatttattgctggtcatagtgatgttactgccggattagcagtagtaaaagatgcagaactcgctcaaaagcttggatttttacaaaatgcattcggtgctattttaggacctcaagattgttctctcgtacttcgcggtctaaaaacattgcacgtacgcctcgagcattcagctaaaaatgccaataaaatcgcacattatttacaagagcacgctaaagtacaaaatgtctattatccgggattacaaacacatctcggatttgatattcaacaatctcaagcaacatcagctggagcggtcttatcgtttactttgcagtcagaagatgcactccgccaatttttatcaaaagtaaaattacctgtttttgcagttagtttaggagctgtagagtcaattctttcttatccagcaaaaatgtcacatgcagcactgtcgcaagaagctcgtgatgaaagaggaatctctaattcattacttcggttatcagtcggtcttgaaaatgttaacgatttaatatccgattttgaaaatgccctttcttatgta

SEQ ID NO: 40222 - DNA, 1092 bp, Bacillus thuringiensis
atcgaaacaaaactagcacaaatcggaaatcgtagtgaaactacaactggaacggttaatccaccagtttatttctcaaccgcttatcgccacgaaggaattggtaaatctactggctttgactattcacgaactggcaatccaactcgcggtcttttagaacaggcgatcgcagacttagaatatggcgaacaaggttatgcctgtagttcagggatggcggctgttctcctcgtcctttctctattccgctctggagacgaacttattgtatctgaagatttatacgggggaacgtatcgattattttctgagcatgaaaaaaagtggaatgttcgatgtagatacgtaaatacacagtctattaaacaaattgagcaagctatcacaactgaaacgaaggctattttcatagaaactccaactaatccattaatgcaagttactgatattgctgctgtcgcaactgtagcgaaaaggcacggactacttcttattgtagacaacacattctacacaccttatatacagcaaccattaacagaaggtgctgacattgtacttcatagcgcaacgaaatatttagggggacataacgatgtactaagcgggcttgtcgttgcaaaaggaaaggaactttgcgaggaaatcgctcattatcataatgcatcaggtgcagttttaagcccatttgactcatggttattaattcgcggtatgaaaacgttagcgcttcgcatgagacaacatgaagaaaatgcgaaagcagttgttgcgtatttaaatgatgaagacggggtgacagatgtattttatccaggaagaggcggcatgatttcattccgccttaaagatgaagcttggattaatccattcttacaatctttatccttaattacatttgccgaaagtcttggtggtgtagaaagtttaatgacttatccagcaacgcaaacacatgctgatattcctgaagaaattagaacagcaaacggcgtatgcaatcgtcttcttcgattctcagttggcattgaaaatagtaacgatttaattcaagacttaaagcaagccattaaactcgtaaaagaaggt

SEQ ID NO: 40223 - DNA, 1416 bp, Bacillus thuringiensis
tacaaattttatttaaatggagaatggagagaaagctcttcaggagaaacaatcgaaattccatctccatacttacacgaagtaattggacaagtacaagcaattactcgcggagaagtagatgaagcaattgcatctgcaaaagaagctcaaaaatcatgggcagaagcttctctacaagatcgcgcaaaatatttatataaatgggctgatgagctcgtaaatatgcaggatgaaattgccgatatcattatgaaagaagtcggtaaaggatataaagatgcgaagaaagaagttgttcgtacagctgacttcattcgttacacgatcgaagaagctttacatatgcacggagaaagcatgatgggcgatagcttcccgggcggtacaaaatctaaacttgcgattatccaacgcgcaccacttggtgttgtattagcaatcgcaccgtttaactacccagtaaacttatctgctgcaaaacttgcaccagcattaattatgggtaacgctgttattttcaaaccagcaactcaaggtgcaattagcggtatcaaaatggttgaagcactacataaagctggccttccaaaaggtcttgtaaacgtagcgacaggacgcggttctgtaattggtgactacttagtagaacacgaaggcatcaatatggtatcgttcacaggtggtacaaacacaggtaaacatttagcgaaaaaagcttcaatgattccacttgtattagaacttggtgggaaagaccctggtatcgttcgtgaagatgctgacttacaagatgctgcaaaccatatcgtaagcggtgcgttctcttactctggtcaacgttgtacagctattaaacgtgtacttgtacacgaaaacgtagcagacgagcttgttgacttattaaaagcgcaagtagcggaactatcagttggatctccagagcaagatagcacaatcgttccattaatcgatgacaagtctgctgacttcgttcaaggtttagttgacgacgctgttgaaaaaggtgctacgatcgttatcggtaacaaacgtgagcgtaacttaatttacccaacattaatcgatcacgtaacagaagagatgaaagttgcttgggaagagccattcggtccaatccttccaatcatccgtgtttcttcagatgaacaggcaattgaaattgctaacaaatcagagttcggcttacaagcaagtgtcttcacaaaagacattaacaaagcatttgcaattgctaacaaaatcgaaactggttctgtacaaattaacggacgcacagagcgcggccctgaccacttcccattcatcggtgtaaaaggttcaggtatgggcgcacaaggtattcgtaagagccttgagtctatgacacgtgaaaaagtaactgtattaaactta

SEQ ID NO: 40224 - DNA, 1398 bp, Bacillus thuringiensis
caacaaaaaaaatggggcttttgggtactaacagctttcgttgtcggtaacatggttggcgctggtattttcatggtaccaagtacgttggcacaaacagcaagcccactcggtgtcactttagcttggttaactacagggtttggtgttttaatgctagctcttgttttcggtaatttagcaattcgtcgtcctgatttaacgacagggccacaaagtcatgcatatgctttattctcaacaccaaaaaagaaaaaaatggctggcttcagtatggtatggggatattgggttgcaaactgggcaagtaacgttgccatcattacatcatttgcgggatatttatcactcttcttcccaattatgaaagatacgcgactactattttcaatcggctcgtttaacgtagaagtcggaaaactaattacatttacgatttgttccatcttactttggggaactcatattatattaacaaacggtgtaagcggagctggaaaactaaacttcttagcaacaacaacgaaagtaactggattccttttattcatcgtcgttacgttatttgcattcgaagcttctaagtttggacaatggtacacaccgatgattgataaatcaggtgcatcacatggtcttctttcacaagtaaatttagctgctcttacaacgctttgggcgtttatcggaattgaatcagccgttcttttatcaaaccgtgctgtttctccaaaaacggtaaaacgtgcaacagttgcgggattacttattacagttgcgatttacttaggaattacaattttaacaatgggtgtacttcacgttgataaattacaagcttctgaacgtccattagcagatgcactaaacgctgcaatgggtcacggcggcgggaaattgatggcattacttgctcttacttccctgtttggttctatcttaggctggattttattaagctcagaagtaccttatcaagcagcaaaagaaggtttcttcccttccttcttcacgaaaacaaataaaaaaggaagtccaatttactcattacgattaacaaacattatgtcgcaagtattcctattctcaacattatcaggaaccattgcggaagcttatacattcgttattaccgtatcaacactggcctacctcattccatatctcgtttcaccaatcttccagttaaaactagtcgcaactggtgaaacatataaaaatgaaatgcgggcaagaattacagatggcatagtcgcagttatcgcactttgctacgcactatgggttattaaaactggcgcatccgatataaaaacgttccttctcggaattggtttattcgtaattggatttgctttctatccattaatgaatcgtgatcagaaaaaaaataacgaa

SEQ ID NO: 40225 - DNA, 861 bp, Bacillus thuringiensis
atgaaagcagtagtggttaataaaaacagcaaagcaaacatcgaagtgattgacaaagaattacgtccgttacactcaggtgaagcgttagtagatgtagagtattgtggagtttgccacactgatttacacgttgcgaatcatgattttggtaacactgatggccgtattcttggtcatgagggtgtaggtattgttacgaaaatagctgatgatgttacttcactaaagataggtgaccgtgtaagtattgcatggatgttccaatcttgtggacgttgtgaatattgcgtaactggtagagaaacattttgccgtgaagttaaaaacgctggttattcagtggatggtggtatggctgaacaatgtatcgttacagctgattatgcggtaaaagtaccagaaggattagatcctgctcaagcatcatcaattacttgtgctggtgtaactacatataaagctattaaagtatcagatattaaacctagtcaacctattgtaatctatggctgcggtggattaggtaacttagctatccaatatgctaaaaatgtatttggtgcaaaggtaatcgcagtagatattaatgacgacaaattagccttagcgaaagaagttggtgctgatatgactatcaatccaatttctcaaggtcctgctgataaaattgtgcaagaggagtttggtggcgcttatgctgcggtagtaacagcagtctctaaagtagcctttaactcagcagttgatgcagtacgtgcttgcggtaaagtagttgcagtagggctaccagtagaaacaatggacttaaacatcccacgacttgtactggatggaattgaagtaattggttctatagtc

SEQ ID NO: 40226 - DNA, 1179 bp, Bacillus thuringiensis
gaaatagttggtaacttagcgaaacgtatggtgattatatcaggtttaccaatcgaggtacatttaacgcttgatcgccgtgaggcattaaaagatgcagacttcgtaacaacacaacttcgcgttggtttattagaagcacgtgcaaaagatgaagcaatcccattaaaatatgatgtaatcggtcaggaaacaaatggtcctggtggtttatttaaagcgttgagaacgattcctgttattttagatatttgtaaagatatggaggagctctgtccgaatgcatggttaattaactttgcaaatccagctggtatggtaacagaggcagttcttcgttatacaaatattcaaagagtagttggtctatgtaacgttccaatcggaattcgtatgggtcttgcaagattacttgaagtagatgcgagtcgtgttcacgttgatttcgcaggtttaaatcatatggtatacggactagatgtatacttagatggcgtaagtgtaatggaccgtgtgttagagcttgtgacagatccagaaaaacaaattacgatggaaaatatcgcagcgcttaactgggagccagactttattcgaggacttcgtgcgattccatgtccataccatcgttactactacaaaacacgtgaaatgttagaagaagaaaaagaagcttctgttgaaaaaggtacacgtgcagaagtagtaaaacaattagaaaatgatttatttgagttatataaagacccgaatttagatattaaaccaccacaattagaaaaacgtggcggagcttattatagtgatgcagcatgtagcttaattacgtctatttacaataataaaggtgatatccagcctgttaatacacgaaacaacggaacaattgcaagcttaccacatgattcagctgttgaagtgaactgtattattacgaaagaaggcccaaaaccaattgcagttggagatcttccagtaccagttcgcggtttagtacaacaaattaaatcattcgagcgcacaacaattgaagctgctgttacaggggattatcataaggcgctgcttgctatgacaatcaatccgcttgtaccatcagataaagttgcaaaacaaattttagatgaaatgttggaagcacataaagagtatcttccacagttctttaaaaaggtagag

SEQ ID NO: 40227 - DNA, 1350 bp, Bacillus thuringiensis
atgatgaaaacgaagcaaactgatgaattattagcaaaagatgagcaatatgtttggcacggaatgcgtccctttagtccaaatagtacaatggtaggggcaaaagctgaagggtgctgggttgaagatatacaaggaaaaagatatttagatggtatgagtggtctttggtgtgtgaatagtggatatggaagaaaggagctcgcagaagcggcttataagcaattacaaacattatcatactttccaatgtcacaatctcatgaaccagctataaagcttgctgaaaaattaaatgagtggcttgggggagagtatgttattttcttctcaaatagtggttcagaagcgaacgaaacagcttttaaaatagcaaggcaatattatgcgcaaaaaggtgaaccacatcgttataaatttatgtcacgttatcgtgggtatcacgggaatacaatggcgacaatggcagcgacgggacaagcgcagcgtagatatcaatatgaaccgtttgcttcaggctttttacacgtaacaccaccggattgttaccgtatgcctgaaattgaagggcagcatatttatgatgtagaatgtgtgaaagaagtcgatcgtgttatgacgtgggaattaagtgaaacaattgccgcttttattatggaaccaattattacaggcgggggcatattaatgccaccacaagactatatgaaagctgttcatgagacgtgtcaaaaacacggtgccttgcttattagtgatgaagtaatttgcggtttcggacgtacaggaaaagcatttggatttatgaattatgatgtgaagccagatattattacgatggcaaaagggattacgagcgcatatttaccattatctgcaacagctgtgaaaaaagaaatatatgaagcatttaaagggaagggagagtatgaattcttccgacatattaatacatttggtggaaatccagcagcttgtgcattagcccttaaaaacttagagattatggaaaatgaaaatttaattgagcgatctgcgcaaatgggttcccttttattagagcaactaaaagatgaaattggggaacatccgcttgttggggatattagaggaaaaggtctattagttggaattgaattagtaaatgataaagagacgaaagagccaattgataacgacaaaatcgcaagtgtcgtaaatgcttgtaaagaaaaagggcttattataggacgaaacggtatgacgacagcaggatataataacgttttaacattagcgccgccgcttattatttcaagtgaagaaattgcctttgttgttggaactttgaagacggcgatggaacgtatt

SEQ ID NO: 40228 - DNA, 867 bp, Bacillus thuringiensis
ttgaagctactagtgaaagcaccagcaaagattaatctgtcgttagatgtactgggaaaaagacaagacggatatcatgaagtgaaaatgattatgacaaccattgatttagcagatcgtctagaactaacggaattagcagaagaccgtattgaaattttatcccataatcggtatgtcccagacgaccaacgaaatttagcttatcaggcagcgaaattattaaaagagaagtttaatgtaaaaaaaggtgtatctattactattgaaaaaacgattccagtagcagctggattagcaggtggaagtagtgatgcagcagcgacattacgtggtcttaataaattatggaatttagagcttacaattgatgagttagcagagcttggtgcagaaattggatcagatgtatcgttctgtgtatacggaggcacagcaattgccactggaagaggagagaaaattgagcatataaagactccgccttcttgttgggttattttagcgaaaccacatataggtgtatctactgctgatgtgtatggaaatttaaagttaaatcgagttacacatccaaatgtagataaaatggttgatgtcataaattctggtgattataaaggaatttgtgatactgttggtaacgttttagaagatgtaacatttggaatgcatcctgaagttgcccgtattaaatcacagatgaagcgatttggagcggatgctgtattaatgagtggaagtggtccaactgtatttggacttgtacaccatgattcacgaatgcatcgcatttataacggattaaaaggattttgtgaacaagtctatgcggtacgtttattaggagagcgagaaacgcttgaa

SEQ ID NO: 40229 - DNA, 736 bp, Bacillus thuringiensis
aaattagtgatcataacaggggctggaaatggaatcgggagaggaattgctttacattatgcagaggggccaatgttattttagcagatatagacgaaaaagcaggtgcaaaaacagttactaagatgaaagaacagggtaaagaagcacttttcgtacaaacagatggtaggctggaaacagattatttattcgtttaagggaggtggttaatcaaacatacggccagatagatattttaattaataatgcaggaaaagagttattcaagtctccttacgatatttcgctagaagaatgggacgatgtaattagcacaaacctaagaagcgttttcttgggttcacgggaagcagcaaaggatatggcgtataacaaagaagggggatctatcgtgaatattgcctctacaagggcgattatgtctgagccaaattcagaatcttatgctgccacaaaaggtgggatcgttgctattacacacgcgctcgcagcctcatttagcgaagctaggattaccgtgaatgctatttccccaggttggattgaaacaggagattattcaaaattaagtaaaattgatcatgaacagcacctatcaaagcgtgtaggaacaccagatgatattgcacgagcctgtctgtatttaacagccagcgaaaatgattttgttacaggtataaaccttgtcgtagacggtggaatgacgaggaaaatgatgtatgaggaataggcg

SEQ ID NO: 40230 - DNA, 1131 bp, Bacillus thuringiensis
atgaaagctgtaacctatcaaggaccaaatcaagtacaagttaaacaagttgatgatgcaaagttagagaaaaaagatgatattattgtaagaattacttcaaccgctatttgcggttctgatttacatttatatcaaggtaacatgcccttacctcaaggatacattatcggccatgaaccaatgggaatcgttgaagaagtcgggccagatgtcactaaagtgaaaaaaggcgatcgtgttgtcatccccttcaacgtttcttgtggacattgtttctattgccaacatgaaatggaaagtcaatgtgataactcaaatcctcattacgattctggtggatactttggttatacggagaaatttggtaatcatccaggcggacaagcagaatatttaaaagttccatttggcaattttactccatttgttataccggaatcatgcgagcttgaagatgaatccctactatttttatcagatgttttacctacagcctattggagtgtaataaacgcaggcgtaaagccaggtgatactgttatcgtccttggttgtggacctgttggattaatgacacaaaaatttgcttggatgcaaggtgctaaacgtgtaattgcagtggattacttagattatcggatgaattatgcaaaaaagattaacaatgttgaggtatttgagtttacaaaattccccgatatgggagaacatttaaaggaaattacacatggtggtgccgatgtagttattgattgtgtggggatggatggaaaaaaatcgcctttagaatttctggaacaaaaattgaaattacaaggcggaactctcggccctattcaaatagctacgaaagccgtaagaaaatatggaacggttcaaatgaccggcgtttatggtggcaattataatgcatttccactcggggcattttgggttagaaatattaatcttaaaatgggacaagcacctgtcattcattttatgccggaactatttgaaaaaataataaataaagaatttgatccaaaagagattattacacacaaaatcccccttgaagaagcgagctacggttatcaaatttttaataatcgtgaagacgactgtataaaagtcattctgaaacct

SEQ ID NO: 40231 - DNA, 1407 bp, Bacillus thuringiensis
aaggatatacgtatagaaaaagattttttaggtgaaaaagaagtaccaagtgcagcttattatggtgtacaaacattacgtgccgtagaaaacttcccaattacaggatatcgcattcatccatcactcattacagcaatggcaattgtgaaaaaagcggcggcgcttgcgaatatagatactggttacttagctaaagacattggacatgaaattgcagaagcagcgcaagaaattgttgatggaaagtttcatgatcaatttatcgtagaccctattcaaggcggagccggaacttctattaatatgaatacaaatgaagtaattgcgaatagagcgttagaacgtatgggatatgaaaaaggggcgtatgcgaaaattagcccaaacactcatgtgaacatggcccaatcaacgaacgatgcgtttccgacaggaattcatattgcaactcttatgatgttagaaaagcttcttattacaatggaggaacttcattctgcttttcttaaaaaagcaaaagagtttgatcacgttattaaaatgggacgcacacatttacaagatgcagttccaattcgccttggacaagaatttgaagcgtatagccgagtgcttgcgcgcgatataaaaagaattaaacagtcccgtcaacatttatatgaagtgaatatgggagcgacagctgttggtacaggattaaatgcaaatcctacgtatattgaacaggtggtaaaacatttaagaacgtttagtgggttcccacttgttggtgcagagcatttagttgatgcaacgcaaaatacagatgcatacacagaagtatctgcagcacttaaagtatgtatgatgaacatgtctaaaattgcaaacgatcttcgtattatggcgtctgggccacgtgttgggttggctgaaattcaattgccagcacgtcagccaggttcatcgattatgccaggtaaagtaaatccagttatggcagaagtgattaaccaagtcgcattccaagtaattggaaatgatcatacaatttgcctagcatcagaagcgggacaattagagttaaacgtaatggagcctgtgcttgtatttaatttaattcaatctattagtattatgaataatggattccgtgtatttcgtgaatattgtattgaaggaattacagcaaatgaagaattgctgaagcaatatgttgagaaaagtgttggaattattacagcagttaatcctcatattggttatgaagcagcatctcgtattgcacgtgaagcgattgaaacaggaaaatctgttagggagttatgtttagagcatggtgtactgacagaagaggaattggatattattttagatccattcgaaatgactcaccctgaaattgctggagcttctttattaaaa

SEQ ID NO: 40232 - DNA, 1097 bp, Bacillus thuringiensis
  unsure (1)..(1097): unsure at all n locations
attctacattacacgtctggttctcttggtaagcaaaaggtgtgcttcatgcgcnaaacgcaatgttcagcactatcaaacggcgaagtgggtattagatttaaaagaagacgatgtatattggtgtactgctgacccgggctgggtaactggaaacagcttacggtattttcgcaccgtggttagttggagcgtcaaacgttattttaggtggacgctttagtccagaagcttggtatgaagcactgcaagattacggtgtgacggtttggtacagcgcaccaacagcattccgtatgttaatgggagctggacaagacgcaattaaaaaatatgacttatcacaagtgcgccacgtattaagcgttggtgagccgttaaatccagaagtaattcgctggggtatgaacgcatttggacttcgtattcatgatacgtggtggatgacagaaacaggtggacaagttatttgtaactacccttgtatggaaatccgtccaggctcaatgggtaaaccaattccaggtgtgaaagcagcgattgttgataatgaaggaaatgaagtgcctccttacacaatgggtaacttagcaattgcgaaaggttggccatctatgatgcgtgggatctggaataacgagcaaaaatatgaatcttatttcatgccgggagattggtacgtatcaggtgactctgcctatatggatgaagatggatacttctggttccaagggcgtattgacgatgtaattatgacgtcaggtgagcgcgttggtccgtttgaagtagaaagtaaattaattgagcacgctgctgttgcagaagctggtgtaattggtattcctgatccggtgcgcggcgaaattattaaagcatttatcgcacttcgagcaggatacgaaccatctgatgaattaaaagaagaaattcgtcaatttgtaaagaaaggcctagcagctcatgcagcgccacgacaaattgaatttagagataaattaccgaaaacgagaagtggtaaaattatgcgccgcgtattaaaagcgtgggagttaaacttaccaacaggtgacttatcaacgatggaagattaagagaga

SEQ ID NO: 40233 - DNA, 867 bp, Bacillus thuringiensis
atagattttgggacaattgcaaccgcgatggtaacaccgtttgatataaacgggaatatcgattttgcaaagacaacgaaattggtaaattatttaattgataacggtacaacagcaatcgtggtaggaggaacgacaggagaatctcctacattaacttcagaagagaaagtagcgttatatcgccatgtcgtatctgttgtcgataaaagagtgcccgtaatcgctggaacaggtagcaataatacgcatgcttctattgacttaactaaaaaggcaacagaagttggagtggatgcagtaatgctagtagcaccgtattataacaaaccgagtcaagaaggaatgtatcagcattttaaagcaattgctgaaagcacgccgcttccggttatgctatataacgttccaggacgatctattgtacaaatctccgttgatacagttgttcgtttatcagaaatagaaaacattgttgctattaaagatgccggcggcgatgtgttaacaatgacagaaatcattgaaaaaacagcggacgactttgcggtatacagcggtgatgacggtttaacgttaccagctatggcagttggagcgaaaggtatcgtttcggtagcctctcatgttatcggaaacgaaatgcaagaaatgattacagcatttcaatcaggagaatttaagaaggcacaaaaattacatcaattacttgtaagagtaactgattcattatttatggcgccaagtccaactccagtaaaaacagcgttacaaatggttggattagatgtaggttctgtacgtttaccacttcttccattaacagaagaagaaagagtaacgttacaatctgtaatgcaatctatc

SEQ ID NO: 40234 - DNA, 1212 bp, Bacillus thuringiensis
atgaaaataattgttcaaaaatttggtggcacatcagtacgtgatgacaatgaacgtaagcatgcgcttcatcatataaaaaaatcattagctgctggttataaagtagttactgtcgtatctgctatgggccgtaaaggtgaaccatatgcaacggatacgttattaagtcttgtaaatcaagaggaatctactatttctaaacgtgagcaagatttattattatcatgcggagagttaatctctgcaattgttttctctaatatgttgaatgagaacggtataaaagcagcagcattaaatggtgcacaagctggttttgtaacgaatgatgactttacgaatgcaaagattattgaaatgaattgcgatcgtatacatgaagagttagaaaatgtagatgtaatcgtcgttacaggatttcaagggcaaacgaaaaaaggtgatacgacaacacttggacgcggaggtagtgatacttcagcttcagcattaggtgttgcacttcatgctgaatatatcgatatattcactgatgtagaaggtgttatgactgcggatcctcgtattgtaaaagatgcacgtcatcttcaaactgtaacgtataacgaaatttgtaacatggcttatcaaggtgcgaaagtcgttcatccacgtgcagttgaaattgcgatgcatgcaaaagtgccacttcgtgtacgttctacgtattctgaaagtgaaggtactcttattgcagcatacgatggtgctacaaaagggcaggatgtagaagaacgtcctgttacaggtattgcccacgtatcgaacgtaacgcaaattaaagtacttgcaaaagaaacggcatacgacatacagcagcatgtatttaaagaaatggcaaacgaaggcattagtgttgatttaattaacatttctcctactggtgtagcttacacagtaaatgataatgtatcagctcgtgctgtcgaagtgctaaaacaacttggatatgagccaattgtgacagaacattgtgcgaaagtatctatcgttggagctggaatggcaggcatcccaggggttactgcaaaaatcgttacagctttagcggaaaaaggcattcaaatcctgcaatcggcagatagtcatacaacaatttgggttcttgtaaaagaaattgatttagtggaggctgtaaatgcattacatagtgcgtttgagctttcaaaa

SEQ ID NO: 40235 - DNA, 1895 bp, Bacillus thuringiensis
gtggatctaacgcaaattcaaaaccctagttttttgaaagatatgtctatcagtgaactagagggattgagtgaggatattcgtaagtttttaattgaagagctctctcaaacaggtggacatattgcacctaatttaggtgtagtagaactcacaattgctctgcacaaattatttgatagcccgcaagataaatttttatgggatgtaggacatcaatcctatgtacataaaattttaactggacgtgcgaaagagtttggtacattaaggcaatatcaaggtctatgtggtttcccgaaacgttgcgagagtgagcacgatgtatgggaaactggtcatagctcgacttcgttatcggctgcaatgggaatggctctggcacgtgatttaaagaaaacgaaagaatatgttataccaattattggagatggtgctttaacaggcggaatggctttagaggcattgaaccatattggacatgaaaaaacagacatgattgttattttgaatgataatgaaatgtcaattgcaccaaacgttggtgcgcttcataatgtgctcggtcgtttacgtaccgcaggaaaatatcactgggtaaaagatgaattagagtatatattaaagaaaatcccagcagttggcgggaaagtggctgcgacagcagagaaaataaaagatagtcttaaatatttactagtatctggtgtctttttcgaagagttaggctttacatatttaggtccagtcgatgggcatgattatgaaaagttattcgaaacgttgcaatatgcaaagaaaacaaaaggcccagtgcttgttcacgttattacgaaaaaaggaaaaggttataaaccggctgagagtgacgttattggaacttggcatggaacaggaccttataaaattgaatcaggtgacttcgttaagccgaaagaagttgcaccagcatggagtgctgtcgttagtgaaacagtacttaagctagcgagagcggatgagcgtatcgtagcaattacacctgcaatgcctgttggatcaaaacttgagaaattccaaaaagaattcccagatcgtatgattgatgtaggtattgcagaacagcatgctacaacaatggcagcaggtatggcaacgcaaggaatgaagccattcttagcgatttattcaacatttttacaaagagcatatgaccaagttgttcatgatatatgccgccaaaatttaaatgttttcatcggaatagatcgctcgggattagtaggagcagatggtgaaacgcatcaaggcgtatttgatatctcattcttacgtcacttgccgaatatggtgcttatgatgccgaaagatgaaaatgaagggcaacatttagtttatacggcgatgcaatatgaagatggaccaatcgcattgcgttatgctcgcggtaatggacttggcgttcatatggataaagaattaaaggcgattccaatcggtacgtgggagacgttaaaagaggggacacaagcagctattttaacgtttggtacgacaataccaatggcaatggaagcagctgagcgtcttgaaaaagctggggtttcagtgaaagtagtgaatgctcgctttattaaaccaatggatgaagcatatttacatgatcttctaggaaagaatataccgattttaacgattgaagaagcttgtttaatcggtggttttggaacaggagtagttgaatttgcatctgaaaatggttaccatagtgcattagttgaacgaatgggtattccagaccgcttcatagagcacggaagtgtaacaaaattattagaagaaattggtttaacgacagatgctgttgtagaccgtattcatacaatgattccatcaaaacaaaaaagggcgtaaca

SEQ ID NO: 40236 - DNA, 891 bp, Bacillus thuringiensis
atagtgacgattgcttttgatacttttttgaaagaaagtaaaactttcgtagaagaaaaacttgtaagctatgcaaatgaattacaatgtccaaatgtacttcgtgaagcgatggcatattctttggaagcgggtggaaaacgtctccgcccgttacttttgtttgcaacattacaagcgtttgggaaagaaagaaatcttggagtaggtgcagcttgtgctcttgaaatgattcatacatattcattagttcatgatgatttaccttgtatggatgatgatgatttaagaagaggaaagcccacaaatcacaaagtatttggtgaagcgatggcagttttagcaggagatggcttattgacgtatgcttttcaagttattatggcatatgagcaaaaagaaatttctgccgaaaaaaaagtaagacttgtacttgaacttgcaaaagcagcaggaccagaaggaatggttggcggacaagtggcagatatggaagctgaagggaaacgccttacgattgatgaattggagtacatccataaacataagaccggaaaactgcttgaatttgctgtacttgcgggtgcgatactttctgatgcgacagaagagcaagaagaaaagttgcttacgtttgccaaatatatcggtctagctttccaaattcgagatgatattttagatgtcgaaggaactgaagaagagattggaaaaccgattggtagcgatctttctaatgaaaagagcacatatacaacgttgtttactgtagatagagcaaaggatattttagaagaaacaattgcagaagcaaaaggtgcgattagttccttgcaattacaagatgaatatttactatctatttgtgatttgattgcaaaacgtaataac

SEQ ID NO: 40237 - DNA, 840 bp, Bacillus thuringiensis
atggtagcagtaatcatcaaaggaaatgaagttgcggagaaaaaacgagcacaattaacagaagaagttgtgaagttgaaagagcaaggtattgtaccaggattagcagttattttagttggagaagatccagcatctcgttcttatgtgaaaggaaaagaaaaaggctgtgaacaagtagggatttactcagagctaattgaacttcctgaaacaattactgaggaacgtttgcttgctgaaatcgatcgcttaaatggagatgaccgtattaatggcatattagtgcaattacctttaccaaaacatattgaagaaaaagctatcattgaaagaatttcaccagaaaaggatgtagacggatttcacccaatcagcgtgggacgtatgatgacgggacaagatacattccttccatgtacaccgcatggtattgtagaattagtaaaagaaacaaatcttgatatttctggaaaacatgtagtagtaattggaagaagtaatattgtcggtaaaccagtgggacaattgtttttaaatgaaaatgccactgtaacatattgtcattctaagacgcaaaatatgaaagagttatcgaagttagctgatattttaatcgtagctgttggacgacctaaaatgataacagcggattatattaaagaaggagcggttgtaattgacgttggtgttaaccgtttagaaacaggaaaactttgtggtgatgttgactttgacaacgtgttagatgttgcgggttacattacacctgtgccaaagggtgttggtccaatgacaatcacaatgcttcttcataatactgttgaatctgccaaacgt

SEQ ID NO: 40238 - DNA, 1398 bp, Bacillus thuringiensis
atgaataaagggcgcgttacgcaaatcatgggtccggttgtagacgttaagtttgatggcggaaagctaccagaaatctacaacgcccttacggtaaaacaaagcaacgaaaacggaagtattaacttaacatttgaagttgcacttcatttaggtgatgatacagttcgtacagttgcgatgtcttccacagatggacttgttcgtggcacagaagtagaagatactggtaaaccaatctctgtaccagttggtgatgtaacacttggtcgcgtatttaacgtattaggtgatgcaattgacttagatggtgaggttcctgcagatgtacatcgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggaattaattaacaacatcgcacaagagcacggtggtatctctgtattcgctggtgtaggtgagcgtactcgtaagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctacaaataaagggtctatcacgtctatccaagcggtatatgtaccagccgatgactatactgacccagcaccagctacaacgttcgctcacttagatgcaacaacaaacttagagcgtcgtttaacgcaaatgggtatttacccagccgtagatccattagcatctacatctcgtgcactttctccagaaatcgtaggagaagaacattatgaagtagctcgtcaagtacagcaaactttacaacgttataaagagcttcaagatatcatcgctatcttaggtatggatgagttatctgaagaagataagttagttgtacatcgtgctcgtcgtattcaattcttcttatctcaaaacttccacgtagctgagcagtttacaggtcaaaaaggttcttacgtacctgtaaagaatacagttagtggtttcaaagaaattctagaaggaaaatatgatgaccttccagaagatgcattccgcttagtaggtggcattgaagaagttattgaaaacgcgaagaaaatg

SEQ ID NO: 40239 - DNA, 858 bp, Bacillus thuringiensis
gtggcatctttacgcgatataaaagcgaagattaactcgacaaagaaaacgagtcaaattacgaaagcgatggagatggtatctgcatctaagttaaaccgtgcagagcaaaatgctaaatctttcgttccgtatatggaaaagattcaagaagtagtagcgagcattgcgcaaggaagcaaagggattaatcatccaatgctaaatgcgcgtcctgtaaagcgtacaggatacatcgttattacgtctgatcgcggactagcaggtggttataacagtaacgtattacgtacagtaagtaacgtaattcgtgaacgtcataatatggattcaaaccaatattctattattgtgcttggacgactaggacgtgattatttaaaacgtcgcggctttaacattattgatgaagtagttggattatctgaccacccatcatttactgatattaaagaccttgcttctcgagcaattgcgatgttcgcagatggtgcttatgatgagctgtacatctactacaaccattacgtaagtaaaatttcacaagaggtaacggaaaataaaattttaccgcttactgatgtggcgtctgacaaaccgacgacagcttatgaattcgaaccttctgaagaagaaattttaaaagtactattgccacaatacgcagaaagcttagtgtacggtgcattactagacggtaaagcaagtgaacacgcagcgcgtatgacagcaatgaagagtgctacagacaacgcaatggaagttatcgattcacttacactttcattcaaccgtgcgcgtcaggcagcgattacgcaagaaattacggaaatcgttggtggagcagcagcgttagaa

SEQ ID NO: 40240 - DNA, 969 bp, Bacillus thuringiensis
cttgatacaatcattaaccaaaaagatgaagatatgatttgtatctatgtagcaattggacaaaaagaatcaactgtacgtaacgtagtagaaacactacgtaagcacggtgcattagagtacacaatcgttgtaactgcatctgcttctcaaccagctccattattatacctagctccttacgctggtgtaacaatgggtgaagagttcatgtacaatggtaaacacgtattagtagtatatgatgacttatcaaaacaagcagcggcttaccgtgagctgtcattactattacgtcgtcctccaggtcgtgaagcttacccaggggatgtattctacttacattctcgcttattagagcgtgcagcaaaattaagtgatgcaaaaggcggcggttctttaactgcactacctttcatcgaaacacaagcaggggacgtatcagcatacatcccaacaaacgtaatttctattacggatggacaaatcttcttacaatctgacctattcttctctggcgtacgtccagcgatcgatgcgggtacttctgtatctcgtgtaggtggatctgctcagattaaagcaatgagtaaagtatcaggtacacttcgtcttgaccttgcatcttaccgtgagttagaagcgttcgctcagttcggttctgaccttgataaagcaactcaagcgaaattaaaccgtggtgctcgtactgttgaggtattaaaacaaggattacacaaaccattacgtgtagagaaacaagttatcattctttacgctttaacacgtggattcctagatgatatcccagtagtagatatcactcgttttgaagaagaattccatgcttggttagattctaatgcgactgacttattagaagaaatccgcacaactaagaaacttgcggatgacgacaaatttgcagcagcaatcaatggatttaaaaaagtatttgtagcttctgaa

SEQ ID NO: 40241 - DNA, 858 bp, Bacillus thuringiensis
atgttgaaagtgacaaacttgaagaaaacaattgatagtcaaacaattttagacaatgtttctttcacattgcaaagagggagtatcatcggattactcggaagaaacggtgcggggaaaacaactttattgcgaacgatggtcggtattttagacccagacgagggaactgttacatatgaagatacaaacattcatcagtttcctgaaataaagcaaaaaattgtatatgttcctgattctactaatatactgaacggctatacgataaaagaaatcgtaaagttttataaagaagtttataccgcatttgatgaaacacatttctatgaactgttagaacgttttaacttaccaaacaaacgaattcgtagctattcaaaaggcatgaaagcactgctcgccatcattttagctgtttctacaaaggcagaatatatcattttagatgaaccgacaaatggacttgatcctatcgtgaaaaggaaaattttacagtttctcgttggagaagttgcagaaaaagagattaccattttcatctccactcaccatttagatgaagtagaacaaattgcagatacaattattatattaaaaggccatactatctcgtctattacatcactagacgatgcaaaatcacgatttgcaaaaatacaagtagcttacgaacgttcattacctcaaaagctagaaaacttaagcaatattaaaatattaaaccaaacaggaaaagtatatacaatcttaattgagggaaatgtggctacaacactcgagaagttttacaaagagcaacctatacttattgaagaattaacaatgtcacttgaagatatttttatcactacattt

SEQ ID NO: 40242 - DNA, 1467 bp, Bacillus thuringiensis
gaaacgaggcaacaatggggaacgagagctggatttatttttgcagcggtcggatctgccgttggattaggaaacatatggcgttttccttatacagcgtatgaaaatggaggaggagcattctttttaccgtacttatttgcattattaacgactggtatttcattgttagcgtttgagtttgcccttggtcatcgtcatcgtggttcagcaccacttacatttttccgtattagcccgcgtgccgaatttattggatgatggcaaatgtgcgtaacatttatcgtttcaacatattatgcagtgattattgcttggtctatatcgtatacatactttgcaattactggagcatggggaaaagacacgcaatcatttttatttaaagagtacttacatgttgcagataagccagggcaatttggaggacttgtaccggaagtattaattccattagttctcgtttggattattgtgcttggcgttgcatttaaaggagttaaaaaaggaatcgaagttgttaaccgtatatttattcctttattagttgttatgttccttattatcgtcgttcgtgcagtgacgatggaaggtgctatgcaaggactagatgcattctttaaaccagattggagtcgtatttttgatgggaaagtatggcttgctgcttatggtcaaatattctttagtttatctttagcatttggaattatgattacgtattctagttatttaccgaaaaactcggatacaacaaataatgcctttattactggatttgccaactcaggatttgaattattagcaggtattggggtctttgcagctcttggatttatggcgaataatatgggagtaccggttgataaagtagcaagtgctggcgttgggcttgcgttcgtagtatttccgcaaattattaatgaattgccgatgtcaccgttgtttggtgtattatttttcttatcgttaacggttgctggaatcacatcacttatttcactcgcggaagtatgttttgctgctgtgtctgaaaaattcagtttaagtcgggaaaaaaccattggaattatgggaacccttctcgtgttagtttctcttgtatttgcaacacgtggtgggcttatgttcttagatgttgtcgactatttcgctaataatttcggattaattacaattgcacttgcggaagtagtgacgatagggctcattttacgtcgtttaccagtttatcaaaatcatgcaaactttgtatctgatattaaattaggaacgttttggagagtaagtttactcgttattactccgcttatgttagggtatatgctaattgatggtacaatccaaaacattaaaaagaattatggagattatccgactgagtttgttgtaacgtatggttggtcgatagcagcagccttccttatcgttgcgctaattattagtctaaagaaatggaatgcacaa

SEQ ID NO: 40243 - DNA, 627 bp, Bacillus thuringiensis
atatatgtaacaaggcatggtgaaacagagtgggatgtagcgaagcgaatgcagggacggaaaaattctgctttaactgaaaatggtatagttcaggcgaaacaattaggaaatcgaatgaaagatttaccaatccatgcgatctatagtagtccgagcgaaagaacacttcatacggcagagttaataaagggggaacgtgatatacccattatagcggatgagcatttctatgaaatcaacatgggtatatgggaaggacaaacaatcgcggatatagaaaagcaatttccagaagaagtacatctgttttggaatgagccacatctttttcagtcaacatcaggcgaaaattttgaggccgtttatgaaagagtaattgaagggatgcagcttcttttagagatgcataaaggacaaaatatattgattgtgtctcatgcggcagcagcaaaattacttgtagggcatttcgcgggaattgaaatagaaaatgtgtgggatgatccatttatgcatagtgccagtttgagcataatagaatttgaagagggtattggtaaagtgaaacaatttgcagatataagtcactttcaataaatgtaaaaaaggccgcaaaacggcctt

SEQ ID NO: 40244 - DNA, 432 bp, Bacillus thuringiensis
gcttattatgaaagcgaagtaggtttgcttgaaattacagcgaatcaagaaggaattacgtctgttatatttgttgatgaacgacaagaagaaaataaaaatgaaatgatagaacaatgtataaatgagttagatgaatatttcaaagggaaaagaatagagcttacggtcgcgctgtctgcggagggaacagcatttcaaaaaaatgtatgggatgcactttatactattccatacggcgtaagtgcttcatatttagatattgcagagaaagttggaaatacaaaagctgtacgggcaataggaggggcaaatagtcggaatccaatttcaatagttgttccatgtcaccgtgtaatagggaagagtggaaagcttgttggatatgctggtggtttatggaggaaagagtggttattaaaacacgaaggt

SEQ ID NO: 40245 - DNA, 1521 bp, Bacillus thuringiensis
tcaaaatatatgattggtgtagatattgggacaactagtacaaaatcagttctattttctactgatggatctgttattgctagtcatggaattgaatatcctttatattctcctacacctgaaacagcagaacaagacccagaagaaatctttcatgcagtaataaatacgattaaagaaactgtacgaataagtagtgtacagccgaatgatattctttgtgtctcttttagttcggcaatgcatagtatcattgctgtagatgaaaagggaaagccgttaacgagatgtatcacttgggcagataatagaagtgcaagctgggcggagaaaataaagaatgatatgaatggtcatgaaatttatcttcgtactgggacaccaattcatccgatgtcaccactttcgaaattagtttggctacagaatgagcaagcagagttattcgcaaaaagttataaattcatttctattaaagaatatgttttttacaagttatataaagaatatgtaattgattattctatagcatcagcgacaggaatgttcaatttaaaatctttaaagtgggatgaagaggctttacatgtagcaggaattacagatgaaaagctttcaaagcttgttccaacaacgcacagtttaacaggattagatgaagagtttgccaaagagatgaatgtacttgtttctacgccttttgtagtaggagcgagtgatggagtactatctaatttaggtgtaaatgcaatagatcctggcgttgtggctgttacaattggtacaagcggtgcgatacgtgctgtaacaaatcgtcctgtaacagatccaaaaggtagaattttttgttatgcgttaactgaagaccattgggtaatcggtggaccagttaataacggcggtatgattttcagatgggctcgtgaccaattgggcacttcagagattgaacttgcaaagcgcttaggaaaagatccatatgaggtgcttactgaaatagcagcaaaagtgaatccgggatctgacggtttattatttcacccgtatttagcgggggaaagggctcctttatggaatgcaaatgcgcgaggatctttctttggactcggattgcatcataagaaagaacatctgatacgtgctgttttagaaggagtaatttataacttatatacagttcttctcgctttaaaagaactaattggcgaaccgaaaaaaattcaagcgacaggcggttttgcaaggtcggaactttggagacagatgatggcggatattttccatcaagacgtatatgttccggaaagtttcgaaagctcttgcttaggagctgcaatcctcggtttatatagtttaggtgaaatagatacattatccgtagtttctgaaatggtaggtgcagattttcatcatgagccaaacatggaaagtgtggaaaaatataaagatttaacgccaatctatatccgcttgtcccgtcaattggaagaagaatatgaaagtatagcagcgtatcaaaaa

SEQ ID NO: 40246 - DNA, 603 bp, Bacillus thuringiensis
gagtctacccgccgatatgagcaattaaagaaagatggcattcacttaatgatgcagaaactctgggtgaatggaaggcgctcgtaatggtgcttgttacatgatcggaagagatcaagaacttgggacatcgttgaacctatcttccgcgatactgctgtagaaaatggattcttatatgctggaaaagctggtagtggtcacttcttaaaaatggttcataacggaattgaatacggtatgatggctgctattggtgaaggatttgagattctagaaaaaagtgaatttgactacgattatgaaaaagtatcaagagtatggaacaacggttcagtcattcgttcttggttaatggaattaacagaaaatgcattttctaaagatgcaaaactggatgagattaagggtgttatgcattcttctggtgaaggaaaatggacagtagaaacagcattagaccttcaaacagcaactcctgttatcgcaatgtctctattaatgcgctaccgctcattagacaatgatacatttacaggaaaagttgtagcagctctgcgcaatgaatttggcggacatgcagtagaaaagaaataaagtgaa

SEQ ID NO: 40247 - DNA, 1740 bp, Bacillus thuringiensis
aaagggaaacttatagtagtcggcggtggcttggctggcttaatggcaacgattaaagcggcagaagcaggagtaaatgttgaactgttttctttagtaccagtaaaacgttcacattctgtatgtgctcagggcggaattaacggtgccgtaaatacgaaaggtgaaggggattctccatggatccactttgacgatacaatttatggtggggacttcttagcgaaccaaccaccagttaaagcaatgtgtgaagcagcacctggtatcattcatttaatggaccgtatgggtgttatgttcaaccgtacggaagaaggacttcttgatttccgtcgatttggtggaacgcaacatcaccgtacagcatttgctggtgcaacaactggacagcaattactttacgcattagatgagcaagtacgtcgtcacgaagtagcaggacttgtaacgaaatatgaaggttgggatttcttacgagctgttgttgatgatgaaggtgtgtgccgaggaatcgttgcacaagacttacaaactatggagattagaagtttcggagcagatgccgtgattatggcaacagggggccctggtatcattttcggaaaatcaacaaactccattatcaatacaggtacagcagcttctgctgtatatcaacaaggcgcatattatgcaaacggtgagttcattcaaattcacccaacggcaattcctggagacgataaattacgtcttatgagtgaatctgcacgtggtgaaggtggacgtgtttggacatataaagatggtaaaccatggtacttcttagaagaaaaatatccggcttacggaaaccttgtacctcgtgacatcgcaacgcgtgaaatctttgatgtttgcgtagagcaaaaactaggtattaacggtgaaaacatggtgtacttagatctttctcataaagatccaaaagaactagatattaaactaggtggaattattgaaatctatgagaaatttacaggggatgatcctcgtaaactaccgatgaaaatcttcccagctgttcactattcaatgggcggactatgggttgattataaacagatgacaaatattccaggtttatttgcagcaggtgagtgtgattattctatgcacggtggtaaccgtcttggtgcaaactcactattatcagcaatttatggtggtatggtagcaggaccaaacgcaattgagtatatgaaaggtctttctaaatcatctgatgctgtttcatctactgtatatgagcaaaatgaattaatcgaaacagagaaatttaacaatattttaacgatggatggtaacgaaaatgcgtatgttcttcataaagagcttggagaatggatgacagataacgttacagtagttcgtgaaaataaaaaattattagaaacagatgcgaaaattgaagaattaatggctcgttacaaacgtattaacattaacgatacagcaagatggagtaaccaaggtgcttcatttacacgccaacttgcaaatatgtttgagttagcacgtgttattacaattggcgcatataaccgtaatgagagccgtggggcgcattacaaacctgaattcccaaatcgtgatgatgcaaacttcttaaaaactacgatggcaaaatttgagggagaaggaaatgcaccagcattccattacgaggacgttgatatttcgttaattaaaccacgtaaacgtgattattcttcaaaa

SEQ ID NO: 40248 - DNA, 750 bp, Bacillus thuringiensis
atgtctgagaaaacaatccgcttcatcattacgagacaagacgggccagatgcgcaagcgtttgaccaagagtttgaaattccatatcgtccgaatatgaatattatctcagcacttatggaaatccgtcgtaatcctgttgattcaaaagggaaccaaacaactccgattgcatgggatatgaactgcttagaggaagtatgtggtgcatgttcgatggtgattaacggaaaaccacgtcaatcatgtacggcacttatcgatcaattagagcaaccaattcgcttaaaaccgatgaagacattcccggttgtacgtgacttgcaagttgatcgtagtcgcatgtttaatgctctaaaacgcgttaaagcgtggattccaattgatggtacgtatgacctaggtccaggaccaagaatgcctgagaaaaagcgtcaatgggcttatgagctttcaaaatgcatgacatgtggtgtttgcttagaatcatgtccaaacgtaaacagtaagtctgactttattggaccagcaccgttatcacaagctcgcttattcaactcacatccaacgggtgaaatgcataaagcagatcgcttacgtgcaattatgggagatggaggactagcaaactgtggtaactctcaaaactgtgtgcaatcatgtccgaagggtattcctttaacaacttcaattgcggcattaaaccgtgatacaacaattcaatcgttcaaagatttctttggtagcgat

SEQ ID NO: 40249 - DNA, 2978 bp, Bacillus thuringiensis
tttacgctagatattgagtctggaatcattttagttgtaacgattcctatcgtgatcatatttatgattcttctcggattggcagcgcaaaaaatggcagatagtcagtacgagatatatcgtgtactttcgaaccattttgtagatacgttaaaaggtttagaaacattaaagtatttagggaaaagtgaacagcacgaaggaaagattgaaaaagtaagtaaaaggtatagaaaagcaacgatgcgtactttgcgagttgcttttctttcttcttttgcattagatttctttacgagtttatcaattgcgtttgtggcagttggattagggatacgtttaatagatggaacgattatactattaccagcccttacaattttgattttagctccggaatattttctgccgattaaacaagtgggagcaaattatcatgcgacattagatggacaaattgcgatggagcaaatagaagagattttgcaacaacaaaaaggaatacaaaagaaagatttaaatgaagatatagtatggaatgcctctagtagcttgaaattacaagacatcaaagttaataatactgaatctgaaaaggctatattagaaggaattaattttacttgggaaggtaacggtgctattggtgttattggtgaaagtggtgcaggcaaatcgacgttaatcgacgtattagcaggttttttatctccttcgagtggaaagatgttagtaaatggtgtagaagttgatggatctactcgtgaagattggcaaaaaaatatcgcttatattccgcagcaaccttatatttttccgctttcattaaaggataacattcgtttttatgaaacaaatgcaacagatgaagaagttgaaagagttattaatgaagtcggccttcgttcactcgttacatcacttccaaatgggatgcacgaaagaattggagaaggtggacgtatgctaagtggcggacaagaacagcgtgttgctatggcgcgtgcgcttttaagtaaaaaaccaatcattttattagatgagcctacggcacatcttgatattgaaaccgaatttgaaataaagcaagcgatgttacgtctatttaatggaaagttagtatttttagcaacccaccgtctacattggatgaaacaaatggaccatattcttattttaaataaaggggaaatgaaagaaagtgggacgtatgaagaacttttagagaatgagacattacattttcatagggaagagaggggagagaaatgagtaactgggttaaaccttatataaaacaaaataaaggtagaatgactttaactattttccttggtcttcttggagttagttcaggagcgatgttactttttatttcaggttatttaatctcaaaatctgcccttagaccagaaaatgtaatggctgtatatgttcctattgttgcaacaagagcgtttagtatagggcaagctgtatttcattatatagagcgcttagtcggacatgatgtcgtactacgtatattagaaaaaatgagaacgaggctatatagaatagtagaaccacaggcgttatttttccgttctcgatttcaaacgggtgatatgttaggagtgttatccgaagatatagagcatttgcaaaacctatatttacgtacaatatttcctagcatattagcgctagttgtttatagtatcttcgtacttgttatcggtgcatttgattttgtttttgcacttattgtaggttgtatgttagctattatcgtttttcttcttccgtttgtatcattacttttgatgaagaaacatcatgttactttaaagcaaggaagaaaccgtttgtatcaacaactgacagatgctgtttttggattatctgattggcaagcaagtggtcgtaaagatgaatttattaatgagtatgtaaaacaaaatgatcagttgttaaaaatcgaaaagagagtgaaacgctggtatcatattcgggacagtatcattcaattagtagtaggtattgtagttatttcgatgatcatatggactgggaatgaagcggcaagtgaacaaattgctcctacagttatcgcagctttcgtattaatgactttatctgtaacgaacgcgcttattcctattgcagatgccatcgatcgaataccgtcgtatgtagaatctacccatcgtcttaatggcgtagaaagtgatagtgttttacatgatgaaacggatttgcatggagagaaagattatattgaaccaaaacatgtagatattgaactgaatcacgtatcgtatagttatccagatagtaatgagattgtattaaaagatgtatcattacaaataaaaacagggaagaaaattgctattttagggagaagtgggacagggaaatctactttactaaaattgttaacaggggcgttaagcccagtaaatggccaagttgtactaaatggtgaacgagctcatacgaatcttttatctaaatatatttctgtattaaatcaaaagccgcatttgtttgatacgacaattggaaataatgtacgaattggcaaaccagaggcgacggatgaagagatatggaaagctttagagaaagcacaattagcttcacatgttacttctcttccagacggattacaaacaaaaatgcatgaaatgggaaagcggttttctggtggggaaagacaaagggttgcttttgctagaactcttatgcaagaaacaccaattattgtacttgatgaaccgactatcggtttagatccaaaaacagaattgtctttaattgaaacaatgttttctgcaacggaagaaaagacggttatttggattacgcaccatcttgtaggaatagaacatgtagacgaagttatattccttgatcgtggccaaattgtcatgcaaggtagtcataaacaacttctgaaagaaaatgaaaagtatcgtaaactttatgagtta

SEQ ID NO: 40250 - DNA, 495 bp, Bacillus thuringiensis
atgttattaatcggcacagaagtaaaaccgtttaaagctaatgcttaccataatggagaatttatccaagttactgacgaaagtttaaaaggaaaatggagtgtagtttgtttctacccagctgacttcacattcgtttgcccaactgaacttgaagacttacaaaaccaatacgcaactctaaaagacttaggcgttgaagtatactctgtatctacagacactcacttcactcacaaagcatggcatgatagctcagaaactatcggcaaaatcgagtacatcatgattggtgacccaactcgcacaatcactacaaacttcaacgttttaatggaagaagaaggtcttgctgctcgtggtacattcatcatcgatccagacggcgttatccaatctatggaaatcaatgctgatggtatcggtcgtgacgcatgcattcttgttaacaaaattaaagctgctcaatacgtacgtaacaacccaggtgaagtt

SEQ ID NO: 40251 - DNA, 1530 bp, Bacillus thuringiensis
gaacaggcacgccgagcatacgaacaatttagttctcagccggatgatttattaaagaatgtatacttaactgcgttacatgatcgaaatgaagtattattttatcgtatattaacagatcatttacgtgaaatgttaccgattgtatatacaccaactgtcggtgtagcaattcaaagatatagtcatgaatatcgtaaaccacgtggtgtttatttatcaattaacgatccatcaggtatcgaagaagcattcacgaatatcggtgcaacagctgagaacattgatttagtcgttgtaacagatggagaaggcatattaggaattggtgactggggcgttggtggtattaacatcgcaatcggaaaattagctgtttacactgctgcagttggaatcgatcctagtcgtgtattaccggtaattttagatgtaggtacaaaccgtgaggagctattaaacaatccattttatattggaaatcgtcaccctcgtataacaggtaaagcttacgatgaatttattgatacgtttgtacaagcggtaaacaaacaattcccgaaagcacttttacattgggaagactttagctctcgtaacgcacgaaaaattttagataaatatcgtcatgatgtttgtacgtttaatgatgatattcaaggtacaggtgcagtttcacttgcggcagtattatcggcagtgaaagcttctggtgtaccgctaagtgaacaccgcgttgttgtatttggtgctggtacggctggaatcggtatcgcagatcaagttagagatgcgatggtccgcgtaggcgtatctgaagaagaatcatataagcgtttctggtgtattgatcgtaacgggttagttacagataatatggaagatcttcttgatttccaaattccgtacgcaagaaaagaagtagaagtaagtgggtggaagcaaaatgatgtgatcggacttgctgaagttgtgaaacatgtaaaaccgacaattttaattggtacatctactgttgcaggtgcatttaaagaagagattattaaagaaatggcttctcacgtagaaagaccaattattttaccaatgtcgaatccgacaccacttgctgaagcaaaaccagcagatttaatcgagtggacagaaggaagagcgttagttgcaacaggaagtccatttgaaccagttacatataacggtgtaacgtatgtgattggacaatcaaataatgcactgattttcccaggtcttggtcttggaacaattgtagtacgagcaagcgtcatgacggatggaatgttcgcagcagcagctgaagcagttgcaagtatggtagatacaagtcagccaggagcacctattttaccagaggtcgaagaattacgtaatatctcagaaatggttgcaattgaagtagctaaagttgcagttgcagaaggtgttgcaagagtgaacttaagtgataacgatatcaagatggcagtgaaagaagcaatgtggaagccagagtatcgccaaataaaagcggta

SEQ ID NO: 40252 - DNA, 666 bp, Bacillus thuringiensis
atgatggatcaatttctttgggtattgtttccctatatcatttttgcaatctttatcggtggacatatttttagatacaactatgatcaatttggatggacatcaaaatctagtgaactattagaaaagaaaatgctccgactcggaagtctattatttcactttgggatcatgttcgtaattggcggtcatgttatggggattttaattccagaagctgtataccgttcagtaggtatttctgagcatgtgtaccatgtagtagcaattagtttcgggcttccggcaggtgttgcttctattatcggtttaattatattaacgtaccgccgcgtaactgtaaaacgtatcattgcaacgagtacaaagggagattatattgcgcttattttattacttatcgtaatgctagcaggactttcttcaacatttttaaatatcgattcaaaaggatttgattatcgtacaacgattggcccttggttccgaagtctctttattttccaaccgaaagttgaatatatgatggaagtaccaatatggtttaaaattcacattctcgcagggatggggcttttcgcagtgtggccatttacaagacttgtacatgtatttagtgccccaattaaatatgtaagccgtagttatgtgatttacagaagacgt

SEQ ID NO: 40253 - DNA, 528 bp, Bacillus thuringiensis
caaacagctttttcttgttcttcttttcttctctcctatcctgaactagggtggagagaagctttaactgaattgcaagaagaggttaaaacaatagaacaggaagacgttaaagcttcacttacagcctttataaagcaagtgctagataaaacgaatgatcaactcattgatagttacgtatatacatttgattttggtaagaaaacaaatatgtatcttacttatatgaacactggtgaacaaagagaaagaggtattgaattactagagttaaaacaacattataaaaaatcaggttttagcgtaacagataaagaactacctgactatttaccacttttacttgagttttttgcaaatgcaaatgagcaagacagtgaaccaattatgagtaaatacacggaaaatatacaagcattacacgttcaattaaaagaagcgggtagtatgtatgaaccaattcttgcgtctgtgctactcgctatcgaaacatggggtgtacagacaaattagaaaggagcgttg

SEQ ID NO: 40254 - DNA, 1452 bp, Bacillus thuringiensis
aaagcacaagtcggaatggtaatgaacctagataaatgcatcggctgtcatacttgtagcgtaacatgcaaaaacacctggacaaatcgtccaggtgctgaatatatgtatttcaataacgtagaaacgaaaccaggtattggttatccgaaacaatgggaagatcaggagaaatataaaggcggctgggaattgaaaaatggtgaaattcagctaaaatccggttcgaaaatgaaacgtcttatgaatattttctacaatccagatcaaccaacgattgatgattactttgaaccttggaactatgattatgaaacgttaacaaatagtccgcagcgtaagcatcagccagttgctcgtccgaaatcagcaattacaggcgaatttatcgacaaaattgaatggggtccaaactgggaagatgacttagcaggcggacatataactggattgcaagatccaaacgtaaagaaaatggaagaagaaattaaaacagattttgaaaacgtctttatgatgtatttaccacgcatatgtgaacattgtatgaatccatcttgcgtatcatcttgtccatctggtgcgatgtataagcgtgaagaagatggaattgttcttgtagatcaaaatgcatgtcgcgcatggagattctgcgtatcatcttgtccatataaaaaagtgtattttaactggcaaacgaataaagctgaaaaatgtacaatgtgcttcccacgtattgaagctggtatgccaacaatttgttcagaaacatgtgtaggacgtatcagatatattggagtaatgctatatgacgctgacaaagtaaaagaagcagcttctgttgaagacgaaaaagatttatatgaatctcagcttactgttttcctagatccaaatgatccagaaatagcagctgaagcgaaaaaacaaggcattcctgaagaatggattaaagcagcacaacagtcacctatctataaaatgattatcgattggaaaattgctctgcctcttcacccggagtatcgtacaatgccgatggtttggtatatccctccgcttagcccaattatgaacatggtggaagggaaaggtagtaactggcaagcagaagaggttttccctgcaattgataatatgcgtattccaattcaatatttagcgaatttactcactgcaggggatgaatcacacattcgtcttacattgaaaaaaatggctgttatgcgaacacatatgagagcactgcaaattaataaagagccaaatgaagctgtattaaaagaacttggtttaacgaaacaggatgtagaagatatgtatcgtcttcttgccatcgcgaaatataaagatcgcttcgttatcccgacatctcaccgtgaacaagtggcagatttatatagcgaacaaggaagctgtggtttatcattcacaggtggtccaggctcttgt

SEQ ID NO: 40255 - DNA, 3564 bp, Bacillus thuringiensis
agaaagcgttggtagcatgataaagtaattcgttctacacacggcgtgaactgtactggttcatgtagctggaatatatatgtgaaagatggaattgtaacttgggaagggcaggagcttaactatccgactacaggtcctgatatgccagattttgaaccgcgaggatgcccacgtggagcaagtttttcttggtacatttatagtccacttcgtgtgaaatacccgtatgtacgtggtgttctttggaatatgtggcaagaagaattgcaaaataacgagtcaccattagaggcttggaaaagcattgtggaaaaccgtgaaaaggcacgtacgtataagcaggcgcgtggtaaagggggattcattcgtgcgaattgggatgaagtattacaactcgtttcagcttcattactgtacacagtaatgaaatacggtccagaccgaaatgttggcttttcaccaattccagctatgtcgatgctaagtcatgctgctggtagtcgctttatgcaacttatgggtggaccgatgcttagcttctatgattggtatgcggatttaccaccagcttctcctcaaatttggggtgatcaaacagatgtaccagaaagtagtgactggtataactctggttacattatgacatggggttcaaatgtaccaatgacgagaacaccagatgcacactttttagcagaggttcgatataaaggaacgaaagttgtttctgtcagtcctgatttcgctgaatcaacaaagtttgcggatgattggattagtgtgaaacaaggtacagacggtgcacttgcgatggcaatggggcacgtaatcttacaagaattttacgtagataatcaagtggaatatttcacaaagtatgcgaagcaatatactgattttcctttctttgtcacattgaaacaaaaaggagatcaattcgttgctgatcggttcttaaatgcttctgatattggacgagaaacgaagttaggggaatggaaacctgttctttggaacgagaatacgaatgattttgcaacacctcacggcacaatggggtcacgttgggataatgaaaagaaatggaacttgcgtttagaagatgaagaaacaggtgaaaagattgatccacgtctttctttacttggaatggaagaagcgattggaactgtacaaattccgtacttctctgatgatggaaacaaagtattagaacgtacgattccagtgaaaaaggttatgacagaagagggcgaaatgttcgttacaactgtatacgacttaacgttagcaaattacggtgtgaaccgagggcttggcggacaagaaccgaaagacttcaatgatgatataccgtttacacctgcatggcaagagaaaatgacaggagtaaaacgtgagcttattattcaaattgctcgtgagttcgcacaaaatgctgttgatacgaatggtcgctcaatgataattgtcggagcgggtattaaccattggtttaactctgatacgatttatcgcgccgttttaaatcttgttcttctcgttggagcacaaggtgtaaacggcggtggttgggctcattatgttggtcaagaaaaattaagaccagcagaaggatggcaaacaatcgcgatggcaaaagattggcaaggtccaccgaaattacaaaacggtacatccttcttctatttcgtaacagatcaatggcgttatgaagatacacctgttggacatttagcgtcaccagttgaaggtaactctcgttatcaacatcacggtgattacaacgtattagctgcacgacttggctggttaccttcttatccaacattcgagaaaaatggaattgaattatataaagaggctgttgctgctggtgcaacaacgcaagaagaaatcggaaaatatgttgcacaaaaattaaaagaaaaagaactgaagtttgcgattgaagatccagataacacaaacaacttcccgcgaaacttattcgtatggcgtgcgaatttaatttcgagttctggtaaaggacatgaatatttcttaaaacatttattaggtacaacaaacgggttaatgaatgacgacagtgattcattacgaccagaagaaataaagtggcatgaagaagcgccagaaggaaagcttgatttactcattaatttagatttccgtatggctggaacagcactgtattctgatatcgtcttacctgcttcaacttggtacgaaaaacacgatttaagcagtacagatatgcatccatttgtacatccatttaatccggcaatcggttcaccgtgggaagcgcgctctgactgggatattttcacttcactttctaaagctgtgtcagatttagcgaagaaaattgatcttgaaccaatgaaagaagttgttgcaacaccacttcttcatgatacaccgcaagaattagcgcaaccacttggcaagattaaagattggagtaaaggtgaatgtgaaccaatcccgggtaagacgatgccacaaattcacgttgttgaaagggattataaaacgatttatgacaaaatgactgcgcttggaccaaatgccggaaaacaaccgattggtacgaaagggatctcttggtcagcagaaaaagagtatgagcaattaaagagcaaattaggagtcgttcgaacggattctatcgcgaaaggttgtccagacatcaaagaagcaatcaatgctgctgaagcggtattaacactatcttctacaacaaacggtcatatggcagtaaaagcatgggaagcacttgaaaaacaaacagatttaaaactacgtgatttagcagaagaacgtgaagaagaatgctttacattcgaacaaattacagcacaaccgaaaacagtaattacttctccggcctttacaggttcagaaaaaggtggacgacgttactcaccgtttacaacaaatgtggaacgtctcattccttggagaacgataactggtcgacaatctttctacttagaccatgacatgatgaaagaatttggtgaaacgatggcaacatttaaaccaattctgcaacataaaccgttccgtaaatcacgacctgaagtagaagggaaagaaattacattaaactatttaacaccgcataataagtggtcgattcatagtatgtacttcgattcattaccgatgttaacgctatttagaggtggtccaactgtttggatgaataaagaggacgctgctgaagcgggtgttgcagataatgattggattgagtgctttaatcgtaacggtgttgttgtagcgcgtgctgttgtaacgcaccgtataccgagaggaatggcatttatgcatcatgcgcaagatcgtcacattaacgtacctggtacgaaattaacaagtaatcgcgggggaacgcataatagtccaactcgaattcacgtaaaaccgacacatatgattggtggatatggtcaattaagttatggatttaactattatggtccaactgggaaccagcgcgacttaaacgttgtaattcgcaaactgaaggaggtagattggcttgaagat

SEQ ID NO: 40256 - DNA, 597 bp, Bacillus thuringiensis
aagaatcttgatgggaaagtagcattagtaacaggggcaagtcgcggcattggtcgtgcgattgcgatgagattggcaaacgacggtgcattagttgcgattcactacggccgaaataaaatagttgcagatgaaacaattagtgagattgaatctaatggaggaaaggcattcttaattgaagctgatctcaatttaatggatggtgtcaaaaaaatagtagaacaattgaagaatgaattacaaataagagttggtacatcagagattgatattttagtaaacaatgcagggataggtacacaagggacgattgaaaatacgacagaagaagtttttgatgaaattatggccgtaaatattaaggcgccattctttttaattcagcaaacattaccgttactacgagtagaagggcgcgttattaacatttcatcagcggaagtaagacttggttttacagggtccattgcatacggtttaagtaaaggtgcactaaatacgatgacacttcctctagctaaacatcttggagaacgaggtataacagtgaatacaattatgcctggatatacgaagacagatatcaatacgaaa

SEQ ID NO: 40257 - DNA, 663 bp, Bacillus thuringiensis
ataaatacaattataaaaacgactaaccttactaaagtatatggcaatcaaaaatcagtagataatttaaatattaatgttcaacaaggagagatttatggcttcataggccgcaacggtgctggtaaaacaacaaccattcgtatgctgcttagtcttataaaacctacaagtggaacgattgaaatattcggagagaacttattccaaaatcaaaaagatattttaagcagaattggttctatagttgaagttccaggattttatgaaaacttaactgcaaaagaaaacctactaattaatgcaaagataattggggttcacaaaaagaatgctatcgaagaagcattagaaatagtaggcttgcagcatgagacaaaaaagttagtaggaaagtattctttaggaatgaagcaacgcttaggaattgcacgcgctcttctccattatcctgagctactcatattagatgaaccaactaacggactagaccctattggtattaaagaaatgcgaaaacttattcattctttagctcaagaaagaaatataacaatactcatttctagtcacatattagccgagatagaacagttggtcgatcgtatcggaattattcatgaaggaaagttactagaagaagtttctcttgatacgctgcgc

SEQ ID NO: 40258 - DNA, 1552 bp, Bacillus thuringiensis
catttattagctttcgatgctggtacagggagcattcgagcagttctttttgatttacatggtaatcaaattgcagtaagtcaaaaagaatggattcacaaatctgaccttcgttatccaggctctatgaactttgatgtagtagaaaattggaagctagtacaagaatgtacgaaagaggtgcttcaaaaaagcaacactcctgcctcttctattcttgctattagcgctacaagtatgcgagaaggatttgttttatatgatcaagatgggcaagaaatatgggcgtgtgcaaatgttgatgggcgcgcatccgtcgaagttagtgaattaaaagaaattcggtcacatcttgaaaaagatttatatacaaagtctggtcaaactttttcattaggtgctttaccacgcctactctggataaaaaaacatgaacccgacgtctataataatatttactcttttacaatgttaaacgattggattttatataaactaagcggcgtactacaaattgatccctcaaacggatgcacgtcaggtatttttgacttacaaaatagagtgtgggataacgatgtcgctaaggagtgcggtctatctttgccattttcaccaacagtaaatgaagctggtacagtaattggcaacgttacaaaagagtgtgcagcattaactggtttacttgaagggattcctgcgtcgccgggggtggagatgctcaaatggcatcgctcggaacaggaatcgtgaaccgaatcaaacgttaatatgcgggggtagcttttggcaacaagaagtgaatgttactgagccaataacagatccacatgctgcgattcgagtaaattgtcacgtcgttccgaacctatggcaatatgaaacaatcgcctttttcccaggtctcgttatgcgctggtttcgagacgctttttgccaagaagaaaagaaacatgctgataaactcggtgtagatgcttatgaattactagaagaacaagcgaaagacgtacctgtcggttcacatggcattatccctactttttcaaacgttatgaactacatttcttggcgtcatgccgcaccttcattcttaaatttaagtttagacgctgacaaatgcggaaaaaaggaaatgttccgtgctattgaagaaaatgccgccttcgttacacttggaaacttaaaactaattgaaaatcttactggtacattcccttctgaagtcgtttttgctggcggtgccgctaaaggaaaactatggccacaaattctatcagacgtactcggtattcctgtaaaagtacctgttgtgaaagaagcagctgctttaggaactgcgattgctgctggagttggtgctggcatatattcatctatggaagaaactgccgaagagtttgtacagtgggagcaaacattcgaaccagttactgaaaatcacgaactatataaagagttctatgaaacatggaaaactgtatatgacagtcagctcgctttagctgataaagggctcacctcacatatgtggattgcgcctggtgcactg

SEQ ID NO: 40259 - DNA, 1488 bp, Bacillus thuringiensis
atgtcaaaaagcgttgtaatcgctgaaaaaccttccgttgcacgagatattgctcgtgtactgaagtgtgataaaaaaggaaacggctatcttgagggtagtaaatatattgtaacttgggctttaggtcatctcgttacattagcagatccagaaagttatgatgtgaaatataaaaagtggaatttagaagatttaccgatgctacctgagcgtttgaaattaacggttattaaacaaactggtaaacaatttaatgctgtaaaaagtcagctacttagaaaagatgtaaatgaaattattgtagcaacagacgctggacgtgaaggggaattagtcgcacgctggattatcgataaagttaagctaaataaaccaatcaaacgtttatggatttcttctgtaaccgataaagcaattaaagatggttttgcaaatttaaaaccaggtaaagcctatgacaatttatacgcttcagcagttgcacgttcagaagctgactggtatatcggtcttaatgcaactcgtgctttaacgactcgctttaatgcccagttaaattgcggccgtgtacaaacccctactgttgctatgattgctagtcgtgaggatgaaataaagaacttcaaagctcaaacttactacggcatcgaagctcaaacaatggagaagctcaaacttacttggcaagatgcaaatggcaatagccgtagttttaataaagaaaaaatcgatggtattgtaaaaagtttagataaacaaaatgctactgttgtggaaattgataagaaacagaagaagtcattctctcctggtctttacgatttaactgaattgcaacgtgatgcaaataaaaagttcggttactctgctaaagaaacattaaatattatgcaaaaattgtatgaacagcataaagtactaacgtaccctcgtacagattcacgctacatttcatctgatatcgttggaacacttccagaacgtctaaaagcatgtggtgttggagaataccgtcccttcgcacataaagtattacaaaagcctatcaaacctaacaaatcatttgttgatgatagtaaagtaagcgatcatcatgcgattattccaacagaaggatacgttaacttcgcagcattcacagataaagaacgcaaaatttatgatttagttgtaaaacgtttcttagctgttttattcccagcattcgaatacgaacaactaacgttacgcacaaaggtcggcaatgaaacattcattgcacgcggaaaaacgattttacatgctggttggaaggaagtatacgaaaatcgatttgaagacgatgatgtaactgatgacgtaaaagagcagattctacctcacattgaaaagggcgatacattaactgtaaagttacttatgcaaacatcaggtcaaacgaaagcacctgcacgctttaatgaagcaactttactttcagcaatggagaatcctacaaaatatatg

SEQ ID NO: 40260 - DNA, 534 bp, Bacillus thuringiensis
atgatgaatcaagatatcgaaaaagtattaatttctgaagagcaaatacaagaaaaggtgcgcgaactaggtgcaattgttgcagaggattataaaaacacagtacctcttgcaattggtgtattaaaaggcgcaatgccattcatggcagatttattaaagagaacagatacatatcttgaaatggattttatggctgtatctagttacggtcactctacagtttcaacaggcgaagtgaaaattttaaaagatcttgatacttctgtagaaggtcgcgatattttaatcgtcgaagatattattgatagtggtcttacactaagctacttagtagacttattcaaatatcgtaaagcgaagtctgtaaaaattgttacattattagataagccaacaggccgtaaggttgatctgaaagcggattatgttggatttactgttccacatgaatttgtagtaggatatggattagattataaagagcagtaccgtaatcttccttatgtaggcgtattaaaaccaagcgtttac

SEQ ID NO: 40261 - DNA, 1383 bp, Bacillus thuringiensis
aggaaaaaagttgtgatcgtcggcggaggtattactggattaacagcaatgtataacttacaaaaaaatattcatgaaaaaaacttgccgattgatacattacttatagaagcatcgggtaaacttggcggaaaaattcaaaccgttcgaaaagatgggtttacaattgagcgcggaccggattctttcttagcacgaaaagaaagtgcagctagattagtgaaagaattgggtctcggcgatgaacttgtaaataatcaagctggtcaatcatttatcctcgtaaacaatcggttacataaaatgccgactggatcaatgatgggaattccaacgcaaattacgccgtttctattttccgggctgttctccccaattggtaaactaagagctggttttgatctattaatgccgaggtcaaagccagtatctgaccaatcactcggacaatttttcagacatcgtcttggaaacgaagtggttgaaaacttaatagaaccgttactatcgggtatttatgcaggggatattgatcaaatgagcttaatgtcaacattcccgcaaatgtatcagattgagcagaaacatcgcagtatttcactcggtatgcgtacgctcgctccgaaagaagagaaagctgaaccgaaaaagggaatgttccaaacagtgaaaacaggtttagaatctatcgtaaaatctctcgaagtaaagatgcatgaaggtacgataataaagggaactcgcattgaaaaagttgcaaaacagggtgatggttatacaattactcttagtaacggaaaagaaatagaagcggacgccatcgtagtggcaacttcgcataaagtattgccgtccatgtttgctcagtacaagcagtttcgtttcttccgtaatattccatccacatccgttgcaaatgtggcacttgctttccaaaagtctgcaatccagcgtgatattaatggtacaggatttgtcgtatcacgaaatagcgattacaccattacagcatgtacgtggacgcataaaaaatggccgcatacaacgccagaaggaaaaacactccttcgttgctacgtcgggcgtgctggtgatgaagcggttgtagaacaaactgaagaagaactcgttcagctcgtactagaagatttaaagaagacgatggacattacagaggatccagagtttacaattgtaagtcgctggaaagaagcgatgcctcaatatacagtaggccataacgagcgaatgaaacagctcacaacatttatggagaaagagttgccaggtatatacttggcaggtagctcctatgctggcgctggacttccagactgtattaatcaaggtgaggaagctgcaaagcgtgtattatctcatttg

SEQ ID NO: 40262 - DNA, 915 bp, Bacillus thuringiensis
aaaaagaaaattggtttgcttgtaatggcatacggaacgccatataaagaagaagatattgaacgttactatacacatattcgtagaggaagaaagccaagtcctgaaatgctggaagatttaacagagcgttaccgtgcaattggtggtatttctcctttagctactattacattagagcaagctaagaagttagaacagcgtttaaatgaagtacaagatgaagtagagtaccatatgtatcttggtttaaaacatattgaaccgtttattgaagatgcggtgaaagatatgcataacgacggaatacaagatgcaatcgcacttgttcttgcacctcactattctacgtttagcgtgaaatcatacgttggacgagcacaagaagaagctgagaaacttggaaacttaacaattcacggcattgatagctggtataaagagccgaaattcatccagtactgggttgatgcagtgaaaggtatatataacggtatgtcagatgcagagcgtgaaaaagcagtattaatcgtatctgcacatagcttaccagagaaaattattgcaatgggcgatccatatccagatcaattaaatgaaacagcggattatatcgcgcgcggagctgaagtagcaaactatgcagtaggctggcaaagtgcaggaaacacaccagatccttggattggtccagatgtacaagatttaacgagagaactaaatgaaaagcacggttatacttcattcgtatatgcaccagttggatttgttgcggaacatttagaagttttatatgacaacgactttgagtgtaaagttgtaacggatgaaattggtgcgaaatattatcgtccagaaatgccaaatgcatcggacgcatttattgattgtttaacagatgttgtattaaagaaa

SEQ ID NO: 40263 - DNA, 1026 bp, Bacillus thuringiensis
actataaatgagacatttttaaaagcatgtaggggggaacgtaccgattatgtaccagcatggtatatgcgtcaagcaggtcgttcacagccggaatatagaaagattaaagaaaagtattctttatttgaaattacacataatccagagttatgtgcttacgttacaaaattgccggttgatcaatataacgtagacgcagcaattctttataaagatattatgtcaccactacctgcaattggtgtggatgtagaaattaaatcaggtattggcccagttattgataatccaatccgttctttacaagacgtagaaaaactaggggaaatcaatccagaagatgacgtaccgtacatactagatacaattcgtttattaacgacagaaatgttagacgtaccgttaatcggtttttcaggagctccatttacattagcgagctatatgattgaaggcggtccatctcgtaactaccataatacgaaagcgttcatgtatgcagagccaaaagcttggtttgctttaatggataaactagcagatatggttattacatatttaaaagcgcaaataaacgcaggagcaaaagcagttcaaattttcgattcttgggttggaacagtaaatgtagcagattatcgcgtatttattaaaccagcaatggagcgtatttttgcagaagttcgtaagatgggtgtaccgatgattatgcacggcgtaggagctgcacacttagtgaatgagtggcacgacttaccgcttgatgtagtcggcttagactggcgcttaccgattgaagaagcacgtgcacgtggcgttcataaggcggtacaaggtaatatggacccttcattcttacttgcaccatggtctgttattgaagaacatgtaaaaggtattttagatcaagggatgaaacagccgggttatatctttaacttaggtcacggtgtattcccagaagtaaatccggatacattaaaacgtttaactacatttattcatgaatactctaaagggcag

SEQ ID NO: 40264 - DNA, 636 bp, Bacillus thuringiensis
atgggtacagaatttaatggtttatttgatgagtgggctcatacgtacgactcatttgtacaaggcgaagatatacaatataaagaagttttcgcccattatgaggacattctagaggatgtagttaacaagtcatttggtaatgtattagaatttggtgtcggtacaggtaatttaacaaataaattattacttgctggccgcacagtttacggtatagaaccgtcgcgtgaaatgcgcatgattgcaaaagagaaattgccaaaagaattttcaattacagacggtgattttctttcgtttgaagttccaaattcaattgataccattgtaagcacctatgcatttcatcatttaacagatgatgaaaaaaatgtagcgattgcgaagtatagtcaattgctaaacaaaggtggtaaaatagtgtttgctgatacgatatttgcagatcaagatgcatatgataaaactgttgaaacagcaaaacaaagaggtttccaccagttagcaaacgatttgcaaacggaatactatacacgtattccagttatgcagactatttttgaaaacaatggcttccatgtaacgttcacgagattaaatcatttcgtttgggtaatggaggcaactaagcaa

SEQ ID NO: 40265 - DNA, 1119 bp, Bacillus thuringiensis
aagacaaagttaattcatggtattcgcataggagaaccttcaactggatctgtaaacgtaccgatttatcaaacaagtacgtacaaacaagaagcagttggtaagcatcaaggatatgaatattcacgtacaggtaacccaacacgtgcagctttagaagaaatgattgctgtattagaaaatgggcatgctggatttgcatttggttcaggaatggctgctattacagcgacaattatgttgttctcaaaaggtgaccacgttattttaacagatgatgtttatggcggaacataccgcgttattacgaaagtattaaaccgtttcggtattgagcatacatttgtagatacaacaaacttagaggaagttgaagaagcgattcgtccaaatacgaaagcaatttatgtggaaacaccaacgaacccactactaaaaattactgatattaagaaaatatctactcttgctaaagagaaagacctattaacaattattgataacacattcatgacgccatattggcagtcgccgatttctttaggagcagatattgtgcttcatagtgcaacgaaatatttaggaggtcatagtgatgtagttgcaggtttagtagttgtaaatagcccacaactagcagaagatcttcactttgtacaaaactcaacaggaggtattcttgggccacaagatagcttcttactacttcgcggtttaaaaacattaggaattcgtatggaagaacatgaaacgaattcacgtgctattgctgagttcttaaataatcatccaaaagtaaataaagtatattacccaggtcttgaatcacatcaaaatcacgaattagcaacagaacaagcaaacgggtttggtgctattatctcatttgatgtagatagtgaagaaacattaaataaagtacttgagaaactacaatactttacacttgctgaaagcttaggagcggtagaaagtttaatttctattccatctcaaatgacacatgcatcaatcccggctgatcgccgcaaagaattaggaattacagatacattatttcgtatttctgtcggtattgaagatggtgaagatttaattgaagatttagcacaagcgcta

SEQ ID NO: 40266 - DNA, 987 bp, Bacillus thuringiensis
actatgaaagcacaaattatccattcttttggggattcatctgtatttcaattagaaaaagtttcaaaaccaaaacttttaccaggtcatgttctaatcgatgtaaaagcaacaagtgtaaatccaatcgatacaaaaatgcgtagtggggccgtttcagccgtcgctcctgagtttccagctatattacacggcgatgtagctggtattgttattgaagtaggagaaggtgtttcgaaattcaaatcaggggataaagtatacggatgtgccggaggttttaaagaaactggaggtgcacttgcagaatttatgcttgctgatgcacgattaattgctcacaaacctaacaatttaacaatggaagaagctgctgctctaccattagttgcaattacagcttgggaatctttatttgatcgtgcaaatattaaacctggtcaaaatgttctcattcatggagctactggtggcgtaggacacgtagccattcaactagctaaatgggcaggcgctaaagtttttacaacagcttctcagcaaaacaaaatggaaatagcccatcgtttaggagccgatatagctattaattataaagaagaatctgttcaagaatatgtacaaaaacatacgaacggaaacggatttgaagttatatttgatacagtaggcggcaagaatcttgatcattcttttgaagctgctgcggtcaatggaactgtcataactattgcagctcgttcaacccatgacctctctcctttacacgcaaaaggactctctctgcacgttacttttatggcattaaaaatattacatacagataagcgtaatgattgcggagaaatcttaacgaaaataacgcaaattgtagaagaaggaaaacttcgtccattgctagattctaaatcttttacgtttgatgaagttgcacaagcacatgaatatttggagtcaaataaagcaataggtaaaatagttttgaaa

SEQ ID NO: 40267 - DNA, 1464 bp, Bacillus thuringiensis
ctgaacttggaatcaatgacctttgttttatttggagcgacaggggacttagcgaaacgcaaaatttacccagcactatataatttatatagagatcaaaagcttccaaagcaaatatccgttatcgggcttgggagacgtcaagtatctcatgtagattttcaagaaagaataaaagaatcaatagagacgttttcccgtcatagagaagaaggtactccggaactggaaggttttttagataattttcgctattgtccattagatgtgagtaagccggaagactatgagaggttattacaagtcgttcgtgaaagggaagaagaattacatataaaaggaaatagaatgttttatctttccgttgctcctgaatttttcgagaccattgctttaaatattaaggaaagcggacttgataaaacggatggatggaaacgtctgatgattgagaaaccattcgggcacgaccttacatctgctcgtgagcttaacgataagcttagtcgcacgtttgaagaagacgagatataccgtatcgatcattatttaggtaaaccgatgattcaaaatcttgaagcattagaatttgcaaatcctgttctccaatcaatttggaataaagaacatatagcgaatgtacaaatcacagcgagtgaaacagttggggttgaagaaagggcaggatattatgaccaggcaggggccattcgagatatggttcaaaatcatatgttacaaatattaatgatgactgctatgaatctgccggaaaaggttaatgcatgtgaaattcgagaggaaaagcgaaaggtaatggaaacgcttcgtaaagtgaaaaaagaagacgttcaaagccatatcattcgcggacaatacgctgcaggtgagataaaaggcgggcaagttgtagcatacaaagaggagccaggagtaaatccttcttctaacatagacacatttgttgctgctcgcctgtggatcgataatccattttggactggcgttcccttctatatacgaacaggcaaacgaatgaaagaaaagtctactcgtattgtaatcgaatttaaaaatacgttaaaacagcaatatcaagataataatccaaatgcagcacctaacttattaataattgaaattagcccaggtgagaacgtttcattacagttaaacagtaaaaatccattgaaaaatggagaaattgaaccgatgcgtattaactttacttgtgagcaagcggatgtgggagtacctgaagcgtatgaaagactcattcatgatgctgtgagtggagacgctacattctttgcacattggagagaagttgaattgtcatgggaatgggtacaaccaattcttgaagcgttcgaggaaaacttattaccgcttcatgaatatgagtctggttcatatggtccagaagcgtctaatgaactgttacaagaaagtggatttaaatgg

SEQ ID NO: 40268 - DNA, 756 bp, Bacillus thuringiensis
gtgagacatgcgctcattacagccggtacgaaaggtttaggaaagcaagtaacagaaaagttattggctaaaggctattcagtaacagtaacgtaccatagcgataccacggctatggaaacgatgaaagaaacatataaagatgtggaagagcgtctacaattcgtgcaagcggatgtcacgaaaaaggaagatttacataaaatagtagaagaagcgatgagccattttggcaaaattgactttttaattaataatgctggtccatatgtatttgaacgaaaaaagttagttgattatgaagaagatgaatggaatgaaatgattcaggggaatttaacagcggtatttcatttattaaaacttgtcgtcccggtcatgagaaaacagaactttggccgtattattaattacggatttcaaggggcggatagtgcaccgggatggatttatcgttcagcttttgccgcagcgaaagtaggacttgtttcattaacgaaaacagttgcttatgaagaagcggagtatggtattactgcgaacatggtatgtcctggtgatattataggcgagatgaaagaggcaactattcaagaagcacgtcagctgaaagagcataacacaccgattggtagatctggaacaggtgaagatattgcaagaaccatttcgtttttatgtgaggacgattccgatatgattaccggtacaattattgaagtgactggtgcagtggatgttattcatagacatcga

SEQ ID NO: 40269 - DNA, 1047 bp, Bacillus thuringiensis
atgaaagcactactttggcataatcaacgtgatgtacgagtagaagaagtaccagaaccaacagtaaaaccaggaacagtgaaaatcaaagttaaatggtgtggtatttgtgggacagacttgcatgaatatttagcagggcctatttttattccaacagaagaacatccattaacacatgtgaaagcacctgttattttaggtcatgagtttagtggtgaggtaatagagattggtgaaggagttacatctcataaagtgggagaccgcgttgttgtagaaccaatttattcttgtggtaaatgtgaagcttgtaaacatggacattacaatgtttgtgaacaacttgttttccacggtcttggcggagaaggcggcggtttctctgaatatacagtagtaccagaagatatggttcatcacattccagatgaaatgacgtatgaacaaggtgcgcttgtagaaccagcagcagtagcagttcatgcagtacgtcaaagtaaattaaaagaaggggaagctgtagcagtatttggttgcggtccaattggacttcttgttatccaagcagctaaagcagcaggagcgactcctgttattgcagttgaactttctaaagaacgtcaagagttagcgaaattagcaggtgcggattatgtattaaatccagcaactcaagatgtgttagctgaaattcgtaacttaacaaatggtttaggtgtaaatgttagctttgaagtaacaggtgttgaagttgtactacgacaagcgattgaaagtacaagcttcgaaggacaaactgtaattgttagtgtatgggaaaaagacgcaacaattactccaaataacttagtattaaaagaaaaagaagttattggtattttaggataccgtcacatcttcccagctgttattaaattaattagctctggtcaaattcaagcagagaaattaattacgaaaaaaattacagtcgatcaagttgttgaagaaggatttgaagcacttgtaaaagataaaacacaagtgaaaattcttgtttcacct

SEQ ID NO: 40270 - DNA, 1317 bp, Bacillus thuringiensis
atggctgtagaaaatattacaatgcctcagctcggggagagcgttacagagggcacaattagtaaatggctcgttaatgttggcgatcacgtaaataagtatgatccgcttgcagaagtaatgactgataaagtaaatgctgaagtaccatcttctttcacgggtgttgtgaaagagttaatcgctggtgaaggtgatacgttagctgtaggtgaagtagtttgtgttattcaagtagaaggcgcagatgaagtagcagcaacagctgttgaggaaaaaacaaaagaagaatcaaaggcagaaatagctacgtctgaaaaagcaccgaaagtaaagcaaccatctgatggaaaaccccgtttttcaccagctgtgttaaagcttgcgggtgagcataacgttgatttagatctagtagaaggtacgggagcaaacggccgtatcactcgtaaagatattttaaagcttgtggaatctggaaatatcccacaagcaggtgcggcgaagaaagaggaagctgtagcggcagtagtagaagctcgcccagaagcaccaaaagcagcaccagtagcgcaaaacgtagcacctgcgaaaccagtacctgtacccacaatgcctggagatattgaaattccagtaacaggtgtgcgtaaagcaatcgcagcaaacatgctacgtagtaaacacgaagcaccacatgcttggatgatgattgaagtagatgtgacaaaccttgtgtcataccgtaactcaattaaaggtgactttaagaagcgtgaaggctttaacttaacgttctttgctttcttcgtaaaagcagtagcacaagcgttaaaagagtatcctcaaattaattcaatgtgggctggcgataaaattgttcagaagaaagatattaacctttctatcgctgttgcaacagaggaagaactatttgtaccagtaattaagcaagcggacgagaaaacaattaaaggtattgctcgtgaaattacagaacttgcaggaaaagtacgtacgaaatcgttaaaagcagacgaaatgcaaggtggaacatttacaattaataacacaggatcattcggttctgttcaatctatgggtattattaattacccgcaagcggctattttacaagttgaatcaattgtaaaacgcccagtaattatggataacggtatgttcggtgctcgtgatatggttaacttatgtttatcacttgatcaccgagtacttgatggtttaatttgtggtaagttcttaggacgtgttaaagaaattttagaaaacatgtcagaaaataatacatctgtatat

SEQ ID NO: 40271 - DNA, 1966 bp, Bacillus thuringiensis
cttggcttaagtgatgagcaagtattagaaatgttccgtacgatgttacttgcacgtaaaattgacgaacgtatgtggttattaaaccgcgctggtaaaattccattcgtaatttcttgtcaaggacaagaggctgcacaagttggagcggcgttcgctcttgatagagagaaagattatgcattaccatactaccgtgatatgggtgttgtactagcatttggtatgacagctaaagagcttatgttgtctgctttcgcgaaagctggagatccaaactctggtggtcgtcaaatgcctggtcacttcggtcaaaagaaaaatcgtattgttacaggttcatctccagtaacaacgcaagtaccacatgcagttggtattgcactagctggaaaaatggagaagaaagatttagtaacgttcgttacatttggagaaggttcttcaaaccaaggtgacttccatgaaggggcaaactttgctggtgtacacaaactacctgttatttttatgtgtgaaaataacaaatatgcaatctctattccagttgaaaaacaattagcatgtaaaaacgtatcagatcgtgcgattggttacggtatgcctggatatacaatagacggaaacgatccgcttgcagtatataaagctgtaaaagaagcagcagatcgcggtcgtcgtggtgaaggcccaactttaattgaaacagtatcatatcgtttaacagcacattctagtgacgatgatgatcgtgtttatcgtgataaagaagaagtagaagaagcaaagaaaaaagattcaattataacattcgcggcttatttaaaagaagctggtgtgttaactgaggaatcggaaaaacaaatgttagacgaaattatgcatatcgtaaatgaagcaacagaatatgcagaaaatgctccgtatgcagcacctgaagatgcattgaagcacgtatacgcagaataggggggaacgtttcatggatgtaatgtcttatattgatgctattacattagcaatgcgcgaagaaatggaacgcgatgagaaagtattcgttttaggagaagatgttggtaaaaaaggtggcgtgtttaaagcgacacacggtttgtatgatcaatttggtgaagatcgtgcgcttgatgcaccgcttgcagaatctgcaattgctggggtagcaattggtgcagcaatgtatggtatgcgtccaatcgctgaaatgcagtttgctgatttcatcatgccagcagtaaaccaaattgtttctgaggcagcaaaaattcgttatcgttctaataatgattggacttgtccagttacaatccgtgcaccatttggcgggggtgttcacggtgcattgtatcattcacaatctgtagaagcgatgtttgcaaaccaaccaggtttaaaaatcgttatcccttctacaccatatgatgcaaaaggcttattaaaagcagccattcgtgatgaagatccagtattattctttgaacataaacgtgcatatcgtttaattaaaggtgaagtaccggaggatgactacgtattaccaatcggaaaagcagatgtaaaacgtgaaggtgatgatattacagttatcacgtacggattatgtgttcattttgctcttcaagcggctgaaaagttagcacaagatggcatctctgcacacattcttgatttacgtactgtatatccattagataaagaagcaatcattgaagcagcttctaaaacaggtaaagttcttcttgtaacagaagacaataaagaaggaagcattatgagtgaagtggcagcaattatcgctgaaaactgtctatttgatttagatgcgccaatcgcacgtcttgcaggtccagacgttccagcaatgccatatgcaccaacaatggaaaaattctttatggtaaatccagataaagttgaaaaagcaatgcgtgaacttgcggaattttaa

SEQ ID NO: 40272 - DNA, 1416 bp, Bacillus thuringiensis
atggcaaaagaatatgatttagtcatcgttggcggcggtactggtggatatgttgctgcaattcgtgcatcacaactagggttaaaaactgcactagtcgaaaaagaaaatcttggtggtacttgtttacacaaaggatgtattcctagtaaagctcttttacgtagtgcggaagtatatgcaactgctaaaaaaagcgaagagttcggagttattgcaagcaatgtagaactaaactttgcgaaagtacaagagcgtaaagagaagattgtaacgcagcttcataaaggcgttcaacatttaatgaaacaaggtaaaattgatgtgtttgaaggtattggccgtattcttggcccatctattttctctccgatgccagggacaatttcagttgaacttgcaagtggagaagagaatgaaatgttaattccaaaaaatgtacttattgcaacaggttctcgtccaaattcattaccaggtttagaattagacggagagtacgtaatgtcttcagatcatgccctaaaaatggaaacgcttcctagttcaattattatcgttggtggcggtgtaatcgggattgagtgggcatctatgcttgctgacttcggtgtagaagttacagtattagagtatgcaaaaacgatattaccactagaagatcaagatgtttcaaaagaaatgcaacgtctattcaagaaaaaaggtattaaagtggtaactggtgcaaaagtattaccagaaacattggtaaaagataatggagtaacaatccaagctgaacacaacggtgaaaataaagaatttaaagcagaaaaaatgcttgtatctgtaggaagacaagcgaatacgcaaaatattggcttagagaacacagatatcgttgtggaaaaaggatacattcaaacaaatgagttttatcaaacgaaagaatcgcatatttacgcaattggagatgtaatcggtggcctgcaacttgctcacgttgcttctcatgaaggaattgctgcagtagaacatattgcagggaaagaagttacaccaattgattactctatggtatcaaaatgcgtatatagcagtccagaagttgcttctgtcggtttaacagaacaagaagcgaaagaaaaaggctataagttaaaagtaggtaagttctcattccgcgcaatcggaaaagcacttgtatacggagaatcagatggtttcgtaaaacttgtagttgatgaagagacaaatgacattcttggtgttcatatgattggaccgcatgtaacagatatgatttctgaagcgggtcttgcaagagtacttgatgcaacaccttgggaagtagcacatacaattcatccgcatccatcattatctgaggcgattggtgaagcagcacttgctgtagatggaagagcgttacac

SEQ ID NO: 40273 - DNA, 1053 bp, Bacillus thuringiensis
atggcatcacaacaattaggtcgtttacgttctgaaattgatcaacttaatttacaaatattagagttactaaacgaaagaggtcgtctcgtacaagaagttggtaatttaaaagaagtacaaggtgtgaaacgttttgatcctgtacgtgaaagaaatatgctggatttaattgcagagaataataatggtccatttgaaacttcgactttacaacatattttcaaacaaatttttcaagctggtttagaattacaagaagatgatcatcgtaaagcattacttgtttctcgtaagaaaaaaacagaagatacgattgttgaaattaaaggtgaaaaaattggtgacggaaatcagcattttattatgggaccgtgtgcagtggaaagttatgaacaagtacgtcaagttgctgaagcaatgaaagagcaaggtctgaaattaatgcgtggtggtgcgttcaaaccacgtacttcaccgtatgattttcaaggtcttgggttagagggattacaaattttgcgccaggtagcagatgaatatgatttggctgttattagtgaaattttaaatccgaatgatattgagatgtcattagattacgttgatgttattcaaattggtgctcgcaatatgcaaaactttgatttgctaagggcagctggtgctgtaaataaaccagtattattaaaacgtggtctatcagcaacgattgaagaattcattaatgcggcagaatatattatggcaaagggaaatgggaacattattttatgtgaacgaggtattcgcacgtatgaaagagcgacgcgtaatacgcttgatatttccgctgtgccgattttaaagaaagaaacacatttacctgtcgttgtcgatgtaacgcattctacagggcgacgtgaccttctcttaccaactgcaaaagcagcgatggcaattggtgcagatgcaattatggctgaagtacatccagatccagctgtagctttatcagatgcggcgcagcaaatgaatataccgcagttcaatgattttatgaatgaattaaaa

SEQ ID NO: 40274 - DNA, 864 bp, Bacillus thuringiensis
aaagtaagaaaagcaattattccagctgcgggactggggacaaggtttttaccggcaacaaaggcaatgccgaaagaaatgttaccaattgttgataaaccaacaattcaatacatagtagaagaagcgatagaatcaggaattgaagatattattattgttaccggaaaaggtaaacgtgcgattgaagatcattttgatcattcctttgaattagagcaaaatctcttagaaaaagggaagtatgaaatgcttgagaaagtacaagcttcatcaaaaattaatattcattacataagacaaaaagaaccaaagggtctaggacacgcagtgtggtgcgcccgtaaatttattggaaatgagccatttgcagtattacttggtgatgatattgtgcaagcagaaacgccatgtttacgtcaattaatggatcaatatgaaggtacacaatcatctgttatcggtgtacaaacagtaccagaaaatgaaacacatcgttacggtattattgatccagttgaaaggaatgatcgccgttatcaagtacgccaatttgttgaaaagccagctcaaggaactgcgccatcaaatttagcaattatgggacgttacgtattaacaccagaaatctttatgctccttgaagatcaacaaacaggtgctggtggggaaattcagttgacagatgcaattcaacgattaaatgaaattcaacgggtatttgcatatgattttgaaggaaagcgttatgatgttggtgagaaattggggtttattaagacgacaattgaggtagcattacagcataaggaattaaaaaagcaattaataaaatatatgaatgatttagtacataaagaaatc

SEQ ID NO: 40275 - DNA, 774 bp, Bacillus thuringiensis
gaggaaaaaatgaaagctgttattcttgctggtgggtacggtacaagaattggggaagaaacacatttaaaaccgaaacctatgattgaaattggaacaaaacccattctatggcacattatgagtttgtatagtcattacggaattactgagtttattatttgcttaggctataaaggatatgcaattaaagagttctttctaaattacaacttacacatgtctgatttcacaatacagttaaacgataatacaattactagccattctcatcgtgtagaaccatggaaagttacactaatcgatactggtgtaaataccgaaacgggtggccgagtgaaaaagattcaaaattatgtcggagacgaacctttctgcctcacttatggtgatggattaagtaatgtaaatataaaagaacttattacattccataaaaaacatggaaaaatggctactgttactgccgtacaaccttttggtagattcggttctctcatattagataaacagtctgtaacatcttttcaagaaaaaccattaggtgatggcggatgggttaatggtggatttttcgttttaaatcctgaagttttcaattacattagtggagataagtctgtttttgaaacagactctttagttcagttagtaaataaaaatgaattggccgcatatcaacattctggtttttggcatccgatggatacattgcgcgataaaaataaattagtcgagctatgggaaagtaataacgctccgtggaaggtttgg

SEQ ID NO: 40276 - DNA, 1047 bp, Bacillus thuringiensis
cttcatcattttttttggaataagaaaaaagtatttattacgggacatactggatttaaaggctcctggctcacccttttcttaagatctttaggtgcagaagtagtaggcttttcttctcatcccccatccattcctaacatttttgaacaaggtaacgtagcaaaagagtgcacgacaatgaaaggcaatattacagattaccattctttatttcatgccatgaagcagcataaacctgacataatatttcatttagcagctcagccaatcgtaaccgcttcatacaaaaaccctatcgatacattcaaaacgaatgttttaggtactgttcacgtgctagaagcagcaaagtccgtcgaaagcgtacgtgccattattaatgtgacaagcgataaatgttatgagaatgacggtagtggcgaccgatcgttcgtggaaaatgaccgactaggaggtttcgacccttatagcgctagtaaagcttgcgctgaaatattggcaacatcctatcaaaaatcattcttccgcactaatacccagaaactcgcctcagtcagagctggtaacgtcatcggcggtggtgattgggcagaagatcgattattccctgatatcattcgggcatatttgcacaatcatactttgtgtattcgaaacaaatatgccgtccgtccgtggcaacatgttttagatcctctacatggctatatccttttagctgagaaactttggaatgatgctaaatatgcagaagcgtggaatttcggcccaatgaatgaacctaacagaaccgttcatgatgtcattgaatctgtaataaaattatggaataacccactaacaatcatttcctcctctacaaatactccttatgaatcacctgttttaacactcgatagtacaaaagcagtaaacaaactcagctggactcctaagttatcaacagatgattctatcgcttggactgttgattggtacaaaaaatatgcatctggtgaaaatatagaatctttcacatgacaacaaatcgatgcattcaaaaat

SEQ ID NO: 40277 - DNA, 924 bp, Bacillus thuringiensis
atgaacagattgcaagttgaattaccaggattatcattaaaaaatccaattataccggcatctggatgctttgggtttggtcgtgaatatgcacagttttacgatttaagtgtactaggatcaatcatgattaaagcgacgacagaacaaccacgttatggaaatccgacgcctcgtgttgctgaaacaccaggcggcatgctaaatgcaatcggacttcaaaacccgggattagacaaagtaatgaattcggaattaccatggttagaacaatttgaccttccaattattgcgaacgttgcaggctcacaagctgaggattacgtagcggttgcgaaggaaatttctaaagcgcctaatgtccatgcactagaattaaatatttcttgtccgaacgtaaaaacaggtggtatcgcctttggtacaaatcctgaaattgctgctgatttaacgaagcgagtaaaagaggtttctgaagtacctgtatacgtgaagttgtcaccgaacgtggcaaacattgtggaaattgcaaaagcgattgaaaatgcaggtgcagatggtttaacgatgattaatacattgcttggtatgcgtctagatttaaaaacagctaaaccaattttagcaaactgtacaggtggattatcaggtcctgcgattaagccagtagcaattcgtatggtacatgaagtaagccaagcggtaaacattccgattatcggaatgggtggtattgagacagcggaagatgtaattgaattcttctatgctggcgcaagcgcagttgcagtaggtacagcgaactttattgatccgttcgtatgtccgacaattattgaagagttaccagcattactagatgaattaggatttgatcacatttcggaatgtcaaggaaggagctggaagcaaacatgtcacagt

SEQ ID NO: 40278 - DNA, 3093 bp, Bacillus thuringiensis
aaggaaggtacaaaagtaatccctgttaactctaacccagcaacaattatgacggatactgcaacagcagataaagtatacatcgagccattaacattagaattcgtaagccgtattattcgtaaagaacgtcctgatgcaatcctaccaacattaggtggtcaaacaggtttaaacatggctgttgaacttgcaaaatcaggcgtacttgacgagtgcggagttgaaattttaggaacaaaattatcagcaatcgagcaagcggaagatcgtgatttattccgtacattaatgcaagatttaaatgaaccaacaccaccaagtgaaattattcataaccttgatgaagcatatggatttgtaaatgaaattggttatccagtaatcgttcgaccagcgttcacattaggaggaacgggcgggggaatttgccataacgaagaagagctaattgaaatcgtaacaagtggtttaaaacatagtccagtaacacaatgtttattagagaaaagtattgctggctgtaaggaaattgaatatgaagtaatgcgtgattcaaatgataacgcgattgtagtatgtaacatggaaaacatcgatccagttggtgttcacacaggtgattcgattgtagtagcaccgagccaaacgctaagcgaccgtgaatatcaaatgttacgtaacacttcattacgaattattcgtgcactaggaattgaaggtggatgtaacgttcagcttgcgcttgatccatatagcttccaatactatgtaatcgaagtaaatccacgtgtaagtcgttcatctgcactagcatctaaagcaactggatatccaattgcgaaattagcagcaaaaattgcagtcggcttaacgttagatgaaattgtaaacccagtaacacaaaaaacttacgcttgcttcgagccagcgttagactatgttgtttcaaaaattccacgttggccgtttgataagtttgaatcagcgaacagaacgcttggaacacaaatgaaagcaactggtgaagttatgtcaatcggacgtaacttagaagaatcattactaaaagcagttcgttctttagagcttggcatttatcacttagaattagaccacttaaaagaacttgataaagaaacgatgaaaaaacgtatcattaaagcggatgatgaacgactgtttattgtagcagaagcaattcgccaaggtgtaacgaaagaagaaatcaatgaatggtgtgaaatggacttcttcttcttacaaaaagttgaaaacatcgtaaatatggaatgtgaagtaaaagcgaatgtaggaaatatagaagtactacaaactgcaaaagaaatgggcttcagcgatcactacattgcagcagcttggaacaaaacggagcgtgaaatttacgatatgcgtaaagaaaataatatgatgccagtattcaaaatggtagatacttgtgcggcagagtttgaatctgcaacgccatattactacagcacatatgcggacgaaaatgaatcgattgtaacagatcgtaagagtgtagtagttctaggatctggtccgatccgaattggtcaaggtgttgagtttgattacgcaacagttcactcagtatgggcaattaaagaagctggatatgaagcaattatcattaacaacaacccagaaacagtttcaacagacttcagtatttctgacaaattatactttgaaccattaacgattgaagatgtaatgcacattatcgatttagaaaaaccagaaggtgttatcgttcagttcggtggacaaacggcaattaacttagcagcgaaactagaagaacacggtgtgaaaattttaggaacatcacttgaagacttagaccgtgcagaagatcgtgataaattcgaagctgctttaacaaaacttggcatcccgcaaccagttggtaaaacagcaacgactgtagaacaagcggtagcaatcgcagaagaaattggttacccagtattagtaagaccatcttacgtactaggtggacgtgcaatggaaatcgtatatcgtcaagaagaactgctgcactacatgaaaaatgcagttaaagttcatgcagatcacccagtattaatcgaccgttacatggttggtaaagaaattgaagtagatgcaatttcggatggtgagaatgtattcattccaggtattatggaacatattgaacgcgctggagttcactctggtgactcaattggagtatatccaccacaaagtttatctgaaaaactaaaagaacaaatcattgaacatacaattgcacttggaaaaggattaaacattgttggattactaaatatccagtttgtagtattcaaagatcaagtgtacgtaattgaagtaaatccacgtgcaagccgtacagtaccgttcttaagtaaaattacaggcgtaccgatggcgaatgttgcaacgaaagttattttagggcaagacctagtagagcaaggatacggaactggctatcacccagaagagaaagaagtatatgtaaaagctccggtattctcattcgcgaaactacgctcagttgatacaacattaggacctgaaatgaaatcaacaggggaagtaatgggtaaagacttaacgcttgaaaaagcattatataaaggattagttgcttctggaattaacatcccaacgcacggctcagtaatcattactgtagctgataaagataaagaagaagcgatggaaattgcaaaacgtttccacgaaatcggctataacttattagcaacagctggaacagcacaatcattagaagagcaaaatatcccagtacaagttgtaaacaaaattgattctgaagactacaacttactagatattatccgtcaaggaaaagcacagtttgtaattaacacattaacaaaaggtaaacaaccagcgcgtgatggtttccgcattcgccgtgaatcagtagaaaatggtgtggcttgcttaacatcacttgatacaacgagagcaatcttacgagtattagaatctatgacattctcagctcattcaatgaaagaaattacgcaaacaaagcgtcacgaggtg

SEQ ID NO: 40279 - DNA, 1068 bp, Bacillus thuringiensis
gcagttattgtagaggcgaaaagaacacctatcggtaagaaggatgggatattaaaagagtatgaagttcagcaattagcaacgccgcttcttacgtttttaagtaaaggaattaagagagagatagacgatgttatattaggaaatgttgttgggccaggagggaatgttgcaagattatctgctttagaggcaggacttggctatcatattcctggtgtaacgattgatcggcaatgtggtgctggtttagaagcaattcgaactgcgtgtcatctcattcaaggcggggcaggtaattgctatatcgccggaggagtagagagtacaagtacgtcaccttttcaaaaaagagcaagattttcacctgaaacaattggtgatcctgacatgggagtagcggctgaatatgttgcggagcgttataacataacgagagaaatgcaagacgagtacgcttgtcttagttataagcggacactgcaagcgttagaaaaaggatatatacatgatgaaatattttcttttaatggattattagatgaatctataaagccagaaatgaattatgaacgaatcattaaaagaacgaagcccgcatttttacaaaatggaacagtgacggcaggtaattcatgtggtgtaaatgatggggcatgtgctgttcttgtaatggaagagggacaagccctaaagttcggttataaacctgtccttcgtttcgttcgtagtactgtagtgggagtggatcccaatcttccagggactggtccgatatttgcggtgaacagattattaaacgaaatgaatgtaaaagtagaggacatcgattattttgaaataaatgaagcattcgcctcaaaagttgttgcttgcgcaaaagagttacaaattccgtatgaaaaattaaatgtaaatggtggggcaattgcgctcggtcatccgtacggtgcatctggggctatgcttgtaacacgtttgttttatcaggctcaaagagagtttatgaaatatggaattgctacattaggaattggaggcgggatagggattgcgctattatttgag

SEQ ID NO: 40280 - DNA, 1653 bp, Bacillus thuringiensis
gtcatgaaagaatataaaagaattttgttaccgttacagaaagaaaaaatattagtaatagcagctgtatgtagtgggataattgctgccattttaaatttatcccgcccaattttcatgggattaattgtagacaatcttattcaaagggagctaaaaggtgcgtatgtatatatagctttgtttgcgggtagtcactttttaatgtgggcgaacaatcttttatttgattatataagttcaaaagcgagtcaacgtatattacaaacgaaacgtatagaattattgcgtcactatttctcattaccgtttgaagagagtgagaagattaagcaaggagagttagaaactttggtcgtgtctgatattccgaactgggtcagattatatggctctatattaatagaatatatacacgctattgcccaatttattggagctttcatagcactacaacatatagatatacagtttatattgtgggtaactccgtttttatttttaagtacaattgttccaatactgatgggagaaaaggtaagagatattgcaagcgtttctcaaaaaaatcactcaagtgttgtagagatggtgtcacagtttgtaaaggggatacaagatttgcggagtttacaaaaagaaaaatgggcaattcgcttatttaaagaagtaacggcacaatcgtataaatcagaagtaaagaagacgatgatgcaacattgcattggagtagttggaacggtgattgaaacaggagcatatattgttgttctcattataggtgcacaaaaaataatgaggggagaaatagaagttggttcactcattgcagtgttagcgacaattgagatgctctttttccctgtccgttatgtgggcgatttattaataatgacacaagttgcagtcgcttcggcaaatagagctttttgctttttaaataaacgagcagcagatagcaatgtagaaagagcgatggggatcaggataacaaatgtttcatttcaggagaatgacgaagagaaatgcagaattcataatattgatttgcaaattcgtcctggtgaactcgttatgattgtgggagaaagcggtgcaggaaaaacaacgcttttaaagttaataacgggcttgtataaaccatctaacggtagcattgcttattatggtaatgaagctcgtatgactacagtgtggcaagaaccacgttttttccgaacgacggtaacagagaatatgtatttcggggaagagggtttagaaaatcagttagaaaaaaatagtgaacttataaatgcaacgccgattattagagggttacctgaagggagtcaaactgtgctacataaaagcggtgaagagttttcgggaggcgaaagaaaacgtcttgcattattgcgcgcgattgtatcaaatccaactcttattattttagatgaaccgacggctgggttagatccgggcaatcaagaactggtttggaatatgattgaagggataggaagagatgtaacgagaattgtggcaacacatgatgtagagagagcgatgatagcagattgtgttgttgtcataaagaatgggactattgtggaatgtgggaatcctagagaattattaaattgcaactcattgtacaaagagttgcaaaca

SEQ ID NO: 40281 - DNA, 426 bp, Bacillus thuringiensis
atgaaaaagttactcctcgtaaacggtcctaacctaaatcgcctcggtgttcgtgaggtaaatgtatatggaaagggcacgctaacgacacttgaagcagatatgaagcaagaagcagaaacaatgggagtggagttagaatgtttccaatcgaatcatgaaggtgccattatcgacattattcatgaagcggaagatatatatgaagggatcattttaaatccgggagcatttacgcattatagctatgcgattcgtgatgccattgcgagcatttcgattcctgttattgaagtacatatttctaacattcatcagcgtgaatcgttccgtcatgaatctgtgacggcagctgtttgtgcaggtcaaattgtaggatttggtttttatggctataagttagcgttatttgcattaatggagaaa

SEQ ID NO: 40282 - DNA, 645 bp, Bacillus thuringiensis
attatgaaagcaattatttttgattttgatggattaattgtggacacagaaacgatatggtttcactctttcagagatgctgttcgtgaatacggcggggaactacctttagaggaatttgcgaaatgtattggaacaacagatgaggtactttatacatatttaaatgatcaattaaaagagaagtttaacaaaaatgcattaaaagaaaaagtggcaactttacataaagagaaaatgagaataccagaagctcgtgacggggtaaaagaatatttagaagaagcgaaagaaatgggattgaaaatcgcactggcttctagttcgtctagagaatgggttattcattttttagaagagctacagattcgagaatattttgaagtgattaaaacgagagaagatgttgagaaggtaaaaccagatccagctctttatcgagttgcaatagaagaattaggaattaagccgtctgaagctgttgtatttgaagattcattaaatggattgagagcagcagttgcagcgggattaacgtgcgttgttgtacctaatgatgtgacacggaatttaccatttgaaaatcatcatcttcgaattgaaagtatgagagagaaaagtttaaaagaagtgcttcaaagtata

SEQ ID NO: 40283 - DNA, 996 bp, Bacillus thuringiensis
aaaattggtattaatggatttggacgtatcggacgtaacgtattccgcgcagctcttaacaactctgaggtagaagtagtagcaatcaacgacttaacagatgctaaaacattagctcaccttttaaaatatgacacagttcacggaactttaaatgcagaagtatctgctaacgaaaacagcatcgttgttaacggtaaagaaattaaagttatcgctgagcgtgacccagctcaattaccatggagcgactacggagtagaagtagtagtagaatctactggccgtttcactaaaaaatcagacgctgagaaacacttaggtggatcagttaagaaagttatcatctcagctccagcttctgacgaagatatcactgtagttatgggtgttaaccacgaacaatacgatgcagctaaccacaacgtagtatctaacgcttcttgtactacaaactgtctagctccattcgctaaagtattaaacgaaaaattcggcgtaaaacgcggaatgatgacaacaattcactcttacactaacgaccaacaaatcttagacttaccacacaaagatttacgtcgtgctcgtgcagcagctgaaaacatgatcccaacatctactggtgcagctaaagctgtagcattagtattaccagaacttaaaggtaaattaaacggtggcgctgtacgtgttccaactgctaacgtttctctagttgacttagttgttgaacttgacaaagaagtaacagttgaagaagtaaatgcagcattcaaagcagcagctgaaggcgaattaaaaggtatccttggatacagcgaagagccattagtatctatcgactataacggatgtacagcttcttctacaatcgatgcattatctacaatggtaatggaaggtaacatggttaaagtactttcttggtacgataacgaaactggttactctaaccgcgtagtagacctagcagcttacatgacttcaaaaggtctt

SEQ ID NO: 40284 - DNA, 1958 bp, Bacillus thuringiensis
atgaacaaaaaatcaattcgtgacgtagatttaaaaggtaagcgtgtattttgccgcgttgatttcaacgtacctatgaaagaaggcaaaattacagatgaaactcgtatccgtgcagctcttcctacaattcaatatttagtagagcaaggtgcgaaagttattttagcaagtcacttaggccgtccaaaaggtcaagtagtagaagaaatgcgtttaactccagtagcagcacgtttaggcgagcttcttggtaaagacgttaaaaaagcggacgaagcattcggaccagttgcacaagaaatggttgcagcaatgaacgaaggcgacgtattagttcttgaaaacgtacgtttctatgcgggcgaagaaaagaatgatgcagaacttgcgaaagaatttgcagcacttgctgacatcttcgtaaacgatgcattcggtgcagctcaccgtgctcacgcttctacagcaggtatcgcagactacctaccagcagtatctggtctattaatggaaaaagagttagatgtacttggtaaagcactttctaacccagaacgtccatttacagctatcatcggtggtgcgaaagtaaaagataaaatcggtgtaattcgtcatctattagacaaagtagataacttaatcatcggtggtggacttgcttacacattcgttaaagctttaggtcatgaaattggtctatctctatgtgaagacgacaagatcgaactagctaaagaatttatgcaacttgcaaaagaaaaaggcgtaaacttctacatgccagttgatgttgtaatcactgaggaattctctgaaactgcaacaactaaaatcgttggtatcgactctatcccttctaactgggaaggcgtggacatcggtcctaaaacacgtgaaatttatgcagatgtaattaaaaattctaagcttgttgtatggaatggaccaatgggtgtattcgaaatgactccattcgcagaaggtacaaaagcagtaggacaagcattagcagatgcagaagatacatactctgttatcggcggtggtgactctgcagcagctgttgaaaaattcggtatggctgataaaatgagccacatttctactggcggcggtgcgtcattagaattcatggaaggtaaagagcttccaggtgtagtttgtcttaacgacaaataagtagcagccaaagaaaaaggacggtgcaaagcatgcgtaaaccaattatcgcaggtaactggaaaatgaataaaactctatctgaagcagttagcttcgtagaggaagttaaaggtcaaatcccagcagcttcagctgttgatgcagtagtttgctctccagctctattcttagagcgccttgtagcagcaactgaaggaactgacttacaagtaggtgcacaaaacatgcacttcgaaaaaaatggtgcattcactggcgaaattagcccagtagcacttagcgacttaaaagttggctatgtagtacttggccactctgagcgtcgtgaaatgtttgctgaaacagatgagtcagtaaacaaaaagactatcgcagcatttgaacatggtttaacaccaatcgtatgttgtggtgagactttagaagagcgcgaaagcggaaaaacatttgatctagtagcaggtcaagtgacaaaagcacttgcaggtttaacagaagagcaagttaaagcaactgttatcgcttatgagccaatctgggctatcggtacaggtaaatcttcttcttctgcagatgcaaacgaagtatgtgcgcacatccgtaaagttgttgcagaagctgtttctccagaagctgcagaagctgttcgtatccaatacggcggtagcgtaaaaccagaaaacattaaagagtatatggcacaatctgacatcgacggcgctttagttggcggtgctagcttagagcctgcttcgttcttaggtcttctg

SEQ ID NO: 40285 - DNA, 2938 bp, Bacillus thuringiensis
atgaatgacaacatggttcatattacaattgacggaaaaaagtatacagcggagcctggttcgacgatattgggtgttattaatgagaacgggattgaacatccgcaaatttgttacgtgccagaagtagatcctattcaaacatgtgacacttgtattgtagaagttgacggaaagttaatgcgttcttgttcgacgatagcaacggaaggtatgaacattgaacgtgcttctgttcgcgcaaaagaagcacaaacagaggcgatggatcggttactagaaaatcatttattatactgtacagtatgtgacaacaacaatgggaactgtaaactgcataatacagcagaattaatggaaatcgaacatcaaaaatatccgtatgaaccgaaagtagatgtaagtgaagttgatatgacgcatccgttttatcgctatgatcctaatcaatgtattgcatgcggtcaatgcgttgaggtgtgtcaaaacttacaagtaaatgaaacgttatcgatagactgggaagcggaacgcccacgagttatttgggataaaggagtaaatattaatgattcttcatgcgttagctgtggtcaatgtgtaacgatttgtccttgtaacgctttaatggagaaaacgatgctcggtgaagctggatttatgacgggattaaaaccagatattcttgaaccgatggtagatttaattaaagaagttgagcctgggtatagcggtatttttgcggtatcagaagtggaagcggccatgcgtgatactcgtacgaagaaaacgaaaacagtatgtacattttgtggtgtaggttgttcgtttgaagtgtggacgaaggggcgtaaaatccttaaagtacagccatcttcagatgcaccagttaatgcaatttccacttgtgtaaaagggaaatttggttgggatttcgtaaattctaaagaacgaataacaaaacctttaattcgtaaaaatggaacgtttgttgaatctacatgggaagaagcactgaatgtagttgcaaataaattaggcgctattaaagaagagtacggtaaaggttctattggatttatttcttcctctaaaattacaaatgaagacaattatgtaattcaaaaattagctcgacaagtatttggaacgaataatattgataactgctcacgttattgccaatcaccagcaacggatggtttgttccgtacaattggtatcggcggtgatgccggaacgattaaagatattgcgcaatctggtcttgttattattgtgggatgtaatccgacagaaggtcatcctgttctagctacacgtattaaacgtgcacataaattacacggacaaaagttaattgtagctgatcttcgtaaaaccgaaatggcagagcgatcagatgtctttattagtccaaaacaaggaacagatcaagtatggttaatggctgttacgaaatatatgatcgatcaaggttggcatgatcaggaatttattaatgagaatgtaaacttctttgaagatttcaaagagagcctagaagaatatacacttgaatatgcagaagaagtaacaggtatttcaaaagaaacacttattcaaatggctgaaatgattcgtgatgcagatggtacatgtatcctttggggtatgggggtaacgcaaaatacaggtggttctgatacttccgctgcaatttcaaacttacttcttgcaacagggaactatcgtcgtccaggagcaggtgcatacccacttcgaggtcacaataacgtacaaggtgcttgtgatatgggtactttaccaggatggcttccaggatatcagcacgttactaacgaaatggaacgtgcgaaatttgaaactgcttacggagtgaaaattgatagtgaaccaggtcttaataatattgaaatgcttcacgcaattgacgaaggaaaaatgaaagcaatgtatcttgtcggagaagatatggctcttgtagattctaatgcaaatcatgtacatgaagtgttatctagccttgatttcttcgttgtgcaagatgttttcctttctaaaactgctcaatatgcagatgttgtattaccagcagcgccatctcttgagaaagaaggtactttcacaaatacagagcgccgtgtccaaagattatatcaagttcttcctacgctaggagacgcgaaaccagactggtggatcgtccaggaagttgcgaataaactaggtgcaaactggaattatagccacccaagtgaaatctttgctgaaatggcaagtttatcaccattgttctcgcaagcgaactatgaagtgcttgaaggatggaacagtttccattggggaagttttgatggaacaaatacaccacttctgttccaagatggatttaacttcccagataaaaaagctcgttttgcgattgctgactgggtacgtccagctgaatttccagctgagttcgaccttcacattaacaacggtcgtatgcttgagcatttccatgaagggaatatgacaaataaatcaacaggtattcaaacgaaagtacctggtgttttcgttgaaatctctccagaccttgcaaaagaacgtggcgtaaaaacaggttcgttagttcgtcttgtctctccttttggagcattaaaattacgtgcactcgttacagatcgtgtaaaagcgaatgagttatatttaccgatgaactctacagataacgaaacggcaattaatttcttaacaggtcctgctgtggatgtacgtacgaatacacctgcgtataaacaaacgaaagtgcgtatggaagtgttagaagttgatggctaaaatccgatgccaaaagcgaacccacgcaataaaaaacgtcaccctcaagctggcattgaggtacatcgtaagtgggcacgtccaggggtatgtgcatttaacggataag

SEQ ID NO: 40286 - DNA, 1606 bp, Bacillus thuringiensis
ttatatgaaaaagtgtatgaagaaatagcgagaagaacaactgcacttcaaacaatgcaacggcaagatggtacgtggcggttttgttttgagggagcgccattaacagattgtcatatgatttttttattaaaattattaggtagagataaagagatagaaccgtttgtaaaaagattagcatcactccaaacaaatgaaggaacatggaaattgtatgaagatgaggtgggtggtaatttatctgctacaattcaatcttatgctgccttacttgcatcggaaaaatatacaaaagaagatgcgaatatgaagcgagcggaaatgtttataaatgagcgcggtggggtagcgcgtgctcattttatgacgaagtttttattagcgattcatggagaatatgaatatccttctctctttcatttgccaacaccaattatgtttctgcagaatgattcccctctcagtatatttgaactgagtagctcagcacgtattcatttaattccgatgatgttgtgtttaaataaaagatttcgagtagggaaaaagttattgccaaatttaaatcacattgcaggcgggggcggagaatggtttcgggaggatcggtctccagtttttcaaacgttagtaagtgacgtgaagaaaattataacgtatccactttctttgcatcataaaggatatgaggaagtagaacgttttatgaaagggcgtattgatgaaaatggaacattatatagctacgcaactgcctcgttttatatgatttatgctttacttgcattaggacattctattcaatcaccaattattgagaaggctataatgggaattacatcttatatatggaagatggagagagggagccatttgcaaaactctccgtcaactatatgggatacagctttactcagttatgctttgcaagaagctcaagttccgaaagtaagtaaagtgattcaaaatgcatcagcgtatttactaagaaaacagcaaacgaagaaagtagattggagtgtacatgcaccggatctcttcccaggtggttggggcttttcggatgtgaatacgacgattccagatattgatgatacaactgctgtgttaagagcgttggcgcgaagtagagggaacgaaaatgtagataatgcttggaagcgagcggttaattgggttaaaggattgcaaaataatgatggtggttggggagcttttgaaaaaggggtaacgagccgtatattagcaaatttaccaatcgagaatgcaagtgatatgattacagatccttctacaccagatattacaggaagagtgctagaattttttgggacgtatacgcaaaatgaattgcccgagaaacaaaaacaaagtgcgataaattggttaatgaatgtacaggaagaaaatggatcgtggtatgggaaatggggaatttgttatatatatggtacgtgggcagtgttgactggtttacggtcactaggaataccatctagcgattcatcattgaaacgagccgttttatggcttgaacatatacagcatgaagatggtggctggggagaatcttgccaaagtagtgtggaaaaaagatttgtta

SEQ ID NO: 40287 - DNA, 1602 bp, Bacillus thuringiensis
atgctagtaggttatacagaatggccaaaagaatttgccgatcgttaccgagaagcaggatgttggcttggtgaaacatttggaggagtgttaagagagcgggctgagaaatatggagatcgaatcgcggttgtaagtggtaagaagcatataacatatagtgaacttaataaaaaggtagatcgtttagcagcaggtttactgaatttaggaataaagaaagaggacagagttgtaatccagttacctaacattatcgagtttttcgaaatatgttttgcactatttcgaattggagcgcttcctgtctttgcactaccttcacatcgaagcagtgaaattagttatttttgtgagtttggcgaggcgagcgcttacgttatttcagataaggctctcggttttgattatcgaaaattagcaagagaagtgaaagagaaagtgccaactttacaacatgtaattgtagtgggagaagaagaagagtttgtgaacataaatgatctgtatatggatcccgtctcattaccagaagtgtagcctagcgacgttgcatttctgcaattatcaggatgcacatcaggtctttctaaattaattcctagaacacatgatgactatatttatagtttacgtgttagcgctgaaatttgtaatttgaatgcagaaagcgtctatatggcagttcttccagtagcacacaattacccaatgagttctccagggacatttggaactttctatgcgggtggaaaagtggtattggcaactggtggtagtccagatgaggcctttgctcttatcgaaaaagaaaaagttacaattacagcgctcgttccgccattagcaatgatttggcttgatgctgcatcttctcgtaatgccgatttatcaagcctagagattattcaagtaggtggtgctaagtttagcgctgaggttgcaaaacgtatacgtcctacatttggatgtacgttacagcaagtgttcggtatggcggaaggattagtgaactatacaagattagatgatccggaagaatttattatttatacacaaggtagaccaatgtctgcactcgatgaagtacgagttgttgatgaaaatgacaacgatgtacaacctggcgaagtaggtagtttattaacaagaggtccatatacaattcgtggttactataaagccgaagagcataatgcacgatcatttacaaaggatggattttatcgcacaggtgatcttgtaaaagtaaatgaacaaggatacatcattgtagaaggaagagataaagatcaaattaaccgcggtggtgagaaagttgctgcggaagaagttgaaaatcatctattagcacacgatgcggtccatgacgtagcaattgtatctatgcctgacgattatttaggtgaacgcacctgtgcttttgttatagctcgcggacaagttccagcagtaagtgaattaaaaatgtttttaagagaacgtggtatagcggcttataaaattccagatcgaattgaatttattgaagcattcccgcaaacaggagtcggaaaagtcagcaaaaaagaactacgtaaagtcattgctgaaaagcttatt

SEQ ID NO: 40288 - DNA, 732 bp, Bacillus thuringiensis
ttaaatggaaaagtagcaatcgtaacaggtggagcaaaaggaattggaaaagcaattacagtagcattagcacaagagggagcgaaagtagttattaactataatagcagtaaagaagcagctgaaaatttagtaaatgaattaggaaaagacggacatgacgtttatgcagtgcaagcggatgtttctaaagtagaagatgcaaaccgacttgtagaagaagctgtgaatcattttggtaaagttgatattcttgttaataatgctggtattacaagagatcgtacattcaaaaagttaaatcgtgaagattgggagcgcgtaattgacgtgaatttaagtagcgtatttaatacgacaagcgcggttcttccatacataacggaagcagaagaaggaagaattattagcatttcttctattattggtcaagcaggtggatttggccaaacaaactactcagcagcaaaagcgggtatgttaggatttacaaaatcattagcgttagaacttgcaaaaacaaatgtcactgtaaacgctatttgcccaggatttattgatactgaaatggtagcagaagtaccagaagaagtacgtcaaaaaatcgttgcaaaaatcccgaaaaaacgttttggtcaagctgatgaaattgcaaaaggtgtagtatacctatgccgtgacggtgcgtatatcacaggtcaacaattaaacattaacggcggattatatatg

SEQ ID NO: 40289 - DNA, 510 bp, Bacillus thuringiensis
acaagtcataccgccaaatattcaaatgccaaatataatgccaatcatggataacaaccaaccaccgaatataatgccaattatggataacaatcaaatgccgaatatgatgccaattatggataacaatcaaccaccgaatatgatgccaatcatggataacaatcaaatgccgaatatgatgccaattatggataacaatcaaatgccgaatataatgccaattatggataataaccaaatgccgaatatgatgccaatcatggataacaatcaaatgccgaatatgatgccaattatggataacaatcaaatgccgaatatgatgccaatcatggataacaatcaaatgccgaatataatgccaattatggataacaatcaaatgccgaatatgatgccgagtatggataacaatcaaccaccaaatatgatgccctatcaaatgcccatgatgccgccgaatccgtattatcaacaaccaaatccatatcaaatgccatatcagca

SEQ ID NO: 40290 - DNA, 1524 bp, Bacillus thuringiensis
atgccaagcgcagatgtcttaattattggaagtggcgttgcggcacttcgtgttgcaaaagagatttgtcacgaaaagaatgtgattattatcacaaaggagacgaaacgtaataataatacacatttagctcaaggtggaattgccgcagcggtagctacatatgacaatcctaatgatcattttgaagatacattagtagcagggtgtcattataacaatgaagaagtggtccgttatttagtcgaggaaggaccgaaagaaattaataaccttattgagaatggaatgaaatttgatggagatgaaacaggtcctcatcttggaaaagaaggagcgcatcgaaaacgtcgtattttacatgcaggtggcgatgcaacaggaaagaatttattagagcatcttattcaagaagtagctccatacgttacggtagtggaacaggaaatggtgctcgattttattatagaaaaagataaatgtgttggggctttaactcgcaacaataaaggagaattgaaacgttacaatgcagattgtacggtgttagcttcaggcggtattggcggtttatacgcctttacttctaatgatgagacgattacaggcgatggacttgcaatggtgtaccgtgcaggcggagagcttgtagatttagagtttatacaatttcatccgacgatgttatacgcgggtgggcgttgttccggcctcgtgtccgaagctgttcgcggagaaggagctgtccttataaatggaaaagggcagcgttttatgatggatatacattccgaacaggatctagcacctcgtgatgtagtcgcacgggctattcatgaacagctacttgcgggtgaaaaagtgtacttaaacatcgaaatgattcaaaactttgaacaacgctttccgaccgtgtcatcgatatgtaaaacaaatggagtcgatataaataaaaaacttattccagtcgtgcctggtactcattttcacatgggcggcgtgaaaacgaactgtgatggagagacgtctattccgaacttatacgcagtcggtgaagtagcttgtaacggagttcatggtgcaaatagattagctagtaattcattattagaaggtcttgtgtttggaaaaagaaccggacgacacattttatctagagagacaaaagaaaaggtgaacatgctagctgaaaaggaaccaaagttcatcgttctgaatcatttaccgacgaaagaagaaatacaaaaatgcatgatgaaatatgttgggattgtgcgaacagagcaaagtttatcttatgcgaagagatggtttagtaagtatggtgttcgaaatatgatattacaacatgatgttcttacgaatgaagagataacacttattaatatgttaacggcttgtgagcttatagttgtgtcagccttgcaaagagaagaaagtattggcgggcattaccggagtgattatccagatagaaatataggaaagaaagagattgttcgagtaaagagaaaattacaactt

SEQ ID NO: 40291 - DNA, 879 bp, Bacillus thuringiensis
atgccaaatattgcagtagtagggagcatttcaatggacttagtggctgtttcaaaaaaacggccgaaagcaggagaaacagtaattggtgaagcgtttcatacaattccaggagggaaaggagcaaaccaagcagttgctgcagctagattaggagcaaatgtagcaatggttggagcggtaggaaatgatgattatggaacagtagttagaaaaaatctagagaacgaacgcatttttatcgattatgtggtaccggttacagatagaacgacaggaattgctcatatcgttttagcagaagaagataacagtattgttgtcgtacaaggggcaaatgctcttgtaaataagtcagttgtagatcgctccaaagaacttcttgtaaaagcggatatggttgttcttcaactagaaattccacttgaaacagtaaaatatgtattggctatttgtgaggaacataatattcctgttatgttaaatccagcgccagcacaagttttatcagaagacattttagaaaaggcaacttatattacgccaaatgaacatgagtgccgcatcgtattagatgatttcatctcaccaattgaagatttattggcgaagtatccaaataaattattgatgacagaaggttctaacggtgttcgtttccataatggcacggagattgtacatgttcctagcattgctgttgatgtagtggatacaactggagctggtgatacatttaatggtgcgttagcagttgcactttctgaaggagagacacttcaaaaagcaattcgtttcgcgaatattgccggtggtctttctgtaacgaaacttggggcgcaaggcggcatgccaacgagagataaagtacgtgaagtg

SEQ ID NO: 40292 - DNA, 831 bp, Bacillus thuringiensis
aacttacaaagtaaaacagtattaaataatggtgtagaaatgccttggttcggtttaggtgtatttaaagtagaggatggaccagaacttgtagaagcagtgaaatcggcgattaaagcaggataccgcagcattgatacagctgcaatttacggaaatgaaaaagctgtaggtgaaggaattcgcgcgggtataaaagaagcaggcatttctcgtgaagatttattcattacttcaaaagtgtggaattcggatcaaggatatgaaacgacacttgctgcatatgaagaaagcttaaaaaaattagagctggattatttagatttataccttgttcattggcctgtagaagggaaatataaagatacgtggagagcgttagaaacactttataacgaaaaacgcgtacgtgcaattggggtaagtaatttccaaattcatcacttacaagatgtaatgaaagatgcagaaattaaaccaatgattaaccaagtagaataccaccctcgtttaacacaaaaagaattacaagctttctgtaaagaacaaggtattcaaatggaagcatggtcaccacttatgcaaggtcaattattagataacgaaaaattacaagaaattgctgagaaacacggtaaaacaacagcgcaagttattttacgttgggatcttcaaaatggagtaatcactattccaaaatcaacgaaagaacaccgcattattgcaaatgccgatatatttaatttcgaattaacgaaagaagatatggaaaaaatcgatgcgttaaatcaaaatcaccgcgttggtccagatcctgataacttcgatttc

SEQ ID NO: 40293 - DNA, 1365 bp, Bacillus thuringiensis
gtgaagtcattattacgaaaaaaagcgcttagtactgagtcaccaaagcaactagatagaacattaactgcactcgatttaacgtttttaggaatcggcgccgtaattgggacagggatctttgtattaacaggtattgttgcagcaaaacattctggtcctggtattatgctatcattccttattgctgcatttacttgtgcttgtgtagccttttgttatgctgaatttgcttcttctattcctgtctcaggaagtgtgtatacttacgcatatatgacagtcggagaagtcgtcgccttcatcgtcggatggtgtttaatgctcgaatatttacttgccgttgcagcagtagctgtcggttggtctggttatttacaatcattactacaaggtttcaatatacacctgcccgccataatcgcctcggcccccggcgtaggaaaaggtggtctcatcgatttacctgctgtctgtattttacttcttattactggccttttaagttttggtatacgcgaaagcgcacgcattaataatattatggttcttatcaagttagccgttattatcgcctttatcgtagcaggtgcaaaatatgtaaaacctgaaaattggacaccgttcattccattcggatacgacggtattattactggggctgccactgtgtttttcgcctttttaggttttgatgcaatcgcaaccgctgcagaagaaacgaaaaaaccacagcgtgatttaccaattggtattatcggttctcttcttatttgtactattttatatatgattgtatctttcgttttaacaggtatggttccttatacacaattagacgtttctgatccagttgcatttgcattgcacttcgttggtgaagatgcaattgcaggactactcgctgttggagcgatgactggaatgacaaccgtcctcttagtcgttatgtatggacaagttcgcgtttcatatgcaatgagccgtgacggtctacttccaaaagcgttagcacgtgtaaataaaaaagtaaaaatccctttattaaatacgtggattactggcgttgttgctgctttattagcaggccttttagacttacatttgctagcgaatttagtaaacatcggcacgttaacagcctttacattcgtttgctgcgcagtacttattttacgaaaaacacaccctgacttaaaacgcggattccgcacacctttcgtacctgtactaccagttgtcgcgattctttgctgcttatatttaatgattaatttgtctaaaacaacatggattagctttgcagtttggcttatagtcggcttatgcttctatttcttctactctagaaagcatagtcattta

SEQ ID NO: 40294 - DNA, 874 bp, Bacillus thuringiensis
atgcgttttgatgaagcttattcaggtaaagtatttattaaaagtcatccaagttttgaagagtcaaaggtagttatttatgggatgcctatggattggacagtaagttaccgtccgggatctcgttttggccctgcacgtattcgtgaagtatcaatcggtcttgaagaatatagcccgtatttagatcgtgaactagaagaggtaaaatattttgatgcgggtgatatcccattaccattcggaaatgcacaacgcagcttagacatgattgaagagtatgtatcaaaacttttagatgccgataagtttccactaggtctcggcggtgagcacctagtgtcttgcccaatttttaaggcaatggcaaaaaaaatatccggatttagcaatcatccacatggatgctcatactgatttacgtgaatcgtatgaaggggagcctttatcccactctacaccaattcgtaaagtgtgtgatttaattggtccggaaaacgtatattctttcggaattcgttctggaatgaaggaagaatttgaatgggcgaaagaagtaggtatgaacttatacaaatttgacgtattagaaccgttaaaagaagtattaccgaaacttgctggccgcccagtctatgtcacaatcgacattgatgtattagacccagctcacgctccaggaacaggaacattagaagctggcggtatcacatctaaagaattattagattccatcgtagcaattgcaaattcaaatataaatgtagttggagcagacttagtagaagtagctccagtctacgaccatagtgatcaaacaccagtcgcagcaagcaaattcgtgcgggaaatgctgctcggttgggtgaaataa

SEQ ID NO: 40295 - DNA, 1395 bp, Bacillus thuringiensis
caaattgaacaaacagatttaaaacgaacaatgaaaagtagacacctatttatgattgcactcggcggtgttatcggaaccgggctatttatgggatctggtcaaatcgtccataatgccggacctggtggtgctattcttgcatttttagtcggtggatttgttatgtatttaacgatgttatgtcttggtgaattatccgttgctatgccagaagcaggttcattccaaagttatgcaagcaaattcatttcacctggttttggatttgttgtcggttggatgtattggttaaattgggctgttacagttggcgtagagttaacaactgtaagtattttaatgaaacgctggtttccagacgtttcttcctggatttggtgcgttacatttgcagcagcactcttcctcgtaaacgctttatcagcaaaagcatatgcagaagcagagttttggttcgcaagtgtaaaagtcgcgacaattgtcattttcatcgtgcttggtggcgctgttatgttcggtctactagactttaatggaaagccagctccaatgcttcataatttcactgaaaatggcgggctatttcccaacggtgcattagctgttcttcttacgatgattacagtaaattactccttccaaggaacagaattaattggaatcgcttcaggagaaagtgaaaatcctgaaaaaacaattccaaaagcaataaaaaatacaatttggcgaactctcttcttcttcgtcttagcgatatcagttgttgtaggtttactcccatggcaagaggctaatctagttgaaagtccctttgtacttgtatttgatgtagccggtgtcccatatgcagcagatattatgaactttgttattattacagctgtattatccgttgctaactctggtctatatgcaaattctcgtatgctgtgggcgatggcaaaacaaggaatggcaagcccagcatttacgaaattaactaaaaaaggtgtaccgctaaatgcattaattttcagcctaattttcgctagcctgtccttactaacaagtgtatttgcggcagatactgtctttctagttttaacatctattgcagcaatggctgccgttgtcgtttggatgtcaatcgccgcttcacagtttttcttccgtagaaatttcgtgaaaaatggtggcaacataaatgatttaaaatatcgtacaccgctctatccactcgttccaatcgtagcgttctcgctcaatttcattacatttgttagtttggctttcattccagatcaaagaattgctctttattgcggcattccatttatgattatttgttacattttataccaagttaaatataaaaaaattgtcacacttgaacagccacgaactgtcacacaa

SEQ ID NO: 40296 - DNA, 2613 bp, Bacillus thuringiensis
aaatggtatgcactctcgcaagaagatgtaataaaagatttacaagtggagaaacagcaagggctaagcgctcgagaagtgcaaatgcgacaagaaaagtatggaatgaatagaattgaaccgaagcagtctgttccttggattgtttcatttatggggcaatttaaagagtttacatcgcttattttacttggagcagctggattatctgtattatcaggtggggtgtttgatggattagcgatggggacaattctcgtcgtcaatgcggtaattggaacccttcaagagcgaaaagcagaaaaagtagtagaagctttaaatcaattccgtgcgccaaattgtatagtaacccgtgaaggggaagagatagaggtagcaagtagtgagctcgtcccaggtgatgttgtctgccttcaagctggagaccgcgtacctgcggatcttcgtattatagactcttggaatttagaagttaatgaagcgatgctaacgggtgagtctctaccagttgaaaagaaagtggatgcggtaggggaagaatgttcgttagcggagcagaataatatgctctttatgggcacatccgtaacgcgcggcaaggcgagagctatagtagtggaaaccgggatgagtacagagatgggctatatgatttccttaatgaagggggaagaaacagagcctacaccactacagcaaaaggtgacgtctattagtaaaacctttattaaaggagcatttgtggctggcggtattgtgcttgtagcaggattgctacgcggtttaccgattacgcaaatgattacaacatcagttgctcttacagcatctgctgtgccagaaggtttaccgattatgattacaatcgctttaagtgcaggaatctttcgtatgcaaaagcaaaatgcacttgttcggaagctttctagtttagaaacgttaggtagaacaactgttatttgttctgataaaacaggtactcttacgaagaatgaaatgacagttaaagtcattgccacaccaaatcgtatgtggagtgtatcgggtgatggatatgaaccagttggtacaatatcggatgtaacgtcgtctaaagtcgcagctgctgtagagatggaagtagaagaagcgacttatcatgaaagtgaaaaaacgccgttagaacatccagattttgttcgcgttctgcaaattagtgttctttgtaataatagtaagttagaacatgaagacgatcagtggattgtgaaaggtgacccaactgaaggggctttattaagttttgcttctaaagcgggtgtttcatataaggatatggcatcatttgaacgacatcatgaagaaccgttcgattctgagacgaaaattatgagtgtcgtttgtaaggaaaatgaatcattgtataagttttcgaaaggatctgtagaggcgatccttactagatgtaaatggtatcaacataacggtgaaatctatccgttatgtgataaagaaaaagaggtcattttacaacaaaatgaaggttttgcagaacaggcattacgtgtattaggttttgcgtatagtaatgttgagaataatgaccttatttttgttgggttagttggtatgattgatccgccaaaacctgaagtggaagagagtattcgtgaagcgattgaacttggtgtaaaacctgtcatgattactggggatcatccgactacggcaatttctattgcgaagcagaccggtatttggaatcgtgatgatcgtgttttgacaggggtagaaatcgacaatgtaacagatgaacaattaaaagaaattgtaaaaaatacttctgtttttgctcgcgtaacaccggcacataagttacgtatagtagctgcataccaagcggactgtcaaattgtagcgatgactggggatggtgtaaatgatacacctgctataaagaaagcgaacattggtattgcgatggggcaaacaggaacagaagtaacgaaagaagctgccgatcttatattgaaaaaagatcatttcggttccattgtggaaggggtaaaagaaggtagaacgattattggtaatattcgtaaagcggttggatgtttattgacgggaaatttagctgaagtattagtgacaagtgcggcagttattgcgggaatgccgattccgttagtaccaattcaaattttattaatgaatcttattacagatgctttaccagcgatgattttagctgtaaatcctggaaacaaaacgaagcaaacgaaacgtcaagacattgttgataaagagttgtacaaaaaagttgtaacgcgaggaatactgcttggagcagggtcacttgctttattcggtatgagcttagcggctggcgtgcctcttgcggtagcgcaaacatcagcatttgcagcattagttgcaggtcaacttattcaaacattctcttggagacaagaaggatcggacgaaacgatgcgtgattggtcaaaagatcgtttctttgtgacggcgttaggaacgtcttggcttgtattattatcagctatatatgttccgccatttgctcgtatattccataccgctccattaacatttatgcaatgggtacctgttctt

SEQ ID NO: 40297 - DNA, 1449 bp, Bacillus thuringiensis
atgaatccaaataatcgcttaacaacaaaccaaggtgctccagttggagacaaccaaaattctcgtacagctggtcgtcgtggaccagtattattagaagactatcatttagtagaaaaacttgcgcactttgatcgtgaacgtattccggagcgtgttgtgcatgcacgtggtgcaggtgctcacggtgtattcgtaacgaaaaatagtatgaagcaatatacgaaagcagcatttttacaaaatgaaggaactgaaacgcctgtatttgttcgtttttcaacggttattcatggtcaaggttctcctgaaacagcacgtgacccacgtgggtttgctgttaaattttatacagaagaaggaaactacgatatcgtaggtaatcatttaccagttttcttcattcgtgatgcaattaaattccctgatatggtacattccttaaaaccagcacctgatacgaatattcaaacgccagatcgttattgggatttcatgacgttaagtccagaatctacacatatgatgacatgggtattttctgattacggtacaccagcaagctatcgtgaaatggagggtttcggcgtccattcatttaaatggattaatgaagaaggtaaaattgtttatattaaataccactggaaaccacagcaaggtgtacgtaacttaaatgcgaaagaagtgcaagaagtacaagggaaagacttcaatcatgcaactcgtgacttgttcgatgcaatcgaaaaaggaaattacccaaaatgggatttacacgtacaagttatgcaattagatgaaatggactctttagactttgatccactagatccaacgaaagtatggccagaagatcgcttcccattaatggaagtagggacaatgacgttaaatcgtaatccgaaaaacttctttgcagaagtagagcaagtagcgttctctccaagtgcaactgtaaatggtattgagccatcggaagataaattattacaaggtcgtttattctcttacccagatacacagcgttatcgtcttggtgcaaattacttacaaattcctgtaaactgcccatacgcagctgttcataatcaacaacgtgatggtgcgatgcaagtgaatcaaaacccatctacaatcaactacgaaccgagtcgtcatgcagagaatccagttgaagacaaagcttaccgcgattcaactatgaaagtagaaggctatgtatctcgtgaaaaaattgagaaaccaaatgacttcaaacaagcaggtgagcgttaccgttcattctctaaagaagagcaagataacttaattgcaaacttaacaaatgatctaaaagacgtaaatgaacgcacaaaattattagctgtttgtaacttcttccgtgcagatcaagaatacggtatgcgtttagcgcaggcattaaatgttgatattacgcaatatgta

SEQ ID NO: 40298 - DNA, 918 bp, Bacillus thuringiensis
atgacaaagaaaagaataggtttactcgtaatggcgtatggaacaccagaatcattagacgatgtagaggcatattatacacatatccgtcacgggcgtacgccatcagaagaagcgcttgaagatttaattgggcgctataaagcgattggtggaatttcaccgcttgcaaaaattacgaaagaacaggcgcataaattaacagattcaatgaataacatatttacagagtatgaatttacttgttacttaggtttaaaacatattgcaccatttatagaagatgcggtagaagaaatgaagcgtgatgggattgagcaagcgattagtatcgtattagcgccacattactctacatttagcattaaagcgtataatgaccgtgctattcgtctttcgcaagaaattggtggtcctgttattgaaccaattgaacaatggtatgatgaaccgaaatttatttcgtattgggcagaccaaataaaagagacgtttacagaaattgataataaagagaaagcagtcgtaattttttcagcgcatagtttgccagaaaaaattattgcaacaggagacccatatgtagaacaactaaagcatacggcatatttaattgcagaagctgcaaatattcaaaactatacaacgggttggcaaagtgctgggaatactccagatccgtggattggtccagatgtgcaagatttaacgaaagatttatatgaagagcatgggtacgaatctttcgtatattgcccagttggttttgtagcggagcatttagaagttttatatgacagcgattatgaatgtaaagttgtaacggatgaattaaatgccaaatatttcagaccaaatatgccgaatgcacaatctgcatttatcgactgtttggctgaaattgtttccaaaaaagtg

SEQ ID NO: 40299 - DNA, 1161 bp, Bacillus thuringiensis
caaattaatgaaagatcattgttattgcataaagaattagtaggaaaaattgaaattacaagtaaagtagaagtaaattcagcggatgatttaagcctgacgtatacaccaggtgtagcggagtcttgtaaagcaattgcggcagatgaagaaacggtgtatgactatacagcacgtggtaatatggtggcagttgtctcagatggaacagcggtactcggtttaggaaacattggaccgaaagcggctatgcctgttatggaagggaaaagtattttgtttaagaagtttgcgaatgtagatgctttcccattatgtttaggcacaacggatgtagatgaaatcgttacccttgtgaaaaatttagagcctacatttgcagggattaatttagaagatattgcagcaccgcgttgttttgaaattgaaaaacgattaaaagaagaaacgaatattcctgtattccatgatgatcaacatggaacagctattgtcgttttagcagctgttattaatgcattaaaagttgttagcaaacaaatggataatgtgaaaatcgttattaacggtgcgggttcggcaggaattgcaattggaaaattattattaaaggctggtgcaaagcacattacgctagttagcctagaaggtattgtttgtgaaggtgaaacatggatgaacgaagcgcaaattgaagtttcaaaaaagacaaatcgtgaacatgtgcgtggaacgttaaaagaagcgattaaccaagctgatatttttattggcgtatctgctcctaacgtattaacgaaagaacttgtacagacgatgaatgagaaagcaattgtgtttgcaatggcgaatccaattccagaaatcttccctgaggatgcattagaggctggggcagctgtagtaggaactgggcgctcggattatgcgaatcaagtaaataatgtattggcgtttcccggaatattccgcggtgcgttagatgtgcgcgcaactgatattacagaagagatgaaattagcggcagcatatgggatcgctaacatcattactgatgaagaacgtaatgcgaattatgtaatcccgaatccattagataaaagagttgttccaagtgttgcggaagcagtagcgaaagcagctattgattcaggcgtggca

SEQ ID NO: 40300 - DNA, 1137 bp, Bacillus thuringiensis
atgcattttaaactatcagaagaacatgaaatgataagaaaaatggttcgagattttgctaaaaatgaagtggcaccaacagcagctgagcgtgatgaagaagagcgatttgatcgagagttatttgatcaaatggcagagcttggtttaactggtattccatggcctgaagagtacggtggaattggaagcgattacttagcatacgtaatcgctattgaagaattatctcgcgtttgtgcttcaacaggtgtaacactgtctgcgcatacttcacttgcgggatggccaatttttaaatttgggacggaagagcaaaagcaaaagtttttacggccgatggctgaagggaagaaaattggtgcatacggcttaacggaaccaggatctggatcggatgctggtggaatgaagacaatcgcaaagagagatggcgatcattatattttaaatggatcaaaaattttcattacaaatggcggtattgctgatatttatgttgtttttgcgctaactgatcctgaatcgaagcagcgcggtacgagtgcatttattgtagaaagtgatacaccgggattttcagttgggaagaaggagagcaagctagggattcgctcttcaccaacgactgaaattatgtttgaagattgccgtattcctgtagagaatctacttggaggagaggggcaagggtttaaagttgcgatgcaaacattagatggaggtcgtaacggtattgcggcgcaagctgttgggattgcacaaggggctttagatgcttctgtagaatatgcaagggagcgccatcagtttggaaaaccaattgcggcgcagcaagggattggctttaaacttgcggatatggcaacagatgtagaagcagcacgccttttaacatatcaagcggcttggcttgaatcagaagggcttccgtatggaaaagaatcagcgatgtcaaaagtatttgcaggcgatgcagcgatgaaggtgacgactgaagcggtgcaagtatttggtggttacggttatacgaaagattatccagtagagcgttatatgcgagatgcaaagattacacaaatatatgaaggaacacaagagattcagaggcttgtaatttctcgtatgttaacgaag

SEQ ID NO: 40301 - DNA, 1119 bp, Bacillus thuringiensis
gaagagcagcaaatgatgaggaaaatggttcgggattttgcacagaaggaaatagctccctttgttcctagtatggaacaaggggtgttcccgaaagagattttgcaaaagatgggtgagcttggattaatgggtattccagcgcctgcaaaatacggcggggcagaaatggactttatttcttacattctagcaattgaggaaatctcaaaggtaagtgcaacagttggtgtaattttagctgtacatacgtcagttggaatgaatccgattttatattttggaacagaagaacagaagaaaaaatatgtttctaaacttgcaaccggggaatatttaggtgcatttgctttaacagagccaaatgcaggatcagatgcagggagtttgaaatcaagagctgtgaaaaaaggtgatcattatattattaatggatcgaaagtgtttattacaaatggtggtgaagcaagtacatacattgtattcgcttctacaaatccagaggcaggaaaaagtggtatttctgcatttatagtagagaaagatacacctggtttaatcattggaaaagatgaacataagatgggacttctcggttctcgtacagtacaacttacttttgaagatatgaaagtgccagctgagaatttacttggggaagaaggacaaggattcaaagtggcgatggcgaatttagatgttgggcgaattggaatcggtgcgcaggctttaggaattgctgaagcggcgcttggctgtgcaattgattatgcaaaagaaagagagcaattcgggaagccaattgcggcgcagcaagggattggcttcaagcttgcagatatggcaacaagtgtcgaggcagcaaggttactcgtatatagagcggcatctcttagggcacaaggattaccatgcggtaaagaagcatctattgcgaaattatttgcttctaagacagcggttgaagtcgcgattgaggcggtgcaagtatttggtggttacggttatacgaaagactatccagtagaacgatttttccgtgatgcgaaaattacgcaaatatatgaaggaacaagtgaaatacagaaacttgttattagccgtgctttataaaagggc

SEQ ID NO: 40302 - DNA, 849 bp, Bacillus thuringiensis
atgggtgtacaaaacattgttgtaattggtgcagggcaaatgggatcaggaattgcacaagtatgtgcaatggcaggatatgacgtgaaggtacaagatttaaagcaagagcaattagatagaggaatggctatcattacgaaaaacttagcgcgccaagtagaaaaaggacgcatgaaggaagaagagaaggaagcgacattaaatcgtcttacagtaacgcttgatttagattgtgtgaaagaagcggatcttattattgaagcagctgttgagaaaatggatattaaaaagaaaatctttgcgaatctagatgaaattgctccagaacacgcaattttagcgacgaatacgtcatctctgccaattacagaaattgcagcggtaacgaagcgtccggaaaaagtaatcggtatgcactttatgaatccagttccagttatgaagcttgttgagattattcgtggtttggctaccgatgatgcggtatatgaagcaattgaagatattacgaaaaaaattgggaaagtaccagttgaagtgaatgatttcccaggttttgtatcaaaccgcattttactaccgatgattaacgaagcaatttatacgttatatgaaggtgtagcgacgaaagaagcaattgatgaagtcatgaagcttggtatgaaccatccgatggggcctttgacactcgctgattttatcggtttagatacgtgtttatacattatggaagtgttgcatgaaggattaggagatagtaaatatcgcccatgtccattattacgtaagtatgtgaatgcaggatggttagggcgtaaaacaggtcgtggattctacgtttacgaa

SEQ ID NO: 40303 - DNA, 1179 bp, Bacillus thuringiensis
atgagtaaaacagttattttaagtgctgcaagaacaccagttggaaaatttggaggatctttaaaagatgtaaaagcgacggaacttggaggaattgcaattaaagcagcgcttgaaagagcaaatgttgcggctagtgatgttgaagaagttatatttggaacggttattcaaggtggacaggggcaaattccatcgcgccaagctgcaagggccgctggaatcccatgggaagtgcagacggaaacagtgaataaagtttgtgcatcagggcttcgtgcggttacgttggcggatcagattattcgtactggcgatcaatcactaattgtagctggcggtatggagtcgatgagtaacagtccttacattttacgcggagcaagatggggatacagaatgggcaataacgaagttgttgatttaaacgttgctgacggtttaacatgtgcattttcaggtacacacatgggcgtttatggcggagaagttgcgaaagaagatggaatttctcgcgaagcgcaagatgaatgggcatatcgtagccatcagcgtgcggtttcagcgcataaagaagggcgttttgaagaggaaatcgtgccagtaacgattccgcaaagaaaaggcgatcctattgtcgttgcaaaggatgaggcgccacgtgaagatacaacgattgaaaagttagcaaagttaaaacctgtatttgataagacagcgacggtgacagctggtaatgcgccgggactaaatgatggtggtgccgcacttgtattaatgagcgaagacagagcgaagcaagaaggaagaaagccattagcgacaattttggcgcatacagcaattgcagtggaatctaaagatttcccaagaacgccaggttatgcaattaacgcattgcttgaaaaaacaggcaagaaaattgaagacatcgatttattcgagattaatgaagcatttgcagcggtagcaattgcaagtacagaaatcgcaggaattgatccggaaaaattgaatgtaaatggcggcgcggtagcgatgggacatccaattggagcaagcggagcgcgcattatcgttacactaatccatgcacttaagcagcgcggcggcggaattggaattgcttcgatttgtagcggtggcggtcaaggggacgcagtgatgattgaagtccac

SEQ ID NO: 40304 - DNA, 675 bp, Bacillus thuringiensis
ttaaagaatgattgggagccactattggcaccagaattcgagaaagagtattatcttactctatccagttttttgacagaagaatacagcacgcatgttgtttatccgaaggtagaagatatttttaacgctcttcagtatacaagttatgaaaatacaaaggttgttattttaggacaagatccatatcatggaccgaatcaagcgcatggtttaagcttttctgtgcaacctggtgttaaaacaccaccgtcattgttaaatatgtataaagaacttcgagatgaatatggttatgaaatcccgaataacggttatttagtaaaatgggcggaacaaggagtattattactaaataccgtattaacagttcgtcaaggcgaagcaaattctcataagggaaaaggatgggagcactttacagatcgtgtaattgaactgttgaatgaacgtgaaaagccagttattttcatattgtgggggcgccatgcgcaggcgaagaagaagttaattacgaatccgaatcatcatattatcgaatctgtacatccaagcccattatcggcaagacgtggtttctttggtagtaagccatattctaaagtaaatacgattttagctaatatgggcgaaagagaaattgattgggaaattccaaatttataaatagaaaag

SEQ ID NO: 40305 - DNA, 930 bp, Bacillus thuringiensis
attaaaattagaacaaggaggggtaaaatgacgacgatactttccgtacgagacttgaagaaggtaattggaaagaagactcttgtagagaatatttcctttgatgtaaagcaaggagaagtgttcgggttcttaggaccaaatggtgctggaaagacgactaccattcgaatgttagtcggattgattaaggcgacagaaggtacgatttctattggtggttattcgattaaggaaaatttcagagaagcgatgcgtcaaattgggagtatcgttgaaaacccagagttgtatacatatttaacgggatgggaaaatttaaagcaatttgctcgtatgttaggtgatatatcagatgaacgtattattgaaattgctgaaatggttcatttagatgaaagaattcatgacaaggtaaaaacgtactcacttggtatgaaacaacgccttggaattgcgcaggcgctccttgggaatccgaaattgctcatattagatgagccaacgaatggtttagatccagcagggattagagaacttagggaatttatacataagcttgtaaaagaagaaaatatgagcgtgtttatttcaagtcacttgctaagtgaagtgcaaatgatatgcgatcgcgttgctattattcataaaggaaaaatgataacagttgccaaggttgaagaattaattaaaacagcaagtgatcgtgtagaatggattgttacaccaatttctaaggcgaaagatatgctagaagcggccaaagaagtaagggaagtgagtgtagaaggcgatcgattactatgccgcatggatattgcatctataagtagttggaataaacactttgtcgaaaatgaaatagatgtacatagcgttaaggagcttgtatttacgctagaagatttatttattgaactcacaaggggt

SEQ ID NO: 40306 - DNA, 1284 bp, Bacillus thuringiensis
aaagaaattcaagttgggttattaggtcttgggacagttggcagtggtgtggttcgtattattacggatcatcaagaacgactcatacaccaagtaggttgtccagtgaaggtaacgaaagtattagtgcaaaacattgagaaagagagagaggtagaggtaccttctactctattaacacaagatgcaaatgaaattttagataatccaaatattgatgttgtcattgaagtgatgggtggcattgatgatgcaaaatcatatattttacaagctttaaaaagcggaaagcatgttgtaactgcaaataaagacttaatggcattacatggagctgaattattagcgacagcaaaagataataaggctgatttattctatgaggcgagtgtggcagggggaattccaattttacgcagtatcgtagaaggactttcctcagatcttattacgaaagtaatgggaattgtaaatggaacgacaaattttattttgacgaaaatgtcagacgaagggagagcatataacgacgtgttaaaagaagcccaacaacttggatttgcagaagcagatccaacatcagatgtagaaggtttagatgcagcaagaaaaatgacgattttagctactctcggtttctctacaaatgtagagcttggagacgtgaaagtaaaagggattacctctattacagaggaagatattgaatatagtaagagcttaggttatacaattaaattaatcggtcttgcaaaacgagatggtgaaaaattggaggttacagttgaaccaactttacttccaaatacacatcctcttgcggcagtacaaaatgaatataacgctgtgtatgtgtacggtgaagcagttggggaaacgatgttttatggaccaggcgcaggaagtttaccaacagcgacagctgttgtttcggatttagttgctgtaatgcaaaatattagattaggggtaacaggaaatagtgctgtagtcccacaatatcaaaaagtattaaaagagccagacgaaattgtcgtgaaaaagtttttaagactgcatgtaaaagacgaaattggtgtatttgcaaaaattacttcattgttctctgagcgcggagttagctttgagaaaattattcaaatgccgcttgaagagaaaggaaaggctgaaattgtaattgtaacgcatcgtgcgtctcttgctgattatgattatattctacatacgttgcaagggtatgaagaaatagattgtttgaaagcgaactatcgaattgaaggggat

SEQ ID NO: 40307 - DNA, 1272 bp, Bacillus thuringiensis
atgcgcgattacttaattaaaccacttgttggtcagccgtatccaatgatttcacatggaaaaggtgtttatttgtatgatcaaaatggcaataaatattttgatggttcgtcaggagcaattacggcaggtattgggcatggcgtaaaggagattgcagacgttattaaaaagcaagctgaggagattgctttcgtttatagatcacagtttacgagtgaaccagctgaaaaattagcgaagaagttaagtgatttaagtgtaggagatttgaactggagtttttttgtaaatagtggtacggaagcgaatgaaacagctatgaaaattgcaattcagcattttcaagagcgaggtattcaagggaaacataaaattttatcaagatggatgagttatcacggtattacgatgggtgctttatcaatgtctgggcatccactacgtagacaacgtttcgtatctattttggaagattatccgactataccagctccatattgtttcagatgtcctgttcaaaaggtatatccaacttgtcagctggcatgtgcgactgaactagaaagatcaattgaaagaattggtgcagagcatattgctgcttttattgctgagccgattatcggagcagctggaggcgcggttgttccgccgaaagactattataaagtcattaaagagatttgcgaccattacgatattttatttattgcggatgaagtaatgactgggcttggtcgtactggagcatggtttgcgatggagcattggggcgtagagccggatattatgacacttggtaaagggttaggagcgggatatacaccgatggcagcgacagttgtaagtgatcgtgttatggaaccaatattacgtggatcacgttcagtaatgagcggtcatacgttaagtgcaaatccattgtctgcagcaacggctttagctgttattgaatatatggagaaacataatcttcctgaaaaaacagcagaaaagggagagtatttaataaaaggcttacagaaagttcagcaacaatcgacaatcattgctgatgtgcgcggaaaagggttgctaatcggagtagaattgcaaccgtttacaaaagcgtcagagcttatttcagttgcagctaaaaatggtctgcttttataccaagcagtttcagggcaagcaggaaaagaagatagtgcactgcttgtagcaccgccaatgacaactacatattccgagttagatgaattactttcaattttctctaaaagtgtg

SEQ ID NO: 40308 - DNA, 774 bp, Bacillus thuringiensis
ttatcaattcaacacattcaaaaacagtttgatgcatttacagcgttaaaagatatttcttttactgtgaacaaaaatgagtttgtatgtttattaggcccaagtggttgtgggaaaacgacattgcttcgaattttagcaggtctagaagaggcaacaacaggtagtatagctgtgaatggaaaagatattacagcattacctcctggaaagagaaacttcggaatggtgtttcaatcgtatgcattatttccgaatttaacagcacttgaaaatattgaatacggcttaaagacaaaaaaatatggaaaagcagaagtaaaagagaaagcgctagaggcgttaaaacttgtagatttactgaatgtaaaagataaatatcctgctcaaatgtctggtggacaacagcagcgagtggcacttgcacgtgcgctcgctctgtctccagatattttgttacttgatgagccgttatctgctttagatgcgaaagtacgtgaaaagttacgtagagaaatgcgtgatttgcaagagaaagtaggagtaacaactattatggtcacgcatgatcaagaagaggcattaacgatggctgataaaattgttgtaatgaatcatgcggaaattatgcagattggaacaccagaggagatttatcaaagaccagccaatccgtttgtggcagattttattggttctattaatttcttttcgaaaaataacgaagagcatgcaattcgtcctgaacatgtaacaattgtacaaaaggacggt

SEQ ID NO: 40309 - DNA, 2307 bp, Bacillus thuringiensis
gaaagaatcgtgcccctcctaccattaagaggcgttctcgtatatccaacgatggttttgcatcttgatgtaggacgtgataaatcgatacaagcactagagcaggcggcaatggatgaaaatatcatctttttagcaatgcaaaaagaaatgaatatcgatgatccgaaagaagatgacatatatagtgtaggtacagtggcgaaagtgaagcaaatgttaaaattgccgaacggtacgcttcgtgtccttgtggaaggtttacatagagcagaagtaatagagtttatcgaagaagaaaatgtagtacaagtgtctattaaaacggtaactgaagaagtagaagatgatttagaagagaaagcttttatgcgtacgttactggagcatttcgaacaatatattaaagtttcgaaaaaagtttcaaatgaaacttttgcaacggtagctgatgtggaagaaccagggagattagctgatttaattgcttctcacttgccgattaaaacgaagcagaaacaagagattttagagattgtatctgtaaaagaacgattacaaacacttatttcaattattcaagatgaacaagagttacttagcctagaaaagaaaattgggcaaaaagtgaaacgttccatggagcgcacgcaaaaagaatatttcttacgtgagcaaatgaaggcgattcaaactgaacttggcgacaaagaaggcaagggcggagaagtagaagaacttcgtgagaaaattgaacagtcgggaatgccggaagaaacaatgaaggctgccctgaaagaattagatcgttatgaaaagttaccagcaagttctgcggagagtggtgttattcgcaattatattgattggttattagcgcttccgtggacagaggcaacagaagatataattgatcttgctcattcggaagagattttaaataatgatcattacggtcttgaaaaagtgaaagagcgtgtacttgaatatttagctgtacagaagttaacgaattcattaaaaggacctatcctttgtttagtaggccctcctggggtcggcaaaacttcgttagcgcgttcaattgcaacatcattgaatcgtaacttcgtccgtgtatctcttggtggtgtgcgtgatgaatctgaaattcgtggtcaccgtcgtacatatgttggagcaatgccaggacgcattattcaaggtatgaaaaaggcgaaaacagttaatccagtcttcttattagatgagattgataaaatgtctaacgatttccgtggagatccatcagcggcattacttgaagtattagatccagaacaaaaccataacttcagtgatcattacattgaagaaccatatgatctatcaaaagttatgtttgtagcaactgctaatacactttcaagtattccaggtccattacttgaccgtatggaaatcatttcgattgctggctatacagaacttgaaaaagtacacattgctcgtgagcatttattgccgaaacaattaaaagaacatggcttacgaaaaggtaatttacaagtgcgtgatgaagcgctgcttgagattattcgttattatacacgtgaggctggtgttcgtacgctagagcgccaaattgcaaaagtttgccgtaaagtagcgaagattatcgttacagcagaacgtaaacgtatcgttgtgacagagaaaaagattgttgatttacttggtaaacacatattccgttatgggcaagctgaaaaaacagaccaagttggtatggcaacaggtctagcttacacagcagcaggcggcgatacacttgccattgaagtttctgtagcgccaggaaaagggaaactaattttaacagggaaacttggggatgttatgaaagaatcagcacaagctgcgtttagttatatacgttctcgtgcagaagagcttcagatcgatccgaatttccatgagaaaaatgatattcatattcacgttccagaaggagcagttccaaaagacggaccgtcagcaggtattacgatggcaacggcacttatttctgcgctaacaggtattcctgtaagtaaagaagtgggtatgacaggtgaaattacacttcgtggtcgtgtattaccaattggtggtttaaaagaaaaaacattaagtgctcaccgcgcaggcttaacaaaaattattttgccagcagaaaacgagaaagatttagatgatattccagagagcgtaaaagaaaaccttacgtttgtgcttgcatctcatttagatgaagtattggagcacgcattagtaggagtgaaacaa

SEQ ID NO: 40310 - DNA, 621 bp, Bacillus thuringiensis
atgaagggattatttgtaacaattgagggcccagaaggttcaggtaaaacaacgttaattaaaagcttattgccatattttgaaaaaaaagcacaaaaggtaatggcgacaagggaaccaggcggtattgcaatttctgaggacattaggacgattttacataaacaagaatatacgatgatggaagcacgtacagaagcgcttctttatgctgctgcgcgcagacaacatttagtagaaaaagttatgccagcacttaatgagaactacctcgtgttatgtgatcgttttatagatagctctttagcataccaaggctatgcaagaggattgggtatggataaggtatttgaaataaatcgtttcgcaacagaggactgtatgcctagtttaacaatttatctagacattgagcctgaggttggtttggctcggattgaaaaagatgcaggacgtgaagtaaatcgactagatatggaagatatctctttccataaacgtgtgcgcgaagggtatttacaagttgtagaacgtttctcggatcgtattgtattggtaaatgctgatcagccgatggaaaaacttatagaagaagttgttcagattatagaagataaattg

SEQ ID NO: 40311 - DNA, 1368 bp, Bacillus thuringiensis
cctttatatgaggcgttaatagagtttaaagaaagagggccgttatcctttcatgttccaggtcataagaatggtttaaacttccctcaggaggcaataagagagtttaaagatattctatctattgatgtaactgagttagcaggactagatgatttgcatagtccgtttgaatgtatagatgaggcacaacaattattggctgaagtttataatacaaagaggagctattttttaattaatggttcaacagtcgggaacttagcaatgattttgtcttgttgtggggaacatgatattgttcttgtacaaagaaattgccataaatcaattattaatgctttaaaacttgcgggagcaaatcccatttttttagatccatggattgatgaagcttataacgtaccggtgggagttcgtaacgaaattattaagaaagcaattgaaaagtatccaaatgcgaaagcactcattttaacgcatcctaattattatggtatgggtatggatctagaggcaagcatcgcttttgcacatgcacataaaatccctgttttggtagatgaggcacatggggcacatctgtgcttgggagaaccattcccaaagtcagcattaacatatggtgcagatattgtagttcattctgcacataaaacattacccgcaatgacaatgggttcctatttacatataaatagtcacttagtagacgaagagaaggttactacttatttaagtatgctacaatctagtagtccatcgtatccaattatggcttccttggatatagcacgctttacaatggcgcgtataaaagaagaaggtcacagtgaaattgttgagtttttacgaagatttaaggaacaattacgttctattccccaaatcgccattttagaatatccgttgcaagatgagttaaaggtcaccgtacaaactcgttgtcagttatcagggtacgaattacagtctgtatttgaaaaggtcggtatatatacagagatggctgatccgtacaatgtcctatttattttacccttacaagtaaatgagggatatatgaaggttatagagatgatccgagtagcattgcaacattatgaggtgaaagacaagagggaatctattcgttatacttataaaggtgaattctctcttttaccgtatacgtataaacaactagacggatatgaaacaaagatagtatctatagaagaggctgttggaatgatagcggcggaaatggtgattccgtatccacctggaattccattgattatgtatggagagagaattacttcagagcataaagagcaaattatgtatttagagagagcaggagctcgttttcaaggtaatacgaaa

SEQ ID NO: 40312 - DNA, 1449 bp, Bacillus thuringiensis
atggaaaagcaagtgagagtacgctacgcgccaagtccaacaggacacttacatatcggaaatgcgcgtacggcattatttaattatttatttgctcgtcatttagatggcaaatttattattcgtattgaagatactgatgtaaaacgtaacgtggctggtggagaagaaagccaattaaaatacttgaaatggctcggtatggactgggatgaaggtgttgatgttggtggtgaatttggaccatatcgccaaacagagcgtttagatatttataaaaaattatatgaagatttattagagcgtggtctagcttataaatgttatatgacagaagaagagctagaagcagagcgtgaaggacaaatcgctcgcggtgaaacacctcgttacgcaggtaaccaccgtgaattaactgaagaacaagtgaaagaatttgaagctgagggacgtattccaagtattcgtttccgtgtaccagctgatcgtgactacacattcaaagatattgtaaaagatgaagttgcgttccattcaaatgatttcggtgattttgttattgtgaaaaaagatggaattccaacttataactttgcagtagcagtagatgatcatctaatggaaattacacatgtacttcgtggtgatgatcatatttcaaatacaccgaaacaaatgatgatttatgaagctttcggctgggatattccacaattcggtcatatgactctaattgttaatgaaagtcgtaaaaagttaagtaagcgtgatgaatctattattcaatttattgagcaatataaagagcttgggtatcttccagaagcaatctttaactttattgcactactaggttggtctccggtaggagaagaagaaatcttctctaaagatgagtttatcaaaatgttcgatgcagctcgtttatcaaaatcacctgcattatttgattctcaaaaactaaaatggatgaacaaccagtatatgaaaaagcaagatttagatacggttgtagagttaagcttaccgcatttagtgaaagctggacgtgtgggagaaactttaagcgaacaagaccaagcttggattcgtgatgtaattgctttataccatgaacaaatgagttttggagctgaaattgtagagctttctgaaatgttctttaaagatcatgttgactatgaagaagaaggacaagaagtattaaatggtgaacaagtacctgaagtacttcgtgcatttgctggtcaaatagaagctctagaagcaatggagccagcagcaattaaggcagcgattaaagcagttcaaaaggaaacaggacataaaggtaaaaatttatttatgccaatccgtgttgcaactacaggacaaacgcatggtccagagcttccgaatgctattgcacttcttggaaaagaaaaagttttaaatcgtcttcaaaaagta

SEQ ID NO: 40313 - DNA, 1728 bp, Bacillus thuringiensis
ataaaaagatatttacaatttgttaaaccatatcgatggcttattgctattacaattattattggactagttaagttcggtatcccacttattatgccgtggttattaaagtatattatcgatgatgtaattcaaggcgcgggctcacttcaagataaaacatctcaattaataacagcgattggaattgctttttttatttttgcggtattaagaccaccgattgaatattatcgtcaatatttcgcccaacatatcgcaaatacaatactgtatgatttgcggaagcatattttcggtcacttacaaaagttaagtttacgttattactccaatacaaaaacaggggagattatttcgcgtgtcatccatgatgtagaacaaacgaaggattttgtaattactggtttgatgaacgtctggttagatactgcaacaattgctattgctatcattgttatgttttctatgaatataaaattaacatttgttgcgttattgattttacctatttatgtaattgcagtgaaatattttttcggacgtcttcggaaattgacgaaagagcgttcacaagcgttagcgacgatgcaagggtatttgcatgaacgtattcaaggaatgcaagtgacacgtagctttgcgttagaagagtatgaggggaagcagtttgaaaaaagaaataatgaatttttaacgaaagcattaacccatacaagttggacggcaagaacattttcggcagtaaatacgttaaccgatttaggtccgttacttgtgattggttttgcagcatatgaagtaattcaagggcagttaacgctaggaacgatggtagcttttgttggatatatggatagtttatatagtccgcttcgccgccttgttaattcatctacaacattaacacaatcttttgcatcgatggaccgtgtgtttgaactgttagatgaaaaatacgatattgttaatgtaccaaatgcggtacaaacgaaaaaattaaatggagaaattgtatttgacaatgtttcttttcgttataatgcagatgaaaaagagatattacacaacttgtcattaactatgcagcctggagagaaagtagcgcttgtaggagcgagtgggggaggaaagtcatctcttgctagtttgatcccgcgtttctatgatgtttctgaaggcgcggtttatgtagatggcatagatgtaagaaagtacaatatgagaaatttgcgtagtcatattggaattgtactgcaggataatttattgtttagcgatacaattggagctaatattttatatggaaatccgaaagctacagagaaagaagtgattgcagctgccaaagctgcgcaaattcatgattttattatagacttaccagatggttataatactgtcgttggagaacgtggtgtgaagctatcaggcgggcaaagacaacgcgtggcaattgcacgagtgtttctaaagaatccgtcggtacttatattagatgaagcaacttcagcattagatttagaaaatgaaaggtatattcaagaggcgcttcagacgttagctgctgaccggacaacgattataatcgcacatcgattagcgacgattacgcatgttgatacgattatttacattgaagacggtgagattaaagagactggttctcatgaagagttaatgcgaaaaagaggattttattacaatttatatcaacttcaacatata

SEQ ID NO: 40314 - DNA, 1152 bp, Bacillus thuringiensis
agcgcgtttatttattcggatgactttcggggctattcatttagccctgatcatccttttaaccaactgcgcgtcacacttacgtatgatttattacaaaagggcggtttcatctctccctctcaaatcatctcaccacggatggctacagatgaagagatcgcctacgttcatacagaggagtacataaatgcggtaaaacgtgctggagaaggaaagttagaaaaatcaattgcaatgacatatggactcggaacagaagatacaccgatgttcccaaatatgcacgaagcaagcgcattgctcgttggcggtacgttaacagctgtcgatgctgttctttccggaaaagtaaaacacgcacttaatttgggcggcggcttacatcacggctttcgcggcaaagcatctggcttttgtatttataacgacagttctatcgcaataaaatatattcaaaagaaatacggtttacgcgtcttatatattgatacagatgctcatcacggtgatggcgtacagtggtcgttttatgatgaccctaacgtatgcaccatttcactgcatgaaactggtcgttatttattccctggaactggcgctgtaaacgaacgtggccaaggtaatggttatagttattcttttaatgttccactcgatgcttttacagaagatgaatcgttcttagaatcatatcgaactgttgtaacagaagttgcagcgtactttaaaccggatattattttaacgcaaaatggtgctgacgcacattattatgacccacttacacatctttgtgcgacaatgaatatttaccgcgaaataccgaagctcgctcgtgaaattgctaatgaatattgcgaaggtcgctggatcgctgtcggcggtggcggctatgaccattggcgtgtcgtaccaagagcatgggcactcatttggctcgaaatgaacaacatccaaaacatctcaggttatctccctccagaatggattgaagcttggaaaggacaagcagaaacagaacttcccctcacatgggaagatccagacaacatgtataaacctatcccccgtaaaccagaaattgaagaaaaaaacgcattaactgtagcgaaatcccttgaaattattcggaataatatgacaaaatct

SEQ ID NO: 40315 - DNA, 723 bp, Bacillus thuringiensis
gagaataaaataattatgatttctggagccaatagcggtataggtcatgcttgtataaaatactttttagaaaaatcatttcatgtaatagcgcttgatattaataataataacttaatagattatatgaaaacagatatgcctttgaaagtagtgcaaattgatttaagtaatagcgaagcgattcataatctgtttactcaattagatttagaaaagctttctcctgatatattaataaatgcagctggtattcgagagataacacctgttttacatttatccgatgatatgtttaaaaaagtaattgatgtaaatttagtagccccatttatcctttctagggaagtagctaagcgatggtgtgaatcgaaaataaaaggttgtattgtgaatatagcatcggtttctggattaatggctgaaccagagcgagctgcttatgttgcatcaaagcatgctttaatcggattgactaaacagatggctatggaatttggaaagcaaaatataagggtgaatagcatttctcccggtgttattagaactgaacttacagaagaatactttagtaatacagccttgatgtctatgataaaaagtaatcaatctttagatacttgggggttgccgcaggatattgtttcatgtattgagtacttgatttctgatcaggcccgctttattactggttctaattttgtaattgatggtggttggact

SEQ ID NO: 40316 - DNA, 705 bp, Bacillus thuringiensis
atgcgctacgttatcataacaggaacttcacaaggtttaggtgaggctattgccactcagttgttagaagaaagtacaactgtcatctctatttctagaagagaaaataaagaacttactaaacttgcagagcaatataacagcaattgcatttttcattccttagatcttcaagatgtacataacttagaaactaactttaaagaaatcatttcatccattaaagaagacaatgtatcctctattcatttaattaataatgcaggtacagttgcacctatgaagccgattgaaaaagcagaaagtgaacaattcattacgaacgttcacattaatttacttgcacctatgattcttacatctacgtttatgaaacatacgaaagaatggaaagtagataaacgcgttataaatatttcatctggtgcaggaaaaaatccttatttcggatggggcgcttattgtacgacgaaagctggtgtaaatatgtttacacaatgcgtagcaactgaagaatgggaaaaagaatatccagtaaaaatcgtcgcttttgcccccggtgttgttgatacaaatatgcaagcacaaattcgtgaaacagctaaagaagacttcacaaatttagaccgcttcattgcattaaaagaagaaggaaagctattatcacctgaatatgttgcgaaagctattcgtaacttactagaa

SEQ ID NO: 40317 - DNA, 1530 bp, Bacillus thuringiensis
acgatagggagaatttttgatttatcagttggtaagtatccgaataaagaggcgttagtggaacctgaaaagaatattcgctggacgtataaacagtgggatgaacaaataaataaaacagcgcacgctctattagaagacggagtaagaaagggagatacggtatctgtttacttatataattgccgtgaatttgtaaacgtttacttagcctgtgcgaaaatcggagcgatctttaacccgattaatttccgcttaaaggcgaaagaagtatcttatattcttcaggacgcatcctcgaaagtcgttgtctttgaaaaagcagttgagtcaactgttgctataattgaaagagattttccaaatacatctttttggtctatagaaaacgataaaccttcctatgcaagttcctaccatgaaaaagtgaatgcagcatcttctgagaaagtaaatatcgaaattgatgaaatggattattgttcaatgctttatacgagcggtacgacaggtcatccgaaaggcgtattacatcgtcatcgcgaaatgactgagcatagtatgatttgtacgtatttccttaaatataatagagatagtgtagggcttgtcgttgcgcctttatatcactgtggtgaattaaacgctggaatcataccacgcattcaagttggcggaaagaatgttattttgcatcattttgatacagaaacagtattacatacgattcaagaagaaaagattacgacgttctttgcagcgccgacaatgtggaatatgttgttgcaaaaagatttagctcagtatgatttaacttcgatgaagattggtatatacggcggagcagcaatggcaccggcgttagtaaaagaatgtaaagaacgtctttatattgatcttgttcaaatatacggaatgacagaaatggggccagttgttgcgtttctcgtagaggaggatcaaattacgaaagctggttcagcaggcacgccatgctttagccatgaagttcgtattgtgaaaccgaacgaggatgcaccggcagaaccagaggatgtattacctccttatgaagtgggagaaattattttgcgcggcccaactatgatggctggctatcataatcgtgaagaagcgaataaaaaatcgatgtataaaggatggtatcattcgggtgatctaggctattttgataaagacggttatttattcgttgctgatcgcgttgatgatatggtaattagcggtggcgtaaatatttatcctcgtgaaattgaagatttccttcatagtcatcctggtatattagatgtggcggtacttggtgagccagacgaattatggggagagcgtgttgtggcagttattgtgaagaaagatgaaacaataacagaagctgatttagaaacgtattgcaaagaaagtgatgaactagcagattataaacgtccgcgtcattatttatttgtagatgaactccctcgtaatgcgagcgggaagttgcagaaatttgtgctgagggagtcattg

SEQ ID NO: 40318 - DNA, 2592 bp, Bacillus thuringiensis
acaaacgaacaacacggtttaacagatgaaattgtaagtgaacgtttaaagcaatacggttctaatgaattagctacaaaacaaaaacgcactttatggcagcgtattttcgcccaatttaatgacgtcctcgtatatgtccttattattgctgcccttatttctgcctttgtaggtgaatgggcggatgccagtattatcgcgcttgttgtagttttaaatgctgttatcggtgttgtccaagaatctaaagcagaacaagctttagaggcactaaaaaagatggcaacacctaaagccatcgtcaagagacatggtgaactaaaagaaattccatctgagcacgtcgttccaggtgatatcgttatgctcgacgccggacgatatatcccatgcgatttacgccttattgaaaccgcaaatttaaaagttgaagaatctgctctaactggtgaatctgtccctgttgataaagatgcaatctaccacccttccatgcaaagtgatgaacaagtaccactcggcgatcaaaaaaacatggcctttatgtctactcttgtaacatacggaagaggcgtcggtgttgctgttgaaactggaatgaactcacaaattggtaagattgctacccttttacatgaagcagacgatgatatgacaccacttcaaaaaagcttagcacaagtcggaaaatatttaggctttgtcgctgtagctatttgtatcattatgttcctcatcggttttttacaaggccgggatacgttagaaatgtttatgactgctattagtttagccgttgcagctattccagaaggcttgccagctatcgtttccatcgttcttgcaattggtgtgcaacgtatgattaaacaaaacgttatcattcgcaaactaccagctgttgaagccctcggttctgtcacaattatttgttcagataaaacaggtacgttaacgcaaaataaaatgaccgttactcacttttatagtgataacacatacgatcgcttagaaagtttaaatgtaaataatgatgcgcaacgtctattgttagaaaatatggtgctatgtaatgatgcgtcttataataacgaatcacaaacgggagacccgactgaaattgcacttctcgttgctggaaccacttttaacatgcaaaaagattatttagaaaaaatacatgaacgtgttaacgaagtacctttcgattcagatcgtaaaatgatgtcaaccgtgcatacatacgatgaaagctactatagcatgacgaaaggcgctatcgataagctcttacctcgatgtacccatatttttaaaaacggcaaaatcgagattttaactgattctgataaaaatcaaatattagaatctgccggagcaatgtctcaagaagctttaagagtactttcattcgcatttaaacaatacaattcaaacgatatggatataaatcatcttgaagaaaatcttatctttattggtcttgtcggtatgattgatccaccacgaactgaagtgaaagattcaattaaagaatgtaaaaaagccggtattcgcacagttatgattaccggtgaccataaagataccgcctttgcaattgccaaagaacttggcattgctgaagaacttggcattgctgaagaaatatcggaaattatgattggaactgaattagataacatttctgatacagaactagctagcaaaattaatcatttaaatgtattcgctagagtctctccagagcataaagtgaaaattgtaaaggcattacgcgcgaaaggaaatatcgtttctatgactggtgatggtgtcaatgatgcaccatctttaaagcaagctgatgttggcgtagcgatgggcattacaggaacagacgttgcaaaaggggcagcagatgtcgtgttaacagatgataatttctcatctattgtgaaagccgttgaagaaggtagaaatatttatcgtaacataaaaaaatcaattctcttcctactctcttgtaacttcggagaaattatcactttatttttagccattttactcggctgggcaacaccactacgacctattcacattttgtgggtaaatttaattacagataccctgcctgcattatcacttggggttgatcctgaagatcctgatgtgatgaaggaaaaaccacgacatgcgaaagaaagcttatttagtggtagcgttcctttccttattttcaatgggattgtcattgggcttttgacgctaatagcctttatcgccggagcaaagttctatactggagatacacatttattccctcttttcccagagcaaattgatgaggatgctctattacacgctcaaacgatggcatttgtcgttcttagtttttctcagctcgttcattcatttaacttgcgttcaagaacgaaatcaattttttccattgggatctttacaaataaatatttagtcttctcccttcttatcggtgttcttatgcaagtttgtatcatctccatcccgccccttgcaaatatattcggtgtacatgcattaacgatgcgagattggggatttgttctcttattaagtatcattcca

SEQ ID NO: 40319 - DNA, 864 bp, Bacillus thuringiensis
atgccacagcaaaaaaactttataacaatgcctgcgcaacatcaaaataagcagcctggtattgaatcattaatgaatcctctaccacagtttgaagatcccaattataaaggtagcgaaaagttaaaaggaaagaatgtattaattacagggggagatagcggaattggacgagcagtttccatcgcttttgcaaaagaaggagcaaatgttgcgattgcttatttagatgaggaagaagatgctaatgagacgaagcaatatgttgagaaagaaggtgtaaagtgtgtattgttgccgggtgatttaagtgatgaacagcattgtaaagatgttgttcaagagaccgtccagcagctaggtagtttacaggttttggtaaataatgtcgcgcagcaatatccgcagcaaggactagagtatattacagcagaacagctagaaaagacttttcgtattaatattttttcttattttcacgttgcgaaagcagccctttctcatttgaagaaaggggatgtcattataaatacggcatctatcgttgcatatgaaggaaatgaaacgttaattgattattccgcgacgaaaggagcaatcgtagcttttacaagatcactttctcaatcgttagtgcaaaaagggattcgggtaaatggtgttgcaccaggaccgatttggacaccgcttattccatcgagctttgatgagaagaaagtctctcagtttgggagcaatgtcccaatgcaaaggcctggtcaaccatatgagttagcgccggcatacgtatatttagcgtctggtgattcttcttatgttactggacaaatgatacatgtaaatgggggcgttattgtaaatgga

SEQ ID NO: 40320 - DNA, 1281 bp, Bacillus thuringiensis
ctgttaatgaatgagaacgaaaaatggaataagttcattgaaacaccgctgtatacgaaagtaggcaaagttcatagtgtacaagaacagtttttcgtagcaaaagggccgaaagcgaagattggtgatgtttgcttcgttggagaacataacgtcttatgtgaagtgattgccattgaaaaggaaaataatatgctacttccatttgaacagacagaaaaagtatgttatggagattcagtgacattagtttcagaagatgttgttgtaccacgtggtaatcacttgctcggaaaagtgttaagtgcaaatggtgaagtgttaaatgaggaagctgaaaacattccattacagaaaataaaactagatgcaccacctatacatgcatttgaacgtgaagagattaccgatgtatttgaaacaggaataaaatcaattgattctatgctaacaattggtatcggtcaaaagattggtatttttgctgggtcaggtgttggtaaatcaactttacttggaatgatagcaaaaaatgcaaaagctgatataaacgttattagtttagtaggggaacgtggccgggaagtaaaagactttattcgaaaagagttaggcgaggaaggtatgcgaaaaagcgtcgttgttgtagcgacgtcagatgaaagtcatcttatgcaacttcgtgcagcgaaactcgcaacgtctattgctgaatacttccgtgatcaaggtaataacgtattacttatgatggactctgttactcgttttgccgatgcacgaagaagtgttgatattgctgttaaagagttaccgattggtggtaaaacactgttaatggaaagttatatgaagaagttgttagagcggtccggaaaaacacaaaagggatctataacaggtatttatacggtgcttgttgatggggatgatttaaatggtcctgtaccagatttagcacgtggtattttagatggacatatcgtattaaagcgtgagcttgcaacgcttagtcattaccctgcaatttcagtattagattcagtaagtaggattatggaagaaattgtttcgccacatcattggcagcttgcaaatgaaatgagaaagattttatcaatttataaagaaaatgaattgtattttaagctaggaacgattcaagaaaatgaagaaaatgcttatatttttgaatgtaaaaataaagtagaaggcataaatacatttttaaagcaaggtcgatcggatagtttccaatttgatgatatcgttgaagcgata

SEQ ID NO: 40321 - DNA, 1161 bp, Bacillus thuringiensis
ttcatttgtttttgcttagctgttgttttgtttgtaccaatacatacttttgcagacgaaaaaagagagtggcgagatgaagttatatactccattatgattgatcgcttcaataatggagaaccgaaaaatgacaagcagttagaagttggtaatttagaagggtatcaaggcggggatataagaggaattataaaaaggttggattacataaaagaaatgggttttactaccgttatgctttcgccgctttttgaaagtggaaagtacgatggattagacgtgcaaaattttaaaaaggtaaatgaacatttcgggacagacaatgatgtgaaagaacttgtaaaagaagctcatgcaaaaggaatgaaagttgtatttcaatttccacttggagaaaacgaacgacaggtaattgacgcaatgaaatggtggataaaagaagttgatttagacggaagctatgttatacatagtgaaaaaaagccgcgttccttttgggataacgcgcaaaaagatatgcaagtgataaagaaagattttcgtattatgacaaaggaggatggtgaatacaacgaaaaaatagtagaatcgttttctaaagcagatgtatcggtgaaatcgttatacgatgtgagtaaaaaagaaggagaatttgttacgtttttagatgatcaagaaacaaaaagatatgcgcgtattgcaaaagaaaatatgtattatccgccatcacgtttaaaactggcgcttacttatttgttaacatcacctggaattccgaatttttattacggaactgaaattgcattagatggaggaagtgtacccgataatagacgattaatggattttaagtcagacgaaaaatttatgcagcacataacaaaactaggtgaacttaggcaggcgagaccgtctttacgacgcggtacgtttgagcttctgtatgataagagcgggatgagcatactaaaacgaaaatataaagatgaagtaactttagtagcaattaataatacgaaagaaacacaaaaagtctccttacctgcaagtgcaattggtgaaaaacaagagttaagaggattgttgcaggatgaaattataagagagggaaacggaaaattttatctcgttttaaagcgtgaagaatcaaacgtgtat

SEQ ID NO: 40322 - DNA, 2130 bp, Bacillus thuringiensis
atggacttaaatcaaatgacaacaaaaacacaagaggcgattatgagtgcccaatctttagcggtatctcatcatcaccaagaggtggatactgttcatctattacttgcattattagaagagcaagatggattagcagtacgtatatttcaaaaaatgaatgttgatatagaagcattaaagcaaggtgctgaaagtttaattaaaaagaaaccttctgtaacggggagcggtgcagaagttggaaaattgtatgtaacgagcgctctgcaacaactgcttgtaagagcagggaaagaagcagaaaaactgcaggatgattacatttcagtagaacatgtgttgcttgctttttctgaagaaaaaggcgatataaatcaattatttacaagattgcatattacgaaagataacttattacagtctttaatgacagttcgggggaatcaaagagtgacgagtcaaaatccagaagcaacttatgaagcgttagaaaaatatggtcgtgatttagtggcggaagtgagagcagggaaaatcgatcctgtaatcggccgtgatagtgaaatacgacgtgtaatccgtattctttcacgtaaaacgaaaaacaatccggttttaattggggagccaggtgttggtaaaacagcaatcgttgaagggctagcccagcgtattgtgaaaaaggatgtacctgaaggattgaaagatagaacgatttttgcgttagatatgagtgcactcgtagctggtgcgaaattccgtggtgagttcgaagagcgtctgcaagctgtattaaatgaaattaaaaagagtgaaggacgcattttattattcattgatgaacttcatacaatagttggagctggtaaaacagaaggagccatggatgcaggaaatatgttaaaaccgatgcttgcgcgtggtgaactgcattgtatcggggcgacgacgctcgatgaatatcgcaaatatattgagaaagatccagcgctagaaagacgtttccaacaagtattagcagaagaaccaactgttgaagatacaatttcaattttacgtggattaaaagaacgctttgaaatttatcacggtgtaaatattcatgaccgtgcgattgtagcagcgtcagttttatcagatcgatatatttcagatcgattcttacctgataaagcaattgaccttgttgatgaagcgtgtgcaacaattcgtacagaaatcgattctatgccaacagaattagatgaagtaacgcgccgcattatgcagctggaaattgaagaagcggctcttggaaaagaaacggatcgtggtagccaagagcgtctaaaaacattgcaacgtgaattatcggatttaaaagaagttgcaagtggtatgagagcaaagtgggagaaagaaaaagaagacattcacaaagttcgtgacttacgtgaacatttagaacgtctgcgtcgtgaattagaagaagcagaaggtaattacgatttaaataaagcagccgaacttcgtcacgggaaaattccagcaattgaaaaagagttaaaagaagcggaagaaatgggcgcgcataataaacaagaaaatcgtttattacgtgaggaagtaagtgaagaagaaattgcagatattgtttcacgctggacgggtattcctgttgcgaaactcgtggaaggtgaacgcgagaaattattacgcttagagcaaatcttatcagagcgtgtcatcggacaagaggaagcagtaagcttagtgtcagacgcagttcttcgtgctcgcgctggtattaaagatccgaaccgcccgattggttctttcatcttcttaggaccaacaggtgttggtaaaacagaacttgcaaaaacgttagcgcagtctttattcgatagtgaagagcaaatgattcgcattgacatgtctgagtatatggagaaacacgcagtgtcacgcttaattggtgcacctcctggatatgtaggatatgaggaaggtggtcaattaacagaagcggtaagacgtaaaccatattccgttgttttattagatgaaattgaaaaagcacatccagaagtattcaacattttattacaaaagatagatgatgggcgcattacagattcgcaaggt

SEQ ID NO: 40323 - DNA, 1266 bp, Bacillus thuringiensis
atgggagaatcatggggaaaaggaacaatttgtgtgcaaggtggctatacgccaaaaaatggtgaaccacgtgttttaccactttatcaaagtacaacatataaatacgatacttcagatgatttagcagccctatttaacttagaggcagaaggatatatttatacacgtattggaaaccctactctagccgcatttgagcagaagttatcagatttagaaggcggtgtaggagctgttgcaacggcttctgggcaagcagctattatgctcgcagttttaaatatttgtagtagtggggatcatttactttgttcttcaacggtttacgggggaacgtttaatttatttggagtgagtttgcgtaaactgggcattgatgttacgttctttaatccaaatttaacggcagatgaaattacggcgcttgctaatgacaagacgaaacttatctatgcagaatcgttaggaaatccagcgatgaatgttttaaattttaaagaattttcagctgctgctaaagaattagaggtaccttttatcgttgataatacattagcaactccttatttatgccaggcgtttgaacatggggcaaatattattgttcattctacgacgaagtatatcgatgggcatgcgagctccttaggcggtattgtaattgacggtggaaactttgattggacaaatggaaagtatcctgaacttgttgaaccagatccaagttatcacggtgtaagttacgttcaaaactttggtgcagcagcgtatattgtgaaagcacgtgttcagctattaagagattatggaaattgtatgagcccattcaatgcatatattagcaatattggcttagaaacattgcatttacgaatggaacgtcatagtgaaaatgctcttgcagttgctaagtggcttgctaatcatgaacgtattgaatgggtgaattatccgggcttagatagtaatgaaaattactcattggcacaacagtacttgaaaaaaggtgctagtggtgttttaactttcggtattaaaggcggattagaagcagcaaaagaatttatcgcaaatgtaaaactagcaactcttgtaacacacgtagctgatgcacgaacttgcgttatacatcctgctagtacgacgcatagacaattaaatgctgaagatcagcgtttagctggtgttacatctgatttaattcgtttatcagttggtatagaagatgtttctgatattattgcagatttggaagcagctcta

SEQ ID NO: 40324 - DNA, 1047 bp, Bacillus thuringiensis
attgaattgaaaaatgtttcaaaggtatataaaaatgcagaagagacagcggttaaaggcgtatcggttcatattaagaagggtgaattttttgttttagttggaccttcgggatgcgggaaaagcacattattacgaatgatcgctggcttagaagagatttcttcaggagatttaattattaatgaacgtgttgcaaatgatctagagccgaaagaccgtaatctatcaatggtatttcaaaattatgcattatatccacacttatctgtagaagaaaatattttatttggacttaaggtaagaaaagtacaaaaagaagagcgacaaaagcgattaatggaagccattgaaatggtaggactgaaagagtatgtgaaaatgaaaccaggccaattatcaggcggacaaagacagcgtgttgcacttgccagggcaattgtgagtcaagcaccaatctgtttaatggatgaaccactttcgaatttggatgcgaaattacgtgcgcaaatgagaattgaaattagagaaattcagcagcgattaggaattacgatgatttacgttacccacgatcaaatagaagcgatgactatgggagatcgtatcatggttttaaataaaggaagtatacagcaagttggaacaccacttgacatatataacgaaccagcaaacgaatttgttgcaagctttataggttctccttctatgaatataaatgatggggaagtaaataaagaaaaaggtgtattacatatagggcaattgcaaattccattatctattagacagttaaagcaattaccagaaggaacaattcgcataggcatgcgtcctgagcatattgcactgtctgaggagggacaagaagtgacgttgcaatctgtagaagtattagggaatgaatctatattgaactttgcggtaaatggaacaacttggagtgcgaaagtcatcggacagttactcttgaacaaaggtgacaaagtaaaattattattctcgcaagaaaagttatgcttctttaatgaaaacacgaatgaa

SEQ ID NO: 40325 - DNA, 600 bp, Bacillus thuringiensis
agtataaatttaatggacaaacagttgttactttcagctacccttggagatacagagacagctatgaagttgattcaggatggagcgaatataaacgtagaaggtgacaacggagaaacgcctgtccttgcagcgacgtaccaaaatcatgtagagacagttaaagcattaattggtgcaggtgctaatattgaaattaaagatgagaaaaaaagtaatccacttctttatgcaagtagagaaggatatacggatattgtaaaagtattaattaatgcaggagttaatacgaaagaaacgactaggtcaggtgggacagcacttatttctgcatctgagcgtggccatgtagaggttgttaaagaattattagagcatacagatattgatgtgaattatacaaatgaacgtggtggaacagcgttattagaagcaattgtattaggaaatggtagtgaaaaccataagaaagtaattcaattgcttattgatcacggtgcagatgtaaacatggctaacaaggaacatctgacgccactgcaatacgctgaaaaaagaggttttaaagatattgtaaatatgttgagggtagctggagcg

SEQ ID NO: 40326 - DNA, 1746 bp, Bacillus thuringiensis
atgaaaaagattataaacaaaccagaaacattagtaatggaaatgtgtaacggaatggttatggctcacccagagcttgaacttttgaaaaaatataaagtgattaagaagaaagaaatgaacgaaaacaaagtaacgttaattagtggcggcggtagtggccatgagccggcacatgcaggattagtcggaaaaggaatgttagatgcggcggtgtgcggagatgtttttgcttctccttcacaaattcaggtatatcaagcaattaaagaaacagctagtaaaaaaggtacgttattaattattaaaaattatagcggcgatattatgaatttcaaaaacggtgcgcatttagcgacggaagatggaattgaagtcgactacgtcaaagtggacgatgatattgcggtagaagatagtctgtatacagtaggacgccgcggcgttgcaggagttattttagttcataaaattgccggtgcagcagcggaagcaggtatggatttaggagcggtgaaaactgtcgcagaaaaagcagcggttaacgtgcgcacaattggtttagcgttaacgtcttgtacagttccagcgagcggatcacctactttcacacttgcggaagatgaaatggaatacggcgtaggtattcacggcgagccaggaattaagcgtgaaaaaatgttgtcagcagatgaactagcgaaccgtatgacaaatgaccttataaaagatttaggagtaaaagatggcgaggaaatcgcacttctagttaacggttttggcggaacaccactgcaggaactttacttatttaacaatgcagtgacgcgagaattagctgctagaaacattaaaattaatagagtattcgtcggcaactatatgacgagtatcgatatggctggtatgtctttaactgtaatgaaattagatgatgagttaaaaacattactatcaaaagaatgtaatacaccagcgtttaaagtagatggaccagttgaaagtttagagtatgtaaatgtacttgaagaaacagaagagaaggaagtttcatttgaactagaaacagcagaagaacacgctgttattaaagataatgtcattacattaaacaacatgatttatctcgttgataaaatgagcgatattatcattaaaaatgaagtaccattctgtgagttagacacgcacgctggtgacggcgatttcggaatgagtgtagcaaaaggatttaagcaattaaaacgtgagtggcattctattgtagatcaagagaacgtaacaatcggatcattccttgatggttgctccatgattattatggaacattgcggcggcgcttctggtccaatttggggcggtgcattccgcgcagctagtaaagcagcaggcgagaagcgtgagttaacagtgaaagaattcgctgaaatactgcaagcagcactgcaaggcatccaatcgatcggtgagagatcattcggcagaggagcagtagttggtgacaaaacgcttgttgacgcacttgctccatgtgtagactcttggttagatagcgcctcaaacgaagtagacgtaaaaactgcctttgaaaaaggtgcagaagcagcggttaaaggagcagagtacacgaaagaaatcgtagctcgcatgggccgcgctggtacagttggcgaaagaagtttaggataccctgatgcaggtgcacatgcgcttggagttatctttacggagattgcaggtagtttg

SEQ ID NO: 40327 - DNA, 948 bp, Bacillus thuringiensis
atgaaaaagattatgaatgatgtacaacatatcgttcaagatatgctgcatggcttttattttgaacataacgacaaagtaaattacgacgaaacaaataacatcatttatgtaaaggatatcgaaaaactaaagcaaaacgtcgcgattataagcggcggtggtagcggacatgaacccgctgatattggctatgtaggaaaaggtatgcttacagcggcagtaaacggcagcattttcactccgcctacagtggaacaaattgtagcggctactcgcctcatgccaaaagataaaagtattttattcatcattaaaaactttaaagatgacgttgagaactttctagcggctgagcagatcgctaaagaagaaggaagaaaaattgaccatatcatcgtaaatgacgacgtttcaattgaagatgatgcttcttttaataaaagaagacgcggcgttgctggtactgttttcattcaaaaaatacttggtgcgtctgctcttgaaggtcattctttagaagagctaacaacaattggccgttctgttacagaaaacttacacacattaggagttgctctttcacctgcaaacgatccagtgcaaggaaaagcttcattcacattaaatgacgatgaagtgttttacggcgtcggcattcacggagaaaaaggatatcgtaaagaagcactatcctcttctgaaatattagcaatcgaactaatgaacaaacttaaaagcatttatcgctggagaaaaggagacaactttgccatccttattaacggactcggcgcaacgccattaatggagcaatacattttcgcaaatgacattcgccgtttatgtgagctggaaggattacagattacattcgtaaaagttggtacattgctaacttctttagatatgaaaggtgtttcgctcagtttgcttaaggtagaagat

SEQ ID NO: 40328 - DNA, 1671 bp, Bacillus thuringiensis
gagaaactggcaactggtgcacagctattgttagaagcgctagaaaaggaaggcgtagaagtgattttcggatatccgggtggtgtcgatttacctgtctatgatgcattgaatgagtgtgaaattccgcatattttaacaaggcatgagcaaggggcaattcacgctgctgaagggtatgccagaattacagggcatccaggggttgtaattgcaacgagtgggccaggtgctacaaatgtaattacgggtctagctgatgcgatgattgattcattgccacttgtagtatttacaggccaagtagcaacaacgttaattgggagcgatgcttttcaagaggcagatattatgggacttacgatgccagtgacaaaacataactatcaagtgcgaaaggcctcagatttacctcgaattattaaagaagcatttcatattgctaaaactggaagaccaggaccagtcgttattgaccttccgaaagatatggtagtcgagaaaggtgagcaatgtagcaatgtacaaatggatttaccgggatataaccctaattatgaaccgaatctacttcaaataaacaaattactcaaagtaattgaaaccgcaaaaaaaccgttaattttagctggagcgggtatattgcatgcgaaagcttcgaaagaattgacaaattttgctcgtaaatatgaaatccctgttgtgcatacattacttggtcttggtggttttccaccagatgatgaactatttctagggatgggaggaatgcatggttcttatacagcaaatatagcgttatatgaatgtgacttactcattaatataggcgcgagatttgatgatcggcttacagggaatttagcttattttgctaaaggggctactgttgcgcatatcgatatcgatccagcagaaatcgggaaaaatgtgccaactgaaattcctattgttgcaagtgctaagcgggcattggaagtattacttgaaccagaagggggaaaagaaaatcatcatgaatggatcactttattaaaggggagaaaagaacaatatccattctcttataaaagaaattctgaaagtattaagccccaatacgcaattgatatgttatatgaaattacgaagggagaagcgattgtaacaacagacgttgggcaacaccaaatgtgggcagcccaatattatccgctgaaaaatccagataaatgggtaacttctggtggattaggaacgatggggtttggatttccagcagcaatcggtgcgcaaattgcaaagcctgaagaattagttattgcaattgttggtgatgctgggtttcaaatgactctacaagaattaagtgtattaaaagaacacgctttacccgttaaagtatttattttaaataatgaagctttaggaatggtaagacagtggcaagatgaattttacaatcaaagatattcacattctttattaccatgccaaccagatttcgtcgctcttgcgaatgcatatggcataaaaggtgttcgtattgacgatccacttcttgcaaagaagcaaatccagcatgctattgaattacaagagccagtcgtaattgattgtcgtgtacttcaatcagagaaggttatgccgatggttgcgccaggaaaaggtgttcaccaaatggagggagtg

SEQ ID NO: 40329 - DNA, 1035 bp, Bacillus thuringiensis
atggaaaaacgtatcgtttgtttagctggtgatggtgttggtccagaagtaatggaaagtgcgaaggaagtattgcatatggtagaaaggctatatggacatcattttcatttgcaagatgagtactttggtggtgttgctatcgatttaactgggcaaccattaccacagcgaacacttgccgcctgtttagcgagtgatgcggttttacttggagcagtaggtggaccaaggtgggatagtgcgaaagaaaggcctgagaaaggattattagcattaagaaaaggactcggtgtatttgcgaatgttcgccctgtaacggtagaaagtgcaactgcacatttatcaccattaaaaaacgctgatgaaattgatttcgttgtcgttcgtgaattaacaggtggaatttatttttcttatccgaaagagcgaacggaagaagtggcgacagatacacttacgtatcatcgccatgaaattgaacgtatcgtttcgtatgcttttcaattagcgaataagcggaagaaaaaagtaacatctattgataaagcgaatgttttagagtctagtaaattatggagaactgtgacagaagaagtagcacttcgctacccaaatgtggaagtagaacacattttagtagatgcagcagctatggaattaattcggaatccaggaagatttgacgttattgtaacggaaaatttatttggtgatattttaagtgatgaggcttcagtattagctggatcattaggaatgcttccatcagcaagtcacgctgaaaaggggccttcattatacgagcctattcacggatcagcaccggatattgcggggaaaaataaggcgaatccaattgcgatgatgcgttctgttgcaatgatgcttgggcaatcgttcggattaacgagagaaggatatgcaattgaagaagcagtttctgcagtccttaaatcaggaaaatgtacagcagatatcggggggactgaaacgacaacttcatttacaaaggcagttattcaagaaatggaa

SEQ ID NO: 40330 - DNA, 1942 bp, Bacillus thuringiensis
atggggaaaaggttactagataagctttgggaaagacatgtagttgcgactaatgaaaatggattggatttattatatatcgatctacatcttgttcatgaagtaacgtcaccgcaagcctttgaaggcttgcggcttacaaatcgaacagtccgcagaccagatttaacatttgcaacgatggatcataatattccaacgaaagatgtttggaatattaccgaccgcattgcgaagcagcaactagatacacttcgggaaaactgtaaacaatttcaggtgccattagcggatatcggagatgaagagcaagggatcgttcatgtaataggaccagaacttggactcacacagccaggaaaaacgattgtttgtggtgatagtcatacagcaacacacggtgcttttggcgcactagcgtttggtattggtacgagtgaagtggaacatgtattggcgacgcaaacgttatggcaacgaaagccgaaagcaatgggcattgagttaaaaggaaagttaccgcaaggtgtttatgcgaaagatattattttacaccttctttcaaagtacggagtagcagttggaacaggttacgtaatggaattttacggagaggccattcatgctatggatatggaagagaggatgacgctttgcaatatggcaattgaagggggagcaaaggctggcattattgcaccagatgaaaaaacggttgcttacgtaaaagggcgtaaatatgcaccgaaagactatgaatctattaagaaaaaatggtcagaactttatacagatttagatgcagtttatgatttacatattctagtagatgttacggatttagcgccgtacgttacgtggggaacaaatcctagtatgggcgttcggatcgatgagaaattgccagaaaagcatgatgcaaatgacgaaagagcgttttcttatatgggattgagtcccggacaaagtacgtatgacattccagttcaacatgttttcattggatcttgtacaaattccaggctttctgacttagaaattgctgcatctgtcgtgaaaggtaaaaaagtaaaagaaggtgtgcgagcacttgttgtacctggatctcaaagggtaagagaagcagcgatgcataaaggattacatcgcatatttgaagaagctggatttgaatggagagagcccggatgctcaatgtgtctaggtatgaatccagatcaagtgcctgaaggggaacattgtgcctctacgtcaaatcgcaattttgaaggaagacaaggaaagggagcacgaacgcatttagttagcccggcaatggcggcagcggctgcgttatatggtcattttgttgatattagaaaggagagttatgatggagccatttcgtattcataaaggtactgccgcagtactgatgaatgataacattgatacagatcaaattattccgaagcaatatttaaagagaattgaaagaactgggtttgggaagtttttatttgatgagtggcgatatgataataatcgccaagaaaaccctaatttcccgcttaatgcacaagaaagaaaaggagccagtatattaatcacaggtgataattttggatgtggctcgtcaagagaacatgctccatgggcgcttgctgattatggtttccgcgttattatcgctggaggatttgccgatatcttttatatgaattgtatgaagaatggcatgttaccgattgtaatggataaagatatgcgtgaacaacttgctaaaacagatgcgagggaacaaattacagttgatttagaaaatgaaataatgacaacgaatacgcatagattccattttacaatcgagaaaatgtggaaagagaagttattaaatggtttagatgaaattagtattacaatgcaatatgaacaagaaataaaagagtatgaaagaaaagtg

SEQ ID NO: 40331 - DNA, 1284 bp, Bacillus thuringiensis
ttaaaagctaaatatcctcacttaaaaacaattatttccgttggtggctggacttggtctaaccgcttttctgatatggccgctgatgaaaaaacaagaaaagtatttgctgaatctacagtagcttttcttcgcgcatatgggtttgatggcgtagatttagactgggaatatccgggcgttgaaacgattcctggtggtagttatcgtcctgaagataaacaaaatttcactctccttcttcaagacgtccgaaatgctttgaataaagcaggtgctgaagatggcaaacaatatttactaacaatcgcttcaggtgcaagccaacgctacgctgatcatacagaactaaagaaaatttctcaaatactcgattggattaatattatgacatatgatttccacggcggatgggaagctacttctaatcataatgcagctctatataaggatccaaatgatccagcagcaaatacgaatttttacgtagatggtgctataaatgtttatacaaatgaaggtgttccagtcgataaactagtattaggcgtacccttttacggacgtggctggaaaagttgtggcaaagaaaataacggacaatatcaaccttgcaaaccaggtagtgatgggaaacttgcttctaaaggtacttgggatgattactctaccggtgacacaggtgtctatgattacggtgatttagcagccaattacgttaataaaaatggttttgtacgctactggaatgacacagctaaagtaccttacttatataatgcaactacaggcacatttattagctacgatgacaatgaatctatgaaatacaaaacagactatataaagacgaaaggtttaagtggagcaatgttttgggaactaagcggagattgccgtacaagtccaaaatatagttgcagtggtccaaaattacttgatacgctagtaaaagaattacttggtggacctattaatcaaaaagatactgagccaccaacgaatgttaaaaacattgtagttacgaataaaaattcaaactcagttcaattaaactggactgcatctactgataacgtaggagttacggaatatgaaattactgctggagaagagaaatggagtacaacaacaaatagcattacaattaaaaacttaaaacctaatacggaatacaaattttcaataattgccaaagatgctgctggaaataaatcacaacctaccgctcttactgtcaaaacggatgaagctaatacgacacctcctgatggaaatggtact

SEQ ID NO: 40332 - DNA, 951 bp, Bacillus thuringiensis
atgtcgactcaatatctaaattctaatttgaaagtattctctttaaactctaataaggaacttgctgagcagattgcaaagcatattggagtaggactaggaaaatgttctgttgatcgttttagtgatggagaagttcaaattaacattgaagaaagtatccgtggttgcgatgtattcattattcaatctacaagcttcccagtaaacgaacatatcatggaattacttattatgatcgatgcattaaaacgtgcatctgcgaaaacaattaatattgttattccttactatggttatgcgcgtcaagaccgtaaagcgcgttctcgtgaaccaattacatcgaaacttgtagcaaacttgcttgaaacagcaggtgcaactcgtgtaatcactctagatttacatgctccacaaattcaagggttctttgatatcccaatcgaccacttaatgggtgtaccgattctttctgattactttgaaacaaaaggtcttaaagatatcgtaatcgtgtctcctgatcatggtggtgtaactcgtgcgagaaaaatggcagatcgtctaaaagcgccaatcgctattattgataagcgtcgtcctcgcccgaacgtttcagaggtaatgaacattatcggtaatattgaaggcaaaacagcgattttaattgatgacatcattgatacagctggtacaattacattagcagcaaacgctcttgttgagaacggtgcttctgaagtatatgcttgctgtacacacccagtattatctggtccagcaattgagcgtattcaaaattcaaacattaaagagttagttgtaacgaactctatcgtattaccagaagagaagaaaatcgacaaagtacatgaactttcagttgctccattaatcggagaagcaatcattcgtgtatacgaagaagaatctgtgagtgtattattcaat

SEQ ID NO: 40333 - DNA, 1296 bp, Bacillus thuringiensis
atgaaaattacgatagtaggtactggatatgttggattgattacaggagtaggattggcaaaattagggcattcagttacatgttttgatatagatgatgaaaaaattgaacggataaaacaaggggatttacctatttatgaggccagattacatgaattaataaattatgcatatgagaataatgctttaacttttacatcaaataaagaagaggcatttgatgatgtagagtttatatttattgcagttggaacaccacctttattagatgggacggcagatttaacgtatattcagagtgcttgtaacgatattggattatatgcgacgaacgatattattgttgttacgaaaagtacagttccagtaggtacaaatgatgtaatgaagggatggattgaggagaagttaaaagggaggcatacagtacatatcgtatcgaatccagagtttttgcgtgaaggttcaggtatttatgatttctttcatggagatcgtattgtaattggagcggatagtgaggaagtagcaagaagagtagagagtttgtatagtgaattatgtttagaaacgtatgttacagatattaaaagtgcggagatgattaaatacgcgtcgaatgcctttttagctacaaagattagtttcattaatgaaatttcaaatatatgtgagaaggtaggcgcgaatgtattggatgttgccaaagggatgggaatggataagagaatcggtgcatcttttttaaatgcgggcattggctacggagggtcgtgttttccgaaagatacgaaagcactggtacaaattgcgggaaatgttgctcatgattttcgtttgttaaaagcagttattgaagtaaataataagcaacagctgctattgattgaaaaagcgaaaaaagttatgaacatgaataaaaagcggattgcagttcttggcgcatcctttaaaccgaatacggatgatattagagaggcatcatctcttattataatagaagcattaattaatataggtgcagatattgttctttatgacccaaaagcaattcaatatgtaaagaatatatttggagatgctatacaatatagtagatgtatagatgaatcgattagagatgcgagtgcggtttttatcgtaacagaatggggagatattcaaacgtatccgttagaaaagtacgtacaacttatgagggagcctattttatttgatgggagaaattgttatactgatgaagatgttaagaaacaaaagatagattattactcggtgggaagaaaaagtatt

SEQ ID NO: 40334 - DNA, 1581 bp, Bacillus thuringiensis
tattttatgaagagagaagaattgttggcgccaccgtcttataatttagtttctgaaatagagaaatatacgggtgataaagggaaattagctttaatttggcaagatgataaagggaatcgaagggaagttacatacgctgaattaatgcaaggtgcgaataaaattggaaacgcttttataaaaagtggtttgcaaaaaggggacaagcttctcattatgatgccgcgtttaattgaagcgtacatgacgtatattgctgctattaaagcaggatttgtcgtaattccaagctcggaaatgttacgtaaaaaagatatagaatatcgaattggacatggagaagtaaaagcgatagtaagctatgagccgtatattaggcagtttgatgatatagaagcgatggaatctcttcggaaatttgtcctgagcgagcagtcagtagatggatggattaatttaaaaacagcgttagaaacagagagtgacatgttagaaatggcgaagacagataaagaagatatggtctttttatcttacacgtcaggaacgacaggaaatccaaaaggtgtcgttcatacacatgcttgggcatacgctcatttacgtacgagcgctccaaattggctcggaattgaagagaatgatattgtatgggcaacagctagtccaggctggcaaaagtggatttggagcccgtttttagcaacgctaggatcaggggcaacagggtttgtatatcacggtaagtttgaaccggaaacgtacctaaacttattagacgataataaggtgaatgtactttgttgtacaccgactgagtatagattaatggcaaaggtagaagatttaagtcagtacaatttagaggcattacatagcgctgtatcagcaggtgagccgttaaatagagaagtcattggaacgttccaaaagcactttcatattacagtgagagacggctatgggcaaacggaaaatacattacttgttggtgtaatgaaagggatggatattagaccaggttcaatggggaaaccaacgccaggtaaccacgtcgatatcgtaaatgaggaaggtactccagttaaagtaggcgaagttggtgatattgcagttcacattgaaacgccggccctctttaaacaatattacaaagacgatgaacgtacagcgatgcaattccgcggtgattattatattacaggtgataaagcgaagaaagatgaagacggctacttctggtttgaagggcgcggtgatgatatcattattagctctggttatacaatcgggccgtttgaagtagaggatgcacttgtaaaacatccttacgtaagagaatgtgcagttgtcgcaagtcctgatgaaattcgtggaagtgtcgtgaaggcatttatcgtattaagagagaatatagaaaagaacgaagaaacattaattccaacactccaacaacacgtcaaagaactcactgcaccatataaataccctcgcaaaattgaatttgtagatgaactaccaaaaacgatttctggaaaaattcgccgtattgaacttagaaaacaagagatggagatt

SEQ ID NO: 40335 - DNA, 564 bp, Bacillus thuringiensis
ttttatgaaggcgatacgttagaagtcgcaaaaaaattactcggacaaaaacttgttcatattgtagacggaataaagcgaagcggaatcattgtagaagtagaagcatataaaggccccgatgataaggccgcacatagttacggaggcagacgaacggaccgcacagaagttatgtttggtgcaccagggcatgcttacgtatatttaatttacggtatgtatcattgctttaacgttattacagcaccagcgggcaccccgcaaggtgttctcattcgagcccttgagccggtagatggaatagaagaaataaaactagcgcgctacaataagaccgaaattacaaaagcgcagtacaaaaatttaacgaacggtcctggcaaactatgccgtgccctcggaattactttagaagaacgcggtgtatcgttacaaagtgatacgttacatattgaattagttccaaaagaagaacacatatcatcacaatataaaataacagcaggacctcgtattaatatcgactatgcagaagaagctgtacattatccgtggcgtttt

SEQ ID NO: 40336 - DNA, 1164 bp, Bacillus thuringiensis
tttttagaagaaaatttagaggatttaaaatcaaaggggctttataacgtaattgatccgcttgagagttcaaatggaccgatcattacaattggcggaaaagaatatattaacttatcttcaaacaactatcttggattagcaacagatagccgtttgcaagaagcagcaattggtgctattcataagtacggtgttggagcaggggctgttcgtacaattaacggtactttagatttgcatattaagttagaagaaacaattgcaaagtttaaacatacagaagcagcaattgcttatcaatcaggatttaactgtaatatggcagcgatttcagctgttatggataaaaatgatgcaattctttcagacgaattaaaccatgcttctattattgatggtagtcgtctatcaaaagcaaaaattattgtttataaacattcggatatggaagatttacgccaaaaagcaattgcggcgaaagaatcaggtctttacaataaattaatggtaattacagacggtgtcttttcaatggatggagatgttgcaaaactaccagaaattgttgagattgcagaagagttagatttaatgacatacgtagatgatgcacacggttcaggtgtacttggaaaaggtgcaggaactgtaaagcacttcggtctttctgataaagttgatttccaaattggtacattatcaaaagcaattggggtaattggtggatatgtagcagggaaacaaaacttaattgactggttaaaagttcgttcacgtccattcttattctctacagcattaacaccagctgatgcagcagcttgcatgagatcaattgaaatcttaatggaaagcacagagttacacgatcgcttatgggaaaatggccgctacttgaaacaaggattaaaagaacttggctttaacattggagaaagtgaaacgccaattacaccttgtatcattggggacgaagtattaacacaagaatttagtaaacgtctaaatgaagaaggggtatacgcaaaatctatcgtgttcccaactgtagcaaaaggaacagggcgcgttcgtaatatgcctacagcagctcatacgaaagaaatgttagatgaagcaattcttaagtatgaaaaagtaggaaaagaaatgggcatcatt

SEQ ID NO: 40337 - DNA, 2130 bp, Bacillus thuringiensis
atgttgaaagtaaaacgtccatttgatgcctatttagatgaaatgaataaaattacaattttgctcccacatgcgtatggaacaagtcggacatttcgtttgcaagaaggaagtaatgtgaaagatttaccgattgctcatactattgcgcttccagatgcaacgaagtatgagtgctttatagaagagccgctagatgtggggaagtattatacagtacgagatgaacggaatgaagaaactgatttacaaataggtgctgttattcgaacaaaaattttcgatgaaaagtattattacgaaggtacagatttaggtgctgtgtatcaaaaacaagaaacgacatttaaagtatgggccccaactgcaaggcttgcgaaagtaagaatttataagagtgataaagaatataccgatcatgaaatgtacaggggagaaaacggagtttggattcaaacattacaaggtgatttagacggagcacgctatacatttcttgtttgtattaatttaatatggaacgaagcggtggatccttacgcaaagtcagtgactgtaaatggaaagtatggcattgttatcgatttagaaaagacgactgtaacgaaacgagagcaattaccaccattacaagcaatgacagatgccatattgtatgaattgcatattcgtgatgctactattcatccgaacagtggagtgagtaaaaaagggacgtataaagggctaatggaagaaggaacaacaggacgaaatgggacattgacaggtttgtctcatataaaagatttaggcgttacgcatgttgaattattacctttatattgtttcggtggtgtagatgaggcgaatccttcgtccgcctataattggggatataatccattatattacaatgcaccaacaggattttatgctacaaacccctctgatccgtataacaggatagttgagtgcaaacaactaattgaaacatttcatgaacaaggtattagggtgattatagatgttgtatataatcatgtttatgaaagagagctatcatcatttgagaagcttgttccaggatattattttcgtcatggtgaagatggtatgccttctaatgggacgggagtcggaaatgatgtagcgtctgaacggaaaatgatgaggaaattcattgtagagtctattttatattggcttactgaatacaatgtcgatggattccgattcgacttaatgggaattttagatgttgatacaatgaatatgatagagaaagaagtgcgaaacataaaacgagatgctttgttattaggagaaggatgggatttacaaacaccgcttcctcttgaggaaaaagcaacgttaaataatgcgaagaaaatgccacatatcgcgcagtttaatgatcaatttcgtgatgggataaaagggagtacatttcatataaataagcgtggttttgcatttggtgggcatgtagactgtaatcatttgcagtatattgcagcaggaagtcttttaagtatgaaagaaacagggctgtttttagagccggcgcaaagcattaactatgtagaatgtcatgataatatgacgatgtgggataaactagtgcgcagtaatgaagaatcagaaacgattttgaaaaaacgtcacctattagcgagcgcaatggttattctttcacaaggcattcctttcttacacgcagggcaagagttttatcgtacgaagaaaggaaatgaaaatagttataatgcaaatgatgagatcaatcaattagattgggatcaaaaagagaaagagatagagaccgttaactatataaaaggtttaattgcgattcgtaaagagcatggggcattccgattacaaaatgcagaccttataaaaaaacatatgacttttttacaaacatctacagaagtacttgcatatcacctagagcatgcagaatcgtttgggccgtggaaagagattatcgtcttatttaatagcggtttagaagctaaaactgtgcaacttccgaaagaagcaacgtggcatgtgttagtaaacgaaaacgaagcgaaaatagagccaatttcttcatttagaggaaaggaacttaggctcgctccaattagcacgtatatattg

SEQ ID NO: 40338 - DNA, 1410 bp, Bacillus thuringiensis
atgttagaaaaacaaattattcattcattcgtatctattgttggcgaagataatgtagatacatccaatatggggcgtttaacttatagttatgatgccactccaaacttccaagcaatgcctgatgcagtcattgctcctcgtaatacaaatgaagtagctgaagtgttaaaagtatgtaacacttacaaaatccctgtgtatgtgcgcgggtctggaacaaatctttgcgcaggaacatgtccacttgaaggcggtatcgtccttattttccgccatatgaacaatattttagaaattgatgaagaaaacttaacaattactgtacaagctggtgtcattacacttgatattattaaagcggtagaagaaaaaggtttattttatccaccagatccaagctcgatgaaaatttctacaatcggcggtaatattaatgaaaactcaggtggattacgcggtttgaaatatggcgtaacacgtgattatgtaatggggcttgaacttgtcttaccaaatggtgatattattcgcactggtggtaaattagcaaaagatgtagctggttacgatttaactcgtttatttatcggttctgaaggaacactcggcgtcgtaacagaagccatattaaaacttgttcctatgcctgaaacaaagaaaacaatgcttgcattatatgaagatattaatgaagctgcacgtgctgtttcttctattattgcaaataaaatcattccagcaacactggagtttttagaccaaccgacaattgaagtagtagaagagtttgcacaaatcggtttacctacagatgtaaaagcaattttattaatcgaacaagacggtccgcccgaagtagtcaatcgagatattgaaaaaatggctaacgtttgtcactctatgaatgcggttgatgttcgtgttgcaaaagatgaaacagaagcagatgcgcttcgtaccgctcgtcgtagtgccctatcagcgcttgcaagattaaaacctactacaatattagaagatgcaactgtaccacgttcacaaatagctccaatggttgaagctattaataccattgcaaaaaaatataatattcctatttgtacgtttgggcacgctggtgatggtaacttacatccaacttgtatgacagacgttcgtaatgcagaagaaatgcaccgagctgaacaagcttttgctgaaatatttgcgaaagcaattgaacttggtggcacaattactggtgaacatggtgttggtgcgatgaaagctccatatttagaaatgaaattaggtaaggaaggtattgcagctatgcaaggaataaagcaagctttcgatccaaataacattatgaatcctggaaaaatgttcgcgaaagacactcgaaaaagagtggtggttgagcga

SEQ ID NO: 40339 - DNA, 2079 bp, Bacillus thuringiensis
atttcgaattccattacaaaaacgattaaaaatgtaattcaagctattaaatccatttcttctaaagaaaaaatcacggaaagaattcatgtaaacacacgtgatgaaataaaagatcttgctcatacaacgaatcacttactagacgaaatatcgaaaagagaatggttacaaactgagcttgcagaattaattttaatgtatcaaggtgtatcttctattgagatgttaggtaaaaaaattcttagtggaattatacaaaaaacgcaaacttcttgcggagcattttatgtacgtgaagaaattgaagacactgtctactatgtgaagaaagcttctttcgccgatcaaggtgctgatattgggaaacaatccattcaaatgggtgaaggttttattggacagtctgccttagaaaagaaaagttttattctcagggatatacccgaagagtttcgttatgtcactagcggagtattagaaatacgtcctaaaaatctattaatcatccctatcttatttgaggataaagtgatcgcagtaatggagttagtaagtgtaactgagatttcagatttacatcaagatttaattcaacaaaccgttgataatctaggtttaacaatccatagcattatgggacgtatgcgaattcaaactcttttacatgaatcacaagcaatgacagaagagttacaagttcaatcagaagaattgcaaacgcaagcggaagaactacaaatgcaagcagaagaattacgaacaacgaatgaacaattagagtctagaactgaagaggctgagcagaaaacagctgacttacaaattactaaatcagaattagaagaaaaagcaagcgagttgttacgcagctcaaaatacaaatctgagttcctagcaaatatgtcacatgaattacgcacaccgttaaatagtattttactattatctgaaatgttaagagaaaatcataataacaatttatccgacgatgagattgaattagcaactgtcattcattcatcagggaaagacttacttactttaattaatgacatactcgatttatctaaagtagaagcaggcaaactagacatcatttttgaagcaacgaacataagtgacatggcagccaatatgcatcaaaactttttacatatagctgcacaaaaaaatgtcgaatttactattgaagacagtgatacgattcctgatctgttttatacagatgcaaaacggattgagcaaattattaaaaacttattatccaatgcatttaaatttacagaaaaaggatccgtttctttacatttcgattcgatagaaacaagtaatttaagtcatgatatgcagtctataagtaaagattggattacaatttcagtaaaagatactggtattggtatcgctaaagaacagcatcaacttattttcgaagcctttcaacaggcagatggcgcaacgattcggaagtatggtggtacaggattaggtttatctatttgtaaagagtttgctagattgttaggtggttggattacgttagagagtaatgtaggagaaggtagtactttcacggtatatattcctaaccttccaaatggattaccagatatacagttatccaatttagaagtcgcagcaacgatagaagatgttattcctgctgaagttgttgaagaaactatcgttactcccgaaacaaataacgtcttccaagagaaaaccattttaattgtcgatgatgatcatcgaaatatatttgcgttacaaaacgcattaaaaaaacaaaatgccaacattattactgcccaaaacggcttagagtgtttagaaatactaaaaagtaatacaaatattgaccttattttaatggatattatgatgcctaatatggacggttatgaaacgatggaaaatatccgaatgaacttagggttaaatgaaatacctattatcgcattaactgctaaagcaatgccaaatgataaggaaaaatgtttatctgctggcgcttcagattatataagtaaaccattaaatctacatcaactctattcggtaatgagtgtatggtta

SEQ ID NO: 40340 - DNA, 744 bp, Bacillus thuringiensis
atgaaagccgtatttctatcggataaaggaaaagttcgtcaacataatgaagatagtgcaggagtttttcacaatttagatggaaatgtattagcggtagtagcagatggaatgggaggtcatcgagctggtgatgtagctagctcgatggccattcaattattccatgattattggaagcaaacacataatatgaatgagccgaaaaaagtagaacaatggttacatactagtgttgggattattaatgagcgtatatatgaatacgctcagcaaaatgcagaatgtaatggtatgggaacaacgcttataatagctgtttgtacaccaagctttgtgacaatagggcatataggagatagtcgttgctatatggtatcagaaggagaaatgacgctagtaacggaagatcattcacttgtaaatgagcttgtgaaacatggtgaaatttcaaaggaagacgcagagtatcatccgaaaaagaatgtgttattaagagcattaggaacagaagaaaaagttgggttagatgttaaaacgttggtgattgaggaagatgatcaattacttctttgctctgatgggttatcaaacaaagtttctattgatgatatgcgacaaattttacagttaaatgaacagcttgaaggtaaagggcagtgtctcattcaattggcaaatgatcgcggtggagaagataatatcacacttgttcttattgattatgcgggttcgacaaacgaa

SEQ ID NO: 40341 - DNA, 2152 bp, Bacillus thuringiensis
tcaagtttataaattgaagagtctgccttgacagggaagtccgtacctgtcaaaaaaaggtaaaagcattcaagggcaagatgttgcaattggggatcaaaaaaatatggcttttatggggacaatgattacgcgaggatctggtacagaagttgttgtagcaactggtatgaatacagcgatggggcaaattgcaaatatgttgcaaaatgcagagcaaatggaaacgccactgcaaagaaggttagaacagctcggaaaaatattaattattgtagctcttattttgacagcgctcgttgtattggctggtgtgtatcaagggaatgaagtatatcatatgtttttagctggcgtatcgctagctgttgcggctattccagaaggattgccagcaattgttacagtagctttatcacttggtgtacagcgtatgataaaaaagagagcaattgtaaggaagttaccggccgtagaaacgttaggctgcgcttctgttatatgctctgataaaacgggatcaatgacgcaaaacaaaatgatggtaacacatatgtggtcaggcggagaattgtggaaagtgacagggcaaggatatgaacctaatggctcttttatgaaaggtgaaaaagaagtgaatccagctaagacaaaatcactttatcagctacttacatttggttcactatgtaacaatgcaaatattattcaaaagaaaaaggcgtacgtattagatggagatccgacagagggagcgcttgtagctgcagcaatgaaagctgggataacacgtgaggcattaaaagggaaatttaaaattattcgtgaattcccctttgattcaactcgaaaaatgatgagtgttattgtacgagatcgagaggggaaaaagtttattgttacgaaaggagcaccggatgttcttttgcaactgagtcaaacaatcttatggggggataagcagcagccgttaagtgagctatatagaaaagaagtacaggcggctattcatagcttaggtagtcaagcgcttcgaacaattgcagttgcgtttaaacctttaaaagtcacggattctattgaacatgaaagagacgttgaaaaagattttatgttggttggaatacaaggtatgattgacccgccaaggccagaagtggcgcaggcggtaaaagagtgtaaagaagctggtattcgaacagtaatgattacaggtgatcataaagtgacagcaatggcgattgctgaacaattaggagttttaccaccagatggacgcgttgttgaaggagtagaactcgcgaatatggatgtggaggaattagaaaatgttgtagaagatacgtatgtattcgctcgtgtatcacctgagcataaattgaaaattgttaaggcactgcaaaatcaaggacatatagtagcgatgacaggtgatggagtgaacgatgctccagcgataaaaacagcggatattgggatagcgatgggaattacagggacagatgttgcgaaagaagcctcttcacttgttttactagacgataattttgctacaattaaatcagcaattaaagaaggaagaaatatatatgagaacatacgtaagttcattcgctacttattggcgtcaaatgttggagaaattttagttatgttatttgcgatgttacttgcattaccactgccgatggttcctattcaaattttatgggtgaacttagttactgatggtttaccagcgatggcattaggtttggataaggctgaaggagatgtgatgaagagaacaccgcgtcacccgaaagaaggggtattcgctagagggcttgcgtggaaaataataagtcgagggtttttaattggagcagtgacgttagtggcgtttattattgcgtataaccaacatccaaatgaactgaaatatgcacaaactgtagcgttcgcgacgttggtacttgctcagcttattcatgtatttgattgtcgtagtgagcattctgtctttcaccgtaatccatttgggaacgtgtatttagtaggggcggttattatttcgttactactcatgctagtggttatatattatccaccgttacaaccaatctttagcacaatgccgatacaagcaagagattggttattaattggaggt

SEQ ID NO: 40342 - DNA, 932 bp, Bacillus thuringiensis
ttagaaattaaaaatttaacgaaaaaatttggtgatttcatcgcagttgataatatgtctttatctattaaagaaggagaaatatttggctttttaggatcgaatggtgctggtaagagtacaacgattaatatgattgctggtttgttaagaagtaatgaaggcgaaattagcatactaggaaaaaatataaagaaacataaccgatttgcgaagatgaatatcggtatcgttccgcaagatattgcgatttatgaagagttaactgcctatgaaaatgtgaaattctttgctgggttgtacggattaagaggagttgagctaaaagcgagagtggaggaagcactgcaatttgtggggcttagcgataaacataaaagttatccgaaaaacttttctggcgggatgaaacgaagattgaatattgcttgtgcaattgcacatagaccgaagttaattattatggatgaaccgacagttggaattgatccgcagtcaagaaactatattcttcagtctgtccggaagttaaatgaaatgggaagcactattatttacacgagccactacatggaagaagtagaagagatttgtacgaaaatcgcaattgtcgaccatggtaaagtgattgcagaaggtacgaaagaacagttaaaagcgattattacagatacgaaagatatttggattaaagaaaagtcagtagaaaatttagatgcagaaaagttaaaagagataaacggtgtgaaagctgttcaaattgaagagaaacgtaatcaaggtaaactcggatgccggattaaataatttaaatcaaataatgccgcatttcattaatcatgacattggaattcgttcgttagagggagtaggctcccaacttagaaacagtatatctttcggtaaccggaagaaacttacctgatatataa

SEQ ID NO: 40343 - DNA, 1305 bp, Bacillus thuringiensis
gtgcatattattgctgttagtgtaaattatagaccagcccctgtagaatttcgtgagaaactcacatttcaggcagcagaactagagcgagcgatgactacattacaaaatcaaaagagcgtgttagagaatgtcattgtatcaacttgtaatcgcactgagatttatgctgttgtcgatcaattacacacgggacggtattatattaagaagtttttagctgattggtttcagcttgaaatagaagaagtcgcgccatatttaactatttttgaacaagatggtgcaatagatcatttattccgcgtaacgtgcggtttagattctatggtagtcggagaaacgcagattttaggtcaaataaaagatagctttttagaagcgcaacaagttaaagcaacaggcacaatttttaatgaattgtttaagcaagtcattacattagcaaaacgtgcccactcagaaacaacaatcggggaaagtgcgatgtctgttagttatgctgctgttgagcttggaaagaaaatatttggcgagttaacagattgtcatgtgcttattcttggtgctggtaaaatgggcgaacttgcactgcaaaacttatatggaagtggtgctcgtaaagtaacagttatgaataggacgctttcgaaagcagaagtaatggctgagaaatatatgggacatgcaaaatcgttaagcgaattacaatgtgcattattagaagcagatattttaattagttcaactggtgcatcggagtatgtcattacgaaagagatgatgacgaaggtagagaaaatgcgctctggtcgccctttgtttatggttgacattgcagtgccacgtgatattgatccagcgattgatgagctagaaggttctttcttgtatgatattgatgatttacaaggagtagtggaggcaaaccgtgctgagcgtttgaaagaagcagagaaaattcaatttatgattgaagaggaaattgttctatttaaaacgtggttaagtacacttggtgttgttccattaatatcagctcttcgtgataaggcacttgcaatccaaagtgaaacgatggtaagcctagagcgaaaaataccaaaccttagtgatcgtgagaaaaaagtcattagtaagcatacgaaaagtattattaatcaattattaaaagacccaattttagtagcgaaagaaatagctgctgaagagggagcgagcgaaaaattagcgttatttgcgaagattttcgatttagaaacggaagacgtagagagttgtgcggaagaagtagaacataaaaaa

SEQ ID NO: 40344 - DNA, 924 bp, Bacillus thuringiensis
attatgcgcaaaattattgtaggatcacgaaagagtaaactagcattaacgcaaacaaactggtttattgatcagttaaaagccctaggtctaccatatgaatttgaagtgaaagaaattgtcacaaaaggtgatgttattttagatgttactctttcaaaagtaggcggcaaaggcttgtttgtaaaagagattgaacatgcgctacttacgaaagaaatcgatatggctgtacatagtatgaaagatatgccagccgtacttccagaaggtttaatgattggctgtacaccaaagcgtgttgaccctcgtgatgcttttatctcaaaaaatggagcatcgtttaaagagttagcggaaggtgctattttaggtacgagtagtttaagacgtagtgcacagctactcgctgcgagaccagatttacaagttaagtggattcgcgggaatatcgatacacgtttacgtaaattaaaagaagaagattacgatgcgattattttagcgacagctggattacaaagaatgggctgggatgatgaagttattacagaacatttagatgaagcgttatgtgtacctgctgtaggacaaggtgcattagcgattgagtgtcgtgaggatgataaggatttattacaattgttagcgcatattaatgatacgataacagaaagaacagtggcagcggagcgagtatttcttcataaacttgaaggtggatgccaagttccaattgctggatatgcaacccttacagaaaacgatgcaatcgaattaacagctcttgtcggctctatggatggctctgttttattaaaagagacagtagtgggtactaatcctgaggaagtaggattagaggccgcggaccgtttaattaagcaaggcgccaaagaactcattcttgctgcaaataaggag

SEQ ID NO: 40345 - DNA, 969 bp, Bacillus thuringiensis
tctttacaatttaatcgtcatcgtcgtttaagacaaagcgggggcatgcgtgcgcttgtgcgtgaaacgtttttacatacggaagattttatttaccctatttttgtattagaaggtgaaaatgttcgtaatgaagttccttctatgccaggcgtatatcaaatgtctttagatttattgcaagctgaaatgcaagaagttgttgatttaggtattcgttctgttattgtatttggtttacctgctgaaaaagatgaagttggatcatcagcatattgtgatcatggaattgtacaacgtgctattcagcaaattaaaggtgatttccctgagctagtagtagttgcagacacatgtttatgtcaatttacaagccatggtcattgcggtgtaattgaagatggtattattttaaatgacgagtctcttgcagttcttgcgaaaacagctgtaagtcaagcgaaagcaggagcggacattattgcgccatcaaacatgatggacggcttcgtaacagcaattcgccatgcattagacgaaaatggttttggacacgtgccagttatgtcgtacgctgtgaaatattcatcagcattttatggaccattccgcgatgctgcgcacggtgcaccgcaatttggtgaccgtaaaacatatcaaatggatccggcaaaccgtatggaagcattccgtgaagcagaatcagatgtaatggaaggtgcagacttcttaatcgtaaaaccagcgctttcttacttagatatcgttcgtgatgtgaaaaataactttaatttaccagttgtcgcttataatgtaagtggtgaatattcgatgattaaagcggcagcgcaaaatggttggattaatgaaaaagaagttgttcttgaaaaattaattagtatgaaacgtgcaggagcagatttaattattacgtatcatgcaaaagatgcagcaagatggttacaagaa

SEQ ID NO: 40346 - DNA, 1275 bp, Bacillus thuringiensis
aagtttgataagtcaattgcagcgtttgaagaggcgcaagacttaatgcctggtggcgtaaatagcccggttcgtgcctttaagtctgttgggatgaatccgttgtttatggagcgtggaaaaggctctaaagtatatgatatcgatgggaatgaatacatcgactacgtattatcatggggtcctttaattcatggtcatgcaaatgatcgtgttgtagaagcgttaaaatctgttgctgaaagaggtacaagcttcggtgcaccaacagaaattgaaaataaattagcaaaacttgttattgagcgcgtgccatcaattgagattgtgcgtatggttaactctggaacggaagcaacaatgagtgcactacgtttagctcgtggttatacaggtcgtaataaaatcttgaaatttatcggttgttaccacggtcatggtgattcgttattaattaaagctggttctggtgtggcgactttaggtttaccagatagtcctggtgtaccagaaggtgtagcgaaaaatacgattacagtagcttataacgatttagaaagtgtaaaatacgcgtttgaacaattcggtgatgatattgcttgtgtaattgtagaaccagtagcaggaaatatgggggttgttcctccgcagcctggatttttagaaggtcttcgtgaagtaacagaacaaaacggtgcattgcttatttttgatgaagtaatgacagggttccgagtagcttataattgtggccaaggttattatggcgtaacgcctgatttaacatgcttaggtaaagtaatcggtggtggtttaccagtaggagcatacggtggtaaagcggaaattatgcgccaagttgcgccaagcggaccgatttaccaagctggtactttatcaggtaacccacttgcaatggcggcaggttatgaaacgttagtacagttaacgccagaatcatatgtagaatttgagcgtaaagctgaaatgttagaagctggattacgtaaagcagctgaaaaacatggcattcctcaccatattaaccgtgcaggctctatgattggtattttctttacagatgaacccgttattaattacgatgcagcaaaatcttcaaacttagaattctttgcggcttactatcgtgaaatggtagaacaaggtgtattcttaccgccatctcaattcgaaggtttattcttatcgacagcacatagtgatgcagatattgaagcgacgattgcagcagctgaaattgcaatgtcaaaatta

SEQ ID NO: 40347 - DNA, 1278 bp, Bacillus thuringiensis
tacgaagaagcgatagggtggatccatagccgattgaaatttggaattaaaccaggattagaaagaatgagatggatgttagaagaacttggaaatccagagcgtcatataaaatgtgttcatcttgctggtacaaatggaaaaggttcaacgttaacatatatgcgttacatgttagaaggcgcgaaatataaggtaggaacgtttacctctccttacatcgaatcatttaatgaacgcattagtgtgaatggaacaccaattgcagacgaagagattactgaacttgtaaagatggtaaaaccagtcgttgaaaaactagatgaaacggatttaggggaagcgacagagtttgaaattattactgttatggcgatttgctatttcggtaaagtcaatttctgtgatgttgttttatttgaaacagggcttggtggacgttttgactctaccaatgttatacaccctgtcctcacgattattacgaatatcggtcacgatcatatgcatattttaggaaatacactaggggaaattgcatatgaaaaggcggggattattaagtctggcgtgccggtaattactggtgtacaagatgaagaagctttgcaagtcattcaaaatgttgcaaaggaaaaccatgcaaacttatacgaacttagcaagcattttacagcgttacataaacagtctaatgaagatggggaacagtttgattttacttgtcctttttccgcatttgaagatttgcaaatctcaatgaaaggcattcatcaagtaggaaatgcagcgttagcacttatggcagtaatgtatgtaaaaacatatttatcatttttaattgaagaagaggaaataagaacgggattactggaagcatattggattgggcgctttgaaaagttgcaaagtaacccggatattattatagatggtgctcataatccagaaggtatcgaaagccttgtgaaaacagtagaagcgcattacaaagataaaaatgtaatagtgttatttactgctcttggtgataaacaattacataacatggtaggccaattagaaaccattgcagatgaaattatttttacaacattcgcctttgatcgtgctatttctgctgataagcttgcatcatattcacagaaagaatcaaaattagtttttgaaaattggaaagaggcaattgatacaaaagttgaaatgatagcagaaaatgatgtttttatcataacgggttctctttatttcatttctgaagtacgaaaatatattcgc

SEQ ID NO: 40348 - DNA, 1428 bp, Bacillus thuringiensis
tttcgagaattaggattaagtgattctttactgcaatctgttgaaagtatgggctttgaagaggctacaccaattcaagctgaaacaattccacatgcattgcaaggtaaagatattattgggcaagcgcaaacaggtacagggaaaacagcagcattcggattaccactattagataaagtggatacacataaagaatcggttcaaggtattgttatcgcgccaacgcgtgaattagcaattcaagttggagaagaattatacaaaattggtaagcataaacgtgttcgcattttaccaatttatggtggtcaagatattaaccgccaaattcgtgctctaaaaaaacacccacacattattgttggtacgccgggtcgtattttagatcatattaaccgtaaaacacttcgcctgcaaaacgtagagacagttgttcttgacgaagcggatgaaatgttaaacatgggcttcattgaagacattgaagcaattttaacagatgtgccagaaacacatcaaacattactattctcagcgacaatgccggatccaatccgccgtattgctgagcgtttcatgactgagcctcaacacattaaagtaaaagcaaaagaagtaacaatgccaaacattcagcagttctatttagaagtgcaagaaaagaaaaagtttgacgtgttaacacgcttattagatattcaatctccagagcttgcaatcgtattcggtcgtacaaagcgtcgtgttgatgaattatcagaagcattaaacttacgtggttatgctgcagaaggtattcacggtgatttaactcaggcgaaacgtatgtctgtattacgtaaatttaaagaaggttctattgaagttcttgttgcaacagacgttgctgcacgtggtcttgatatttcaggcgtaacgcacgtatataacttcgatattccacaagatccagaatcatacgttcaccgtatcggtcgtactggtcgtgcaggtaaaaaaggtattgcaatgctatttgtaacaccacgtgaatcaggacaattaaaaaatatcgagcgtacaacaaaacgtaaaatggaccgtatggatgcaccgacacttgacgaggcattagaaggtcaacaacgtttaatcgctgaaaagcttcaaagcacaattgaaaatgaaaacttagcatactacaagcgtattgcagaagaaatgttagaagaaaatgactctgtaacagtagtagctgctgctttaaaaatgatgactaaagagccggatacaactccgatcgctttaacatcagaaccacctgttgtttcaagaggcggcggttctaaaaaacgcggcggtaacggaggcggataccgtgatggtaaccgtaatcgtagtcgtgatgcacgcggcggtggcgatggacgtaatcgtgaccgtaac

SEQ ID NO: 40349 - DNA, 603 bp, Bacillus thuringiensis
attatatttgatattgacggaacaatgttagatacggaaaaagcagttttatattcattacagagaacgttgcgagatgaagggatgaattattcattagaaaagctacattttgcattaggtattcctggtatggctgcgttacaagaaattggtgtggaaaatatgaaagcagttcatgagaaatggatacgtaatatggcagattttaagaatgaaattacagtatttaaaggaattgcggaagtgattgaaatagtatcttcatataagattcgaacaggtattgttacttcaaaaacacgccaagagtttatcaatgatttcaagccatttggattacattcatattttgaacactctatttgtgtagaagatacaataaaacataaaccacatccagagccacttgtgacatgtctaaaaagattgaatatagatgcacaagaagcgatatacataggtgattcagtatatgacttacaatgcgcaaaacaagcgggagcaaaatttggtttagccctgtggggagcgaaaacaaggaaaggattcgaggtggctgattatatttttcaaacgcctcatgaaattttaagtttagta

SEQ ID NO: 40350 - DNA, 762 bp, Bacillus thuringiensis
cgagttgtctttttaacaggtgctgcaagtggtattggttatgaaatgggaaaggcttttgcaaaagaaggtgcaaaagttgtgattaccgatcgacttgaagaacgtgcaaaagaagctgctgaacaattacaaaatgaaggttttcaagctatcggtttaaaatgtgacgttacatctgaagaggaaattacagcagcaatttctcaaacagttgatcatttcggttcattacatatattaattaacaacgcaggaatgcaacacgtttcacccattgaagactttccaactgaaaagttcgagctactaattcaaattatgcaaattgctccgtttatcgcaattaagcatgcctttccgattatgaaacaacaaaaatatggtcgtattattaatgtcgcttctattaacggccttgtcggatttgctggaaaagctgcctacaatagtgcaaaacatggcgtaattggattaacaaaagttgctgctttagaaggtgctacgcatggtattactgttaatgccctttgccctggttatgtcgatacccctcttgtacgtaatcaactacaagacttagctactacacgaaatgtaccacttgaaaatgttttagaagatgttatttatccactcgtcccacaaaagcgcttattacaagtacaagaaatcgctgattatgcgatgtttttagcgagtgaaaaagctaaaggtataacgggacaagctgttgttgtagatggtggttataccgctcaa

SEQ ID NO: 40351 - DNA, 1419 bp, Bacillus thuringiensis
tataatttttatgtaaatggagaatggagagaaagctcttcaggagaaacaattgaaatttcatctccatatttacacgaagtaattggacaagtacaagcaattacttgcggagaagtagatgaagcaattgcatctgcaaaagaagctcaaaaatcatgggctaaagcttccctacaagatcgcgcaaaatacttatataaatgggctgatgagctcgtaaatatgcaggatgaaattgccgatatcattatgaaagaagtcggtaaaggctataaagatgcgaagaaagaagttgttcgtacagctgacttcattcgttacacaatcgaagaagctttacatatgcacggagaaagcatgatgggcgatagcttccctggcggaacgaaatcgaaacttgcgatcatccaacgcgcaccacttggtgttgtattagcaatcgcaccatttaactacccggtaaacttatctgctgcaaaacttgcaccagcattaattatgggtaatgctgttattttcaaaccagcaactcaaggtgcaattagcggtattaaaatggttgaagcacttcataaagctggccttccaaaaggtcttgtaaacgtagctacaggacgcggttctgcaattggggactatttagtagggcacgaaggcatcaatatggtatcgttcacaggtggtacaaacacaggtaagcatttagcgaaaacagctgcaatgattccacttgtattagaacttggcggtaaagatcctggtatcgttcgtgaagatgctgatttacaagatgctgcaaaccatatcgtaagcggtgcattctcttactctggtcaacgttgtacagctattaagcgtgtacttgtacacgaaaacgtagcagacgagcttgttgacttattaaaagcgcaagtagcggaactatcagttggatctccagagaaagatagcacaatcgttcgattaatcgatgacaagtctgctgacttcgttcaaggtttagttgacgacgctgtagaaaaaggtgctacgattgttatcggtaacaaacgtgagcgtaacttaatttacccaacattaatcgaccacgtaaaagaagaaatgaaagttgcttgggaagagccattcggtccaatccttccaatcatccgcgtttcttcagatgagcaagcaattgaaattgctaacaaatcagagttcggcttacaagcaagtgtcttcacaaaagacattaacaaagcatttgcaattgctaataaaatcgaaactggttctgttcaaattaacggacgtacagagcgcggccctgaccacttcccattcatcggtgtaaaaggttcaggtatgggtgcacaaggtattcgtaagagccttgagtctatgacacgtgaaaaggtaactgtattgaattttaaa

SEQ ID NO: 40352 - DNA, 510 bp, Bacillus thuringiensis
atggatttcaagcaacatatcgcaattgtaccggattatccgaaagaaggtattgtgtttaaagacattacacctttaatgaatgacggtaaagcatacaaagcagcaacagatgcaatcgttgaatacgcaaaagaaagagatatcgatgttgtagtaggaccagaagctcgtggtttcattatcggttgcccagtttcttatgcgttagaagtaggatttgcgccagttcgtaaattaggaaaattaccacgtgaagtaattacagttgactacggtaaagaatatggtaaagatgttttaacaatccataaagatgcaattaagccaggtcaacgcgtattaattacagatgacctattagctacaggtggaactatcgaagcgacaattaagctagttgaagaacttggcggagttgtagcagggattgcattcttagtagagcttacttacttagatggtcgtaaaatgttagatggttacgatgtattagtattagaaaaatac

SEQ ID NO: 40353 - DNA, 903 bp, Bacillus thuringiensis
ttaaatcgtaattataaaatagtaccagcagtaaatgatgtatcttttactgtaaagcaaggtgaaatggttggttatatcggtgagaacggtgctggtaaatcaacaacaattaaaatgcttacggggattttaactccgacatcagggcaaatcacagtaaatggaatgaacccacataaacaaagagaagaatttgtaagaacaattggtgttgtttttggacagcgttcgcaactttggtgggatattgcagtacaagaatcgtttcgtttattaaagaaagtgtacggtgtatcagacgctcagtataaggagcatatggagcacgtaattgaaacgttagatatagggcctttattagataaaccagttcgaaaattatctcttggtcaaagaatgcgttgtgaattagcggcagccttaattcataatccaccgttattatttttagatgagccaacaattgggttagatgtacttgtgaaattgaaaatacgtgaatttttaaaagaaatgaatgaacgttataaaacaacaattttattaacaacacacgatattactgatattgaagctttatgtgagcgcgttatcatgctggatgaagggaatattatgtatgacggttctttaagtaatcttcgtacgcagtggggagcagagaaggaaattcactttcagtttgttgcaccagtttcctatcaggctttatcaatggttatgccagataatcatgtcgtttggtcgaaagcgaaagaggaaaatgcatgggttgcaaaaattccgaatgaagaagttattatttcaatgcttatttctaaagtagtacaagcatttcaaattaaagatttaaaaattaacgaagtgtctacagaggaaattattcgtaacatttatgaa

SEQ ID NO: 40354 - DNA, 1275 bp, Bacillus thuringiensis
acaaagtcagaagcattacataaagaagctttagagcatatcgttggcggtgttaatagtccttctcgttcttttaaagcagttggcggcggcgctcctgttgctatggaacgtgggaaaggcgcttatttctgggatgtagacggaaataaatatatcgattatttagcagcatacggtcctattattactggacatgctcatccgcatataacaaaagcaattacaacagctgctgaaaatggggtactttatggaacaccaacagcgctagaggtaaaattcgcaaaaatgttaaaagaagcaatgcctgcattagataaagtccgtttcgtaaactctggtacagaagcagtgatgacaacgattcgtgttgctcgtgcttatacaggtcgcacaaaaatcatgaaattcgctggttgttaccacggtcattctgatttagtacttgtggcagctggatctggtccttctactttaggaactcctgactcagctggcgtaccacaaagtattgcacaagaagttattactgttccatttaataatgtagaaactttaaaagaggctttagataaatggggtcatgaagtagcagctatccttgtagaaccgatcgttggaaacttcggtattgtagagcctaaaccaggattccttgaaaaagtgaatgaacttgttcacgaagctggcgcattagtaatttatgatgaagttattactgctttccgctttatgtacggtggtgctcaagacttacttggtgtgacacctgacttaacagcgcttggtaaagttattggcggcggcttaccaatcggtgcttacggtggtaagaaagaaattatggaacaagttgctccgcttggacctgcataccaagctggtacaatggcaggaaaccctgcttctatggcatcaggtatcgcttgtctagaagtgcttcaacaagaagggctttatgagaaattagatgaacttggtgcaatgcttgaaaaaggaattttagaacaagcagcgaaacataatatcgacattacattaaaccgtctaaaaggggctttaactgtatacttcacaacaaatacaattgaagattacgatgccgcacaagatacagacggtgaaatgttcggtaaattcttcaagcttatgcttcaagaaggaattaacttagcaccttctaaatacgaggcatggttcttaactacagaacatacaaaagaagatattgaatatacaatcgaagctgtcggcagagcatttgctgcccta

SEQ ID NO: 40355 - DNA, 1431 bp, Bacillus thuringiensis
atgatggagacgatgccaaattggttaaagcaacgtgcatttttaacaccagatcgtactgcaattgaaatagaggaaaaggaagttacttttatgcagctgcatgaaaaggtagtatctgtttgtgaacacctcacgcatgtaggagtgaagcgaggggaaaaggtggctgttctgatgaaaaatggtatggagatgattacagttattcacgccctatcgtacgtaggagcagtagctgtgcttttaaatacgcgtctttcaagagaagagctactttggcaaatggatgatgctgaagttatttgtttagtgaccgatcaagaatttgatgctaaagatgttcctgtctattcattcgccgaagtgatgaatggaccaaaagaggaagcctctatacaagaagaattctctttagaagaagcgatgacgattatttatacgtcagggacgacagggaaaccgaaaggcgttattttaacatatggaaatcactgggccagcgcggttggctcttcgcttaatttaggacttcgtgatgatgattgctggttagcgtgtatgccgatgttccatgttggcgggttatctcttctaatgaaaaatattatgtacggcatgcgcattttactcgttccgaaatatgatgctgattttattcatacagcacttcaaacgagaggcgtaacgattatttcagtcgtatcaaaaatgttaactgatttattagagagacttggagaagaaacatatccttcttctttacgatgtatgttacttggcggaggaccagcgccaaaaccgttactcgaaacatgtgtagataaaggaattcctgtgtatcaaacgtacggtatgacagaaacgtcttcgcaaatttgtacgttgtccgcagattacatgttaacgaaagtaggatcagctggaaagccactatttcagtgccaacttcgtattgaaaaagacggcgtagtagtgccgccacatgcggaaggcgaaattgtagtaaaagggccgaacgtaacaggcggttattttaaccgtgaagatgcgacgcgtgagacaattcaaaacggatggcttcatactggcgacctcggttatttagatgaagaaggatttttatacgtattagatcgccgcagtgatttaattatttctggcggagagaatatatatccggctcaaattgaagaagtgttgctgtcccatccagcgatagcggaagctggtgttgtaggtatgactgatgataaatggggacaagtacccgctgcttttgttgtgaaaagcggggcggtaacagaagaagaaattcttcacttttgcgaggagaaattagcgaaatataaagtgccgaagaaagcatgtttcttagaggaattaccacgtaacgcttcgaaaaaattgttaagacgagagttaagagaa

SEQ ID NO: 40356 - DNA, 381 bp, Bacillus thuringiensis
gtaatggtcagcaaggaatttacatttgatgcagcacaccatttacactgttatgaagggaaatgtaaaaacttacacggtcacacatataaagttgtatttggaattagtggatatgtaaatgaaataggtcttgcaattgactttggagatataaaagaaatttggaaaaatgaaatcgaaatttatctagatcatcgttatttaaacgaaacgttacctgcaatgaatacgactgctgaaaatatggtcgtttggatttatgaaaagatggcagaagcactaacaaaagagaatcgagtgaacgaatataaaggagctcgcgttgaatttgttcgtctatttgagacgccgactagttatgcggaagtaagacgggag

SEQ ID NO: 40357 - DNA, 1530 bp, Bacillus thuringiensis
ctcgttcaatctttggctgaaacggcaaaaaagaagggggaaaaaccggcttatatatttatggatcagtcggtctcatatgaccaattaaacaaaatggtcacaaggttttctagcaatttagcagaaatgggcattggaaaaggggacaatgtcgcattagttgttgggaactcaccacattttttggtcggtttatacggaacaatgaaagccggagcaactgttattccagttaatccaatttatacagcagacgaaatgcattatattttacaaaatggagatgtaaaaacaatcatcgtactcgacgtccttctacctgttatacaatctcttacaacaagacttccttcattagaaaacatcatcatatgcgaaacctcatcagattttaaccatacagaaaccgaaaaaatgaaaacgtttactagttttgtggggactggagatacaacttacgaaggtcctgaactagatgaagaagatgtagcggttattctatacacatcgggcacaactggaaaaccgaaaggcgctatgttaacacataaaaatttatatagtaatgcgaacgatgtggcgtcgtatttacaatatacggctgatgaccgcgttgttgcggcactgcctatgttccatgtattctgtttaacagttgcggtaaatgcaccgattgtgaacggggcaacgattttaatgttaccgaaatttagtccgaaagaagtattccgtatttgtcgcacgtacgaaccaacgatctttgctggcgtaccgacgatgtacaattatttatatttatttgaagaagcaagcgcagaagatgtgaagacgcttcgcctttgtatttccggtggtgcatcgatgcctgttgctcttctgcaaaactttgaaaaacgttttaacgttattgtttcagaaggatacggtttatcagaagcatcaccagttacttgtttcaatccgctagatcgtcctcggaaaccaggatcaattggcacaaatatttggcatgtagaaaataaaattgtaaatgaacttggggaagaagtacctgtcggcgcagtcggtgaattaattgttcgcggacctaacgttatgaaaggatactataatgcaccagaagatacagctgcgacattgaaagacggctggctatatacaggtgacttggcgaaaatggatgaagaaggttacttctatatcgtggatcgtaaaaaagatatcgtcttagttggcggttataacgtataccctcgtgaagtagaagaagtattatatacgcacgaatcagtagcggaagttgtcgtaatcggtgttcctgatgaaaacttaggagaagctgtgcgagcgtacgtcgttttgaagcaagcaaacgtaacagaagaagaactaatgcattactgtacgttacatttagcgaaatataaagtgccgaaaagcattgagtttttaatagaattgccgaagaatacgacgggtaagttgttaagaagagcattgagagagaaagcgatgcaagtgtaaaaa

SEQ ID NO: 40358 - DNA, 747 bp, Bacillus thuringiensis
gaaaaccgatttgaagtagcattacaaatggtagatattttttataatgaaattttatccctacaaggtgtgaagtttattcagacaaaagatgatattaacatattaaaacaggacgagattggagcgatattaacaatagaaggatgcgaaacaattggaaaagatgcaatgaaattacggttgttgtatcgcctaggagtacgttcttttggactaacatggaattatgccaatctcttagctgatggtgcgctagagacacgtggggcgggtttaacgacttttggtaaacatgttgtacaagaactgaatacgttacatgtatggactgatgtgtctcatttgaatgaaagaagtttttgggatgttatagagattgcaaaaaatcctattgcttcccactcaaattgtatgaaactttgcgagcacccacgtaatttaaacgatgaacaacttaaagctcttataaagcgaaatggcatgattggtgtcacttttgtaccgcagtttctaacaaatgaaaaacaagcgaatgtagcagatataataaaacatatcgaatatatttgcttgctaggtggagaaaacaatatagggtttggttcagattttgatgggattgtagatacagttgtaaatgtatcagcgtatcgagattatgaaaatgtaatgaatgagctttgtaaacactatgctgcatctactgtagaacgatttttatatgataattttgtagaacatatg

SEQ ID NO: 40359 - DNA, 2661 bp, Bacillus thuringiensis
atgactcaatatacgcctatgatacagcaatatttaaaggttaaggcagattatcaagatgcctttttattttttcgcttaggcgatttttatgaaatgttctttgaggatgctgtaaaagcagctcatgaacttgaaattacattaacgagccgagatggcggtagtagtgaacgtataccaatgtgcggtgtaccgtatcatgcggctaaaaactatattgaacaacttgttgaaaaaggatataaagtagctgtttgtgagcaagtagaagatccgaaaacagctaaaggtgtagtacgtcgtgaagtagtacaattaattacgccaggaacgatgatggaagggcgtacaattgatgagaaagaaaataacttcttagccgcattaacacattttgaagatggatcatatgcattagcttgtaacgacttaacgactggacaaaatacagtaacgttattgactggttcagtagaagatattttattagaagtgtatgcaactggttcgaaagaaattgttgttgattcttcattttctaaagatgaactaaacaagttaactgaaacattgaaaatgacgatttcgtatgaagatgcaacggcaattccggaaggattagaacatcttgtgaaaaatgtttcacaagcaaaattaattaaagcagttggacgtttatttaactatgtaataagaacgcaaaaacgttctttagatcatttgcaaccagtagaaatttattatacgaatcaatttatgaaaattgatgtacattcaaagcgaaatttagaactgacagaaacacttcgaacgaaagaaaaaacaggatcactattatggttattggacaagacgaaaacagctatgggtggtcgtatgttaaaacagtggatggaacgtccacttatacagaaagaaagaattgaagagcgtttagaaatggttgaaacgtttgtaaatgattacttcttacgtgaagatttaaaggaaaagttaaaagaagtatatgatttagaacgcttagcaggaaaagttgcatttggtaacgtaaatgcaagagacttattacaattaagacgttcattgcttcaagtaccagctattttagaagcaattagtttgttagataacgcttatgcatcgagattaattcaaggtgcagatccatgtgaaagcttaacagaattactaggaagaagtattcaagaaaacccaccgctttcgattaaagatggagatattattaaagatggttataatgacaagcttgatcaatatcgttacgttagtaaaaacgggaaaacgtggattgctgagcttgaaaaaagagaacgtgatattaccggaattaaatcgttaaaaatcggatacaaccgtattttcggttactacattgaagtaacgaaagcgaatcttgcagcacttccagaaggtcgctatgagcgtaaacagacgcttgctaatgctgaacgtttcattacagatgaactgaaagaaaaagaaacgttaatcttagaagctgaagaaaaaattgtacagctagaatacgatttatttacagcacttcgtgaagaagtaaaagtatttattccgaaattacaacatttagcgaaagtaattagtgaattagacgtactgcaaagttttgcgacagttagtgaagaagaacagtttgtaaaacctgtactgacaacgaagcgcgaaatctttattaaagatggtcgtcatcctgttgttgaaaaagtattgaacgggaaattgtatgtaccgaatgattgtattatgccagagaatatggatgtctttttaattacagggccgaacatgtctggtaaaagtacgtatatgagacaattagcacttgtaacggttatgtcgcaaatcggttgtttcgtaccagcaacagaagcagtattacctgtatttgaccaaatctttacgagaattggtgcagcggatgatttaatttcaggtcaaagtacatttatggtcgaaatgttagaagcgaaaaatgcaattgcaaacgcatcagaaagaagtttaattttattcgatgaaattggacgcggtacatctacgtatgatggtatggcacttgcacaagcgattattgaacatattcatgaccaaattggtgcaaaaacgttattctctacgcattatcacgaattgacggtgttagaagagagtttaaatcaactgaaaaatgtacacgtttcagcaattgaagagaatggaaaagtagtattccttcataaaattcaagatggagcagctgataaaagttacggaattcacgttgcgcaacttgcggagcttccagatagcctaatcgctcgtgcgaaagaagtgttagcacagctagaaggacaggaagaaattattattccaaaacgagtagaagtgaaagtacaagaagctactccagaacctgtagttgtaaaagaagaaatagcagaaatacaggaaacgaaagtagagactgaagaagaatcgcaactatctttctttggaggagaacagtcttcgaagaaacaagaaaagcctctgctagatcaaaaagaaacagcagtactggcgcaaattaaaaaaatcgatttacttgatatgacacctttagaagcgatgaacgaattgtatcgcttacagaaaaagtta

SEQ ID NO: 40360 - DNA, 1941 bp, Bacillus thuringiensis
atggggaaaattcgcaaactcgatgaccaactctctaacttaattgcggcaggggaagtagtagagcgccctgcttcagtcgtaaaagaacttgtggaaaattctatcgatgcgaatagtacatctattgaaatccacttagaagaagctgggttatcgaaaattcgtatcattgataatggtgatggtattgcagaagaagactgtatcgtcgcttttgaacgccatgcaacgagtaaaattaaagatgaaaacgatctgttccgcataagaacactcggtttccgcggtgaggcattgccaagtattgcctcagttagtgaattggaattaattactagcacaggtgatgcgcctggtacacaccttattattaaaggtggagacattataaagcaagagaagactgcgagccgaaaaggaacagatattacagtacaaaatttattctttaatacaccagcacgtcttaaatatatgaaaaccattcatacagagctcggaaatattacagatatcgtgtatcgtattgcaatgtcacatccagaagtatcgttaaaactatttcataatgaaaagaaattgcttcatacgtcaggtaacggtgatgtaagacaagtacttgcatcgatttacagtattcaagttgcgaagaagcttgttccaattgaagctgaatctttagactttacaattaaaggttatgtaacattaccagaagtaacgagagcatctcgtaattatatgtcaacgattgtaaatggtcgttacgttcgaaactttgtattaatgaaagcaattcagcaaggataccatacattactgccagttggccggtatccaattggtttcttatcgattgaaatggatccaatgctagttgacgttaacgtacatccagcgaaattagaagttcgttttagtaaagaacaagaattgctaaagctgatcgaagaaacattgcaagctgcatttaaaaaaatacagcttattccagatgcaggtgtaacaacgaagaaaaaagaaaaagacgaaagtgtgcaagaacagttccagtttgagcatgcgaagccgaaagaaccatctatgccggacatcgttttaccgactggcatggatgcaaaacaagaagaaccgcaggctgtgaaacagcctgcgcagctttggcaaccaccgaagcaagaatggcaaccaccacagtcgctcgtgagagaagaacaaagttggcaaccatccactaaaccgataatcgaagagccaattcaagaagagaaatcgtgggacagtaatgaagaggactttgaactagaggaattagaagaagaagttcgggaaataaaagagattgagatgaacgggaatgacttaccaccgctttatccaattggacaaatgcatggaacatatattttcgctcaaaatgataaaggattatatatgattgaccagcatgccgcgcaggaacgtattaattatgaatacttccgtgataaagtaggaagagtagcgcaagaagtacaagagttacttgtaccgtaccgtattgatctatctcttactgaatttttacgtgtcgaagagcagttagaagaactaaaaaaagtcgggctatttttagaacaattcggccatcaatcctttatcgtccgctcgcatccaacatggttcccgaaaggacaagaaacagaaatcatcgatgaaatgatggagcaagttgttaaactaaaaaaagttgatattaaaaagttacgtgaagaagcagccatcatgatgagctgtaaagcatctattaaagcgaatcaatatttaacgaacgatcaaatatttgctttactggaagaactacgtacaacaacaaacccgtacacatgcccgcacggaagaccaattcttgtgcatcattctacttatgagttggagaagatgtttaagagggttatg

SEQ ID NO: 40361 - DNA, 783 bp, Bacillus thuringiensis
atggctggttctacattaacggttaaagacttacacgtatcaattgatggcaaagaaattttaaagggtgtaaaccttgaagtaaaaggtggagaaatccacgcaattatgggacctaacggaacaggtaaatcaactttatcttctgcaattatgggtcacccaaagtatgaagtaacagaaggtagcatcatcatcgacggtgaagatgtattagaaatggaagtagacgagcgcgcacaagcaggtctattcctagcaatgcaatatccaagtgaaattagcggagtaacaaacgctgacttcttacgttctgcaattaacgcacgtcgtgaagaaggcgatgaaatttctcttatgaaatttatccgtacattagataaaaacatggaattcctagaaatggatccagaaatggcacaacgttacttaaacgaaggtttctctggtggagagaaaaaacgtaatgaaatccttcaattaatgatgattgagccaaaaatcgcaatcttagatgaaatcgactcaggtcttgatatcgatgcattaaaagttgtatctaaaggtattaacgaaatgcgcggcgaagagttcggttgcctaatgattacgcattatcaacgtttattaaactacatcactccagacttcgttcacgttatgatgaacggtcgtatcgttaaatctggtggccctgagcttgcacaacgtctagaagctgaaggttacgactggattaaaaaagaattaggtattgaagacgaaacaacagagcaagaagcg

SEQ ID NO: 40362 - DNA, 2385 bp, Bacillus thuringiensis
atgtttactcatgttgaaagttttaaatcaacttttctagaaaagttagagacgatgtatggtaaaagttttaaagattctacaactcgtgatcaatataatacactcggccatatggtacgtgagtatatgaatagtcaatggattgcaacgaatgagagttatcgatccggagagcaaaagcaaatgtattacttgtctattgagtttttgcttggacgtttgcttggaagtaacatcttgaatttaggtattagagatgtatgcgagcaagggttatctgaactagggatttcgttacaagagttagaagaagtggaagcagatgcaggccttggtaatggtgggcttggacgcttagcagcctgttttctcgattcacttgcatctttaaacttgccaggacacggctgtggaattcgttataaacatggtttgtttgatcagaaaattgttgatggttatcaagtcgaatttccagaacagtggcttcttcatgaaaacgtatgggaagtaagaaggcatgatcaagctgtagaagtaagttatttcggcaatgttgaaccgctagaaattgacgggcgtttagagtttaggcatacaaatgcagaagtcattatggccgtgccatatgatgtgccggtagttggctatgagacgagtactgtaaatacacttagactttggaatgctgaaccagttcctttcccgcaaaactgcaaagatattttgaaatataagcgtgaaacagaggctgtatcggagtttttatatccagatgatacgcatgatgagggaaaaatacttcgtttaaaacaacagtatttcctcgtatcagcaagtttgcaaaatatcgttcgaatgcatagagaaagatatggtgaccttcgtcaactacatgaaaaaattgcgatccacattaacgatacacatccggttttagcaattccggaactgatgcgtattttactagacgaagaaaagttagcatgggaagaagcttggcacataacgacgcagacgatttcttatacgaatcatacgacgttatcagaagcgctcgaaaagtggccaattcacatttttaaaccgttattaccgagaatttatatgattattgaagagattaatgaacgtttctgtcatgaactgtgggaacagtatccgtatgagtgggatcgtattgaagcaatggcgattattgcacatgaccttgtgaaaatggctcatttagcgattgtcggtagccatagcgtaaacggtgtagcgaaaattcatacggaaatattaaagcagcgggaaatgcgattgttttatgaattttatccagataagtttaataataagacgaatggaattgctcataggcgctggcttatgaaagcaaatccacagttaacaaatctcatttcagaggcgattggaacagagtggaagaaagaaccgattaagcttcaagagctacaattagttcaatatgatgcgagtttccaagagaaatttgcagaggtaaaacaagagcgtaaagagattttagcggagcgtattcataatacaatggggattaccattgatccaaattctatttttgatgtgcaagtgaaaagattacatgcttacaaacgacaattattaaatgttcttcatattttatatttgtataaccgtttgaaagaggatgctagttttacattttatccgcgtacttttatttttggagcgaaagcatcacctggctattattacgcgaaaaaaattattaaattaataaatgaactcgcaagaaaagtaaataatgacccgtatgtcagtcaatatatgaaagttatctttctagaaaactatcgagtttctttagcagaagatatattcccggcagcggatgtaagtgaacaaatttcaacggcgagtaaagaagcatcgggaacaggtaatatgaaatttatgatgaatggtgcgattacactcggaacgctagacggtgctaacgttgaaataaaagaccgggtcggtgatgataactgtttcattttcggtttaacagccgaagaggttcttcattactatcaaaatggtggatatcgtgcaagtgattattatcaccacaatgggcacattaaaaaggtagtagatcagttaacgaatggtttctttgcacagtcgggagccgaatttgaagcaatttacgattctctcgttattcaaaatgatgaatatttcgttctgcgagattttggtccatatgctgaaagacaagaagctgtcggtagagcttatgagaaccgaacgaagtggctagaaatgtcgattttaaatattgcacagtctggtcattttgcgagcgatcgaacgattttgcagtacagtaatgaaatttggggtatt

SEQ ID NO: 40363 - DNA, 1428 bp, Bacillus thuringiensis
gtgaatattttatttgcagtatcagaatgtgtaccgtttgtgaaatcgggaggattagctgatgtagcgggtgcgctcccaaaagagctgaaaaaattaggagtggacgttcgtattatacttccgaattatagcctcattccgcaaaagttaagagatggatgtacgttacataaagtaattaacgtcccgcttgggtggagaaatcaatattgtggaattttaaaaggtgagcaagacggaattacgtattacttaatagataatgaatattattttaagagagattctctgtatggtcattatgatgacggagagcgtttttcttatttctcaaaagcggtgttagagtgtattccgcaccttgattttgaagtggatgttcttcatagccacgattggcatacggctatggttaatttcttacttcgtgaaaagtatcaagataacccgttatatgagcgtattaaaacggtatatacaattcataacttacagttccaaggtgtatttcctcctgaagtaatgtacgacttgttagaacttggtgatgaatatttccacagtgagcagttagagttttatgggaatgtgaactttatgaagggcggtattatcgcttcggatcaaattacagcggtgagcccgacatataaagaagaaattcaatatgaatttttcggtgagaagttagatggattactgcgaaaatataatgataagcttagcggcattgtaaatggtattgatacgagcgtatataatccagaaacggattcgtatattaaggctcagtatgatgcagagtcattatatgaaaagagtgaaaataaacgcgccttgcagcgttattttggtttgccagaaaaagaggatacaccaattatttcaatggtaacgagattaacgaagcaaaaaggtcttgatttagtacgtactgtattccgcgaaataatggaagaagatgtacaatgtattattttaggatcaggtgattcggaatatgagcaattctttgaatggatggcatatgagtatccggagaaggtaaaagtttatatcggatttaatgaagaattagctcatcaagtgtatgcaggaagtgatttattcttaatgccatcgctgtttgaaccgtgtggacttggacaacttatcgcattagcatacggtacgattccaattgtaagagaaacaggtggattaaacgatacggtacattcttatgatgaagaaactggagaaggaaatggttttagtttcacgaattttaatgcacatgacatgctgcatacgattcatcgtgcaattgaattctatcacgataaaccggtatgggagcagcttgtaaaacaagcgatgactgaagattatagctgggagcaatcggctcttgcttataaggaattgtataaaagtctcatggaa

SEQ ID NO: 40364 - DNA, 1071 bp, Bacillus thuringiensis
agtcgtttaagtgcattaacaaagaatttagccaagccagctgttccatttggtggtaaatatcgcattattgattttacgctaagtaactgtgcgaattctggtattgaaacggttgggattttaacgcaatatcaaccactcgaacttcataattatatcggaatcggaaatgcgtgggatttagaccgagtaaacggtggggtcacagtcttacctccttatgcggagtcttcaggggttaagtggtatacaggtacggcaagtgccatttatcaaaacttaaactatttaagtcagtatgaaccggagtatgttctcattttatcaggcgaccatatttataaaatggattacagtaagatgctagattaccatattcagaaagaatcggacgtatccatttctgttattgaagtaccttgggatgaagcgagtcgctttggcattatgaatacaaatgaagaaatggagattgttgagtttgaagagaaaccacaatttccaagaagtaatcttgcatcaatgggaatctatatttttaattggtcaattttgaaagagtatttagagatggatgcaagaaaccctgaatctagtaacgattttggaaaagacgtacttccccttttattggatgaagggaagaagctaatggcgtatccgtttgaaggatattggaaagatgttggaacggtgaagagcttatgggaagcgaatatggatttgcttcgcgatgaaacatcactgaatttaaacgatcgtaattggcgtatttactctgtcaatccaaacgaaccgcctcaatatattgctgaaaaggcgaaagtagaagaatcgcttattaacgaagggtgcgtcattgaaggggacgtgaagcattctgtgttattccaaggagtgacggtggaagaaggaagtatggtgattgattctgtcgttatgccaggggctaagattggtaaaaatgttgtgattgaaagagcgattgttggatcagaaatggttatcgaggatggaacaatcattcgtccagaaaagaatgttgacgatgtagtattaattgctgaa

SEQ ID NO: 40365 - DNA, 1944 bp, Bacillus thuringiensis
gtgaacatattgagtgtaataaattgtgaagaagtgaaacgagatgagtttcatacagaaaagtactatgaaagttataacatctttggcgcacatgttgtgacggaagatgagattcaaggggtacgatttacagtctgggctcctcatgcgaaagcaatgagtgttgttggagattttaatgagtgggattatgagcaacataagatgctacaagtgacagaagaagggatttggtccttatttataccgcatattgaagaaggagaaatatataaatatgcgattgaaacgttggctggtgacgtcattttaaaggcagatccgtatgctatatatgcagaagtaagaccgaatacggcatctgtagtttttgatataaaaggatatgaatggaatgataaaaactggaatcgtaagaaaaagaaaaaaccgatttataaagaagcgatgacagtttatgaattacattttggttcttggaaaaagaaagaagatggaacactatattcttacagggaaatggcagaagaactcattccgtatgtggtggaacatcaatttacacatattgaaattatgccgcttgttgagcatccatatgatcgttcttggggatatcaaggaacgggatattatgcagcgacgagtagatttggtacaccgcatgatttaatgtattttgtcgacgaatgtcataaatatggaatcggtgtcattttagattgggtaccggggcatttttgtaaagatgctcacggtttatatttgtttgatggcacaccgacctatgaatataaagataaagatgtacaagaaaatctagtatggggaactgtcaattttgatttaggaaagagagaggtacgtaatttcttaatttcaaatgcgttattttggatgagatatttccatattgatggtttcagagtagatgcagttgcgaacatgttgtactggaataaagaaggacaagagcaaagtaatgagtacgctgtgtcatttttaagggagttaaatgaagcagtgtttgcagaggatgaagattttcttatgacggcagaggattcaacagcttggccacttgtaacagcaccaacgtatgaaggtgggcttggattcaattacaaatggaatatgggctggatgaatgacgtgctgaaatatatggagtgtgcgccagagtacagaaaatatattcatgagaaaatgacgttctctttactatatgcttactctgaaaacttcatattacccctttctcatgatgaagtcgttcatgggaaaaagtcgttattaaataaaatgccaggtgattactgggataagtttgctcagcttcgtttattatatggatatttctttactcacccaggaaagaaattacttttcatgggaggagaattcgggcagtttgatgagtggaaagaccttgaagatttagattggaatttacatgattttgaaatgcatcgttatatgcatgattactttaaagagctcatagcattgtataagcgctcaaaaccactttggcagcttgatcattcgcctgaaggttttcagtggattgatgctaataataacgagcaaagtattttctcgtttatccgccaaggggataaacaagaagatgcgttagttatcgtatgtaattttacgaaagctacatatgaaaactataaagtaggtgtaccagatttcgagtattataacgagattttaaacagtgatgcacagcaatatggcggttcgggacaagtgaataagaaacgtcttaagacgattctagaaccgtaccataatcaagcagcacatgtagagattacaattccaccatttggcgtatccatattacgaccagtgaagacgagaaaggggagcaaaaaacaagatggctcaaaaacaaaagtgcgtagcaatgttactagcagggggaaaagg

SEQ ID NO: 40366 - DNA, 936 bp, Bacillus thuringiensis
atgaaaaaaggtatcaatcgtgtagtattagtaggaacaggagctgtaggttgtagttacgcttactcaatgattaaccaaggtgtagctgaagaattcgtattagtagatgttaatgaagcaaaagcagaaggggaagcaatggacttaagccatgcggtaccattctctccatcaccaacaaaagtttggagcggtagctatgcagattgtaaagatgcagatttagttgttatcactgctgggttaccacaaaagccaggtgaaactcgtttagacttagttgagaaaaatacaaagatctttaaacaaatcgttcgcgtcattatggatagcggattcgatggaatcttcttaatcgcaactaatccagttgatattttaacttacgtaacttggaaagaatctggtttaccgaaagagcgcgtaatcggttctggtactactttagactctgctcgtttccgttacatgttaggtgactacttagatgtagatccacgtaacgttcatgcttacatcgttggtgaacacggtgacactgaacttccagtatggagccacgctactatcggtgtacaaaaattagaaacaatcttagctaacaacgaacagtacaaacaagaagacttagacaaaatcttcgaaaacgtacgtgatgcagcttaccatatcatcgagcgtaaaggtgcaacttactacggaatcggtatgtcactacttcgtgtaactaaagcaatcttaaacaacgagaacagcgtattaactgtatctgcataccttgaaggtcaatacggcgagaaagatgcttacgtaggtgttccagctgtaattaaccgcgaaggtgtacgtgaaatcgtagaacttgagctaaatgaagaggaaaaagtgaagttcgctcattctgtaaaagtattaaaagaaacaatggcacca

SEQ ID NO: 40367 - DNA, 726 bp, Bacillus thuringiensis
ttattgcgtgtagaaaatgttacaggaggatatacgaaacgacctgtattaaaagacgtttcgttctctgttaataaaggcgaacttgtcggcttaatcggtttaaatggagctggtaaaagtacgacgattaaacatattatcggtttaatggaaccgaaaaaaggaactgtcacaattaatgggaaaacaattcgtgatgatatgacagcgtaccgttctagcttttcattcattccggaaacgccagtattatatgatgaattaacgttagaagagcatttgaaattaacagctatggcgtatggcattgatgaaaaacaatatgaagaacgtgtaggacaactactacaagagtttcgtatgaaaaatcgtttaaaatggtttccatctcatttctcaaaaggaatgaaacaaaaagtaatgattatgagcgcatttttagtggagccatctctttacatagtagatgaacctttcgttggattagatccgttagcgattcaatcccttcttcaaatgatggaccaaatgaaaaagagtggtgccggtattttaatgagcacacatattttagcgacggcagagcgttattgtgattcgttcattattttgcatcaaggtgaagtaagagcgaagggaacgctatctgaactgcaatcacagtttaatatgccaggtgcaacgttagatgatatttacatcgcgctaacaaaggaagaagat

SEQ ID NO: 40368 - DNA, 1380 bp, Bacillus thuringiensis
ctacaagaacaaattgaagtaaataatcctgcgacgaaggaaatatttgcaactgtaccaaagggcggagtaacagaggcaaagcaagctgttgatgctgcacatgaagcttttaaaacgtggtctaagttaacggcagcagatcgtgccacgaagttaaaaaagtggttcatgcttattgataaaaataaagaagaaatcgcagcgattatgacgaaggaacaaggaaagccgtttgcagaagcgcttggtgaagtaaattatgcaaatagttttgttgaatggtatgcagaagaggggaaacgtgtatatggtgaaatgattcctgcttctcatccgaataagcgcattttagttatgaagcaaccagttggcgttatggcagctattacaccttggaacttcccggcagcgatgattacgagaaaggtagcaccagcgcttgcagcaggctgtacagccgttgtgaaaccggcgagtcaaacgccattaactgcattgaaattagctgaattagctcatgaagcagatattccaaagggcgtaatcaatatcgtaacaggtagtgcaaaagcaattgctgatacatggatggaagatagtcgcgttcgaaaagtgtcctttacagggtcaacggaaatcgggaaagagttaatggctagtgctgcacaaacgatgaaaaaagtttcgcttgagttaggtggccacgctccatttatcgtaatgaatgatgcagatttagataaagcagtagaagcggtaattggttcgaaattccgtaacgcaggacaaacgtgtatatgtacaaaccgagtattcgttcaagaagaagtatacgaagtatttgtagagaagttccaaaaggcagtagggcagttgaaagtaggagacggtttcggtgacggaacgactgttgggccacttattgatgagaatgcagtttcaaaagtacaagaacatattgaagatgctattcaaaaaggtggaacagttttatatggtggtcaaaaggtcgcagagttagagggacatttcattcaaccgactgtaattggggtggcaaatgatacgatgctttgtatgaatgaagaaacatttgggccagtggcaccagttgcgaaattcaaaacagttgatgaagtaatcgaacgtgcaaataatacaccatacggtttagctgcgtatattttcacgaaagacattagccaagcattccaaattagtgaagcgttagagtacggtattatcggtctaaacgacggtcttccatcagttgcacaagcaccattcggtggatttaaagaaagtggtatcggccgtgaaggaggccatttcggcatcgaggaatatttagaaattaaatatatttcattgggacta

SEQ ID NO: 40369 - DNA, 1278 bp, Bacillus thuringiensis
gcatctttattagaacgccgtcaaaatatagtaccaaaaggagtaagtaacggcatcccaacgtttgtacaatctgcaaatggtgctcttgtaacagatgttgatggtaatcagtacattgattttgcaggagcaatcgggacaattaacgtagggcattgtcatccagcggttaaagaagcgctccataaacaagtcgatcaatacattcatactggatttaatgtcatgatgtatgagccatatattgaattagcggaaaagcttgcggcattggcaccaggaagtttcgataagcaagtcctctttttaaatagtggtgcagaagcagttgagaacgcggtgaagatcgctcgtaaatatacgaagagacctggtattatcgcattttctaaaggtttccacgggcgtacattaatgacaatgacgatgacaagtaaagtgaagccatataaatttgggtttggtccctttgctccagaagtatataaagcgccatttccatacgaataccgtcgcccagagggattaacggaagagcaatatgatgattttattattgaagagtttaagaacttcttcatatcggaagtagcaccagaaacaattgcagctgttgtaatggagcctgttcaaggggaaggtggatttatcgtcccaagtaagaaatttgttcaagaagtacgccgcatttgttcagagaacggcatcttatttgtagcggatgaaatacaaacaggctttagtcgtacaggaaaatattttgcaattgatcactataatgtcgttccagatttaattacagtgtctaaatcattaggtgctggtgtaccgataagtggtgtcattggacgtaaagaaattatgaatgagtctgcaccaggtgaacttggtggaacgtatgcaggaagtccattaggatgtgcggctgcattagctgttctcgatgtaatagaaaatgagaaattaaatgatagagcgatagaattaggaaaagtcgtaatgaaccgattcgaagagatgaaaaataaatatcattgcatcggcgatgtgcgtgggttaggtgcaatgtgtgcatttgaggtcgttcaagatcgtaagacgaaagcacctgacaaaacgttaacggctaatctatgtgcagaggcaaataagcgtgggttactgttattatcagcaggaacatatggaaatgttatccgtgtgttaatgcctttagttattacagatgagcaacttgaagaaggtttaacaataattgaagaatcattgcaagct

SEQ ID NO: 40370 - DNA, 1470 bp, Bacillus thuringiensis
aaattaaatcagaccgagaaaaataaattagaaaaagatggcttagaaatttttaatgatattccttactatgcggaaaatggtttcgaatctattccgaaagaagagtgggatgcctttaaatgggcaggcttgtatttacaaagaccgaaagaagctggttattttatgatgcgggtaaatattccgtcagggattattacaaatgcacaggcagaagtacttgcttctatcgctgaagattatggacgtgatgtaatagatattacgacgagacaggcgattcagtttcactggttagaaattcagcaaattccagatatttttaaaaggttagcaagagttgggttatcttcagcgggggcttgtggtgatataacgcggaatattacaggtaatccgcttgctggcattgatgcaaatgaactatttgatacaacgaatattgtaaaagaagtatatgattacttccaacataatgaagagttttctaacttgccacgtaaatttaaaatgtctattagttctaatatttataattcagcaaacgcagaaattaactgtgttgcatttacgcctgcaacgaaagaaatagatggtgagaaaaaagttggttttcatataaaagtaggtggaggattatcagctcgaccgtatttagctgatgaattagatgtattcgttttaccagaagaagtgaaggcggtggcgattgcgattgctactatattccgtgattttggatatcgtgaaaaacgtcatttagctcggttgaaatttcttgttgcggactggggagcagagaaatttaaagagaaactaatagagtatacagggtctttacaaagtaaaggggaaagtgcattcaaaggatggaatgcaggctatttttatggtgttcaagaccaaaaacaaaagggattaaaatatgtaggttttaatgtaccggtaggtcgtttacatgcagaagaaatgtttgagattgcaagaatcgcaaagcaatatggaaatggacaaattcgtacatgtaactcgcaaaacttcattattccgaacgttcctccggaaaatgtaaaaggattacttagtgaaccgctgtttgaagtgatatctgctagcccgaaatcatttattggtcatgcggtttcatgtaccggtattgaatattgtaatcttgcactagtagaaacgaaagaaagattacgaaaaattgcagaatacttagatacacaaattgcactcgatgttccagttcgaattcatatggtaggctgcccgaattcatgtggtcaacgtcaaattgctgacattgggttacaaggggtgaaaatgaagacgaaggaaaaaggcattgttgaagcgtttgaaatatacgtaggtggaacattgttagatggcggtgcctacaatcaaaagttaaaaggaaaaatagatggcgaggatctacctgatgtactggcatcatttata

SEQ ID NO: 40371 - DNA, 588 bp, Bacillus thuringiensis
gatacgaatattacttggcatacagcttcggtttcaaaagatgagagaagagtgaagaatggacatcatagttttgtaatttggtttactggtttatcagcttcgggtaaatctacagtagcgaatgcggtcgctcgtaaactgtttgaaaagaatattggaaattatgtgctggatggggataacattcgccacggtttaaataaagacttaggattttctgaaagtgatcgcatggaaaatataagacgtattggcgaagtggcaaagttatttgtagatcaaggagcagttgtccttacagcatttatttcaccatttcgagtagaccgcaaacaagtaagagatttattagcggcagatgaatttattgaaatttttgtgaagtgtccgattgaagagtgtgagaaacgtgatccgaaaggactttataaaaaggcaagaaaaggtgatattaaggatttcacaggtattgattcgccttatgaagagccagagcaagcggaattaattgtagaaacgcacaaatattctattgaagaatgtgcagaacaaatcgtgaagtacttacaagagcgtagttttata

SEQ ID NO: 40372 - DNA, 1107 bp, Bacillus thuringiensis
gaattagtaaaccgtatagatgagacatatgacgtatcacaaattgaaaaagaaattaaattagacaatattgcgttaagtgatttagaactattggcgacaggtggatatagcccccttactggttttttagggaaggaagattatgattcagttgtagaaacgcttcgtttagcaaatggtagtgtgtggagtataccgattacattaccggtaacagaaaaagtcgcagaaagcctgaaggttggagaggaagtaaagcttgtcaacaatggaaatatatacggtgtcattcaaatagaagatatttttgtaccagataaagaaaaagaagcgttacttgtatataaaacaacggatgaggctcatccaggagtgaaaaaattatatgaacgaccaaacgtttacgttggaggaactattattctaacaaaacgctttgaaaataatcaatttccttcttatcatttagacccaattgaaacgagggaagcatttaaaaaacgtgggtggaaaacagtggtcggatttcaaacgagaaacccggtacatcgtgcccatgagtatattcaaaaatctgctcttgaaattgtagatggtctctttttaaatccgctcgtcggagaaacgaaatcggatgatattcctgctgatgtaagaatggaaagctatgaagtacttcttcaaaaatattatccgaaaaatcgtgtctttttaagtgtatttcctgctgccatgcgttacgcaggaccaagggaagcgatatttcatgcgttagtaagaaagaattttggatgtacccactttatagtagggcgtgatcatgctggagtaggagattattacggaacgtatgaagcgcaagaaatcttcacaaattttacgatagaagagttaggaattacaccactattctttgaacatagtttttactgcacgaaatgtgaagcgatggcttcaacgaaaacatgtccgcacggaaaagaagatcatgttattttatcgggtacgaaagtaagagaattattaagaaacggtgagattccgccaagtacatttagtcgtaaagaagtagtggaagtgctaattaaaggcttgaaaaaagaa

SEQ ID NO: 40373 - DNA, 696 bp, Bacillus thuringiensis
atgttgacgtatgaaacgtgggaagaaaatgttgtttcgttttcggaagaagatgaaacaaaaggcgcgctatcagtattaaagtgggcttataaagaatataaagatgaaatcgtctacgcatgtagctttggggtggaaggtatggtattgctgcaccttataaaccaagtaaatccatctgctaaagttgtatttttagatacaaatgttcattttcaagaaacatatgaattaattcaaaaagtgcggaggcgatttccttcattaaatattatagaaaaacaaccggaacttacgcttgatgaacaagagaagttgcatggcgagaaattatgggaaagtaatccgaatctttgttgtaagattagaaaaattttaccgttagaaaaatcattagcagcggaaaaagcgtggatatcgggcttaagaagggaacaatcagaaacacgtaagcatacaaagtttataaatcaagatcatcgttttcaatctattaaagtttgtccactcattcattggacgtggaaagaagtttggcgatatgtatacaaacatagcttgccgtataacccgttgcatgatgttggctatccaagtattgggtgtgagaaatgtacgttacctgtaggggatggtggcgattcaagagatggtagatgggctgggaaagtgaaaaccgaatgtggtcttcat

SEQ ID NO: 40374 - DNA, 1290 bp, Bacillus thuringiensis
atgtatttacacggcacaagccgaattaatgggcaaggacacttagaaattggagggtgcgatacgacgcagctagcaaagcaatacggaacaccactttatgtatacgatgaagagtctattcgaggaaaatgccgagcatttcatcgtgcttttaaagaaagtggtttctcttatcaagtagcatatgcaagcaaggcgttcttgtgcatggagatgtgccgagtagctcgtgaagagaatatgtcattagacgttgtctctgggggagaattatatactgcgctccaagcaggatttccggcatcacgtattcattttcatggaaataataaaacagaagaagaaatagtgatggctcttcaggcgaatatcggttgttttgtcgtagataatttctttgaattagaagttttacacgatttagcgatgcaacatggaaagtttgtgaacatattaattcgtgtaacgcctggagtagaggcgcacacacatgaatatattacgacaggccaagatgattcgaaatttggatttggcgtttcaaacggtcaagcgatgcaggcaattacatttgctttacaaaaatccaattataatgtgctagggatccattcacatattggatcgcaaatatttgaaacagctggttttgttcgagcgattgaagttcttcgccaatttttagtagaagtgagagagcaaacaaactatgtagtaaaagtgttaaatgtaggcgggggatttggaatacgctacacagagtcagatacaccattaactcttgagacatatgtgcgagctgtaacaagtgcagtgagagaacaatttactgtatgtgaatatccattgccagaaatatggattgaaccaggacgtagcattgtaggtgatgctgggacaacaatttatacagttggatctgtgaaagatattcctggtattcggaaatatgtatcagtcgatggtggaatgacagataatttaagacctgctttatatagcgcgcgttatgaagcgatgttagcgaatcgagggaatgatgagaatgaggaactcgtttcgattgccgggaaatgctgtgagagtggagacatgttgatttgggatattcatttaccaaaagtcgcttcttctgatttactagcagtttcctgtacaggagcatacgggtactcgatggcgaataattacaatcggattcgaagaccagccgttgtctttgcaaaaggcggaacatcgcaagtagttgtggaacgcgaaacatatgaaaatattattgggaacgat

SEQ ID NO: 40375 - DNA, 645 bp, Bacillus thuringiensis
ccaaacttatttacgctcggaaatttatatagcggatttttatcaatcggctatgcatctttaggatattataaatcagctgctattttagtacttatcgggatgatgttagatagtcttgatggtcgtgttgctcgtttattacgtgttgattcacaaatgggaaaagagctcgactcgcttgcagatgtcgtaacatttggtgcagcaccagctgttttaatgtattacacatctttctcaaactacggaatcatcggattatacatagcgggattattccctcttttcggagcatatcgtttagcacgatttaatgtaacaccatcttctacttcaatgaaatatttcactggagtaccgattacagcagcgggagggcttgttgctttcttaacattattttcacataccattccaaaaatcgttcttattaccgtatttgtaacgttcgcatttttaatggtgagccgcattcgtatcccaagtttaaaagatgtaccaattccacgatatagcatcattattacactatttttagttggaatcattattacaatgtatcaaacaggatttggaaatttttctgttttcttatttattgccattccactatatattttgtacatgttatctcaattcatt

SEQ ID NO: 40376 - DNA, 583 bp, Bacillus thuringiensis
ggattaataccagcaattgtcatcgaagaaggtacgaaagaagttttaatgctagcttatatgaatgaagaagcatatgaaaaaacgttagagacgaaaagaacatggttttattctcgttcgaggcagtcgttatggaataagggggaaacatcagggaatcttcaatatgtgcaatctttatatttagattgtgatcaagattcaattgttgtgaatgtgaaacaagtaggacctgcttgtcatacgggagagaagacatgttttcactatcaaattatatagggggatacatatggaaaatgcctttaagttgctgtataaaacaattgaagaacgaaaggaaagcccacttcctgaatcgtatacaaattatttattttcaaaaggagaagataaaattttaaagaaaattggtgaagagtgtgctgaagtaattatcgcatgtaaaaataatgataaagaagaagtagtgaaagaaatggttgatgtattttatcactgtttcgttttattagctgaaaaaaatattacattggaagatgtcatgcgagaggtgaaagaacgaaatggaaagctttcg

SEQ ID NO: 40377 - DNA, 753 bp, Bacillus thuringiensis
atgttagcgaaacgaatcattccatgtctagatgtgaaagaagggcgagtcgtaaagggtgtaaattttataggattacaagatgtcggtaatccggttgaaatagctgaagcatataacgaggcaggggcagatgaaatcgtatttttagatattacagcgactcatgaaggaagaaaaacgattatagatgttgtagaaaaaacagcagctaaagtatttattcctcttacggttggcggggggatttcaagtgtgaaagatatgtacaatttactaagagctggagcagacaaagtttcaataaactcagcggcagtgcgaaacccgaagcttatagaagaaggggcagaacactttggatcacaatgtattgtcgtggcaattgatgctagaaaagtagcagaaggtaaatggaacgtatacgtcaacggcggaagagttgacacaggaatggatgccatagaatgggcgaagcgtgttgttaaacttggggcaggtgaaattttgttaacgagtatggatgcagatggaacgaaaagcggatatgaccttcgtttaacagaagaaatttcaaaaagtgtttccattccagtcatcgcatcagggggctgtggtcatacggatcacattatagaagtttttcaaaagacaacagttgatgcagcgttagcggcatccatctttcattatggtgaggcgacagtgcagagtgtaaagcgaaaattaagagatgcaaatgttgaggtgcgg

SEQ ID NO: 40378 - DNA, 585 bp, Bacillus thuringiensis
ataatgcgtcagtccagtcaagcacgtgagacgacagaaacaaaaattaaattaagtttgcagcttgatgaaagtacgagtgtatctattcaaacgggggttggttttttcgatcatatgctgactttatttgctagacatggaagatttggattgcaagttgaggcagaaggtgatgtatttgtcgatgcacatcacaccgttgaagatgttggaattgtactcggaaattgcttgaaagaagcattgcaaaataaagaaggaattaatcgttacggttccgcgtatgtaccgatggatgaatctttaggatttgttgcaattgatataagtggacgctcatattgtgtatttcaaggggaattaacaaatccgaagctcggggattttgatacagaattgacggaagaattttttagagcagttgcacatgctgccaatattacattacatgcgcgcgttctatacggaagtaatacacatcacaaaattgaagcattatttaaagcttttggtagagcgcttagagaagcggtcgaaaaaaatgccaacattactggtgtaaattcaacgaaagggatgttg

SEQ ID NO: 40379 - DNA, 1755 bp, Bacillus thuringiensis
atgcgtaaaactaaaattgtatgtactataggtcctgctagtgaaagtattgaaaaattagagcaattaatcgaagcaggtatgaacgttgctcgtttaaacttctctcatggtagccatgaagagcacggagctcgtattaaaaacattcgtgaagcttcaaagaaaactggtaaaacagttggtatcttacttgatacaaaaggtccagaaatccgtactcacgacttcgtagacggacaagctgagcttgtaacaggtgcagaggtagttctttctactgagcaagtattaggtactgcagagaagttctctgtatcttatgctggtctttatgacgatgtagacccaggttctcgtattctaatcgatgacggtcttatcgaactagaagtaatcgaaaaagctgatggaaacatccgtacaaaagttcttaacagcggaactgtaaaaaataaaaaaggtgttaacgtaccaaacgtaagcattaagcttcctggtatcactgaaaaagacgtaaaagatatcatcttcggtatcgagcaaaaagttgatttcattgcagcttcattcgtacgtaaagcgtctgacgtattagaaatccgtgaattattaaaagagcataacgctcaatacatccaaatcgtaccaaaaatcgaaaaccaagaaggtatcgacaacatcgattcaatcttagaagtttctgacggtttaatggtagctcgtggtgatatgggtgtagaaattccaccagaagaagtaccgttagtacaaaaacgtctaattaaaaaatgtaacgtgttaggtaaaccggttattactgcaacacaaatgttagattctatgcaacgtaacccacgtccaactcgtgcggaagcaagtgacgtagctaacgcaatcttcgatggtacagatgcaatcatgctttcaggtgaaacagctgctggacaatatccggtagaagcagtaacaatgatggctaacattgcggtacgtgttgaaaaatcattacaatatgaagatatgttcaaaaaacgtattaaagagttcactccaacaattacagatgcaattagccaatctgttgcgcatacagcacttgctcttgatgtagctgcaatcgtagctccaacagaaagtggatatactgcgaaaatgatctctaaataccgtccaaaatctccaatcgtagctgtaacatctgacgagcaagtaggacgtcgtcttgcacttgtttggggtgtacaagcatttatggctgagaagcgcgcagcttcaactgacgaaatgttagatacagcaattcaaacaggcatggatgcgggtctaattggacttggagatactgtagtgattactgcgggtgtaccagttgctgaaactggtacaacaaacttaatgaaaatccacgttgttggtgaagaaattgctaaaggacaaggaattggtcgtaaagctgcaaaaggtaaagtagttgtagcaaaaacagctgctgaagctgtagcgaacgtaaacgaaggtgatatccttgttacaacaagcactgataaagatatgattcctgcaatcgaaaaagctgcggctttagttgtagaagaaggtggcttaacaagccatgcagctgttgtaggcgtatcaatcggtattcctgttatcgttggtgtaaactgcgtaacagcaactttaaaaaatggccaagaagtaacagttgatgcagcacgcggaattgtttataatggacatgcggaagtgcta

SEQ ID NO: 40380 - DNA, 957 bp, Bacillus thuringiensis
atgaaacgtattggtgtattaacaagtggtggagattcacctggtatgaatgctgccattcgtgcagttgttcgtaaagcgattttccatgatattgaagtatatggtatttaccatggatacgctggattaatttctggtcacattgaaaaattagaacttggttctgttggagatattatccaccgcggtgggtcgaaattatatacagcaagatgtcctaagtttaaacacccagtagtcgacttaaaaggtatcgagcaattaaagaaacatggtatcgaaggacttgttgttattggtggagatggttcttaccaaggcgctaaaaaattaactgaacaaggattcccatgtgttggtgtaccaggtacaatcgacaatgatatccctggaacagacttcacaattggtttcgatacagctttaaacactgttattgatgcaattgataaaatccgtgatacagctacatctcatgaacgtacatatgttatcgaagtaatgggacgtcatgctggagatatcgcattatgggctggtttagctgatggtgcagaaacaatcttaattccagaagaagagtatgacatggatgatgtaatcgctcgtctaaaacgtggtagcgaacgtggtaaaaaacacagtattatcattgtagctgaaggtgttggaagtgcaattgacatcggtaagcacattgaagaagcaacaaactttgatactcgtgtaactgtattaggtcacgtacaacgtggtggatcaccaagtgcacaagaccgtgtattagcaagtcgtcttggtgcaagagcagttgagttgttaattgctggtaaaggtggacgttgtgtaggtattcaagataataaacttgttgatcatgacattatcgaagcgttagctcaaaagcatacaatcgataaagatatgtatcaattatctaaagaattatccatc

SEQ ID NO: 40381 - DNA, 1227 bp, Bacillus thuringiensis
acacttcgtgaagaagcacttcacatgcataaagtgcatcaaggaaaattagaaactgtatcaaaagtaaaagtagaaaatgcaaaagatttaagtcttgcatattctccaggggttgcagaaccttgtaaagaaatttatgacgataaaagtaaggtatatgaatatacgatgaagggaaatatggtagcagttgtgacagatggaacagctgtacttggtcttggtaacattggacctgaagcatctcttccagtaatggaaggtaaagctgtattattcaagagctttgctggtgtagatgcattcccaattgccttaaatacaaacgatgtagataaaattgttgaaactgtaaaattaatggagccaacttttggcggcgttaacttagaagatatcgcagcaccaaactgcttcattattgaagagcgtttgaaaaaagaaacaaatattcctatcttccatgatgatcaacacggaacagctattgtaacagtagcaggtcttgtaaatgcactgaaattagttggaaagaaaatgtctgacattaaagttgtcgcaaatggcgcaggtgcagcaggtattgcaattattaaacttttatatcgctatggtgtacgcgacattattatgtgtgaccgtaaaggggcaatctatgatggtcgtcctacaggtatgaatccggtgaaggatgaagttgcaaaatatacaaataagaatcgtatagaaggttctttagctgatgttgtacaaggtgcagacgtattcattggtgtatctgcagaaggtgcattaacagaagagatggttcgtacaatgaatgacgatgcgattatttttgcaatggcgaatccagttccagaaattatgccagaattggcaaaagcagcgggcgcagctgttgttggaacaggtcgttctgacttcccgaaccaagtaaataatgtactggcgttccctggtattttccgcggtgcacttgacgtacatgcgacacaaattaacgaagaaatgaagatggcagctgtacaggctattgctgagcttgtagcagaagatgagttaaatgcagactatatcattccggcaccatttgacgcgcgtgtagcgcctcaagtagcggcttacgttgcaaaagcagcaatggagacaggagtagctcgccgtcaagtagatccaaatgagatcgctgaaaaaacaaaacaattagcgctgattggtaaa

SEQ ID NO: 40382 - DNA, 978 bp, Bacillus thuringiensis
aatttaaaaggaagaagctttctagcagaaaaagattttacacaagaagaattgttatattttctagatttggcagcagaattaaaagagaaaaagaaaaatggtattccgcatcattatttagaaggtaaaaatgtagcgcttttatttgaaaaaacttctactcgtacgcgttgtgcatttacagtagcatgtacagatttaggggcaaatcctgaatatttagggaaaggtgatattcaacttgggaaaaaagaatctgtagaggatacagcaaaagtgttagggcgtatgtttgacggaattgagtttcgtggatttcatcatgaaaccgtagaatctttagcacaaaattctggtgtaccggtttggaatggattaacagatatgtggcatccaacacaaacactagcagatttattaacaattagagaacatctagggaaattgaaaaatgtgaagctcgtttacgttggcgatggacgaaataatgttgctaatagcttactagttggtggagcaatcgttggaatggatgtatgtatttgtacaccggaatctttatggcctgcacaagaagtaattgatttagcaaaaaaatataatgaacaggtaatgataacaagtaatgtggaagaagctgttgcgaatgcagatgtaatttatacagatgtatgggtgtctatgggggaagaagaaaaatttgctgaacgtgtcgagttattgaaaccttatcaagtaaatatgaaaatgattaaagcaacagggaatgaaaacgtgattttcttacattgtttacctgcatttcatgatgttgaaacgatgtatggcgaagaagtttatgagaaatatgggttgaaagaaatggaggtaactgacgaagtattccgcagtaaacattcaaaagtatttgatcaagctgaaaatagaatgcatacaattaaagcggttatggcagctactttaggaaatatggag

SEQ ID NO: 40383 - DNA, 1230 bp, Bacillus thuringiensis
atgaaacatccgatacatgttacttcagaaattggggaattacaaacggttttattaaaacgaccgggtaaagaagtggaaaacttgacgccagattatttgcagcaattattatttgacgatattccatacttaccaattattcaaaaagagcatgattattttgcacaaacgttacgcaatcggggtgttgaagttctttatttagaaaaactagccgctgaggcgttagtagataaaaaacttcgagaagaatttgttgatcgtattttaaaagaaggacaggccgacgtaaatgttgcacatcaaactttaaaagaatatttactttccttttcaaatgaagaattaattcaaaaaattatgggtggtgtacggaaaaacgaaattgaaacaagtaagaagacacatttatatgaattaatggaagatcactatccgttttacttagatccaatgcctaatttatattttactcgtgatccagcagctagcgtgggcgatggcttaacgataaataagatgagagaaccagcgcgtagacgtgaatcattattcatggagtacatcattaaatatcatccaagatttgcaaaacataatgtaccaatctggttagatcgtgattataaatttccaattgaaggtggcgacgagctaattttaaatgaagaaacaattgcgattggagtatctgctcgtacttcagctaaagcaattgaacgtttagctaaaaatctctttagccgacaaaataaaattaagaaagtgttagcaatagaaattccaaaatgtcgagcatttatgcatttagatacagtatttacaatggttgactatgacaagtttacaattcacccagccattcaaggaccaaaagggaatatgaatatttatattttagaaaaaggatcagatgaggaaactcttaaaattacacatcgtacgtctttaatggaagcattaaaagaggtattaggcttaagtgaattagttcttattccatgtggaggaggagatgtaattgcttctgctcgtgaacaatggaatgatggctcgaacacattagcaatcgcgccaggtgtagttgttacatatgatcgcaactatgtatctaatacgttattacgggaacacggtatagaagtgattgaggttctaagttcggaattatctcgtggtcgtgggggtccacgttgcatgagtatgccaattgttcgtaaagatatt

SEQ ID NO: 40384 - DNA, 882 bp, Bacillus thuringiensis
aaggaaatctcagttattggagttccaatggatttaggacagatgcgtcgtggagttgatatgggaccgagcgcgatccgttatgcaggggtaattgaaagaattgaagaaattggatatgacgttaaagatatgggagatatatgtatagagagagaaaaagagatagatgaaaatacaaaattaagaaaccttacacaagttgcaactgtatgtaatgaattagcaagtaaggtggatcatattatagaagaaggtcgttttccacttgtattaggtggtgaccatagtattgctatcggtacattagctggtgtagcaaaacattataaaaacttaggcgttatttggtatgatgcacacggtgatttaaatacagaggaaacttcaccatctggaaatattcatggtatgtcacttgcagcaagtttaggttatggacattcttcacttgtagatttatacggagcatatccaaaggtgaaaaaagagaatgtcgtaattatcggtgcgcgtgcattggatgaaggagaaaaagatttcattcgcaatgaaggtattaaagtgttctcaatgcatgaaattgatcgtatggggatgacggctgttatggaagaaacaatcgcatatttatctcatactgatggtgtacacttatcattagatttagacggtcttgatcctcatgatgcaccaggtgttggaacgcctgtaattggcggtctatcttatcgtgaaagtcatttggcgatggaaatgttagcagaagctgatattatcacatctgctgaatttgttgaggtaaatacgattttagatgagagaaatagaacggcaacaacagcagttgctttaatgggttctttattcggtgaaaaacta

SEQ ID NO: 40385 - DNA, 1344 bp, Bacillus thuringiensis
atgggtaaatattttggtacagatggagtacgcggagttgcaaataaggagttaacacctgaattagctttcaaaattggacgttttggtggttatgtattaacaaaagatacagatcgtccaaaagtaattattggtcgtgatacacgtgtatctggccatatgttagaaggagctttagtagcagggctattatcaactggagcagaagtaatgcgccttggcgttatttctacaccgggcgttgcttatttaacaaaagcactagacgcacaagcgggtgttatgatttctgcatctcataatccagtacaagataacggtattaaattctttggttcagacggctttaaattaacagatgagcaagaagctgagattgaagctttattagacaaagaagttgatgaactaccacgtccgacaggtactaatcttggacaagtgagtgattactttgaaggtggacaaaaatatttacagtacattaaacaaactgttgaagaagatttctctggcctacatatcgctttagattgtgcacatggtgcaacttcttctcttgctccatacttatttgcagacctagaagctgatatttcaacgatgggaacttctccaaatggtatgaatattaatgagggtgtaggatctacacatccagaaggcttagctgaattggtaaaagaaaaaggtgcggatatcggacttgcttttgatggcgatggcgaccgtttaattgctgtagacgaaaaaggaaacatcgttgacggtgatcaaattatgttcatttgtgcgaagtacatgaaagaaactggtcaattaaaacataatacagttgtttcaactgttatgagtaacttaggtttctacaaagcacttgaagcaaataatattacaagtgataaaacagcagttggtgaccgctacgtaatggaagaaatgaagcgcggaggttacaacctaggtggagaacaatcaggccatattatcttacttgattacattacaactggtgatggaatgttaagtgcacttcaacttgtaaacatcatgaaaatgacgaaaaagccattatctgaacttgcaggggaaatgacgaaattcccacaattgctagtaaacgttcgtgtaacagataaaaaattagcattagaaaatgaaaaaattaaagaaattattcgtgttgtagaggaagaaatgaacggtgatggccgtattcttgttcgcccatctggaacagagccacttattcgtgtaatggcagaagcaccaacacaagaagtttgtgatgcatatgtacatcgcattgtagaagttgtgaaagccgaagttggcgctgaa

SEQ ID NO: 40386 - DNA, 1800 bp, Bacillus thuringiensis
atgtgtggaatcgtaggatttattggagagcaagatgcaaaggaaattttattaaaaggtttagaaaagctagaatatcgtggatatgattcagcaggtattgcagtacaagcagagaacggtgttgttgtatacaaagaaaaaggccgtatcgcaaaacttcgtgaaatcgtagatgagaacgtagcagcaagcgtaggtatcggacacacacgctgggctacacacggtgttccaagtaaagtaaacgcgcatccgcatcaaagtacatcaaaacgctttacattagttcataacggtgtaattgaaaactatgaattagtgaaaaaggaatatttacaagatgtaacgttcgtaagtgaaacagatacagaggttatcgtacagcttatggaacaacaagtgagcacaggattaagtgtagaagaagcgttccgtaatacgctatctcttttacatggctcttatgcaatcggattacttgatgctgaaaatccaaacatgatttatgttgctaaaaacaaaagcccgctattagtaggtgttggtgacaactttaatgttgtggcaagcgacgctatggcgatgttacaagttacagatcaattcattgagttaatggataaagaaatcgtaatcgtaacgaaagaaagtattacaattaaaaacttacaaggtgaaacgattgaacgtgcaccgtttacagcggaattagacgcaagtgatattgaaaagggaacatatcctcatttcatgcttaaagaaatcgatgagcaaccacttgtaatccgtaatataattcaaaagtatcaagatgaaaatggcgaaattgaattaaatcaagacatccgcaatgcgattttagatagcgatcgcatttacatcattgcatgtggaacgagttatcatgcaggtcttgttggaaaacaatttatcgagaagtttgcaaaaatgccagttgaagtacacgtggcaagtgaattctcttacaacatgccattattaacagaaagaccattcttcatttacatttcacaaagtggtgaaacagctgatagccgtgcagtacttgtacaaacaaatgaaatggggcataaagcattaacaattacaaacgtgcctggttctacgctttctcgtgaagctgattatacacttccgttatacgctggaccagaaattgcagttgcatcaacgaaagcttacacagcacagcttgcagtactttcaattttagcggctgatattgctaaagcaaaaggtgaagttcttgatttcgatttaacacacgaactaggacttgtagcaaatgcaatgatagaactttgtgatcaaaaagaagaaatggacgcattagcaaaacaatttttagcaacaacgcgtaactgtttcttcatcggccgtagcgtagacttctacgtaggattagaaggtgcgttaaaactaaaagaaatctcttacatccaagcagaaggattcgctggaggagagttaaaacacggtacaatcgctttaattgaaaatggtacaccagttatcgcacttgctacacaagagcacgtaaaccttggaattcgtggtaacgtgaaagaagtagtagcacgcggggctaacccatgtatcatctcaatgaaaggcttagaaatggaaggtgacagcttcgtattaccagctgtacacgaagcgctagcaccgctagtagcagttattccattacaacttatctcatactacgcagcacttcaccgcgagtgtgacgttgataagccacgtaacttagctaagtctgttactgttgag

SEQ ID NO: 40387 - DNA, 771 bp, Bacillus thuringiensis
atgaaccaattaaaaaataaagtagcagttattacaggggtaagtcgtctagatggtataggggcagcgatttgtaaagaattagctgaatcaggatacgatatattttttacgtattggacagcttacgataaagagatgccttggggcgttgataaaaatgaacaaatacaattaaaagaagagttactaaaaaacggtgttaaagtatcaagtatggagttagatttaactcagaatgatgcaccaaaagagcttataaataaagttactgaacaattagggtaccctcatatattaattaataatgcagcatattctacgaataataatttctctacgttgactgctgaagaattagataagcattatatggtaaatgttcgtgcgactacattgctcagtagtcaattttcccggggatttgataagaaatctggtggtagaattgttaatattacttcggggcaatttcaaggtcctatggcaggagaactagcttatgcgacaacgaagggagctattgatgctcttactagtacgttgtcagcagaggtagctcatttaggaataacagtgaatgcaattaatccaggaccaaccgatacaggatggatgactgaagagataaaacaagggttaaagccgatgtttccttttggcagaattggtgagccaagggatgcagctagactcattaaatttttagtaagtgaagaggccgagtggattactgggcaagttattcattcagaaggtggatttaaaaga

SEQ ID NO: 40388 - DNA, 1191 bp, Bacillus thuringiensis
acaatcatgattcaaactaaggatattatcgaacttacagacacatacggagcaaataactatcacccacttccaatcgttatttctaaagcagaaggtgtttgggtagaagatcctgaaggaaaccgctatatggacttattaagtgcatattctgcagtaaaccaaggtcatcgtcacccgaaaattattaacgctttaattgaccaagctaatcgtgttacgttaacttctcgtgctttccatagcgatcaattaggtccttggtacgaaaaagttgcgaaactaactaataaagaaatggtacttccaatgaatacaggtgctgaagctgttgaaactgcaattaaaacagttcgtcgctgggcttacgatgtgaagaaagtagaagcaaaccgcgctgaaatcatcgtttgtgaagataacttccacggacgtacaatgggttctgtttctatgtcttcaaacgaagagtacaagcgtggattcggtccaatgcttcctggcatcgttgtaattccttacggtgatttagaagcattaaaagccgcaattacaccaaacacagcagcattcattttagagccaattcaaggtgaagcaggaattaacatcccaccagctggttacttaaaagaagcttttgaagtatgtaaaaaagaaaacgttttatttgtagcagatgaaatccaaactggcttaggccgtactggtaaagtatttgcttgtgactgggacaatgtaactcctgacatgtacatacttggtaaagcacttggcggcggcgtattcccaatctcttgcgtagcagcaaaccgcgacattttaggcgtattcgagccaggttctcacggttctacattcggtggtaacccacttgcatgtgctgtttctatcgcagctcttgaagtgttagaagaagaaaaattaacagagcgttctcttcaattaggtgaaaaattagttgggcaattaaaagagattgataacccaatgatcactgaagttcgcggtaaaggtttattcatcggtatcgaattaaacgaaccagctcgtccttactgtgaacaactaaaagcagctggtctactatgtaaagaaacacatgaaaacgtaattcgtatcgcaccacctctagtaatctctgaagaagatttagagtgggcattccaaaaaattaaagctgtatta

SEQ ID NO: 40389 - DNA, 2037 bp, Bacillus thuringiensis
ggtttttatcagcttcataaagataaagaggcattagaagtctttatggaagaagctagagagaataccgttccttttaatagcgtggcagagcgaatggagtatatgaaagaacatgattactattacaacgttctggacgagtatagcttggaggaagtagaggaagtatataacatcgcttatggtgaaaacttcgagttccaatcttatatggcagcatctaagttctacaaagattatgcgttaaaaacgaatgatcaaaaacaatacttagaaagctatgaagatcgtgtagcaattgtttcattatacttaggacgcggtgatgtttcgaaagcaagacaattcgcaagcatgattgtaaaacaaaactaccaaccagcgacaccaacctttttaaatgcgggaagaagcagaagaggagaaatggtgtcttgtttcttgttagagatggatgatagcttaaattcaattggctttaacattaatactgcgatgcaattatcaaaaatcggcgggggagtagctttaaacttatctaagctacgcgcacgtggtgagcaaattaaaggtatcgacaacgctgcaagtggcgtagtacctgttatgaaattgcttgaagattcgttttcatatgcgaatcagcttggccaacgaaaaggtgccggtgcagtatatttaaacattttccattgggatattattgaattccttgataccaaaaaaataaatgccgatgagaagagccgtattcagtctctatcaatcggaattatcgttccaagtaagttctttgagcttgctgagaaaaacgaacctttccatgttttcgcgccttatacggtttataaagaatatggcaagcatttagatgatattgacattgatgaaatgtacgatgaattaatgagcaatccgaaagtgaagaagaagccactagatattagtgcacgtgatatgcttattaaaatcgctatgattcagcttgagtctggttacccatacttaatgtttaaatcaaatgcaaataatcaacatccattgaaggatattggaactgtgaagatgtcgaacttatgtacagaaatcttccagcttcaagaaacttcagaaataaatgattacggtacagatgacattatccgtcgtgatattaactgtaacttaggatcgttaaatattgtaaacgtaatggaaaataaagaaattcgtgaagcagttcatgcgggaatggaagctttaacagctgtttctgatatgacgattattccgaatgcaccaactgtgaaaaaagcaaatgacgagcttcattcagttggacttggagcaatgaacttacacggatatttagcaaaaaataaaatcgcttatgaaagtgcagaagcgaaagaattcgctcgtacattctttatgatgttaaattactattctattgagaaaagtatggaaatcgctacagaaaaaggcgagacatttaaagacttcgataaatctgattatgcgaatggcacatacttcgaaaagtatgaaacgacagattacagtcctgtaactgaaaaagttcagcaactatttgaaggaattcatattccgacaaaagaagattggacaagtttaaaagagcaagtgcagaagaatggtttatacaactcatatcgtcttgccattgctccaacacaatcaatcagttacgttcaaaatgcaacttcaagcgtaatgccgatcgtaagtcaaatcgaatcaagaacatatgcgaatgcgacaacatattatccaatgccgtatttatcaaaagatacgttctggtactataaatcttcttacgatatgaatcagtttaaattaattgatttaatcgcagaaattcaagaacatattgaccaaggaattagtacaattctttacgttaatagtgatatttcaacacgtgaattagcacgttactacatctatgcacataaaaaaggcttaaagagtctgtattatacgagaacacgtaaattaagcgtggaagagtgtgtggcttgtaccgtt

SEQ ID NO: 40390 - DNA, 936 bp, Bacillus thuringiensis
atgaaaagacatacaagaaaaattgcaattatcggtactggattagttggatcaagttgtgcgtattccattgtaaatcaagggatttgtgaagagctattattaattgatataaatcatgaacgtgcagttggggaagcaatggatttatcacattgcattaactttacaaatacaagaacaaaagtatatgcaggaagctatgaagactgcaaagatatggacattgttattattacagcagggccagcaccaaaaccagggcaaagtcgcttagatactttaggagcgagtgcgaagattatggaaagtgttgttggcggcgtaatggaaagtggatttgatggtattttcttacttgcatcgaacccagttgatattattacatatgaagtgtggaaattatctggattacctagaaatcgcgtaatcggtactggtacatcactagattcttctcgcttaagaacaattttatctgaaatgctacatgtagaccctcgtagtattcatgggtattcattaggagaacatggtgattctcaaatggttgcttggtctcatgtaactgttggtggaaagccaattctgcaaattttagaagaacaaaaagaacgatttggtgaaatagatttagatgaaattgttgagaagactgcaaaagctggttgggaaatttataaacgtaaaggaactacttattacggaattggaaattctctagcatatattgcgagttcaatctttaatgatgatcaccgtgtcattgctgtatcagccattttagatggtgagtatggtgaatatgatatttgtacaggagtaccagctattattactagagacggtataagagaagttgtagaactcaatttaacagaggatgaagaatctcgattcgcaaaatcaaacgatattttacgtgattatatgaaa

SEQ ID NO: 40391 - DNA, 1782 bp, Bacillus thuringiensis
atggaaaaaacagtaggaaatgcggttaaaggcggtagctttttagtagatgagattacgattgatcaagtgtttacgccagaagatttttcatctgagcataaaatgattgctaaaacgacagaggactttatcgtaaatgaagttcttccagagcttgaatatttagagcaacatgagtttgatcgttcagttcgtcttttaaaagaagctggagaacttggtttattaggcgctgacgtaccagaagagtacggcggaattggtcttgataaagtaagctcagcgttaatcgcagagaaattctctcgcgctggtggttttgcaattactcacggtgctcacgtaggtatcggatctttaccaatcgtattattcggtaacgaagagcaaaagaaaaagtatttaccattacttgcaactggtgaaaaattagctgcatacgcattaacagagccaggttcaggatctgacgcattaggcgcaaaaacaactgcacgtttaaatgcagaaggtacacattatgtattaaacggtgaaaaacagtggattacaaactctgcattcgctgacgtattcgttgtatatgcaaaaatagatggcgagcacttctcagcatttatcgtagagaaagactacgctggcgtatctacaagcccagaagaaaagaaaatgggtattaaatgttcttcaactcgtacgttaattttagaagatgcgttagtaccgaaagaaaacttacttggcgaaatcggtaaaggtcatattatcgcattcaacattttaaatatcggtcgttataaattaggtgttggtacagttggatctgcgaaacgtgcagtagaaatttcagcacaatatgcaaaccaacgtcaacagttcaaacaaccaatcgctcgcttcccattaattcaagagaaacttgcgaatatggcagcaaaaacatatgcagctgaaagctctgtatatcgtacagtaggtttattcgaaagccgcatgagcacattatctgaagaagaagtaaaagatggtaaagcagtagcagcttctatcgctgaatatgcaatcgagtgctctttaaacaaagtatttggttctgaagtattagactatacagtagatgaaggtgttcaaattcacggtggttacggatttatggcagaatacgagattgaaagaatgtaccgtgattctcgtattaaccgtattttcgaaggaacgaacgaaattaaccgcctaattgtaccaggtacgttcttacgtaaagcgatgaaaggtgaattaccacttcttcaaaaagcacaaaaattacaagaagagttaatgatgatgatgccagaagaagtaggcgatgagccattagcacttcaaaagtatttagtaactaatgcgaagaaaatcggcttaatggtagctggattagcggctcaaaaatacggtaaagcattagataaagagcaagaaattcttgtgaatatcgctgacatcgtaagcaacctatacgcaatggagtcagctgttcttcgtacagaaaaagcaattaaaacaactggtcttgaaaagaataaacaaaaagtgttatacactgaagtattctgccaagaagcattcaacgaaatcgaagcagatgcgaaagaaacacttatcgcagttgaaaatggcgacatgctgcgcatgatgttatcatcattacgtaaattaactcgccacacaccacttaacgtaattccgaagaaacgtgaaatcgctgcgaaaattttagaagatgagcgttatacagtt

SEQ ID NO: 40392 - DNA, 1167 bp, Bacillus thuringiensis
atgagagaagctgtcattgttgcgggagcaagaacaccaattggaaaagcaaagaggggttcattaaaaacagttcgtcctgacgatctaggggcgttagtagtaaaggaaacgttaaagcgtgcgaattatgaaggaccaatcgatgatttaattttcggttgtgcgatgccagaagcagagcaaggtttaaatatggctcgtaatatcggcggattagcaggactttcttacgatgttccagctattacgattaaccgttactgttcttcaggtttacaaagtatcgcttacggagctgagcgtattatgcttggtcactctgaagctgtattatcaggcggagcagaatcaatgagtttagttccaatgatgggacacgttgttcgtccgaatagtcgccttgtagaagcggctccagaatattatatgggtatgggacatacagcagagcaagttgctgtgaaatatggaatttctcgtgaagagcaagatgcatttgcagtaagaagtcatcaacgtgctgcgaaagcattagctgcaggaaactttgctgatgaaacagtacctgtagatgtgacgttacgctcggttggatcaaacaataaacttcaagaagaaacaatcactttcgcacaagacgaaggtgtaagagcagagacgacactagacattttaggaaaattacgtccagcatttaacgttcgcggttctgtaacggctggtaactcttcacaaatgagtgatggtgcagcatctgtattattaatggatcgcgaaaaagcagtgagcgatggcatgaagccacttgcgaaattccgttcatttgcagtagctggcgtaccaccagaagtaatgggaatcggcccaatcgctgcaattccaaaagcgttaaaactagctggcttagagttatctgatattggcttattcgaactaaatgaagcatttgcttctcaatccattcaagttattcgtgaacttggtttagatgaagaaaaagtaaacgtaaacggtggtgcaatcgcacttggacatccacttggctgtacaggagcaaaactaacactatctcttattcacgaaatgaaacgccgcaacgaacaatttggtatcgtaacaatgtgtatcggcggcggaatgggagcagcgggagtatttgaatta

SEQ ID NO: 40393 - DNA, 777 bp, Bacillus thuringiensis
atgtggaattatgaagcggaggaagcaaaagctgtcattgttattgtgcacggcgcaatggaatatcacggacgttacgaagccgttgcggaaatgtggaatcatatcggctaccacgtcgtgatgggggatcttccgtcacatggaacgacttcaagaaatagaggacatattgattcatttgatgaatacatagaggaagttaaattatgggtgaaagaagcaagaaagtataggttacctatttttctattcggtcatagtatgggtggtcttattgtcattcgtatgatgcaagaaacgaagagagaagatgtagagggtattattttgagttcgccttgtttaggggtagtgactggaccctctgctccgcttcaatttgcttcaagaatattaaatgttgtggctccaaaattgcaatttgcaacgaatcttacggtggaaatgtcaacacgtaaccatgaagtgagagatgcaatggagaatgattctttgttcttgcgcaaagtatcagtacgttggtatagtgaattgattaagtctatcgaaattgctcataaaaaaatagatgattttccagatgttccgctcttgctaatgcaagcttgtgaggataaacttgtagataaaatacgtgtccgcacttggtttgataatgttaaaataagtgataaggcttttaaagaatggccgaattgttatcacgagctattaaatgagtatgagcgtgatgaaattttgagttatattcagtcatttactgaaatgcatgtc

SEQ ID NO: 40394 - DNA, 1072 bp, Bacillus thuringiensis
gtagctattgaaacaactgtaacaactggtttagggttgttagcgggggaaagggggacttctacttacgtagatattccgaaaatcgttcgtgaaacaattcaaggcattggttacacacgcgcaaaatacggattcgatgcagaaacttgtgctgttttaacatctatcgatgagcagtctgctgacatcgctatgggtgttgaccaagcgctagaagcacgcgaaggtcaaatgactgacgctgagattgaggcaattggtgcaggagaccaaggtttaatgtttggttttgcatgtaatgaaacacaagaattaatgccacttccaatctcgcttgctcacaaattagctcgccgtttaactgaagtacgtaaagatgatacattatcatacttacgtccagatggaaaaacgcaagttacagttgagtatgatgaaaatggtaaaccagtacgtgttgatactatcgtaatttctacacaacatcatccagatgttacatgggaagaaatcgatcgcgacttaaaagagcacgtaattaaagctgtagtaccagcagaattaatggatggagaaacgaaattcttcattaatccaactggccgcttcgtaattggtggaccacaaggtgatgctggtttaacaggacgtaaaatcatcgttgatacttacggtggatacgctcgccacggtggcggggcattcctctggtaaagatgcaacgaaagttgaccgttctgcagcatatgcagctcgttatgttgcgaaaaacatcgtagcagctggtcttgctgaaaaagcagaagtacaacttgcatacgcaatcggtgtagcacaaccagtatcaatttcagttgatacattcggcactggtaaagtatctgaagacgtactagtagaactagttcgtaacaacttcgatcttcgcccggctggtattattaaaatgttagacttacgtcgcccaatttacaaacaaacagcagcttacggccacttcggacgtactgatgtagatctatcatgggaacgtacagacaaagctgcagctttaaaagagcaagctggt

SEQ ID NO: 40395 - DNA, 1374 bp, Bacillus thuringiensis
atcgtggccaacctatttaaaaagaaatccgttacgcaattgttaggggaaagtaaaagtaaaactttgacgaaaacgctaggggcatttgacctaacaatgctagggattggtgcgataattggtacaggagttctagtattaactggattagtagcagcaagagatgctggtccagcagttattttttcattcatgattgcagccatcgtttgtggatttgcagcattatgttacgcagaggttgcttctacacttcctgtttcaggtagtgtgtacacatactcatatgcaacaattggtgagtttgtagctcatttaatgggatggacattactatccgtatatgttgtaacgactgccgcagtagctggcggatggactggttacttccataacttagtgagtggattagggcttgaaattccaaaagcactgctaacgattccgtctcaaggtggtatagtgaatttaccagcagttatcgttacattagttataacttggttattatcaagaggtacgaaagaaagtaaacgagtgaataacataatggtattaattaaaattggtatcgttgttttattcattgcagttggtgtattctacgtgaaaccagaaaactggataccatttgcaccgtatggtttaagtggagttttcgcggggggagcagcagtattctttgctttcttaggatttgatgcattagcaacttctgctgaagaagtaaaaaatccgcaacgtgatctaccgattggtattatcgcttcgttagtcatttgtacaatcatttatgttgtagtttgtctcgttatgacgggtatggtttcatataaagagctagatgtaccggaagcgatggcgtatgtgttagaagttgtaggacaagataaagtagctggtataatcgcaattggagctgtaattggtattatggcagtaatttttgcttacatttatgcaacgacacgtgtattcttcgctatgagccgtgacggtttattgccagaatctttcgcgaaaattaataaaaagacagaagcaccaacatttacagtttggttaacaggaattggtagtgctttaattgctggatttatcgatttgaaagaattgtcgaatttagcgaatattggagcgttgttaacatttgcgatggttggtgtgtcagttattattcttcgtaaaacacatccaaaattacaacgtggatttatggtaccacttgtaccgatcttgccgattatttcaattgcatgttgtctattcttaatggtaaacctaccattaaaaacatggatgtacttcggtgcttggttagcaatcggagtagttgtatactttgtttattcgaaaaaacatagtcattta

SEQ ID NO: 40396 - DNA, 2934 bp, Bacillus thuringiensis
atggcagaacagacagtccgtgtaaccgtcgatggtaaagaattttctgcatcaggtgaaaagacgatactacaattatttaacgagagtaatttggaacatcctcaaatttgtcatgtaccagaagtagatccaattcaaacttgtgatacgtgtattgtagaagtaaatggaaagttattgcgtgcttgttcaacgaaattagagaacggtatgcatatcgaaagacagtcccagcgtgcaaaagaggcacagactgaggcaatggatcgaatattagaaaatcatctattgtattgtaccgtttgtgataacaataatggtaactgtaaagtccataatacagtacatatgatgggaattgaggaacagaaatatccgtatgagccaaaagtaagtgcgtgtgaagtggatatgtcacatccattttatcgatatgatccaaatcaatgtattgcttgtgggcagtgtgtagaagtatgtcaaaacttacaagtgaatgaaactatatcgattgattggagcttagaccgtccacgtgttatatgggacaatggtgtaagtataaatgactcatcttgtgtaagttgtgggcagtgtgtaacagtatgtccatgtaatgcgttaatggaaaaaacaatgctgggtgaagctggattcatgacaggattgaaaccggatgtgttagatccgatgattgattttgtaaaggatgtagagccgggatatagtagtattttagcagtttcagaagtagaggctgcgatgcgtaagacgaaagtgaataaaacaaaaacagtttgtacattttgtggtgtaggttgttcatttgaagtatggacgaaagaccgccacattttgaaagtgcagcctgtttcagatgcgccggttaacggtatttccacatgtgtaaaaggcaaatttggatgggattttgtaaacagtgaagatcgtattacaaagccattaattcgccaaggagatacgtttgttgaagcttcatgggaagaggctctggaagttgttgcatccaatatgcagcatattaaatcagaatatggaagtgatgcatttggatttatttcttcttcgaaagtaacgaatgaagaaaattatcttatgcaaaaactagcccgtcaaatatatggaacgaataatgtagacaattgttcccgttattgtcaatctccagcaacagacggtttatttaaaactgtcggtatgggcggggacgctggaacagtgaaagatattgcggaagcaggccttgtcattatcgttggagcaaatccaacagaaggacatcctgtacttgcaacgcgtgtaaaacgtgctcataaattacatgaccaaaaattaattgtggcagaccttcgtaaacatgaaatggcagagcgtgcggatttattcattcatccgcgccaaggaactgattacgtatggctcgctggtattacgaaatatattattgatcaagattggcacgataaaaagttcatagctgaaaatgtgaagaattttgatgaatatagcaaaatggtagaaaagtatacgcttgattatacagaagaaattacggggatttcgaaagaaaatctgaaagaaatggctcgtatggtatatgaagcagatggtacttgtgtactttggggaatgggtgtaactcaaaatactggaggaagtacaacttcagcagcaatttcaaatctattgcttgttacgggtaactatcgtcgtcctggtgcaggagcatatccattacgcggacataataacgtacaaggcgcttgtgatatggcaacattaccaaactggcttccaggttaccaagcggtttcagatgatgcgctccgtgcgaaatttgaaaaagcatacggtactacaattccgaaagcaccaggtttaaataatattgcaatgttacttgcggcagatgaaggaaaactgcgtggtatgtatgttatgggtgaagaaatggctttagtagattcgaatgccaaccatgtacaacatattttagcgaatttagatttccttgttgttcaagatatgttcttatcgaaaacagctcgttttgctgatgttattttaccggcagcaccaagcttagaaaaagagggaacatttacgaatacagagcgccgtattcaaagattatatgaagtattgaagccgcttggtgattcaaagccagactggtggattttacaaaaagtagctcgtgcacttggcggggactggaattatgaaaatccaagtgaaatcatggatgaaattgcatcgcttgcacctttatattctcaggcaacatacgatcgtttagaaggatggaatagtttatgttggggtagccatgatggtagcgatacaccgctattatatgtggacggatttaacttcccagataaactagctcgtctatcattagatgaatgggtaccaccagttgtagcaccagatgagtatgatttacttttaaataatggtcgtatgttagaacatttccatgaagggaatatgacgaataaatcggctggtattttatctaaagtatctgaagtgttcgttgaaatctcgcctgaacttgccctagagcgcaatgtgaaagatggtggccttgtagaattagcatcaccatttgggaaaattaaagtacaggcacttgttacagatcgtgtaacggggaaagagctatatttaccgatgcatgcaacggtaaatgaagaggcaatcaatattttaactggaacggcgacagatctttatacgtgtacaccagcgtacaaacaaacgatggtaaagatgcgtgtactacgtgaaaaagggaatcgtccgttaccatcttcaaacccgagagataaaaagcgtaatccgcaaaatggtgttgaaatccagcaaaaatggcaaagaaaacaatacgtatcacttgtggac

SEQ ID NO: 40397 - DNA, 1173 bp, Bacillus thuringiensis
aaaatgaatcaaacgtggcgggcgcaccttcaatctaaattacaacaattacatgagcaagggcagtatcgtgatttgcatgtaacagagaaggcagaagagacttggcttattcgagataaaaaaaagatgttaaatttagcgtcaaataattatttagggttagctggagatgaaaggttaaaagaagctgctattgcctgtacaaaaagatatggaactggagcgactgcctctcgtctcgttgtaggaaatcatccattatatgaagaggttgagagaagcatatgtgactggaaaggtactgaaagagctttaattgtaaatagtgggtatacggcaaatataggtgccatatcttctttggcctctcggcacgatattgtttttagtgataagttaaatcatgcaagtattgttgatggaatcctattaagcggggcagagcataaaaggtatcgtcataatgatttggatcatttagagaagctgttgaaaatggcttcgcctgaaaaaaggaaattaatcgtaacagataccgtttttagtatggatggtgatactgtgtatttaagagatttagtacagctgaaagagaaatacggggcaatcattatagtcgatgaagcacatgcgagtggaatatatggaatcggcggagctgggttatctcatatagaaaaaaatcttgctcaaaaaattgatatacatatggggacgtttagcaaggctttagggtgttatggtgcgtatttgacaggtgatgaaatttatatagagtatttacaaaatatgatgagaagctttatttttactacagctttaccaccaagtacgttaggagcagtgcaaaaagcaattgaaattgtaaaagaagataacgaaagaagagagaaccttatagcaaacggagaatacttcagaactaaattaagggatgctggttttgatattgggaatagttcaactcatattgtaccgattgtagtcggttcaaatgaacatgctttacgatttagtaaaaggttgcaagaggcagggattgcggccattgcaattcgtccgccaactgtgccggttcatagttctcgaattcgctttgcagttacatcgcaacatacaatagctgatttaaaatgggctattgatcgaattattcacattgcgaaagaa

SEQ ID NO: 40398 - DNA, 1338 bp, Bacillus thuringiensis
gaattagcagagaaaaataaagcttacgtatggcacccatttacacaaatgaaagattatttagaagaagatcctgtcattattgaacgtggagagggaagaaagctatacgatgtaaatggtaatgaatattgggatggtgtttcatctatatggttaaatgttcacggacatcaagtaccggaattagatgaagcaattcgtgagcaattaaataaaattgctcattctactatgttaggacttgctaatgttccatctattttattagcagaaaaaattattgaggttgtaccagatggattgaagaaggtattctattctgattcaggttctaccgctgttgaaattgcaattaagatggctttccaatattggcagcataaagggaaaccaaagaaacaaagattcgttacattaaaagaagcatatcacggtgatacaattggagctgtttcggtaggagcaatagacttgtttcaccaagtgtatagttcgctcttatttgatgcgattaaaatgccgtatccatatacatatcgttctccttacggaaataataaggaggaaattgtaaaaagccatttagaagaaatggaagaattgttgaaagaaaagcatgaagaagtagctgccatcattgtagagccattaatgcaaggtgctggcgggatgattacaatgccaaaaggatatttaaaaggactgcgcgatttatgtactaagtacaatgtattatttattacagatgaggtagcgactggatttgggcgtactgggaaaatgtttgcatgtgaacatgaaaatgtgacgccagacattttaactgctgggaaaggtttaacaggtggatatttaccaattgcagttacggtaacgacggatgaaatatataatgccttcttaggagaatatgaagaacaaaaaacatttttccatggacatagctacacaggcaatccgttagggtgtgccgtagcaatcgcgaatctagaactatatgaaaaaacaaatttaatagaagaagtggcacgtaaaacggattatgtggcagcgcaattagaaaagctctttgcgtataaacatgtaggtgatattcgtcagtgcggattaatggttggtattgagcttgtgaagaataaggaaacgaaagaagcgttcgactggacagaaagagtcggtgttcaagtatgtaaacgctcaagagagctgggtatgattttgcgcccgctcggcaacacgattgtatttatgcctcctcttgcttctacaattgatgagattgacgatatgttacgtattttatataaagcaatctcggatgttacggagggagaa

SEQ ID NO: 40399 - DNA, 924 bp, Bacillus thuringiensis
gtaccgaaattaaatacgaaagatcttttaacactagaagaattaacgaaagaagaaattatttctttaattgagttcgctatatatttaaaaaagaataagcaagagcctttattacaaggcaaaatattagggcttatttttgataagcattcaactcgtactcgtgtatcttttgaagcaggaatggtacagctcgggggacatggtatgtttttaagtgggaaagagatgcaaatgggaagaggagaaagcgtttcagatactgcgaaagtattatcgcagtatattgacgggatcatgatacgtacattctcacacgcggatgtagaagagcttgcaaaagaatcgagtattcctgttattaacggtttaacggatgatcaccatccttgtcaagcattggcagaccttatgacgatatacgaagaaacaaatacatttaaaggaataaaattggcttacgtaggtgacggaaataatgtatgtcattcattgttgctagcgagtgcaaaagtcggaatgcatatgactgtggcaacgcctgtagggtatgaaccgaatgaagagattgtaaaaaaagcgttagcaattgccaaggaaacaggagctgaaattgaagttttgcatgatcctgaattagcggtgaatgaagcagatttcatttatactgacgtttggatgagcatggggcaagagggcgaagaagagaagtatactttatttcaaccttaccaaatcaataacgaacttgttaagcatgcgaagcaaacatatcgtttcttacactgtttacctgcccatcgtgaagaagaagtaacaggagaaattatagatggaccgcagtctatcgtctttgagcaagctggtaatcgattgcatgctcaaaaagcgttattagtgagtttatttaaaaatgtagaa

SEQ ID NO: 40400 - DNA, 1128 bp, Bacillus thuringiensis
agtcatctttttcaaacgtatggcagaagaactattgagtttgtaaagggaactggaacgaaagttattgataataacggtaaggaatatttagatttcacatcaggaattggcgtatgtaatttaggacattgtcaccctactgttctcaaaggtgtacaagagcaacttgatgatatatggcatatatctaacctgtttacaaacagcttgcaagaagaagttgcgtcattattaacagaaaatagagaattagattatgtgtttttctgtaatagtggggcagaggcaaatgaagcggctttaaagttagcacgtaagcatactggaaaatctctcgtcgtaacatgccagcagtcttttcacggtagaacatttggaacgatgagtgcaacgggccaagataaggtaaaagaaggatttggtccattacttccatcttttttacatatcccttttaacgatattaaagcattagaggaagtaatgaatgaagaagttgcggcggtaatggtagaagttgttcaaggagagggaggagtaatacttgctgatctatcttttttgaaagagattgaaacattatgtaataagttcggttccttatttattatagacgaagtacaaacggggataggaagaactggaacactattcgcttatgaacaagtgggaatagagcctgatatcgttaccgttgcaaaggcgcttgggaatgggattcctgtcggagcgatgattggccggaaagagctcggagcgtcgtttactgcaggatcacacggttcaacttttggcgggaattacatcgcgatggctgcagcgaaagaagtattgcaagtaagtgaaaaaccatcgtttttaaaagaagtacaagaaaaaggcgagtacgtattagagaagttgcaagaggaattacagcatgtcgaatgtattcaaaatatacgtggtaaggggcttatgattgggattgagtgtaagcatgaagttgcaagttttatagaacaactagaaaacgaaggacttctcgtattacaagcaggtcctaatgtgataagactattaccgccactcattgtcacgaatgaagagttagaacaggcagtatatataataaaaaaagtagtt

SEQ ID NO: 40401 - DNA, 762 bp, Bacillus thuringiensis
atgagcgaatatattgtagtgaaatgcggcggtagtatgttgaatcaattaaaagctgtgttttttgaatgtataaagaaattgcaacagaagtataaagtagtgattgttcatggtggtgggccagaaattgatgccaaattaaaagattgtaacatcaacgtagaaaaaagagatggattacgcgtaacaccaaaagaagttatggatgttgttcaaatggtgctatgcggaagtacgaataaaaaactcgtaatgaatttacaaaagcataatttacttgcggtaggttgttcaggatgtgacggcaatttacttcaagttcaacctgtcagtgaagagataggatatgtgggggaagtaagttatgtagaaacagccttattaaaaggattaatgaatatggagtatattcctgttattgctccaatcggggtaaatggtaatgaagtttataacataaatgcggacaatgctgcagctgggattgcggctgcgttaggggcaaaagagcttatttttattacggatgtagatggaatattacatgaagggaatttggtaaaggaaacggatgaatctgaaattgctacttttatagaaacaggtgttattacaggtgggatgattccgaaagtacaggcggcactagcatcattaaaaatgggagtgcaaaagataagtattgtgaatggtacaaaagattttactgaggttacgggagagtgtattggaacgacggtaacgaaaggtgtgagtatt

SEQ ID NO: 40402 - DNA, 1206 bp, Bacillus thuringiensis
aaagtagcgtctattacaaaattagaaaatggttcaattgtaacgccgaaaggcttttcggcaattggtactgcaaatggtctgaaaaaggatttaggggcaatcgtttgtgacgtaccagcatcatgtgccgctgtgtatacaacgaatcaaatacaagcagcccctttgcaagtaacgaaggatagtataacggcagaagggaagttacaagcaattatcgttaatagtggaaatgcaaatgcttgtactggaatgaaaggattacaagacgcatacgagatgcgcacattaggggcggaacattttggattgaaagaaaattacgttgcagtagcttcaacaggtgtaattggtgttccgctaccgatggatataatccgaaagggagttgcaactcttataccgacgaaggaagaaagtgaagcatattctttttctgaagcaattttaacgacggatctcataacgaaagaaacttgctatgaaatgattattgatgggaagaaagtgacgattgcgggtgttgcaaaaggttcagggatgattcatccgaatatggcaacgatgcttagttttattacgacagatgctcatatagagcatgacgtattgcaaacggcattatcccaaattacgaatcatacatttaatcaaattacggtagatggagatacttctacgaatgatatggtcatcgttatggcaagtggattatcagaaacaaggccgataaatatggaacatacagattgggaaactttcgtatgtgctttacagaaggtatgtgaagatttagcaaaaaaaattgcgcaagatggtgaaggcgctacgaagttaatagaagtaaatgtgctaggagctcaaacgaatgaagaggcaaaaaaaattgcaaagcaaatagtcggttcgagtcttgtgaaaacagcaatacatggtgaagacccaaactggggacgaattattagcagtattggacaaagtgaagtagctattagtccgaatacaattgacattactcttcaatctatattggtattaaaaaatagtgagcctcaaacattttctgaagaagaaatgaaagagagattacaagaagatgaaatagtcattaatgtgtacttacacttaggagaagagacaggatcagcttggggctgtgacttaagctatgaatatgtgaaaataaacgcttgttatcgtaca

SEQ ID NO: 40403 - DNA, 1032 bp, Bacillus thuringiensis
atgaaagtcgcaattattggagccactggatatgggggcattgagttaattcgtttattagaacaacatccatatttttctatagcatctcttcattctttttcacaagttggtgagtgtataacaaatgtatatccgcatcttcgaaatgtcctcgttcatacgttacaagaaattgatgtggagacaatagggaaagaagcagaaatcgtatttctagcaacaccagcaggagtatcggcggagttaactcccaagttattagcagaaggtttaaaagtaattgacctatctggagactttcgtatgatagatccttcgtcatatgaactgtggtataaaaggccagcagcgaaagaagaaattcttagaaaagcagtgtatgggttaagtgaatggaaaaggactaagattcaaaaggcaaatttaattgcaaacccaggatgttttgctacagccacattgctagcgatagcaccgttagtacgtagtagcaggattgaagaagattcgattattattgacgcgaaatcaggggtatcaggagcaggtaaaacaccaacaacaatgactcattttcctgagctatacgataacttacacatctataaagtaaaccagcatcagcacgttccagagattgagcaaatgcttacagaatggaatagtgagttacagccaattacatttagcacacatttaataccgatatcacgaggaatcatgattacactttatgcaaaagtaaaacaaaagatggaaataaagcaacttcaaaaattgtatgaagaaacgtatgaacaatcgcctttcatccgaatttgtacgcaagggaaatttccaagtccaaaagaagtgagaggctcaaattattgtgatattggcatagcttacgatgaaagaacagaaatagttacggtcgtttctgttatagacaatatgatgaaaggcgcggctgggcaagcgattcaaaatgcaaacataatagcgggactagaagagacaacaggtttacaacatatgccgctttat

SEQ ID NO: 40404 - DNA, 744 bp, Bacillus thuringiensis
atcatgtctattcaaaacatttcctttctcggtgcaggctctattgccgaagctattattggtggcttgttacatgcaaatgtcgttaaaggtgaacaaattactgtaagtaatcgttctaacgagacaagattacaagagctacataaaaaatacggtgtcaaaggtactcataataaaaaagaattacttactgatgcaaatattctttttctagcaatgaaaccaaaggatgttgcagaggcgcttaccccttttaaagaatacataaataataacgtgcttattatttcattactagcaggtgtttctactcactcaattagaaaactacttcaaaaagacgttccaattattcgtgcaatgccaaatacatccgcagccattttaaaatcagctaccgctatctccccttcaaaacatgcaacagcggaacatattcacactgcaacatctttatttgaaacgattggtctcgtctctgttgtagaggaagaagatatgcatgctgtcactgcattatccggaagtggacctgcttatatttattacgtagtggaagctatggaagaagctgcaacaaaaattggtttaaaagaagatattgcaaaatcacttattcttcaaacgatgattggtgctgctgaaatgttaaaagcaagtgacaaacacccttctattttgcgaaaggaaattacttctcctggtggaactactgaggcaggtattgaagtattacaagaa

SEQ ID NO: 40405 - DNA, 696 bp, Bacillus thuringiensis
gtgaaaggaattattttagcaggtggtactggatcgagattatatccaataacgaaagtaacgaataaacatttacttcctgttggtcggtatccgatgatttatcatgcggtatataagctaaaacaatgcgatattacagatattatgattattacgggtaaagagcatatgggggatgttgttagctttttagggagtggtcatgaatttggagtgtcctttacgtatcgtgtgcaagataaagcgggcgggatcgcacaggcgttagggctttgtgaagatttcgtcgggaatgatcgtatggtagttatattaggggataatattttttcagatgatattcttccgtatgttgaagagtttgcaaatcaaaaagaaggtgcgaaagtgctattgcaatctgtagaagatcccgaaagatttggcgtagcacatattcaaaaccgaaaaatagttgaaattgaagaaaagccgaaagagccgaaaagttcttatgcggttacgggaatttatttgtatgattcgaaagtcttttcttatattaaagaattaaaaccttctgcacggggagaacttgaaattacagatataaataattggtatttaaaacgaggggtacttacttataatgaaatgagcggctggtggactgatgcgggaactcatgcttcgcttcaaaaggcgaatacgtta

SEQ ID NO: 40406 - DNA, 2736 bp, Bacillus thuringiensis
tgggccaagttccacggtccgaaccttggttatgttattgagcagtatgatctttacgtaactggagcaggttctgttgatccggaattacaagagctttttgaaatttttggagctccttcgtttcaagatgatgtcgtaacaggggacaacacagcaacacatttttctcctcaaaacacaggtaacattgaaaaaattcttaaagtcgttcaacttgttgagcagattcgttctttcgggcacacgttggctcacatcaacccgatggaagatgctgcaaatggacaatctcttcttgagaaagcaatgaacgaactgagcgatgctgacttgaaagcgattccagcgaaaacggtatggcaagatgcaccagaaggtattcacactgcacttgatgtaattcatagattaaaagacgtttatacaaaatctttagcttatgaattttctcatatacaagatagtgaagaacgcgcgtggttgcatcaaatggtggaatcaaattcattgcgtcaaccactatcaaataaaaaacgaactgctcttttaaaacgtttaacagctgttgaaggtttcgagcaattcttgcataaaacattcgttgggcaaaaacgtttctctatcgagggcgttgatatgcttgtacctgttttagatgaaattgttctagaaggtgctaagaacggcgtagaggatgtcatgattggtatggctcaccgcggtcgcctaagcgtacttgctcacgtattagaaaaaccatatagccacatgtttgctgagttcaaacatgcaaaaatagaaggcgcagtggctaattctggctggactggcgacgtgaaataccatttaggtagagaacaagtcgttagtaacgaagaagttagtactcgcgttacattagcaaataacccgagtcatcttgagttcgtgaatcctgtagtagaaggtttcgcacgtgcggctcaagagaatcgtaaaaaatctggtcttccagatcaagatacttcaaaatcattcgtaattttagttcatggtgatgctgcattccctggtcaaggtattgtatctgagacactcaacttaagcagattgaacgcgtatcaaacaggcggaacgattcatgttatcgcaaacaatgcagttggttttacgactgatagctatgattctcgttctacgaaatattcaagtgaccttgcaaaaggtttcgatattccgattgttcacgtgaatgctgatgatccggaagcttgtcttgcagctgctaaccttgcgattcaatatcgcatgttgttcaaaaaagacttcttaatcgatttaattggttaccgccgctacggtcataacgaaatggatgacccggcagttacgcaaccacaagtgtacaaaaaaattaaaaaccatccaactgtaagagcaatttatgcagatcaattacaagctgctggtgttctaaatgcagatgaggttgaaacaattacacagtttatacaagagcaattaaaatccgactatgcactcgtaccaccagctgatacgagtgatgcaacaattcacgttaaagtaccagatgttgttgcaaaaggtattcagtcaattgatactggcgttgagattgactcacttcgtgcaattaatgaaggtctactatcttggccagaaggctttaacgtatatccgaaagtgaagaaaattcttgagcgccgtaaagatgctcttgaagagaacggcaaaattgaatgggcacttgctgaatcattagcattcgcttctattttacaagaaggtacgccaattcgtttaactggtcaagattcacagcgtggtacattcgcacaccgtcatatcgtattacacgatactgatacaaatgaaacatattcaccattacatcgcttaccaaacattaatgcttcattctctgttcataacagtccgttatcagaggctgctgttgttggttacgaatatggttataacgtattcgctccagaaactcttgttatgtgggaagcgcaatatggtgacttctcaaatactgcgcaagcattatttgatcaatatgtttcagctggaagagcaaaatggggtcaaaaatctggcttagttcttctattaccacacggttatgaaggtcaaggaccagagcactctagtgcacgtccagagcgtttcttacagttagctgctgagaataactggacagttgcaaacttaacgagcgcggctcaatacttccatatcctgcgtcgtcaagcatctatcttaggaacagaagctgttcgaccattagtattgatgacgccgaagagtttattacgtcacccacttacgctttcaactgctagtcagttaagcgaaggacgtttccaacctgctttagaacaagaaaaccttggcatgaaaccaaataaagtaaaacgtcttgttttaagcacaggtaaaatggcgattgacttagcagcagaaatcgagtctggtaaacatgagtacaacttagacgaagttcatgtcgttcgtattgagcaattgtacccattccctgctgagaaagttcaatctattattaaacgctttaaaaacttagaagaaatcatttgggttcaagaagaacctcgtaatatgggcgcatggcattacatggctccaattctgttcgaacttgctggagataaagtgaaaacaggctacattggacgtcctgatcgctctagtccatctggcggcgatcca

SEQ ID NO: 40407 - DNA, 1257 bp, Bacillus thuringiensis
atgatcgaaattaaagtacctgagcttgcagaatctattactgaaggaactatttcacaatggcttatcaacgtaggcgacaaagttgagaaaggtggcagcgttgttgagcttgaaactgataaagtcaatgtagaaatcattgcagaagattcaggtattgtatcgaagttactaggcgaacctggggatacagttgaagttggtgcaactatcgcaattttagatgctaatggagcaccagttgcagtaagtacacctgcaccagtggctgagcaaccaaaacaagaaacgactgaagcaccgaaagctgcggcaccaaatgctgagcaaactgcaacactacaagggttaccaaatacaaaccgtcctatcgcatcaccagctgctagaaaaatggctcgtgaattaggaatcgacttaaacgacgtacgtagcacagacccacttggacgcgtgagaccacatgatgtacaagctcatgctgcagcaccaaaagaagcaccagctgctccaaagagtccagctcctgctccagttgcaaaaacggaattcgaaaaaccagttgagcgcgtgaaaatgtcccgccgccgtcaaacaattgcaaaacgtcttgtagaagttcaacaaacatctgcaatgttaacaacctttaacgaagttgatatgagtgcgatcatggaattacgtaaagaacgcaaagatgctttcgagaaaaaacatgatgtacgtcttggcttcatgtcattcttcacaaaagcagttgttgcagcattaaaacaattcccattattaaatgctgaaattcaaggtgacgagcttatcattaaaaaattctatgatatcggtattgcagtagcagctccagatggattagttgttccagttgtacgcgatgccaaccaattaaatttcgctgaaattgaaagtgaaattcgtgaattaggtaaaaaagcacgtgacaacaaactttcattaaaagaactacaaggtggtacatttacaattacaaacggtggtgtgttcggttctctaatgtcaacaccgatcctaaatagcccacaagttggtattttaggaatgcataaaatccaagtacgcccagttgcaattgataacgagcgtatggaaaaccgcccaatgatgtacattgctttatcttacgatcaccgtattgttgatggtaaagaagcagttagcttccttgttgctgttaaagatatgcttgaagatccaaagtcattattattagaaggt

SEQ ID NO: 40408 - DNA, 1539 bp, Bacillus thuringiensis
atggtagtagcatacaaacatgagccatttacagatttttcagtggaggctaacaaattagcgtttgaagaaggtttaaagaaagtagaatcttatcttggacaagactatccattaattattgggggagaaaaaatcactacagaagacaaaattgtttctgtaaaccctgcaaataaagaagaacttgttggtcgtgtttcaaaagcaagccgtgagttagctgaaaaagcaatgcaagtagcggatgaaacattccaaacttggagaaaatcaaagccagaaatgcgtgcagacattttattccgtgctgcagcaatcgttcgtcgcagaaaacatgaattctctgctattcttgtaaaagaagcaggtaagccatggaatgaggcagatgctgatacagcagaagcaatcgactttatggaatattatggtcgtcaaatgttaaaattaaaagacggtattccagtagaaagccgtccaattgaatataatcgtttctcttacattccattaggagtaggtgttatcatttctccttggaacttcccattcgcaattatggcaggtatgacaacagctgctttagtttctggtaacacagtattactaaaaccagctagtacaactcctgtagtagcggcgaaatttatggaagtattagaagaagctggcttaccagctggtgtagtaaacttcgttccaggtaacggttctgaagttggtgactacttagtagatcatcctcgtacacgtttcgtaagcttcacgggatctcgtgatgtaggtatccgcatctatgagcgtgcagcgaaagtaaacccaggacaaatttggttaaaacgcgttatcgctgaaatgggcggtaaagacacaatcgttgttgataaagaagcagatcttgaattagcagctaagtctatcgttgcatcagcattcggattctcaggacaaaaatgttctgcatgttctcgtgcagtaatccatgaagatgtatacgatcacgtattaaatcgtgctgttgaattaacaaaagaattaacagttgctaacccagcagtattaggtacaaacatgggtcctgttaatgaccaagctgcatttgataaagtaatgagctatgttgcaattggtaaagaagaaggtagaatcttagcaggtggcgaaggagacgattctaaaggctggttcatccaaccaacaatcgttgctgacgttgcagaagatgctcgcttaatgaaagaagaaatcttcggaccggtagtagcattctgtaaagcgaaagacttcgatcatgcacttgcaattgcaaacaatacggaatacggtttaacaggtgctgttattactaacaaccgtgaccatattgaaaaagcacgcgaagacttccacgttggtaacttatacttcaaccgtggatgtactggtgcaatcgtaggttaccaaccattcggtggctttaacatgtctggtacagactctaaagctggtggacctgattacttagcacttcacatgcaagcaaaaactacttctgaa

SEQ ID NO: 40409 - DNA, 2241 bp, Bacillus thuringiensis
atgacagataagttattaaacggtttaaatccacagcaacaaaaagcagtacaaacaacgaatggaccacttctattaatggcaggtgcaggtagtggtaagacacgtgtgttaacacatcgtattgcgtatttacttggtgaaaaaggtgtagcaccatggaatgtactagctattaccttcacaaataaagcagctcgtgaaatgcgtgagcgtattgatacacttgtgggaccagaagcagaagatatttggatttcgacgttccactctatgtgtgtacgtattttacgacgcgatatcgatcgtattggtattaatcgtaactttacaatcttagattcaggtgatcagctaactgtagtcaaaaaaattatgaaagagcgcaatgttgatccgaagaaatttgagccgcgctctattttagcgggtattagtaatgcgaaaaatgaactgttatctgcggataaatatgcaaaaaaaattacaatggctgatccatatgaaaaattaacgagcgatgtatacacagagtatcaaaaacgtcttttgaaaaataattcattagactttgatgatttaattatgacgacgattcagctatttgaacgtgttccagaagtattagagttttatcagcgtaagttccaatatattcatgttgatgagtatcaagatacgaacaaagcgcaatatcttcttgttaaacatttggcagcgcgttttaaaaatctttgtgttgtgggtgactctgaccagtctatttatcgctggcgtggtgcagatatttctaacattttgtcattcgaaaaagactatgagaatgcacaagtaattctgttagaacaaaactatcgttcgtcacaaaatattttaaatgcagcgaatgctgttattgaaaaaaatacgaatcgtaagccgaagaaattatggacagacaatcaagttggaagtaaaatctcgtattatcgtgctgcaactgaaaaggacgaagcgtattttgttgcaaaaaaaattcgtgacgatattcaaatggggaaacgaaaatatactgattttgcagtgctatatcgtacgaatgctcagtctcgtatggtcgaggagattttccttaaatctaacattccgtataaaattgtcgggggtacgaagttctacgatcgtaaagagattaaagatattttggcgtacttacgtttaatcggtaatccagatgatgaaattagttttgcacgtattataaatgtgccaaagcgtggcattggtgcgacttctatcgataaaattattaattacggtgtgcaaaatggaatttcattaactgctgtatttgatgagattgagcatgttggagtaagtgcaaaaattacaaaggcagtaaaagaattcgcgaatttattaaataactgggtaaatatgcaagagtatttatctgttacagaattagtagaagaagttattgaaaaaacaggctatcgcgatatgttgaaaaatgaacgttctttagaagcggaaggtcgtttagaaaacttagacgagttcttatctgttacgcaaacatttgaatctcaaagcgaagataagagccttgttgcattcttaacagatttagcacttgttgctgatattgatcgtgtagatgaagacccaactgctggtgaagaagttattttaatgacgatgcactcggcgaaaggattagagttcccggttgtctttattgttggcttagaggaagggatattccctcatactcgttctcttatggaagaggatgaaatgcaagaagaacgtcgtcttgcttatgtaggtattactcgtgcagaagaagagctatatttatctaacgcgcaaatgcgtacattatttggtagaacaagtatgaacgctgcgtctcgatttattacagaaatcccgacagaactagtggaatcattaaatgaaacagcgccgaagcgtgaaacatcgtttggtacaaaaggcagaacggcaagtagcggcaaaacgacaatcacaacagcaacacgctctcgttcagctttcgcgcgccctgcagctaagacgacaggcggcgaacaaattggctgggcagtaggagataaagcttcccaccaaaaatggggagtcggtacagttgtaagtgtaaaaggtgaaggtgatgcaaaagaattagatattgcgttcccaagcccaattggtgttaaacgtttgttagcaaaatttgcgcctgtgacgaaacaa

SEQ ID NO: 40410 - DNA, 1344 bp, Bacillus thuringiensis
acacatgtaacgttcgactattctaaagcgttatccttcatcggtgaacatgaaatcacttatttacgtgatgcagtgaaagtaacacatcacgcaatccacgaaaaaactggagctgggaacgatttccttgggtgggtagaccttccgcttcaatatgacaaagaagaatttgctcgcattcaaaaatgcgcagaaaaaattaaaaatgactctgacattttacttgttgtaggtatcggtggttcttacttaggagcacgtgcagcaatcgaaatgttaaaccattctttctacaacacgctttctaaagaacaacgtaaaactccacaagtgctatttgttggacaaaacattagctccacttacatgaaagatttaatggacgtattagaaggtaaagacttctctattaacgttatttccaaatcaggtacaacaacagagccagcactagcattccgtatcttccgtaagttattagaagaaaagtatggaaaagaagaagctcgcaaacgtatttatgcaactacagataaagcgcgtggtgcattaaaaacattagctgataacgaaggttacgaaacatttgttattccagatgatgttggaggtcgtttctctgtattaacgccagttggtttattaccaatcgcagtaagtggcttaaatattgaagagatgatgaaaggtgcagctgctggtcgtgatgacttcggaacatcagaactagaagaaaatccagcttaccaatatgcagtagttcgtaacgctttatacaataaaggaaaaacaattgaaatgcttgttaactatgaaccagcacttcaatacttcgctgagtggtggaaacagttatttggtgaaagtgaaggaaaagatcaaaaaggtattttcccatcttcagcaaacttctcaactgatttacactcattaggtcaatacgttcaagaaggtcgtcgtgacttatttgaaacagtccttaaagtaggcaaatctacacatgaactaacaatcgaatcagaagaaaacgatttagacggattaaactaccttgctggtgaaactgtagacttcgtaaacacaaaagcatacgaaggtacattacttgcacatagcgacgggggagtaccaaacttaatcgtcaatattcctgaattaaatgagtacacattcggttaccttgtatacttcttcgaaaaagcatgtgcgatgagcggctacttattaggcgtgaatccatttgaccaacctggagtagaagcatataagaaaaacatgtttgctttacttggtaaaccaggatttgaagaattaaaagcagaattagaagagcgtttaaaa

SEQ ID NO: 40411 - DNA, 1049 bp, Bacillus thuringiensis
ctatctagatcagcagaatctttaaaaccatctggtattcgaaaattttttgatttagcagcaaatatgaaaggtgttatctccctcggggtaggagagccagattttgttaccccttggaatgtaaggcaagcatgtattcgttctttggaacaagggtatacgtcatatacagcaaatgcaggattattagagctccgtcaagaaatagcaaagtatctaaaaaaacaatttgcagtatcttatgacccaagtgatgaaatcattgttacagttggagcgagccaggcgttagatgtagcgatgcgcgccattataaatcctgatgatgaagtgctcattattgaaccaagcttcgtttcttatgcaccacttgtgacattagctggaggagttccggttcctgtggcgactactttagaaaacgagtttaaagtactaccagaacagattgaagcagttattacagcgaaaacaaaggcgattttgctttgttcaccaaataacccgacaggtgcaatgctaaataaatccgagcttgaagaaatagcagtgattgttgagaagtacaatctaattgtattatctgatgaaatttatgcagagcttgtatacgacgaagtatatacaagtttcgcgagtattaaaaatatgcgtgagcatacgattttaatttcgggattttcaaaagggtttgcgatgacaggatggcgtctcggtatgattgcagctcctgttcaattttcagaattaatgctcaaaatccatcagtattcaatgatgtgtgcaccgacgatgtctcagtttgcagcacttgaggcgttacgcgcagggaacgatgaagtgattcgaatgagagatagttataagaagcgtcgtaacttcatgacgaaatctttcaatgaaatgggcttaacgtgtcatgtgccaggcggagcattttatgttttcccttctatatcttcaacaggattatcttcagcggaatttgcagaacagttattgctggaagaaaaagtggctgttgtccctggtaccgtatttggcga

SEQ ID NO: 40412 - DNA, 1140 bp, Bacillus thuringiensis
tttcataaagcaatcaatcgacgtggaacgcatagtataaaatgggatacatataaaaacgaagaacttatccatgcttggattgctgatatggattttgaagtaccaaaaccaattcaaactgccttaaaacaacgaatcgaacatccgatttttggctatacacttcctcccgaaaatattggagatattatttgtaactggacaaaacaacaatacaactgggatattcaaaaagaatggattgtctttagcgccggaatcgttccagctcttagtacgagcatacaggctttcatcaaagaaaacgaatctgttctcgtacaaccacctatttatcctccatttttcgaaatggtcacaacaaacaacaggcagttatgcgtgagtccattacagaaacaaaatgatacatatgtgatagacttcaagcatttagaaaagcagtttcagcaaggcatcaaactcttgcttctttgtagccctcataacccaatcggacgcgtttggacgaaagaggaacttgtgcagctcggatcgttatgtactaaatatgacgtaatcgttgtggcagatgaaattcattccgatatcatttatgcagaccatacacatacaccgttcgcttccttatctgaagaattagcagagcgcactatcacttgcatggctccaagtaaaacatttaatatcgctggattacaagcgtcgatcattatcattccaaacgaaaagctccgtcatgcctttacagccatccagtatagacaaggcttccacgggttaaatatcttcgcttatacagcgatgcaaagcgcctatacagaatgtaatgattggctaaacgaaattcgattatatatagaagataatgctcaatttgcttgtgaatatattaaaactcacatacctgctctttccgtaacgaagccagaaggtagctttttattatggattgattgttctcgtctaaagctttctcaaaacgagcgtaccgcactacttgaggaaaaaggaaaaatcatcgttgaacctggtgagaaatacgggttaggtggcgaagaacatattcgaattaacatcggctgtccacgatctgttttagaagaaattttaaacagactgcgtcatacgttttca

SEQ ID NO: 40413 - DNA, 1329 bp, Bacillus thuringiensis
atgtttaaatggctcaagccagcacctgcaattgaaagattgccagcggatatgatcgaccgtgtatatcgattactacgtattcgtgtgttaatcggaatttcagttggatatgctgcttattatttagttcgtagtaactttacgttatcaagtacgtatttagtacaagaatatggttttagtacagctgaaattggtctactaggctcagtaatggcaattgtttatggatttagtaagttctttatgggtaatttatcagataaagctttcgcccagcgctttattgcagtcggtttattcttatcagggcttgtaaatatttgtttcggctttgcatcatcctttgggatgattgttacattacttgttgttaacggtattgtacaaggtatgggagcaccaccttgtagtattgttatgacgaaatggttctcgaagaaagaacgtggtacgaaaacaggcctttggaatatttcacataacgttggtggaatgcttgtaccaccacttgtcggaattggtgtaggtattttcggtgaaaatcattggcaaggcggcgtgtttattttccctgcgattatcgcaatggtaattgcagtacttgtttggatcaatgcgaaggatacaccagaatctgaaggtcttcctccaattgatgagtatcgtaatgactatgaaaatcttgaaaaagcagataatgctaacaagatgtcaccaaaagaaattttaatgaagtatgtagtgaaaaataaatttgtatggttcttatgtattgcgaatgcttttgtttatttaattcgtttcggtgttattaactgggttccactttatttaacgacagttaaaggattttcaaaagcagaagcgcatgcggcatatgcaatctttgaaggtatggcaattccaagttcattaatcgttggttttttaagtgataaattatttaaaggaaaacgtatgccattatgtattattagtatggttggagttgttattggtacgtttatatattggcaagcaactagcgtacttgttgtaagtattgcagtttctattatcggttgtttaatttatgtaccacagttcttaatcggtttaagtgcgatggaattagtaccgaaatttgcagtaggtacgacagttggtatgtgtggtctattcggttacgtaggcggaagtcttgtagctaacgcagcaattggtgttattgttgatagttctggctgggatggttgtttcatcttactattaacaggagcggttttatcaacaatcttcttatttattgttcaacgtggacatgagagaaaagatcctaaagta

SEQ ID NO: 40414 - DNA, 822 bp, Bacillus thuringiensis
acaagtttaaaagactatacaacattacataacggtgtaaaaatgccttggtttggtttaggtgtttttaaagtagaagatggttcagaagtaattgattctgtaaaagcagcaattaaaaatggctaccgcagcatcgatactgcagcaatctatcaaaatgaagaaggtgttggacaagcgattcgtgaatccggtgtttcacgcgaagaattatttattacctcaaaagtatggaatagcgatcaaggatatgaaacaacacttcaagcatttgaaactacattagagaaattaggtctagaatatttagatttatatttagtacattggcctgtaaaagggaaatataccgaatcatggaaagcattagaaaaactttataaagatggccgtgttcgcgctatcggtgtgagtaatttccacattcaccacttacaagacgtatttgaaattgctgaaattaagccaatggtcaaccaagtggaataccacccacatttagcacaagaagagttacatgcattctgtaaagaacataatattcagcttgaagcttggtcaccattaatgcaaggacaactactagataatccaacgttacaagaaattgcgacaaaatataataaatcaactgcgcaaattattttacgctgggatttacaaaacgaagttgtaacaattcccaaatcaattaaagaacatcgcattattgaaaatgcaaacatcttcgactttgaattaagtgctgatgatatgaaagcaattcaagctttaaatgaagatcgtcgcgttggtccagatccagataactttaacttc

SEQ ID NO: 40415 - DNA, 777 bp, Bacillus thuringiensis
cgaattttatttattggtgccggtcgtatggcagaagctatattttccggattacttaaaacaagcaaagagtacatcgaagaaattatcgtctctaatcgaagcaacgtagaaaagctaaaacagttacaacatcgatataatgtgtctactgcaacagattggaaacagcatgttacatctgttgatacggttgttttagcaatgccaccttctgctcatgaagagttattagctgagctatctccgttaatatcaaatcaactagtcgtaacagtcgcagctggcattggaccatcttatttagaagctagactcccaaagggcacgcctgttgcttggattatgcctaatacagctgctgaaattggaaaatctatctccttatatacaatgggacaatcagtaaatgagatgcatcaagaaaccctgcaactgcttttaaaaggtattggtacttcgcaactttgtactgaggaagaagttcatcagcttactgcagttactggaagtgcaccagccttcctttattactttgctgaaagcttaattgaaacaacaaaaagttatggagtcgatgaagaaaccgcaaaacatcttgtcattcaaatgatttctggctctgcttctatgctcgaacaaacgcaaaatccagctaacctccgcgaacaagtaacaacgccaggtggttccacagctgagggtctcaaaactttatacgaatataatttttcagaggcaattcaaaaagcagtagaagcaacaaacaaaaaagct

SEQ ID NO: 40416 - DNA, 897 bp, Bacillus thuringiensis
atggaaaagattattgaagtaaatgatgtttctaaaacatttaaacataaaaacgcagtaaataatgtttcatttcatgtaaataaaggggaaatagtagcgttgcttggtccgaatggtgctgggaaaacaacgacgatgtcgatgatgcttgggttaaaggaaccaacggaaggtaaggtctctatatttggaaagagtccaaagcatagagatgttcgtaatagcctcggtgcgatgctgcaagaagtaagtgtcattgatagtattacggtggaagaggcaattgagttattccgtagttattatacgaatcctatagagaaagagacgttactgcagttatcaaatttagaatcagagcgaaagcaaagatgtgagaaattatcaggtgggcaaaaaagaaggttaaactttgcgcttgcacttgcgggaaatccggatttgttatttttagatgagccgacagtcggaatggatattacgtctcgaagaacgttttgggaaacgattcgaaagttagcaagtgaagggaaaacgattattttaacgacgcattatttagaagaagcagatgctttagcaaatcgtatcttattatttgcgaacggaaagattatcgcagatgttacaccagacgaaatgaaagcaacgatttcgagaaaaacaattacattttactcaaaggaaagcattcctacaaaattactaaaggaattaccaaatgtaacagaagtaaagtcaaacgaaggacgcttcattttaacaacggaggatacggatgcaactttaaaagccatttatcaaaggagtttacctgtaacagatgtttcagttgaacgtggaagccttgatgaggcatttgaacagtttgtcgcaaatcagaaggaggaaatc

SEQ ID NO: 40417 - DNA, 870 bp, Bacillus thuringiensis
atgaaaaaagtaagaaaagcgataatcccagcagctggattaggaacacgttttttaccagcaacgaaagcaatgccgaaagaaatgttaccgatagtagataaaccaacgattcaatacattgtagaagaagcagtgaaatcgggaatcgaagatattattattgttactggtaaaacaaagcgctctatcgaagatcattttgataacgcatttgaactagaacaaaacttattagagaagaaaaaatatgagttgcttgaaaaagtacaagcttcttcaaaaatggtagatattcattacatccgtcaaaaagagccgaagggactaggacatgctgtttggtgtgcacgtaaattcattggtgatgagccatttgcagtgttactaggtgatgatattgtccaagctgagaaaccgtgtttacgtcaattaatggatgagtatgaaaaaacactttcttctgttattggtgtacaaactgttccggagtcggaaacacatcgctatggaattatcgatccattagaacaagaaggtcgtcgttaccaagttcgcaatttcgttgaaaaaccagcacaaggtacagctccttcaaacttagcgattatggggcgctacattttaacgcctgaaatctttatgttcttagaacagcaacatgtcggtgctggtggtgaaattcagttaacagatgcaatccaaagcttaaatgaaatccaacgtgtatttgcctacgatttcgaaggaaagcgctacgacgtaggtgaaaagctaggattcgttcaaacgacaattgaaatggccctgcaacacccagaattacgtgatgacatggttgcaatgatgaagaaaattttagaagaacaa

SEQ ID NO: 40418 - DNA, 1749 bp, Bacillus thuringiensis
atgaattggaaacaagaatttagtcgctggctttcttacgcacaattagatgcagaattaaaagaacagctagaaaatatgaagcaagatgagaagaaaatcgaggatagcttttataaaaatctagagtttggcacaggtggtatgcgtggtgaacttggtgctggtacgaaccgtttaaatgtatatacagttcgtaaagcaacaaaaggattagcaagctttatcgaaaagttaggtgaggaagcgaaaaaacgcggtgttgttgtagcctatgattctcgtcataaatcacctgagtttgcaatggaagttgctgctacacttggtgcacgcggtatcacaacatatgtgtttgaaagcttacgtccaacgccagtactttctttcgcagttcgtcatttacatacagtaagtggaatcgttcttacggcaagccataatccacctgaatataacggatacaaagtatacggtgaagatggtggacagttacctccaaaagaagcagatgagttaattagctacgtaaatgcagtagaagatgaattaacagttgaagtcgctgatgtagagcaattaaaagctgacggtttattacatattattggacaagaagtagatgatgcatatgctgcagaattgaacaatgtcatcattaataaagaaatggtacaaaaggttggtaaagacttaaaaatcgtctttacaccattacacggaacatcaaatatttctgtacgccgtggtttaaaagaagttggatttacagatgtaacagttgtaaaagaacaagagttaccagatccaaacttctctacagtaaaatcaccgaacccagaggagcacgcagcgtttgagtatgcaattcgtgacggtgaaaaggtaggcgcagatgtattaatcgcaactgatcctgacgcagaccgtcttggtgtagcagtgcgtaatcataatggtgagttccaagtattaaccggaaaccaaacaggtgcattaatgcttgattacttactatctcaaaagaaagaaaacggaacgcttccagagaacggtgtcgtattaaaaacaatcgtaacgtctgaaattggtcgtacaattgcaaaagcatacggtttagatacagttgatacgttaactggatttaaatttatcggtgagaaaattagacagtatgaagaaagcggacaatatgaattccaattcggttatgaggaaagctatggttatttaatccgcccattctgccgtgataaagatgcagtacaatctgttctatttgcatgtgaagtagctgcatactacaaatcacaagggaaaacgttatatgacggtctattagaagtatttgagaaatacggcttcttccgtgaagaccttgtatcgttaacgttaaaaggaaaagatggagcggaaaaaatccaagagatgatggcaacgttccgtgagaatccgccgaaagaagtagcgggcttaacagtcgtagcagtggaagactataaagcaagcatcgttacatctttacaagatggacataaagaagagattcacttaccgaaatcaaatgtgttaaaatatcaattagaggatggttcatggttctgcctacgcccatctggaactgagccgaagattaagttttactttggtgtaaaagatagttctttacaaaatagtgaacaaaagttacttactattaaagaagacattatgaatcgtttataatacaaagtaattttaagtagtaag

SEQ ID NO: 40419 - DNA, 4101 bp, Bacillus thuringiensis
gatagtctccctagcggtacttcttttatacccggcactgtaacagtagataacgtaccgcaaacaaatgcaaatcctgcggctggtatatctcttggaacaattaataatggtgcttctcgtacagtaactttccaagctactgtcgtttctcttccaagtcaaaatcctatctctaacactgctaatattacatttcaatatacaccaatcgccggaggaacaacttttaatggtcttgcaacaagcaactctgctggaacacaaattaacctcgcagatattaatggaacaaaatcagttaacaaactttttaccgatattggtgaaacattaacttacagtattgccttagctaatataggaaatatcgctgcaacgaatgtgatatatacggatccgattcctagcgggactactttcattccagggagtgtaactgtgaacggagttactcaagctggagcaaatcccgctaatggtatatcaattgggtcaattgccgcaaattccactactactatttcattccaagtactcgttccttctatccctcaaacaaacccaatattaaatagtggaacaacaacatatcaatacattcctgtacctaatcaaccagcagtaagtgggactgataagacaaatattgtctccactcaagtgaataatgctactgtaacaatgacgaaagcagtagataaaaattttgcagatattggtgatacactaacgtacaccgtttcctttacagctacaggtaatacaaatgcgaacaatgttatttttacagatgtcatccctactggaacaactttcgttctaaacagtttaacaatagatggcacgacacaagtgggcgcaaatcccgctaacggcgtgaatattggatccatcccaagcggcacaacaaaaaatgttgcatttcaagtagtagtaaatacaatacccgcgtcaaatgtcgtatctaacggatcaagtgcttcttatcaatataccgtcaaccctagccaatcacccgttacaaaaaacatttcttctaatctcgtttccactcaaattaacaatgcgaatgtaacattaacaaaatcaactaacaaacaatttgccacaattggcgaaacgataagttatacaattcttattacaaacagtggaaatgcggccgctaatagcgttcaactaacagacccacttccaaatggaacgatattaactcctggtactgtaacactaaacggagttttgcaaaatgtagattctctcgtcgctttacctatcggcacaattcctggcggggctacttttaccctttctttccaagtaacagtcatcaatattacgacccaaaatcctatcattaataatgccttcgcttcttatctatatactgtaaatccaaatttgccaccgacttcaaagacagcaaattctaattctgttacatcaacaattagactagcaaatctccatgctaataaatctgtagataaaacgtttgcggaagttggcgatgtattaacttacaccttcgctcttactaacgatgggaatgttgcagcgaacaatgtattactatccgattcaattgcgaatggaaccgcctttgtaccaaatagcgttatagttaacggtgttactcaaccaggcgttacaccaactagcatcaatattggtagcatcaatgctaatactacaattacagcttcattccaagtagtaataactagcattccaaatccaaaccctatttcaaatagcgcttccatctcctataactttattgttgatccaaacgcttcacctgtaagtaagaacactacttcaaccactacatttactcaagtaaacgatgcaaatgtcatttcagccaaaacagtggatcgagcgttcgctaccgtaggggatatattaacttatactgctactttgacgaatgcaggaagtgtttctgctgatagtcctactttcgtagatacgaatccagacggtactacctttattccaaacacttttcttattaatggtgtactccaaaataacgcagatccaaatataggtgttccactaccttccattgctgctaacggctcacttaccgtctcttatcaagtaaccgtcacctctttaccaatacaaaacccaacgataaattcatctagtacacagtatagttttattctaaatccgggcgatccaccaactgtagaaacatctgtaagtaacactgtaagtacacaaattaatttagcaaatgtagtgattgtcaaagaagtagatttaactatcgccgatgtcgggcaaccaatcacatatacaatttctttagctaatcttggaaatactatagcaaataatgttatttttaccgatataatccctaatggcaccacaatcgtaccaaatagtatttttataggtggtgctttacaactaggtgcagaccctagtaccggtcttcaagtcggctccattccttcaggtggttttacaacgattgtttttcaaataagtgcaaatgggctaccttcaccaaacccaattcaaaacagcgcttcacttcaatatagctttatcgctgatccaaatttacctgctcttgttagaaacgctgctagcaatatagtaactacacaaattaatactgctaatatcgttgctacaaaactaacgagtacaaacttcgctgatgttggtgatgtcatactatatgcgactattttaacaaataacgggaatatccctgctgctaatgtaacgtttacagatatcattccagcgggtaccctcttcattcctaatactgtaacgattaataatgtccctgtagctaacgcaaatcctgctaccggcatttcaattggtacaataggagcgaattcatcacgcaccgttgcattccaagtttttgtaccaactatccctgctgtaaatccaattacaaatcaatcaggcacaacattccaatatacgtatgatccatccaaacctgctgtgatgcagatggttgcttctaacactgtacagacaactattaataacgcctcaattgccgctactaaatctgcagataaacagtttgctaacgtaaatgatattattacgtacacgactactttaacgaataacgggaacacacttgcatcaaatgtaatatttacagatgtaattccaaacgggacatcatttattgctaatagtgttactgtaaacgggaatacactgcctaatgtaaatccagcaagtggaattgccattgatccaataaatccgaatgcaaatacgctcatctcgttccaagtacaagtaaattctatcccgaatccaaatccactcccgaaccaaagcaatacaacgtaccagtacgtcgtagatcctaacttacctccagcatccgccaatacgttaagtaacgtaataacaactcaaattaataacgctactattgtcgctactaagtctgtgaatacaccgacagctgcaattggcgatatcgttacctatacgattgcagtaacaaatacaggtaatactcctgctagtgcgactgttttaacggatgggcttggtgcaggagcttcatttatccaaaactccgtaacgatcaataatgtcccacaaccaggattagatccatcacttggtattcacttggcagatatttcgccaggggatactgtatttattacttttcaagcacaaattttagcgataccacctagtggcacattaacaaataatgctcttgtaaattatgaatataccgtgaatcccaaccaatcacctgccgtcaatagtacaattacgaatacaacggttactccaattattgatgctactctttctataaataaaactgtcaattcaacattcgctactattggagatacacttactttcacttctaccattactaattccggtaatactaccgcaaacaatgttatttttacagatgtaattccaaatggtacaacgtttattccaaatagttttacggtaaatggaacaactattactaatgcaaatccacaaaacggtatcaatattggtaacttgaattcaaatgcatctgctacactcagttttcaagtaaacatt

SEQ ID NO: 40420 - DNA, 3508 bp, Bacillus thuringiensis
attaataacgcgactgttacaactgttttacaagcaaatcgttcaattgtatctatcggggatgtaattacgtatacagcaacattaacgaatactggaaacttccctgcaaactctatattactcattaacggagttcctgaaggagcattatttgttccaaatagtgttacgctcaacgggatttcacttccagatgcaagtccaactctcggtattccagttggtattatcgcaccaggtgattccgctactattacgttccaatttcttgcaagttctattccaccgcaaggagcgattataaatcaagcacttacaagttacacgtatattgtcgatccaagtcaacctcctgttacagcaacatcctcgtctaatacggttaatacagctgttgttgatgcatcgttatccgtaattaaaagtacagattctctcgtacaatctactgacggtacaatcacttacacagtagtcgttcaaaataacggaaatactactgcaaatacagttactttaacagatttggtcccagaaggaactgcatttattccgaatagcgttaccattagtggtgtttctgttccaggtgccgatcctaacgtaggaataccattaaactccatcacaccgtcagaaatcgtcactgtaacattccaggttatcgttcaatctataccaagcgtgaacccaattttctaatacagcccgtattgactatacttttatcgccgatccaactgctcctatcatctctcgaacaattacgtctaatcccgctttcacacaaatttcggatgcaactatcctttctttaaaagcagtcaatgcacctcaaacaacaacaggtgatattttgacttacacaataacactagaaaataccggaaatattccagctacgaatctcatattttcagatacgattccccaagatactacattcgtagaaaatagttttacacttaatggaacagctatacttggtgccaatccaaatgtaggtgttactttacctaccttagcagcaaacgctactcaccttatttcgttccaaattcttattaaagattcattctcgcgagaatcgattacaaatcaatccaatacaacatatacaatccaaccagacccagggcaaccgcctattactgaaacatctactagtaatatcgtcattacaaatttcgtgcaagcacaattgacaattacaaaaacatccaatccaacaactgtagatattggcggaactatactttatatttctgaagtgaaaaatatcggtaatgttgacgcaataaatattgttttcacagattctatcccagctgggactacattcgttcccgatagtgtcacaattaacggtgtccttcagccaggtgtaaatcctgaaaacggaataccgattggaacaattccagctaacagttccaaaacgatactatttcaagtgcaaacaaataatccacctactgaaaccgaaattgtaaatcaatcttcagcaacttaccaatatgtaagtatccctacagccccaccagtgaatcgctctgcaaattctaacattgttacaacatcacttcaaaacgcaaatattatttctgttaaaagcgcggatataactttcgcatcaatcgggcaaattattacctacacaaatacactacaaaatataggaaccgttccagctaacaataccgtgttcattgataacattccagaaggtactatatttattgaagatagcttagcaataaataatgtaattcagcctggcgctaatcctgaaaacggagtaactctcggcacgatacaaccaaatgaaacagtcactatttcattccaagtacaacttacaaatataccagttggcaatgtagtcattaatatttcagacacctcgtacgaataccaaattgaccctagttctcaaattattcagcgtagatcgttatcaaatgcagtaaatactgaagtgcggacggcaaatgttagtgcaattaaatccgctaacagatccattacacgtatcggtcaaatcatcacatatacagtcgcagttacaaacgctggtacaatacctattacaaatactctcctacttgacgcaattgcttctggcaccacattcgttccaaatagcattcttgtagatggcgtaccaagacttaacgaaaatccaattacaggtatcaatcttgatataattcttccaaataatacgattattgttacgttccaagtaagcgtagtctctataccgccacaaaataacattaataatatcgccgtcattcactatgagtatcgaccagacccaagcacaccaccaatttcagaaacgacctcttccaatgctacaaacatacaatttattgatgctattcttattactacaaagtccactaatactgtattagctaacattgatgaaaccattgaatatacagtattcattcaaaataatggatcggctacaactaactccatcttttttacagatactatagcggatggaacagtatttattccaggaagtgtagtagttaataatactgtacttcctgcagcagatccgaatatcggcttttccattcctaatgtcgcagcaggtcaaatggctacaataacattccaagtttccgttacgaatttacctgctgtaaatccaacacctaatactgcaaacgtcgtctacgactttattttcaatcctgactttgcaccaattcaaaaatctactacttccaatactacttttgttcaaattaatgatgctgacatcgtttcacttaaaactgttgatttaacctctgtaacgattggtgacattttaacttatacaacaactttaacgaatacagggaatacggatgccactgctgttgtatttacagacaatattcctaatggaacaacctttattgacggtagcgttttagtaaataacattcctcagcttaatgccaacccaagtgcaggtatacttgtaggaacgattgctcctaatatttctatcccagtcacattttctgttaccgtcgtagctcttcctgctagcggccatgttcaaaatcaatcaacttctcgttatacaataaacgtggaagaacaaatatccactagcaatattaccttcactgaagttatttctgctaatgtaattgcgacaaaaacaacacctatccaatatgctgacctacaaactattatcccttacactatttccattacaaacaatgggaatatacaagtagaaaacattattgttacagatatcatcccagcaaatacgagctttatagagaatagtgttatcgtgaatggcaacgctcggccaaatgacaatccacttaacggtatacaaattgataacattccgcctaatacgacagcaaccattctattccaagtacgggttacttcgattccacaaacaaatccaatctctaacacgagtacaattgaatatgaatacacggtaccaaatcgaccacctatt

SEQ ID NO: 40421 - DNA, 783 bp, Bacillus thuringiensis
atgtatagtgatttagcagggaaagttgtcgttattacaggatcagcaactggtctcggaagagcgatgggagtgaggtttgctaaggaaaaagcgaaagtggttattaattatcgctcacgagaatcagaagcgaatgatgtgttagaagaaattaaaaaggtaggcggcgaagcgattgctgtaaaaggtgatgtaaccgtcgaatcagatgttgtgaatctcattcaatctgctgtgaaagagtttggtacgcttgacgttatgattaataatgcagggatagaaaacgcggtaccgtcgcatgaaatgccgcttgaagattggaatagggtaattaatacaaatttaacaggtgcttttttaggaagtcgtgaagcgattaaatattttgtagaacatgatattaaagggtctgtcattaatatgtctagtgttcatgagaaaattccgtggccactatttgtgcactatgcagcaagtaagggtggcattaaactgatgacagaaacgttagcgctagaatatgcgccaaaaggtattcgagtaaataatataggaccaggtgcaattaatacgccaatcaatgcagaaaagtttgctgatcctaaaaaacgtgctgacgtagaaagtatgatacctatgggctatattggaaaacctgaagaaatcgcagcagtagcaacttggcttgcttcatcagaggcgagttacgtaacgggaattacgctatttgcagatggtggaatgacgttatatccatcgtttcaagctgggcgtggg

SEQ ID NO: 40422 - DNA, 1275 bp, Bacillus thuringiensis
aagaagagaatacaaatgaatagtagtaaagtagctattattgggttagggtatgttggccttcctttagcggtacattttgcagaaagagggcatacagtacttggattagataaagatattagaaaaatagactcaattataaaaggagaaagttatattccagatgtttcttctaaagagttacaaagtttattgacgaaaaaaaaattaacagtaaacacaccggatcaaggcattgctgattttcaaagtagtgattatgttattgtcactgtcccgactccaattaatgaacaaagagaaccagatttaagtgccctcatttcagcttcgcattatatacaacaaaaccttcaaaaaggacaaaccttcatttttgaaagctccacatatccaggcacacttgaagaagtcatcatacctattatttctcaaaatagtaacaaggtaggggaagatttctatatcggatattcccctgagagaattgatccagcaaatagtcaatattcagttcaagctattccaaaagttattagtggacaaacagaaaagtgtagacaaaaggtacaggatttatatagtaccatttttgacgaagttgtacctgttagctctccgaaagtagcagagatgtgcaagctatttgaaaatattcagcgcttagttaacatttctttagtaaatgaactaaacacactatgtgaaagtttaggcattgatttttatgaggccattgaagcggcatctacaaaaccatttgggtttactccatattggccagggccagggatagggggacactgtattccagtagaccctttatattttcaatggagaataaaaaagaatggggcaattagtcaattaattgaggcagcacatataattaatgaagaaatgccagagaaaatggtccggaaagtaaaaagtgtggtgcaatcacctgcaacggtgttaattgtagggattgcgtataaaaaagatgtaaatgatttgagagaatcaccagcgttaccgattattcaattattaagaaatcaaggatacgagatagaatatcatgatccttatatttctttcgcggaaattggagataaggtgtatcaatctgtttctttagatgaagaaaaagttaaaaaagcggattgtattttaattttaacggatcattctaatattgattggaagctttttaaaggaatggaccgagtaatagatacacgcgggattgtaaagaaggtgagtaaatgagtaagaaatgtttaatta

SEQ ID NO: 40423 - DNA, 1359 bp, Bacillus thuringiensis
gatcaaaaccaaggtttaaaacgtgaattgaaaagcaggcacatatttatgattgcacttggaggagttattggtaccggtctttttttaggatctggatatacaattcatgaagctgggcctgggggagcaattgtagcgtatcttgttggagggtttgttatgtatttaacgatgctctgtcttggagagttagctgttgcgatgcccgacgcaggatcttatcaaacgtatgcaacgaagcacatttcccctgcagcgggttatgtagtcggatggatgtcgtggttaaactggtctgctacgataggtattgaactgattgcagttagtattttaatgaaacgatggtttcctgatgtaccgtcatggatttggtgtgtagcgtttgcggtgcttctctttgctatcaatgcattatcttcaagaagttttgcagaagttgaattttggtttgcaagtattaaagtaattacaatcattgcatttattattttgggcggggcagcaatgtttggttttctagatatgaaaggaaatgaaccagcaccaatgttctctagttttactgattatggtggattgtttccaaatggattatccgctattttaattacgatgattgctgttaatttttctttccaaggaacagaactagtcggtattgcagcaggtgagagtgaaaatccagaaaaaacaatcccaaaggcaattaataatacagtttggcgtatactcgtgttctttgtattatctattttcattcttgcaggattattcccatggcagcaagcaggagtgatagaaagtccattcgtagttgtatttgataaaattggtattccttatgcagctgatattataaacttcgttattattacagcagtactatccgttgcgaattcaggattatatgcaacttctcgtatgctatggtctatgtctaatcaaggaatgattagtccgatttttggtaagttatctaaaaatggtgttcctatttatgcattgattgtaagcacgattgtaggctgtctttcattactatcaggtatttatgcggaagatacagtttatttatggctactttctattgccggatttggggcgatattagtttgggcatctattgctttatctaacttattagctagaagggcatatgttaagcagggcggagatgtgaaggacttgaaatttaaaacaccgctatatccattcgtaccacttctggcattagcattaaatataacagttatagttgctatggcttttatcccagagcaaagaatggcgttatattgtggaattccatttatgattgtttgtttactgttttaccgtgcgacaagaaataag

SEQ ID NO: 40424 - DNA, 1665 bp, Bacillus thuringiensis
ggtttatttatactcgacttttcttgtgcggttgtcgcaggattattagaactcggcttcccgcttatcgtaaatcaatttattgataagttattgccagggcaaaactggacgcttattttatgggcttgtttcggtttactcgcagtttatatgttaaatgcaggcttacaatatgtcgttacatattggggacatatgcttggtgttaacattgaaacagatatgaggcagaaattatttgatcatattcaaaagctatcattcagattttttgataataataaaactggtcatttaatttcacgccttacaaacgatttaatggaaattggggaaattgctcaccatggaccagaagatctatttatcgccgtaatgactttagttggggcattctcatttatgatgatgatcaactggaagttagcgttattaacgttcttcgtcattccattcctattatggttagcactttactttaataaaaaaatgacaggtacatttagacgtttattctcagacgttgctgattttaatgcatgcattgagaacaatgttgggggaattcgtgttgtacaagcattcggaaatgaaaagtttgagaaagagcaatttgctgtcaacaacgctcgtttccgtacaacgaaattaatggcgtataaaattatggcgttaaattcatcgattagttatatgctcatgcggctcgtaacgctcttcgtcttaatatgcggtacatggtttgttctgcaaggagaattaacgtacggtggatttatcggattcgttctattaacgaatattttcttccgcccaattgaaaaaattaacgcggtaatcgaaagctatccgaagggaatcgccggttttaaaagatatgtagagcttcttgaaacagagcctgacattgtagactctaaagatgcaatggaagttaaacatgtacatggtgatattcaatataacaacattacgttcggatatgaaaataaagaaccaattttaaatgacattagtttgaaaatacatgcaggtgaaacggttgcgttcgttggaccatcaggagctgggaaaacgacgttatgtagcctattaccacgtttttatgagcaatcatctggatcaattcaaattgatgggattgatacgaaagatatgacattatcttcacttcgtaagcaaattggaattgtgcagcaagacgtgttcttattttcaggaacaattcgtgaaaatatcgcttacggaaatttaaaggcatcagagcctgaaatttggcaggcagtaaaacgtgcgcagttagaagatttaatttactcacagccggaaggtttagatactgttatcggtgagcgcggcgtgaaactttcaggtggacaaaagcagcgtctagctattgctcgtatgttcttgaaaaacccgccaattttaatattggatgaagcaacttctgcactagatacagagacagaacttgcgattcaaaaatcgcttgctgaattagctgtcggtcgcacaacgctagttatcgctcacagacttgcaacgattaaaaatgcagatcgcatcgtcgttgtaaataaagatggcattgcagaacaaggttcacataatgaattaattgagcaaggcggaggatacagtaggttatacgaagctcag

SEQ ID NO: 40425 - DNA, 684 bp, Bacillus thuringiensis
atgataaaaatgacgaatgtttataaggagtacccgaatggtatgaaagccattgctggtcttacagttaacattaaacaaggtgaattcgtatacgtagttggaccgagtggagccgggaaatctacatttattaaaatgatgtatcgtgaagagaaaccatctacaggatctattaatgtaaatggacttactatcgaaacattggcagaaagagacgttccgtattttcgtcgtcaattaggcgtaattttccaagattttaaattgctacctaaattaacggtatatgagaatgtttcgtttgctttagaagtaattgaagaagaaccggatgcaattcgtgagcgtgtaacagaagtgctaggtcttgtaggccttgaagatcgtgcagacgcacttccaagtgagctttcgggcggggagcaacaacgtgtggctattgcaagagcaattgtaaatagaccaaaggttgtaattgccgatgagccaacaggtaacttagatattgaaacagctcttgatattatgaatatttttactcgcattaatgagcgcggcacaacgatcgttatggcgacgcataatgcagatatcgtaaatacaatccgtcatcgtgtaatcgcgattgaaggcggaaaaattgttcgagatgagattgagggaggatacggatatgaaggc

SEQ ID NO: 40426 - DNA, 507 bp, Bacillus thuringiensis
atgaatattgaaataaaagacactttaatttctgaagaacaattacaagcaaaagttaaagaattagcacttcaaatcgaacgtgactttgaaggagaagaaatcgtagttatcgcagtattaaaaggttcattcgtatttgctgctgatttaattcgtaacatcaaaaatgatgtaacaattgactttatttctgcatctagctacggaaatcaaacagaaacaacaggaaaagtgaaactactaaaagatatcgacgtaaacattactgggaaaaacgtaattgttgtagaagatattatcgattctggtttaacacttcatttcctaaaagaccacttctttatgcataaaccaaaagcactcaagttctgtacattacttgataagccagaacgtcgtaaagtagacttaacagctgaatatgttggcttccaaattccagacgaattcatcgttggatacggtatcgactgtgcggaaaaatatcgtaacttaccattcatt

SEQ ID NO: 40427 - DNA, 539 bp, Bacillus thuringiensis
attatgattccagttcaagatgtcacaaaacattttttgaatggaaaaggtttgtttcatattacatttgatgtaaaagagggagaagtatttggttatttaggaccgaatggtgccggaaaatcaacgacgattcgtaatttaatgggatttataaaaccgacagctggtaaagcgacaattttcggattagattgttggaatgaagcagcgaaaattcaaagggaagttggttatctaccgggtgaaatttcttttattgaaggaatgaacggattagagtttttaaaattaatgcaaggaatgcgtggattaaaggatacgaaaagacgagatgaactgatagagcgtctgcaatttgatgtgaaaacaccgattcgcaaaatgtctaaagggatgaagcaaaaagtagggatagtcgctgcatttatgcacgatccagaggtgttattttagatgaaccaacatctggacttgatccacttattgcacaagtgtttattgatttaatatttgaggaaaagcacagaggaaaaaca

SEQ ID NO: 40428 - DNA, 375 bp, Bacillus thuringiensis
ctagaaggtgcgttatcactaagagagatctcgtacatccaaccacaagcattcgctgcaggagagttataccccggaccaatcgcggaaattgaaactggcacagcagttatagcccttcagcctcaagtgcacgtaagccttgcacttcctggaaacataaaggaagtagtagcacggggggctaacccgtgtatcatatcaatgcgaggcatagaaatgccaggtggcagcgtcggattaccagctgtacgcgaagcgctagccccgttagtagcaggtatcccattacgacatgtctcacagtaggcagcacttcaccgcgagcgtcacgttgatgacccacgtaccgtagctgactctgtaactgctgag

SEQ ID NO: 40429 - DNA, 441 bp, Bacillus thuringiensis
atgaagctgtccttttcacttggtttcaatgctctcacgttgcttcttcaagtttgcatctttgctcaagccaggatttctaatgagactgatatgcaagctttgcttgagttcaagtctcaagtttctgaaaacaacaagagagaggtcttggcttcatggaatcactcctccccattttgtaattggataggagtcacatgtggccgcaggagagaaagagttataagtttgaaccttggaggattcaagttaaccggtgtgatctcaccctccattggtaatctctcctttcttagattacttaatcttgcagacaactcttttggaagtaccatccctcaagaggtgggaaggctatttaggcttcagtacttgaacatgagctataatcttctcgaaagaaggattccgtctagtctttctaactgctctagactg

SEQ ID NO: 40430 - DNA, 582 bp, Bacillus thuringiensis
ttatatggtgtaatcggaaatccaattggacattcatatccacccgttatgcataacgatgcatttgaacacttgaatatggatgcccattatcatgcgttccttgttgaagaggaattgctagggaaagcagtaagaggtttaaaagcattaggtatttcaggatttaatgtaacaactccgcacaaggttgctattatggagtatttggatgagattgacccattggcaaggaaaatcggtgcagtaaatacagtggttcataaggatggaagattaattggctataacacagacgggattggttttgttcgagcgctgcagtcaattagtaatgaaccacttcaagggaaacgtattttgttacttggttcaggtggtgctagccgagctatttatttttctcttgctgatgtaggtgtaaaagagattgatgtagccaatcgtacagtagataaggcgaaggaacttattgctgcacgtacggccgatgttaattctgttgctttgtcgttagaaaaagcgacagaagaacaaggaaattataataaaatcattcagacgacaacgataggtatgcat

SEQ ID NO: 40431 - DNA, 336 bp, Bacillus thuringiensis
gacgtcatggctgcagattatggagagtcctctcactctttgattctgcaattgccaagtgactatgcagctgaatttgcctgaggtggctcgtgcatatgtcatggccaaaaccctctggttgcgtgcgctcgagcatttttcacagatggagatatattacttctcgcggaagggacatctaagatcgacacatgtgcagaactgcaagtgcatgcagggctatttaatttattgagcggagttacatgttctcagatgtctcaccgactcagtacacttgaaacagcagatcaaattacggttatgaaggcgggaagaattctagattgaggg

SEQ ID NO: 40432 - DNA, 1200 bp, Bacillus thuringiensis
atgctaaggtatcattttcctgatgtgtgtgaaggcgaattaattaatatatattcttatgggaatttcaaagggaaaggaaaatatgtatgcctctttaaaaatgaaaaccaatcatttttattttggaaaaacgaaaaaggacataaaatatatacaaatttagactctatcagcgtggaaataatagacacgaataatacgtataaccaaagccaaaattggctgtacgcgcaagatttagtggatacgtataaccagagccaaaatggtgcctgcgcgcaagatttaatggatacgtataaccaaagccaaaatggtgcctacgcgcaagatttagtgaatacgtataaccaaagtcagaatggtgcctacgcgcaagatttagtggatacgtataatcaaagtcagaatggtgcctgcgcgcaagatttaatggatacgtataaccaaagccaaaatggtgcctacgcgcaagatttagtgaatacgtataaccaaagtcagaatggtgcctacgcgcaagatttagtggatacgtataatcaaagtcagaatggtgcctgcgcgcaagatttaatggatacgtataaccaaagccaaaatggtgcctacgcgcaagatttagtgaatacgtataaccaaagtcagaatggtgcctacgcgcaagatttagtggatacgtataatcaaagtcagaatggtgcctacgcgcaagatttagtggatacgtataaccaaagtcagaatggtgcctacgcgcaagatttagtgaatacgtataaccaaagtcagaatggtgcctacgcgcaagatttagtgaatacgtataaccaaagtcagaatggtgcctacgcgcaagatttagtggatacgtataatcaaagtcagaatggtgcctacgcgcaagatttagtggatacgtataaccaaagtcagaatggtgcctacgcgcaagatttagtgaatacgtataaccaaagtcagaatggtgcctacgcgcaagatttagtggatacgtataatcaaagtcagaatggtgcctacgcgcaaaatttagtggatacgtataatcaaagtcagaatggtgcctgcgtgcaagatttagtgaatacgtataatcaaagtcagaatggtgcctgcgtgcaagatttagtggatacgtataaccaaagtcagaatggtaattgtggttgtaag

SEQ ID NO: 40433 - DNA, 1905 bp, Bacillus thuringiensis
atggctatgaggtctcaaaaattcacactgctattactatccctactacttttcttacctctttttctcacaaattttattactccaaatctcgcattagcagattcaccaaagcaaagtcaaaaaattgttgggtactttccttcgtggggcgtttacggacgtaattatcaagttgctgacattgatgcatcaaaacttactcaccttaactatgctttcgcggatatttgttggaatggaaaacatggaaaccctttctactcatctgataatcaaataaacaaactggactgtaaagatctggtgtaccattgcaaaataaaggttcctaatggtactcttgtactcggtgaaaaccatgggctgatgttaccaaatcgtatcctggctcaggggacaacttgggaagattgcgataaatatgcccgtggaaatttcggggaactaaaacgattaaaagctaaatatcctcacttaaaaacaattatttccgttggtggctggacttggtctaaccgcttttctgatatggccgctgatgaaaaaacaagaaaagtatttgctgaatctacagtagcttttcttcccgcatatgggtttgatggcgttgatttagactgggaatatccgggcgttgaaacgattcctggtggtagttatcgtcctgaagataaacaaaatttcactctccttcttcaagagctccgaaatgctttgaataaagcaggtgctgaagattgcaaacaatatttactaacaatcccttcaggtgcaagtcaacgctacgctgatcatacagaactaaagaaaatttctcaatactcgattggattaatattatcacatatgatttccacggcggatgggaagctacttctaatcataatgcagctctatataggatccaatgacccagcagcaaatacgaatttttacgtagatggtgctataaatgtttatacaaatgaaagggtttcccttccaacgcagtgtccaaaattacttgatacgctagtaaaagaattacttggtggacctattagtcaaaaagatactgagccaccaacgaatgttaaaaacattgtagttacgaataaaaattcaaactcagttcaattaaactggactgtatctactgataacgtaggagttacggaatatgaaattactgctggagaagagaaatggagtacaacaacaaatagcattacaattaaaaacttaaaacctaatacggaatacaaattttcggtaattgccaaagatgctgctggaataatcacacctaccgctcttactgtcaaacgatcatccaacgcgacacctgatggaaatggtactgctacattttcagtcacttcgaattggggcagcggttataacttctcgattataatcaaaaataatggaacgactcctattaaaaagtggaaattagaatttgattatagcggcaatttaacacaagtttgggattctaaaattagtagtaaaacaaataatcattatgtaattacgaacgcaggatggaatggtgaaattcctcctggtggatctattacaattggcggtgcaggaacaggtaatcctgccgaacttttaaatgccgtcattagcgaaaactacacgttatatccattaattacttcaataaagtttgaatttaggtttgagcaataccttctaaattcaaactttaaattttatgaaaaatcaaaaatatcacaaaaacctattataattatatttaatttcaaatatgaagtttatatgaagttcatttggattttacatgaatttcctttaatttctattgtcttctataatatcatattatctttacataaaggaattattttattcatttcaactatctatatatataagaagatagtcacctgt

SEQ ID NO: 40434 - DNA, 1192 bp, Bacillus thuringiensis
atgaaaaagaaagtacttgctttagcggcagctattacattagttgctccattacaaagtgttgcatttgctcatgaaaatgatgggggacagagatttggagttattccgcgctggtctgctgaagataaacataaagaaggcgtgaattctcatttatggattgtaaaccgtgcaattgatattatgtctcgtaatacaacacttgtaaaacaagatcgagttgcactattaaatgaatggcgtactgagttagagaacggtatttatgctgctgactatgaaaatccttattatgataatagcacatttgcttcacatttctatgaccctgacaatgggaaaacttatattccgtatgcaaagcaggcaaaggaaactggagctaaatattttaaattagctggtgagtcttacaaaaataaagatatgaaacaagcattcttctatttaggattatctcttcattatttaggggatgtaaaccaaccgatgcatgcggcaaactttacgaacctttcgtatccacaaggattccattctaaatatgaaaactttgtagatacgataaaagataattataaagtaacggatggaaatggatattggaactggaaaggtacaaatccagaagattggattcatggagcggcagtagttgcgaaacaagattacgctggcattgtaaatgataatacgaaagattggttcgtaagagcagctgtatcacaagaatatgcagataaatggcgcgctgaagttacaccaatgacaggtaagcgtttaatggatgcacaacgtgttactgctggatacattcagctttggtttgatacgtacggaaatcgttaagtatttgaaaaaggtcaaatctcagaatagagtatttggcctttttatgactatacaatacatggaggtatgaaacgtgaaaggtaaattgctaaaaggtgtacttagctttggggttggtttaggagctttatatagcggaacttcagctcaagcagaagcatctacaaatcaaaatgatacattaaaagtgatgacgcataatgtatatatgctatcaacaaacttatatccaaactggggacaaactgagcgtgctgatttaatcggggcggcagattatataaagaatcaagatgttgttatattaaatgaagtgtttgataatagtgcctcagat

SEQ ID NO: 40435 - DNA, 1944 bp, Bacillus thuringiensis
gtgagcatattgaatgtaataaattgtgaagaagtgaaacgagatgagtttcatacagaaaagtactatgaaagttataacatctttggcgcgcatgttgtgacggaagatgagattcaaggggtacgatttacagtgtgggctcctcatgcgaaagcaatgagtgttgttggggattttaatgagtgggattatgagcaacataagatgctacaagtgacagaagaaggcatttggtccttatttataccgcatattgaagaaggagaaatatataaatatgcgattgaaacgttggctggtgacgtcattttaaaggcagatccgtatgctgtatatgcagaagtaagaccgaatacggcatctgtagtttttgatataaaaggatatgaatggaatgataaaaactggaatcgtaagaaaaagaaaaaatcgatttataaagaagcgatgacagtttatgaattacattttggttcttggaaaaagaaagaagatggaacgctgtactcttacagggaaatggttgaagagctcatcccgtatgtggtggaacatcaatttacacatattgaaattatgccgcttgttgagcatccatatgatcgttcttggggataccaaggaacgggatattatgcagcgacgagtagatttggtacgccgcatgatttaatgcattttgtcgacgaatgtcataaatatggaatcggtgtcattttagattgggtgccggggcatttttgtaaagatgctcacggtttatatttgtttgatggtacaccgacctatgaatataaagataaagatgtacaagaaaatccagtatggggaactgtcaattttgatttaggaaagagagaggtacgtaatttcttaatttcaaatgcgttattttggatgagatatttccatattgatggtttcagagttgatgcagttgcgaacatgttgtactggaataaagaaggacaagagcaaagtaatgagcatgctgtttcatttttaagagagttaaatgaagcagtgtttgcagaggatgaagattttcttatgacggcagaagattcaacagcttggccacttgtaacaactccaacgtatgaaggtgggcttggattcaattacaaatggaacatgggctggatgaatgacgtgctgaaatatatggagtgtgcgcctgaatataggaaacacattcatgagaaaatgacgttttctttactatatgcgtactctgaaaacttcatattaccgctttctcatgatgaagtcgttcatgggaaaaagtcgttattaaataaaatgccaggtgattactgggataagtttgctcaacttcgtttattatatggatatttctttactcacccaggaaagaagttacttttcatgggaggagaattcggacagtttgatgagtggaaagaccttgaagatttagattggaatttacatgattttgaaatgcatcgttatatgcatgattactttaacgagctcatagcattgtataagcgctcaaaaccactttggcaacttgaccattcacctgaaggttttcagtggattgatgctaataataatgagcaaagtattttctcttttatccgccaaggggataaacaagaagatgcgttagttgtcgtatgtaattttacgaaagctacatatgaaaactataaagtaggtgtaccagatttcgagtattataacgagattttaaacagtgatgctgagcaatatggcggttcggggcaagtgaataagaaacgtcttaagacgattctagaaccgtaccataatcaagcagcgcatgtagagattacaattccaccatttggcgtatccatattacgaccagtgaagacgagaaaggggagcaaaaaacaagatggctcaaaaacaaaagtgcgtagcaatgttactagcagggggaaaagg

SEQ ID NO: 40436 - DNA, 1539 bp, Bacillus thuringiensis
atgactagttatatgttaggaatcgatatcggcacgacaagcacaaaagctgtgctgttcagtgaaaacggagatgtggtacagaaagaaagcatcggctacccgctctatacaccggacatctcaacagctgaacaaaatccggaagagatttttcaggcagtcatccatacaacagcgagaattacaaaacagcatcccgaaaaacggatctctttcatttcgttcagcagcgccatgcacagcgtcattgcaatcgacgaaaatgacaagccgctgacgccatgcattacatgggccgacaacagaagtgaaggctgggcgcataagatcaaagaggaattgaacggacatgaggtgtacaaacggacgggaacaccgattcatccgatggcaccgttaagtaaaattgcctggatcacgaatgaaagaaaagaaatcgcttccaaggcaaaaaaatatatcggcatcaaagaatacatttttaaacagctgttcaatgagtatgtcatcgattactcattggcatcagcgacaggcatgatgaacctgaagggcttggattgggacgaagaggcactgcgcatcgcaggcatcacgccggatcacttatccaaactcgtgccgacaaccgagatctttcagcactgcagcccggaaatagcgatccaaatgggaatcgatccggaaacgccttttgtcatcggcgccagcgacggcgtgctgtccaacctcggcgtcaacgccattaaaaagggtgaaatcgccgtcaccatcggtacaagcggtgccattcggacgattattgacaagccgcaaaccgatgaaaaagggagaattttttgctatgccttgacggacaagcattgggttattgggggacctgtgaacaatgggggcatcgtccttcgctggatcagagacgagtttgcctcctccgaaatcgaaacagcgacacggctgggcattgatccatatgacgtgctgacgaaaattgcccaacgcgtcagacccggttctgacggtctgctgttccacccatatctcgccggagaacgcgctccgttgtggaatccggatgtacgcggctcatttttcggcttgaccatgtcgcataagaaagagcatatgatacgcgcggcattggaaggcgtcatttacaacctgtacacggtgttcttggcgttaactgaatgcatggatggcccggtaacccgcatccaagcgacagggggttttgcaaggtcggaggtttggcgccaaatgatgtcggatatcttcgaatcagaggttgtcgttccggaaagctacgaaagctcatgtctcggcgcctgcattttaggcctgtatgcaacaggaaaaatcgattctttcgacgccgtgtccgatatgatcggcagcacatacagacatacgccgatcgaagactcagccaaggaatacagaacattaatgccgattttcatcaatctatcaagattattagaaaatcaatatacacaaattgcagattatcagaggggcttaatcacacacaaa

SEQ ID NO: 40437 - DNA, 471 bp, Bacillus thuringiensis
gtcagatcatcttctcgaaccccgagtgacaagcctgtagcccatgttgtagcaaaccctcaagctgaggggcagctccagtggctgaacaacacggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctg

SEQ ID NO: 40438 - DNA, 1944 bp, Bacillus thuringiensis
gtgagcatattgaatgtaataaattgtgaagaagtgaaacgagatgagtttcatacagaaaagtactatgaaagttataacatctttggcgcgcatgttgtgacggaagatgagattcaaggggtacgatttacagtgtgggctcctcatgcgaaagcaatgagtgttgttggggattttaatgagtgggattatgagcaacataagatgctacaagtgacagaagaaggcatttggtccttatttataccgcatattgaagaaggagaaatatataaatatgcgattgaaacgttggctggtgacgtcattttaaaggcagatccgtatgctgtatatgcagaagtaagaccgaatacggcatctgtagtttttgatataaaaggatatgaatggaatgataaaaactggaatcgtaagaaaaagaaaaaatcgatttataaagaagcgatgacagtttatgaattacattttggttcttggaaaaagaaagaagatggaacgctgtactcttacagggaaatggttgaagagctcatcccgtatgtggtggaacatcaatttacacatattgaaattatgccgcttgttgagcatccatatgatcgttcttggggataccaaggaacgggatattatgcagcgacgagtagatttggtacgccgcatgatttaatgcattttgtcgacgaatgtcataaatatggaatcggtgtcattttagattgggtgccggggcatttttgtaaagatgctcacggtttatatttgtttgatggtacaccgacctatcaatataaagataaagatgtacaagaaaatccagtatggggaactgtcaattttgatttaggaaagagagaggtacgtaatttcttaatttcaaatgcgttattttggatgagatatttccatattgatggtttcagagttgatgcagttgcgaacatgttgtactggaataaagaaggacaagagcaaagtaatgagcatgctgtttcatttttaagagagttaaatgaagcagtgtttgcagaggatgaagattttcttatgacggcagaagattcaacagcttggccacttgtaacaactccaacgtatgaaggtgggcttggattcaattacaaatggaacatgggctggatgaatgacgtgctgaaatatatggagtgtgcgcctgaatataggaaacacattcatgagaaaatgacgttttctttactatatgcgtactctgaaaacttcatattaccgctttctcatgatgaagtcgttcatgggaaaaagtcgttattaaataaaatgccaggtgattactgggataagtttgctcaacttcgtttattatatggatatttctttactcacccaggaaagaagttacttttcatgggaggagaattcggacagtttgatgagtggaaagaccttgaagatttagattggaatttacatgattttgaaatgcatcgttatatgcatgattactttaacgagctcatagcattgtataagcgctcaaaaccactttggcaacttgaccattcacctgaaggttttcagtggattgatgctaataataatgagcaaagtattttctcttttatccgccaaggggataaacaagaagatgcgttagttgtcgtatgtaattttacgaaagctacatatgaaaactataaagtaggtgtaccagatttcgagtattataacgagattttaaacagtgatgctgagcaatatggcggttcggggcaagtgaataagaaacgtcttaagacgattctagaaccgtaccataatcaagcagcgcatgtagagattacaattccaccatttggcgtatccatattacgaccagtgaagacgagaaaggggagcaaaaaacaagatggctcaaaaacaaaagtgcgtagcaatgttactagcagggggaaaagg

SEQ ID NO: 40439 - DNA, 858 bp, Caulobacter crescentus
atgaccaacgccatcacgggcgcggccattgtcggcggtgtctgcggtcaaccgatcaagcattcgatgagcccggtgatccacaacgcctggatcgcagcggccggccttgacgcggcttatgtgccattcgccccggcggctgatcggttcgagacctttgtcgacggtttgcgtggcggcgcggtgcgcgggctcaacgtcaccattccgttcaaggagcgggcgctggccgtcgccgacaccgccagcgatctggcgcggatggccggggcggccaatctgttggtgttcaatgaggacggcagcgtccatgccgacaataccgacggcccgggcctgctgggcgccatcgcgatccaggcgcctggcttcgacgtcacggccgcacctgtggtcattctcggcgcgggtggcgcggcccggggagcggtcgcggccctgctgctggccggcgcgccgcgcatagctgtcgtcaaccgcactgtcgcgcgcgcccaggacctggccgacacgttcggggagaaggtcgtagccaagggcgaagacgccctccccgctctgctgccagaagcgggattgatcatcaacgcgacctcgctaggtctgggcggcggcgctgggccgtcagccgacttgaccctgacccccaagaccgccgtcgtgatggacatggtctacaagccgctgcggacagagttcctgcgccgggccgaggccgccggtcgccgtacggtggacgggctggagatgctgctgcgtcaggcgatccccaccttcgagaccatttatggccaggccccctcccccaagatcgacgttcgggtcctggcgctcaagctcctgggcgaggtctga

SEQ ID NO: 40440 - DNA, 1896 bp, Caulobacter crescentus
atgagcaagattatcggtatcgaccttggcaccacgaactcgtgcgtcgccatcatggacggcaagaccccgaaggtgatcgagaacgccgagggcgctcgcaccaccccgtcggtcgtcgccttcctcgaggacggtgagcgcctgatcggccagcccgccaagcgccaggccgtcaccaacccgaccaacacgctgttcgcgatcaagcgcctgattggccgcaccgccagcgacccggtggtcgagaaggacaagggcatggtgccctacgagatcgtcaagggcccgaccggcgacgcctgggtcaaggcccacggcaaggactacagcccgcaggaagtctcggccttcattctgcagaagatgaaggaagccgccgaagcccaccttggcgagccggtgaccaaggcggtcatcacggttccggcctactttaatgacgctcagcgtcaggccaccaaggacgccggcaagatcgccggcctggaagtcctgcgcatcatcaacgagccgacggccgctgcgctggcctacggtctcgacaagaacgacggcaagaagatcgccgtctatgacctgggtggcggcaccttcgacgtgtcgatcctggaaatcggcgatggcgtcttcgaggtgaagtcgaccaacggcgacaccttcctgggcggcgaggacttcgacctgcggatcgtcgactacctggccgacgagttcaagaaggagcagggcgtcgacctgcgcaaggacaagctggctctgcagcgcctgcgcgaagaggcggaaaaggccaagaaggagctgtcgtcgacggctcagtacgaggtcaacctgccgttcatcagcatgaacgcctcgggtccgctgcacctgaacatcaagctgtcgcgcgccaagctggaagccctggtcgacgacctgatcgcccgcaccatcggtccgtgcgaacaggctctgaaggacgctggcctgaagaagagcgacatcgacgaagtgatcctggtcggcggcatgagccgcatgcccaaggtccagcaggcggtgcaggacttcttcggccgcgagccgcacaagggcgtgaaccctgacgaagtcgtggctctgggcgcggccgttcaggccggggtgctgcaaggcgacgtcaaggacgtgctgctgctggacgtgaccccgctgaccctgggcatcgagaccctgggcggtgtgttcaccccgctgatcgaacgcaacaccaccatcccgaccaagcgctcgcagaccttctccaccgccgacgacaaccagtcggccgtgacgatccgggtgttccagggcgaacgcccgatggcgcaggacaacaagatgctgggccagttcgacctggtcggcatccccccggcgccgcgcggcgtgccgcagatcgaggtcacgttcgacatcgacgccaacggcattgtccaggtccacgccaaggacaaggcgaccaacaaggagcactcgatccgcatccaggccaatggcggcctttcggacagcgacatcgagcgcatggtcaaggaagccgaggccaacaaggctgcggacgaaaagaagaagcagctggtcgaggccaagaaccagggcgaggcgatcctgcactcgaccgagaaggccctggccgagcatggcgacaaggtcggcgcggctgagaagaccgcgatcgaaaccgggatcaccgagctgaagaccgccctggaaggcgaagacgtcgaggccatccaggccaagacccaggcccttatccaggcttcgatgaagctgggcgaggccatgtacgccgcccagcaaggctcggccgagggcggcgacgccaaggctgacgacggcgtggtcgacgccgagttcgaggaagtcgacgacaacaagccggcggcttaa

SEQ ID NO: 40441 - DNA, 1158 bp, Caulobacter crescentus
atgcgcgactattacgaaattctcggcgtgacccggaccatcgatgaagctggtctgaagtccgcgttccgcaagctggcgatggaacaccaccctgaccgcaatggcggctgcgagaacgcggccgggcggttcaaggaaatcaacgaggcctattcggtcctctccgatccccagaagcgcgcggcctatgaccgcttcggccatgccggcgtcaacgggccgcaaggcggtccgggcgggttcggcggccagggcttcgacgccagcgacatcttcaacgacgtctttggcgatgtgttcggcgagatgttcggcggcggtcgtcgccagtccaacgccccccagcgcggccaggacctgcgttatgacctggagatcaccctcgagcaggcctatgcgggcgccgaggtcgagatcaccgttcccgccgccatgacctgcgaggtctgcgaagggtccggcgccaagccgggcaccagcccctctgtctgcggcacctgcggtggcgcgggccgtgtccgagcgacccagggcttcttcgccgtcgagcgcggttgcccgcgctgcggcggatccggccgtctggttctggacccgtgctccaactgccatggccatggccaggtgcgtcgcgagcgcatcctgtcggtccgcatcccggcgggcgtcgacgacggcgcccggatccgcctggccggcgaaggcgacgccggcgcgcgcggcggtccgcgtggggatctctacatcttcctgtcagtgaccccgcacgagctgttcgagcgtgatggtctggaccttctctgcaccgtgccggtgccaatgaccacggcggccctgggcggcgagatcgacgcgccttgcctcttgggtggcgagagctgcgacggcgagtgcaaggtcaaggtccatgtgcccgaaggcgctcagaccggtaagaccgtccgcctcaagggcaagggtatgccgtccctgcgcagccgccagcgcggcgacctggtggtcgaactgttcgtcgagaccccgacccatctgtccgcgcgccagaaggaactgatgcgcgaactggcgggcctgtgcggcgaaaagcagaaccccaagtccgccaacttcgtcggcaaggcgaagaggttctgggaagaggtcacggggagctag

SEQ ID NO: 40442 - DNA, 2712 bp, Caulobacter crescentus
atgaacgcccacgccacgccgacccctgcccacgagatcgaccccaccggcgccacgccggtgatggcgcagttcttcgagatgaaggcgcggcagcctgatgcgctgatcttcttccgcatgggcgatttctacgagctgttcttcgacgacgcctacaaggcggccgctgctctgggcatcagccagacgttccggggcacgcataacggccagccgatcccgatggcgggcgtgccgcagcatgcggccgaggcctatctctccaagctgatccgtctgggcttcaaggtcgccgtctgcgagcagatggaagaccccgccgaggccaagaagcgcggctccaaggcagtggtccgccgcgatatcgtccgggtggtgacgccgggcaccctgaccgaggatggcctgctggacgcccgcggggccaaccgcctggcggcggtggccctgcgcgccggccaggcggctgtggcgtcggtcgagctgtccaccggcgaggtcgaggtgctcgccgtggccaaggagggggtcgccccgatcctggcggccttggcgccgtccgagaccctggtcgccgaccggctgctgtccgatgacagcctttcccagaccctcaggatctgcggcggccttgtgcagcccatgccctcggccctgtccgagccccaggcctcggagacccgcgtaaagcgcctctatggcgtcgagaccctggacggcttcggcggtctgtcgccggccgagatcggggccctgggcctgatcgccgcccatctggaaatgacccaggccggccgactgccggccctgcgcgcgccgcgccgggcggccgacgccgatgtcatggcgatcgatccggccacccggtccagcctggaaattgaccgcacccagagcggtgatcgcaacggctcgctgctggccgccatcgatcgcacggtgacggcggggggcgcgcggatgctggcctcgcgcctggcccgtccgctgctggatgtggccgccatcgaccagcgcctggacgcggtggaatggttcgtcgagcaccgccagctgcgtcagcgcctgcgcgaggtgctgaaaggcgccggcgacatggcccgcgccctgtcgcgcctggcgctgggccgaggcggtccgagggacctcggctgtattcgcgacaccctgaaggtcggtgagcggctggccggcatggcgggcggcgcgcccgatccgctgtcgccgccgccgttcgagctggagcacgccttcaaggccctgacacctgcgctgcatgagggcctgtcgcaatttctgaccacgctcgaacatggcctcggtcccgacctgccggcgctcgcccgtgacggcggtttcgtggcggcgggcgtgcggcccgagctggatcaggccaggggcctgcgtgacgacagccgcaaggtgatcgccgctctggaatcccagctggccctggaaagcggcgtgccgctgaagatccgccacaacggcgtgctgggctatttcgtcgaggcgacggcgggcaaggccgaccctctctttcagccgccgctgaacgccaccttcatccaccgccagaccctggccaatcaggtgcgcttcaccacggtggagctggctgatctcgacgcccgcatcgcccaggccgccgagcgggcgctggctatggaggtggccgccttcgaggactggcgcgagcaggcccgcctgctggccgacgccatccagatcgcctcggaagccctggcccgcatcgacgtggcctccagcctggccgaatgggccgaggacgcgggcgcggtgcggccggtcgtcgacgcctcctacgccttcgacgccaaggccgcccgccacccggtggtcgaggccgccgtgaagcgggcgggagagccctacacccccaatgactgccgcctggacgcctcgggcgaaacggcggcccgcctgtcgatcgttaccggtccgaacatggccggtaagtcgaccttcctgcgccagaacgccctgctggcgatcctggctcagtcgggttgctacgtgccggccgccagcttccggctgggcgtggtcgatcgcctgttcagccgtgtcggcgccggcgatgacctcgcccgcggccgctcgaccttcatgatggaaatggtcgagaccgcctccatcctgacccaggccggtccgcgcagtctggtgatcctggacgagatcggccggggcacggccacctatgatggtctggccatcgcctgggcctgcgccgaggccttgcacgacactaatcgctgccgcgccctgttcgccacgcactatcacgagctggcgaccttggagacgcggatggccttcgtctccaacctcagcctgcgggccaaggagtggaacggcgaccttgttttcctgcacgaagccgcgccagggccggccgatcgttcgtacggcgtgcaggtggctaaactggccggcgtgccggcgcccgtggtggtgcgcgcccgcgaggtgctggatcggctggagagcaaggaccagtcgccggccaagctggacgatctgccgctgtttgcggtcagtcaggcggtggccgtcacctccgcgcccgccaaggccgcgcctagcgccgtcgagaccagcctcgccgacctcgacgtggacggcatgagcccgcgcgaggccctcgaggcgctttaccgccttaagggtctgctcacggcctag

SEQ ID NO: 40443 - DNA, 1224 bp, Caulobacter crescentus
ttgagccgttcgtcctacatcttcaccagcgagagcgtttccgaaggtcaccccgacaaggtcgccgatcgcatcagcgacaccgtcgtcgacgccttcctctcggtcgatcccgaggcgcgcgtcgcctgcgagaccttggtgaccaccaatcgcgtcgtgctggccggtgaggttcgcgccggcaagccggacggcgacaagaaggccaacaagcagctgaccaaggacatcctcggctccctggagccgaaggtccgcgccgcgatcaaggatatcggctacgagcagaagggcttccactggaacaaggcgaagtactccaacttcctgcacggccagtccgcccacatcgcccagggcgtggacgccaccgacaagaaggaagagggcgccggcgaccagggcatcatgttcggctacgccagcaccgagaccccggagctgatgccggcgaccctgcagtacagccacaacatcctgaagcgcctggccgagctgcgtcacagtggcgcgctctccgagctggagccggacgccaagagccaggtgacgttggaatacgatggcaatggccgcccgctgcgcgtggtctcgatcgtcgtgtcgcaccagcacaagaagaagatcgacggcaaggccgcgacctccaagcgcgtgctggagctgatcaagccgcacatcctgccgatcttccccgacggcctgatcaccaagaagacccagtggctggtcaatccgaccggccgcttcgagatcggcggtccggacggcgacgccggcctgaccggccgcaagatcatcgtcgacacctacggcggcgcggccccgcacggcggcggcgccttctcgggcaaggacccgaccaaggtcgaccgttcggccgcctatgcctgccgctatctggccaagaacgtcgttgcggcgggtctggccgaccgctgcacgatccagatcgcctacgccattggcgtcgcccagccggtctcattccacgttgacctgcacggcaccggcaaggttgatccggcggtgctggaaaagaccctgccgcagctgatcggcggcgccaccccgcgcgcgatccgcgagcaccttcagctgaaccgtccgatctacgcccgcaccgccgcctacggtcactttggccgcacgccggacaacgaaggcggcttctcgtgggagaagaccgatctggtgggcgacctgaagggcctagcgtaa

SEQ ID NO: 40444 - DNA, 996 bp, Caulobacter crescentus
atgacctttgagaaggttggcgtgatcggcgccggcgcctggggcacggccctggcgcaggtggcggcgcgggcgggccttgcggtgacgctgcaggcgcgcgagcccgagatcgtggccgcgatcaatgacacgcacgagaatgcggtcttcctgccgggcatagcgctggagccggggatcaaggcggtcgccgacctggcggacctggccgactgcgacctgatcctggccgtcgcccccgcccagcacctgcgcgcggccctgaccgccttcgccccgcatcggaaggcgggcgcgcccgtcgtcctgtgctccaagggcgtcgagcagggctcgttgaagctgatgaccgacgtggcggccgaagccctgccgggcgcgccgatcgcggtgctgtcgggccccagcttcgccggcgaggtcgcccgcaacctgcccgccgccgtcaccctggcctgcgaggacgaggccctgggtcgcgccatcgccgaggccatcgccatcccgaccttccgcccctacaccgccaacgacctgatcggcgccgaggccggcggggcggtgaagaacgtgctggccatcgcctgcggcatcgtcgagggcaagggcctgggccgcaacgcccacgccacggtgatcacccgcggcttcgccgagctgacccgcctggccgtcgccctgggcgcgcgtccggagaccgtcgccggcctttgtggcctgggcgatctggtgctgacctgctccagcccccaatcgcgcaacatgagcgtgggtctggcgctgggccagggcctgaccctggagcaggcgctggccggcaaggtctcggtcgctgaaggcgtggcctcggcccccgccgtgcgcgccctggcccgcaaggtcggcgtcgaggccccgatctgtgaggccgtcgccgccatcctggcgggcgaggtcgcggtcgacgccgcgatcgccggtctgctctcgcgccccctgaaacccgaagcctga

SEQ ID NO: 40445 - DNA, 969 bp, Caulobacter crescentus
gtgtcccggcaacctcccatccgcatcggcgcgcgcggctccaagctgtccctggcgcaatcgggcctcatgcaggcgcggatcgcccacgcattgggggttccggccggagcgtccaaggacgagatcgaggcggccgccccgctgatcccgatcgtcaccagcggtgaccgcatccaggatcgccgcctgatggagatcggcggcaagggcctcttcaccaaggagatcgaggaggccctgctggacggtcgcatcgactgcgccgtccattcgctgaaggacatgccggccgagctgccgccagggctcgtcctggccgccacgcccgagcgcgaggatccgcgcgacgccttcatcagccatgtctgcgagcggctcgaggacctgcccaagggcgcgcgccttgggaccgcgtctctgcgccgccaggcccaggccctgcacgtgcggcctgaccttgagatcgtcatgctgcgcggcaatgtcgatacgcgcctggccaagctggagcgcggcgaggccgacgcgatcctgctggcccagtcgggcctcaatcgcctgggccttggccatctgaccaggagctggctcgatcccgacgcctgtccgcccgcgccgggccagggcgccctcgtcatcgagacccgggccgaggatatcggcgcgccgtggctcgaggctgtccgctgccgccagaccacgatcgccgtggccgccgagcgcggcgctctgctggcgctggaaggctcctgccgcaccgccatcggggcgcgtgcgatcctggacggggcgcggctttcgatgatcgtcgaggccctgacccccgacggcgctcagcgtttccgccgcgaaggcgacatcaccctgaccggcgccgacgacatcgccgaggcgcgcgcgttcggtctgacgctgggcgccgaggtccgggcggccggcggcgacgccatcatcctgccggaatag

SEQ ID NO: 40446 - DNA, 1206 bp, Caulobacter crescentus
atggctgacgcttacatctttgacgccgtgcgcacgccgcgcggcaagggcaagaaggacggctcgctgcacgagaccaccgccctgtcgctggccacccaggtgctggaagccctgcgcgaccgcaacggcctggacaccagcaaggtcgatgacgtcgttctgggctgcgtctcgccggtcggtgagcaaggcagcgacatcgcccgcaccgccgtcctgaccgccgactacgccgaaagcgtcgccggcgtgcagatcaaccgcttctgcgcctcgggcctggaagcggtgaacatggccgcggccaaggtcgcttcgggtgaagcgggcctcgccatcggcggcggcgtcgagagcatgagccgcgtgccgatgggcagcgacggcggcgcctggccgaccgacccctcctcggccttcaagacctatttcgccccgcagggcgtctcggccgacctgatcgccaccctgtatggcttctcccgcgacgacgtcgacgcctacgccgtcgagagccagaagcgcgccgccgccgcctgggcggacaaccgcttcaagaagtcggtgatcccggtgaaggaccagctgggcctgaccctgctggaccatgacgagaccgtccgcggctccaccaccatgcagaccctggcctcgctgaacccctcgttcacgggcatgggcgagatggctttcgatgcggtggtcacccagcgctatccgcaggtcgaacgcgtcaaccacgtgcaccacgccggcaacagctcgggcatcgtcgacggcgccgccggcgtgctgatcggcaccaaggagatgggcgaggccctgggcctgaaggcccgcgcccgcatcaagggcgcggcctcgatcggctcggaaccctcgatcatgctcaccggtccggccctggtcagcgaaaagctgctcaagaagctgggcatggaggtcaaggacatcgacctctatgagctgaacgaagccttcgcctcggtcgtgctgcgcatgatgcaggcgctggacatcccgcacgacaagatgaacgtgaacggcggcgccatcgccatgggccacccgctgggcgccaccggcgcgatgatcctgggcaccgtcctcgacgagctggagcgctcggacaaggaaaccgccctgatcaccctgtgcgtcggcgccggcatgggcaccgccacggtcatcgaacgcgtctaa

SEQ ID NO: 40447 - DNA, 1176 bp, Caulobacter crescentus
atgagcgtgctcaacgttgaaaagccggccttcatggccgaggaagacatcgcgatcttcgaggacgcggtcggcaaattcttcgacgagcacgcttctgaagcgaccgtggcgacgtggcgcaagaaccactgcgtcgaccgcgacatgtggaccaaggcgggggaggcgggcttgctcggcctctccacgcccgagcaatacggcggcgccggcggcgactaccggcacgaggtcgtgctgatggagcagttgggcaagaagggcgtcgacggtttcggcgccagcctgcataacgccatcgtcatgccgtacatcgtccactacggcaccgaggagcaaaagcagcgctggctgccccgcatggtgaccggtgagctggtcagcgccatcgccatgaccgagccgggcgccggctcggacctgcaaggcatcaagaccaccgccaagaaggccggcaatcagtacgtcatcaacggctccaagaccttcatcaccaacggccagaccgccaacctgatctgcgtggtcgccaagaccgatcccgccggcggcgcgcgcggaacgtccttgatcttcgtcgagaccgacggcccagatggccttcttgaaggcttcgagcgcggccgcaacctcgacaagctgggccaggaggcccaggacacctcggaactgttcttcaatgacgtgaaggttccgaccgagaacctgctcgggaccgacgagggccaaggcttcttccagctgatgggccagctgccgcaggagcgcctgaacatcgccgtgcagggcatggccacgatcgagcgggcgctggagctgaccatcgcctacgtcaaggaccgcaaagccttcggcaaggcgatcatcgacttccagaacacccagttcgtgctggcggaatgcaagaccgaggcgaccgtcgccaaggtgttcgtcaaccactgcatcggccagcatcttgagggcaagctcgacgcggccaccgcctcgatggccaagtactgggtctcggatctggagaacaagatcgtcgatcgctgcttgcagctgttcggcggctacggcttcatgaacgagtatccgatcgcgcgcatgtacaaggacagccgcatccagcgcatctacggcggcaccaacgagatcatgaaactcctgatcgcgaggacactatga

SEQ ID NO: 40448 - DNA, 1638 bp, Caulobacter crescentus
atgcacgaccgcgccggccttcgcgctcttcccgaagatcttgtcgatctcgacgcgctgatcggcgcctatttcgagatcaagccggacgtctccaatcccgcgcagaaggtcgtgttcggcacctcgggccatcggggctccagcctggacggcgcgttcaacgaggcgcacatcctggccgtcacccaggcgatcgtcgaataccgggccgcccagggcgtgaccggtcccctgttcgtcggccgtgacacccatggcctgtccgagcccgcctggcgctcggtgctggaggttctggcggccaacggcgtcgaggccctggtcgactcccgcgacggcttcaccccgacgccggcggtgtcgcacgccatcctgacccacaaccggcaaggcggacgccaggccgacggcctgctgctgacgccctcgcacaacccgccgcgtgacggcggcatcaagtacaatccgccgtcgggcggtccggcgggttccgacgccacctcggccatcgccgcccgcgccaatgagctgctggcgcagggcctggccggcgtgaagcgcgttcccttcgagaccgcccgcaaggccgtcggcgactacgacttcctgggccgctatgtcgacgacctgccggcggtgatcgacatcgcagcgatccgcgccgccaaggtgcggatcggcgccgatccgctgggcggcgcggccgtcgcctattggggcgcgatcgccgagcgccacgctctggacctgaccgtcgtcaacgacgccgtggacccccgctgggcgttcatgccgctcgacaccgacggcaagatccggatggactgctcgtcctcgtcggccatggccaatctgatcgggatcatgaagggcggcgcggcctacgacgtggccaccggcaacgacgccgacgccgaccgccacggcatcgtcacccccgacggcgggctgatgaaccccaatcactacctggctgcggccatctcgtacctgttcagccatcgtcccggctggggcgcagacacggcggtcggcaagaccctggtctcgtcctcgatgatcgatcgcgtggtgtcgggccttggccgccgcctgctggaggtgccggtcggcttcaagtatttcgtaccgggcctcctggatggctcggtcggcttcggcggcgaggagtcggccggcgcggccttcctgcgccatgacggcggagtgtggaccaccgacaaggacggcatccagctggccctgctagcggccgaaatccaggcggtgaccggcaagagcgccagccagctctacgccggcctgaccgatcagtacggcgcgccggcctatgcccgcgtcgacgccccggccagccgcgaggagaaggcgcgcctgtccaagctcagccccagcgacgtctcggccaagaccctggccggcgaggcgatcaccgacatcctcaccgccgcccccggcaacggcgaggcgatcggcggcctgaaggtctgcacgcagaacgcctggttcgcggcgcgcccgtccggcaccgaggacgtctacaaggtctatgcggagtcgttcttaggcgctgatcacctgaagcaggttcaggccgaggcccgcgaggtggtggcgggggcgttgaagggctga

SEQ ID NO: 40449 - DNA, 984 bp, Caulobacter crescentus
atgcaaacagttctggtgactggcggcgccggctatgtcggctcgcattgctgcctggccttggccgaggcgggttttcgcccggtcgtgttcgatgatctgtcgaacggccatcgcgagcatgtccagtggggccctctggaagtgggcgacatccgagacgccgcgcgcctggacgcggtgttcgccgcctatgcgccggtggcggtgctgcacttcgcggcgcgcatcgaggtgggcgagtccgtcaagaaccccggcgccttcttcgacaccaatgtcggcgggacgatcacgctgatcgaggcggcgcggcgagccggcgtgaaggtggtggtgttctcctccacctgcgcgaccttcggcgatccggtcgacctgccgatgaaagagacccacccgcaggcgcctctcaacccctatggccgcagcaagctgatggtcgagcaggccctggccgactacgatcgctatgtcgggctcaagagcgcggtaatgcgctatttcaacgccgccggcgccgacccgcagggccgtatcggcgagtggcacgagcccgagacccacgctgtaccgctggcgatccaggtggcgctcggccagcgaccgcgcttcacgatcttcggcgacgactatgacacgcgcgacggtacggccgtacgcgactacgtccatgtcctcgacctggcggatgctcacgtcgcggccctcaagcgcctgctcgtgggggggtcatcagagacctacaatctcgggacaggaaccgggacgacggtccgcgaattggtcgacggcgtgggtaaggtggccggcgcgccccttccggttgagatcgcatcgcgacgccccggcgatgcgccggtgctggtcggtgatcacgccaaggcgcgagccgaactcggatggaaggcttcccgaagtctggacgagatcctctcgaccgcctggcggtggcatcgcgggcgccttgaacaggaaccctga

SEQ ID NO: 40450 - DNA, 891 bp, Caulobacter crescentus
atggtcggacgtctgaacggcaaggtcgccgtcatcaccgggggctgctcgggcatcgggctgggaacggtcgaactgttcgtcgccgagggcgcctgcgtggtcgccgccgacctgcaggacgagaaggggcgcatgctggagcagcgctttccagatcaggtccgcttcgcgcggtgcgacgtcaccgccgatgacgatctggccaagaccatggccctggcggaaagcagcttcgggggcctggacatcctcttcaacaacgccgggcatggggggacgccggcgagcgtgcccgaactgaccgccgaggcctgggacaagaccttcgccctcctggtgcgcgggccggccatgggcatgacgcacgccctcccactgatgcaaaagcgcggcggcggctcgatcatcaacaccgcctcgatcgccgggctgcaggcgggctttgggcctctggcctattcctcggccaaggcggcggtgatccacatgagccgctgcgcggcggccgagctttcgccgcagaagatccgcgtcaacgccatctgccccggcctgatcgccacctcgatcttcggcgcctcgatgggcctgccgcgcgaggtcgccgaccagatggccgcccagatcgcctccatcgggccgaagatccagccgatcccgaaatcggggctgccggaggacatcgcggcggcggccctgtatctggctagcgacgactcgcgattcgtgacgggcacgcacatcgtcgtcgacggaggcatcaccgtgggtccgcgcagcgcctgggacatcaacacgccctcgccgatcctggcggccatgggcatcacgccggagcaagccgaacagatgcgggcccagttgctggcggctggcgggaccgggtga

SEQ ID NO: 40451 - DNA, 1347 bp, Caulobacter crescentus
atgagcaagcgcgcctatttcggcaccgacggcatccggggccaggccaacaagcatccgatgacggctgaggtggccctgcgcgtcggtctggcggccggcaagctgttccgctcgcaggacgaacgccgccatctggtggtgatcggcaaggacacgcgcctgtcgggctacatgatcgagccggccctggtggcgggcctgaccagcgtgggcctggacgttcgcctgttcggcccgctgcccaccccggccgtggccatgatgacccgctcgatgcgcgccgacctcgggatcatgatcagcgccagtcacaacagcttcgccgacaacggcatcaagctgttcgggcccgacggctacaagctgtcggacgcccaggagctgggcatcgaggcgctgatggaccagggcctgcaggaaggcctggccgccccccgcgagctgggccgcgtcaagcggatcgacgacgcccaggcccgctatgtcgagatcgtcaaggcgaccttcccgcgccacctgaacctgtcgggcctgcgcatcgtcatcgattgcgccaatggcgcggcctacaaggtggctcccaccgccctctacgagctgggcgcggaggtgatcacgctgggtgtctcgcccgacggcaccaacatcaacgaggagtgcggctcgacccatcccgaggctatggccaagatggtgcgcgagtaccgcgccgacatcggcatcgccctggacggcgacgccgaccgcctggtgatctgcgatgagaagggcgtggtcgtcgacggcgaccagatcatggcgatcatcgcggcggcctcgcacaaggccgggaccctgaagggcggcggcgtcgtggccacggtcatgtcgaacctgggcctcgagcgccagttgaacactatgggtctctcgctggaacgcaccgctgtgggcgaccgctatgtaatgcagcgcatgcgcgaaggcggcttcaatgtgggcggcgaacagtcgggccacctgatcctgtcggacttctcgaccacgggcgatggcctgatcgcggccctgcaggtgctggccgtcatggtcgagaccgacaagccgatgagcgcgctgggccgtcagttcgagccggtgccgcagctgctggaaaacgtccgcttcgtcggcggcaagccgctggaggcggcggcggtgaaggaagccatcgccgacggcgaggcccagctgaacggcgcgggccgcatcgtcgtgcgcgcctcaggcaccgagccgctgatccgcatcatggccgaaggcgacgacccggccctggtgaagaaggtcgtcaagtcgatcgcctcggcggtgaaggcggcctaa

SEQ ID NO: 40452 - DNA, 1821 bp, Caulobacter crescentus
atgtgcggcattatcggcatcgtcggaaaagaacccgtcgccgaccggctgatcgagagcctcaagcggctcgagtatcgcggctatgactccgccggtgtcgcaggtgtggtcggtggaaaggtcgagcgccgtcgggcccagggcaagatcaaggcgctcgaagccgtgctcgccgatgagcccctgacggcgaccaccggcatcggccacacccgctgggccacgcacggcgcgcccaatgtccgcaacgcccacccgcataccgccggccgggtgacccttgtccacaacggcatcatcgagaacttcgccgagctgaaggccgagctggccggcatgggccgcacgttcgagagcgacaccgacaccgaggtcatcgcccagctgatcgacgtggcgctggccaaggggctggcgccgctcgacgccttcaaggccacgctggaccggctgaccggggcctacgcgcttgcggtgctgattcagggtgaggccgacctgctgctgggcgcccgtcgcggcagcccgctggtggtcggcgagggccagggcgagatgttcctgggctcggacgccctggccgtcggccccttcaccaaccgggtgatctatctggaggagggcgactatgtggctctcgaccacgacagccgccgcatcttcgacgcctcgggcgcgcgggtcgagcggcccgtgcgcgtggtgccgacctcgtcggtcatgctggagaagggcaactaccggcacttcatggaaaaggagatccatgatcagcccgaaggctgccagcgcacgatcgcggcctatgtcgacaccctgacctcgaaggcggccgtgccgggcgatatcgacttcgccacgctggatcggatccagatcgtggcctgcggcacctcctatatcgccggcgtgatcggcaagtacctgatcgagcagctggccgacctgccggtcgatgtcgagatcgcctcggagttccgctaccgcaccccagccctgcggcccggctcgctggtcgtggccatgtcgcagtccggcgagaccgccgacaccctggcggccctgcgctattgcaaggccaagggcatgaagagcgcggtggtcgtcaacgcccaggaatcgaccatggcccgcgaggtcgacgtcgtctggccgatccattgcggtcccgagatcggcgtcgcctcgaccaaggccttcaccgcccaggtcagcgtgatgatcgctctggccatcgccgccgccaaggcgcgcgggacgatcgacgccgccgaagagcagcgcctcgtcaaggtgctgttggaagccccgcgcctgatcgccgaggccatcggcctggaagacgccatcaaggagatcgccgccgacgtcgccaaggcccgcgacgtgctctatctgggtcgcggtccgatgtcggccctggccctggaaggcgcgctgaagctcaaggaaatcagctacatccacgccgagggctatgccgccggcgagctgaagcacggcccgatcgccctcgtggacgaccagaccccgatcgtcatcctggccccctatgacagctatttcgagaaatcggcctcgaacatgagcgaggtgatggcgcgcggcggtcaggtgatcttcatcaccgacaccgaaggcgtgaagcacgcgccggccggcgccaaggtggtggtgacggccccggccagcgacccgctggtctcgaccctggtgatgtcggccccgatccagcttctggcctaccacgtcgccgtggtgaagggcgcggacgtggatcagccacgcaacctcgccaagtcggtgacggtggagtag

SEQ ID NO: 40453 - DNA, 783 bp, Caulobacter crescentus
atgaaactcgacaacaccgtcgccgccgtcgtcaccgggggcgcttcgggcctcggcgaagccaccgcccgcgcgctcgccgcccaaggcgtcaaggtcgccctcttcgacatgaacgaagagcgcggcctgcaggtcgccaaggaaatcggcggcgtgttctgtaaggtcaatgtgaccagcgacgccgatgtcgacgccggtttcgaaaaggcccgcgccgcccacggccaggagcgcatcctggtcaactgcgccggcaccggcaacgcggccaagaccgccagccgcgacaaggccaccggcgagaccaagcacttcccgctcgacgccttcgaccgcatcatccagatcaacctcgtcggcacgttccgctgcatcgccaagtcggccaagggcatgctggatctggagccgctggaagacggcgagcgcggcgccatcgtcaacaccgccagcgtcgcggccgaggacggtcagatgggccaggcggcctattcggcctcgaagggcggcgttgtgggcatgaccctgccgatcgcccgcgacctgatgggcgagggcatccgcgtcaacactatcctgccgggcatcttcaacaccccgctgatgaacaatgcgcccgaagcggtgaaggcgggcctggccgccagcgtgccgttccccaagcgcctgggtcaccccgaagaatacgcccagctggcgctcaccatgatcacctgcggctacttcaacggcgaggacgtgcgcctggacggcggcatccgcatggcgccgcggtag

SEQ ID NO: 40454 - DNA, 1227 bp, Caulobacter crescentus
atggccgacaagtccgtgaagaaggtcgtgctcgcctattcgggcggtctcgacacctcgatcatcctcaagtggctgcagaccgaatacggcgctgaggtcatcaccttcacggccgacctcggccaaggcgaagagatcgagccggcccgcgccaaggccctggccgccggcgtcaagcccgagaacatcttcatcgaggacgtccgcgaagagttcgtgcgcgactacgtcttcccgatgttccgcgccaacacggtctatgagggccagtacctcctgggcacatcgatcgcccgtccgctgatcgccaagaagcagatcgagatcgcccgcaagatgggcgcagacgccgtcagccacggcgcgaccggcaagggcaacgaccaggtccgcttcgagctcggctattatggcctcgagcccgacatcaccgtgatcgccccctggcgcgagtgggacttcaagtcccgcgaggccctgctggacttcgccgagaagcaccagatccagatcaccaaggacaaacgcggcgaagcgccgttcagcgtcgacgccaacctgctgcactcctcgtccgagggtaaggtcctggaggacccggcggtcgaggctcccgagttcgtccacatgcgcaccattgcgccggaagacgcgccggacgcgccgaccatcatcaccatcgacttcgaaaagggtgacccggtcgccatcgacggcgtggcgatgagcccggccaccctgctgaccaagctgaacgaactgggccgcgacaacggcgtcggccgtctggacctcgtggaaaaccgcttcgtcggcatgaagtcgcgcggcgtctacgagacccccggcggcaccatcctgctggccgcccaccgcggcatcgagagcatcacgctggaccggggcgccatgcacctgaaggacgagctgatgccgaagtatgcttcgctcgtctataacggcttctggttctcgcccgagcgcgagatgctgcaggccgctatcgactacagccaggacaaggtcaccggccgcgtccgcgtgaagctgtacaagggcaatgtcacggtcatcggccgcgagagcccctactcgctgtatgaccaggacttggtgaccttcgaagaaggcaaggtcgcctacgaccaccgcgacgccggcggcttcatcaagctcaacgccctgcgcctgcgggtcctggccaagcgcgacaagcgcggctag

SEQ ID NO: 40455 - DNA, 1545 bp, Caulobacter crescentus
atgagcgacagcagatccgacgaccgccatcccagcgtcacgcccgagcagctggcgaccctgagccacgagttccgcacgcccctgaacggcgtgctgggcatggcgcggctcctggaaaacaccaagctgacggccgagcagcggtcctatgtcaccgccctgcgcgagagcggcgaccacctgctgtcgctggtcaatgacgtgctgcacttcgcccgcctgggcgcggccgcgatcgagctgtcgctggccccggtcgatatcgagggcctgctgcgccaagtcgccgagctgatgagcccgcgcgcgcacgaaaaagggatcgagatcgcctgggccgtctcctcgcctctgccgaccatcctggccgacgaaggccggctacgacagattctgctgaacttcgccggcaacgccgtgaagttcacggaagccggcggcgtgctgctgaccgccagcgcgatcgacggcggccgcgtccgcttctcggtggccgacaccggccccggcgtcgcgccagacgcccgcgcccgaatcttcgaagccttcgtccagaccgacgtcacccacgccacccagctgggcggcgcaggcctgggcctggccatcgtctcgcggctctcggccgccatgggcggcgcggtcggggtcggcggcgaactgggccagggcgcagagttctggttcgaggcgccgttcgccacagccgccgcccccctgcgcgccgcgccgctcgagggccgcaacgtcgccatcgcctcgcccaacgccattgtccgcgccgccacggcccgccagatcgaggcggcgggcggacgcgcctacgccgccgtcgacatcgcctcggccctggccggcgcgcccgccgacgcggtgctgctgatcgacgcggctctctcaggcccacgcggcgccctgaagccgcccgccggccgccgctcggtggtgctgctgacgcctgaacagcgcgaccgcatcgaccgcctgaaggccgccggcttctcgggctatctgatcaagccactacgcgcggcctcgctggtcgcccaggtgctgcaggcggtcacggctgatggtgtggccgaggatgagcccgcccacgacgaccgcatcgccggcgccgtggccagcggcgcacgcgtactgctggccgaggacaatccgatcaacgcgctgctggcccgcaccctgctggagcgcgaaggctgcatcgtcgaccgcgtcgccgacggcgagcaggccatcgccgcggcctcagcaggggtctatgacctgatcctgatggatctgcgaatgccgggcctgaccgggatcgaggccgcccgcgccctgcgcgccaagggcgtggccaccccgatcgcggccctgaccgccgacgccttcgacgaggaccgccgcacctgcctggcggccggcatggacgacttcctcgtcaagcccctgacccaggaggccctgcgcgacgcgctcaagcgctggaccaccggcggcgtctcgggcggctggacgaaacccgcgacgcgagccaaggtcgccggctga

SEQ ID NO: 40456 - DNA, 1005 bp, Caulobacter crescentus
atgacgtttcgcggcccttcgccgccccgctttggacattccatggacctgcccgcctacgccatcgaagccgaaggcctgtacaagacctatgccggcaccaagacctcgccggagaagcgggccctgaacggtatcgacctgaagattccgcgaggctcgatcttcggccttctgggacccaacggcgcgggcaagtcgaccttcatcaacatcctggcgggcctggtccgcaagagctcgggcacggtgcggatctggggccgcgacatcgaccagcggccgcgcgacgcccgcgccgcgatcggcgtggtgccgcaggagctggccgccgatgtgttcttcaccccgcgcgagtcgctggaggtgcaggccggcttctatggcgtgcccaagagcgagcggcgcaccgacgagctgctgaacgccctgggcctgggcgacaaggcgggcgcctatgtccgccagctgtcgggcggcatgaagcgccgtctgatggtggcgaaagccatggtccaccagccgccggtgctgatcctcgacgagccgaccgccggggtggacgtcgagctgcgtcgccagctctggcagtacgtcaccagcctcaacgaactgggcgtgaccatcgtgctcaccacccactatctggaagaggctcaggagctctgcgacgagatcgccatcatcaaccggggcgaggtggtggcctgcgagccgacggccaagctactgagccgcatggacagccgcaacgtggtggtgacacccgaaagccccgtgaccgccgccccggtcctggagggcttcgacaccaagctgcgctcgggcggcgccttctcggtcagctaccgcaccggccagtccagcgtcgagcaggtgctcgcggccgtccgcgccagcggcctccatatcaaggacatcgccaccgaagatcccgatctggaagacgtcttcgtcgccctgacctacggcgatcccaacgccgccgatccgaccaaggactga

SEQ ID NO: 40457 - DNA, 1620 bp, Caulobacter crescentus
atgatcccgggcctgatgcagacgacgccgttgatgatcagcggcatcctgacctacgccgcccaggcccatggcgcgcgcgagatcgtctcgcggctgatcgacgaacctctgcatcgctacgactatgccggcctggcgggccgcgcggcccaggcggcccatgcgctccggcgactggggatcaaggccggcgaccgcgtcacctccctggcctggaacacccaccggcatctggagctgttctacgccgcgcccggcatcggcgcggtgctgcacaccgccaatccccggctgttcgacgagcagatcgtctacacgatcaatcacgccgaaagcggcgtgctcttcttcgagcgcaacttccaggccctggtcgagcgcatcgcgccgcaactgaccacggtgaagaccttcgtcatgctgtcggacgccgagcggaccgtccccggcgcggtcggcgcgatcagctacgagaccctgatcgaaggtgagccggacgtgatcgcctggcccagcttcgacgagaacgccggcgccttcctctgctacacctcgggcaccaccggcgatcccaagggggtgctctattcgcaccgggccgtggtgctgcacgccatggcggggggcttaaacagcgccttcggctttacgccgttcgacgtggtgatgccctgctccagcctctaccacgccaccgcctggggcctgccgttcagcgccccgatctgcggcgccaagctcgtgctgcccgccgacaagatggacggcgccagcctgcaccagctgatcgagggcgagggcgtcaccttcaccggcggcgtgccgaccatctggaccatgtatctggactggctggacaagaacgaccgtcggcccgacagcctgaagaaggtggtcatcggcggcagcgccgtaccccgcgccatggccgagaccttcaagcgccgctacggcgtccagaccctgcagatctggggcatgaccgagacctgcccgatcggcgtcgtcgccacccccaccccggccctggcggcgctgggcgaggaggccatggacgaggcgatctggacccgccagggccgcctgcagttcggcatcgagctgaaggtcgagaccgaggacggccaggccgccccctgggatggcgagacctccggcgcgctcctggtgcgcggtccctgggtggtgaagcgctacttccggaaagacgccgacgccgcgcgcgaggacggcttcttcgacaccggcgatatcgccacgctggacgccaacggcttcatgcgcatcaccgaccgccagaaggacgtcatcaagtcgggcggcgagtggatcagctcgatcgaccttgagaacgtcgccgtcggctgccccggcgtgaagatcgccgccgtgatcggcgtgccgcaccccaagtgggaggagcgtcccctgctggtcatcgaaacgcacgagggcgcggaggtcaccaaggccgccgtgctcgactacctgacgccccggatcgtcaaatggtggacgcccgacgacgtggtcttcgccaccgtgccgctgaccgcaacgggcaagatcgacaagaaggtgctgcgccaggcgtggaaggatcacctgatcggctga

SEQ ID NO: 40458 - DNA, 1053 bp, Caulobacter crescentus
atggcgactcttctcctcctgcccggcgacggcatcggcccggaagtctgcgcgcaggtgcgccgcgtggcggccgccctcaccccagacctcaaggtggacgaagcgctctatggcggcgccagctacgatacgcacggcacgccgctgaccgacgaggtccgcgagcaggccctcgccagcgacgcggtgctgatgggcgcggtcggcggtcccaaatgggctgacgccccgcgccacctgcgccccgaagcgggccttctgaacctgcgcaaggcgatggacgtgttcgccaacctgcgtccggcctattgcttcgaggccctggccggcgcctccagcctcaagccggagctggtctcgggcctggacatcatgttcgtgcgcgaactggtgggcggcgtctatttcggccagccgcgcggcatcgaagacctggccgacggccagaagaagggcttcgacacccaggtctatacgaccagcgagatcgagcgcgttggacgcgtggcgttcgagctggcgcgcggccgcaccaacaaggtccactcggccgagaagtcgaacgtcatggagtcgggcctgctgtggaagcaggtcatcaccgagctgcacgcgcgcgaatatccggacgtccagctggagcacatcctggccgacaactgcgccatgcagctggtccgcgcgcccaagcagttcgacgtgatcgtcaccgacaacctgttcggcgacatcctgtcggacgcggcggccatgctgaccgggtcgctgggcatgctgccctcggccgccctgggcgcgccgggcaagccgggcctgtacgagccgatccacggctcggcgccggacatcgccggcaagggcctggccaatccgctggccgccatactgtcgttcgagatggccctgcgctggtcgctcaagcagaccgaggccgccgacgccctgctggcggcggtgaaggccgcactcgacaacggcgcccgcacccgtgatctgggcggttcgctgaccacgacgcagatgggcgacgcggtgctggcggcgctttag

SEQ ID NO: 40459 - DNA, 936 bp, Caulobacter crescentus
gtgtccacctccgccatcgacccggtttcgttttctctctacgccaaggactttacgcgcttcgcccaggagctcggcgcgtcgttcgaacgctacggcttcgccgtgctgtccgactatgatctggatcaggcgcgcatcgacgcggccgtcgactccgccaaggccttcttcgccctgccggtcgagaccaagaagcagtacgccggggtcaagggcggcgcgcgcggctacatccccttcggcgtcgagaccgccaagggcgcagaccactacgacctgaaggaattctggcacatgggtcgcgatctgccgcccggccaccggttccgcgcccacatggccgacaatgtctggccagccgagatcccggccttcaagcacgacgtcagctggctgtacaacagcctcgacgggatgggcggcaaggtgctggaagccatcgccacctacctgaagctggagcgcgacttcttcaagccaacggtgcaggacggcaattcggtgctgcgcctgctgcactatccgccgatccccaaggacgccaccggcgtgcgcgccggcgcccacggcgacatcaacaccatcaccctgctgctgggcgccgaggaaggcggcctggaagtgctggaccgcgacggccagtggctgccgatcaacccgccgccgggctgcctggtgatcaatatcggcgacatgctggagcgcctgaccaacaacgtcctgccctcgacggtgcaccgcgtggtcaacccgccgccggaacgtcgcggcgtgccgcgctactcgacgccgttcttcctgcacttcgcctcggactacgagatcaagacgctgcagaactgcgtcacggccgaaaacccggaccgctatccggagtcgattacggccgatgagttcctccagcagcgcctgcgcgagatcaagctggcctga

SEQ ID NO: 40460 - DNA, 1620 bp, Caulobacter crescentus
atggccgatctcgacgccgcctggacccgcctggaagccgccgccaaggctgcgggcgacaagcgtatcgtcgagttcttcgacgccgagccgggacgccttgacgctctgaccctggacgtcgccggcctgcacctggatctctccaagcaggcctgggatgaggcgggtctcgaggccgcgctcgatctggcccacgcggccgatgtcgagggcgcccgggcccgcatgttcgacggcgaggcgatcaattcgtccgaaggccgggctgtgctgcatacggccctgcgcgctccggcgggagcggacgtcaaggccctgggccagccggtcatggccgaggtcgatgccgtccgccagcggatgaaggctttcgcgcaggccgtgcgttcgggggcgatcaagggcgcgaccggcaagccgttcaaggcgatcctgcacatcggcatcggcggcagcgacctgggcccacgcctgctgtgggacgccctgcgaccggtgaagccgtcgatcgacctgcgcttcgtcgccaatgtcgacggcgccgagttcgccctgaccaccgccgacatggacccggaagagaccctggtcatggtggtctccaagaccttcacgacccaggagaccatggccaacgccggcgcggcgcgggcctggctggtggcggccctaggcgagcagggggccaatcagcatctggccgccatctcgaccgcgctggacaagaccgccgccttcggcgtgccggacgatcgcgtgttcgggttctgggactgggtcggcggccgctattcgctgtggtcgtcggtcagcctttcggtggccgtcgccgcgggctgggacgcgttccagggtttcctggacggcggcgcggccatggatgagcacttccgcaccgccccgctggagcagaatgcgccggtgctggtggccctggcccagatcttcaatcgcaacggcctggaccgccgggcccgctcggtcgtgccgtactcgcaccgcctgcgccgcctggccgccttcctccagcagctggagatggagagcaacggcaagtcggtcggccccgacgggcagccggccaagcgcggcacggccacggtggtgttcggcgacgaaggcaccaatgttcagcacgcctatttccagtgcatgcaccaggggaccgacatcacgccgatggagctgatcggcgtcgccaagtcggacgaaggcccggccggcatgcacgagaagctgctctcgaacctcttggcccaggccgaggccttcatggtcgggcggaccacggacgatgtcgtggccgagctcacggccaagggcgtctctgacgccgaaatcgccaccctggccccgcagcgaaccttcgccggcaaccggccctcgaccctggtgctcctcgaccgcctgacgccccagaccttcggcgccctgatcgccctctatgagcacaagaccttcgtcgagggcgtgatctgggggatcaacagcttcgaccagtggggcgtcgagctgggcaaggtgatggcgaaccgcatcctgccggagctggagagcggcgcttcgggccagcatgacccttcgaccgcagggttgatccagcgcctgaagcgctag

SEQ ID NO: 40461 - DNA, 786 bp, Caulobacter crescentus
atggcgcagagcacgggccgggtcgccggcaagaaggccttcatcaccggcggcgcccagggcctcggcgcggcggcgggtcgcatgctggccaaggagggcgccaaggtcgccctggccgacatcaatctggccggcgcccaagccgtggccgacgagatcaacgccgctcacggcgcgggcacggccttcgccttcgagctggacgtcacccaggaagaccagtggatcgacgtgctggaaaaggcgacggcggccatgggcggcctgtcggtgctggtcaataacgccggcatcggcggcgatggtcccatcgagagcctcgacttcgggctctggaagaaggtcatgtcggtcaatgtcgactcggtgttcctgggcgccaagcacgccctgacccacatgcgcgcccaccagccgggctcgatcatcaacctgtcctcgatcgccggcctgatcgccaacggcaactcgcccgcctataacgcctccaaggcggcggtctggctgctgagcaagaacatcgcgctgtactgcgccaagatgaagctcgacatccgctcgaactccatccacccgaccttcatcgacaccccgatcctggacggcttctcggctcggttcggcaaggaagaggccttcgccaagctggcccgtcaggtgccgctgggccggatcggcgagccgaccgacatcgccaatgcggtgctctatctggccagcgacgagagcaagttcatgaccggcgccgagatcaaggtcgacggcggcatttcggcgatgtga

SEQ ID NO: 40462 - DNA, 1029 bp, Caulobacter crescentus
atgggttaccgggtcgccgtggtcggcgccacgggcaatgtgggccgcgagatgttcaacatcctcgaggaagtcaaattccccgtggacaagatgcacgccatcgccagccgcaaatccatcggcgtcgaggtctcgttcggcaacgagatcctcaagtgtgaggacctggagcagttcgacttctccaaggtcgatctcgtgctgatgagcgccggcggttcgatctccaaggcctggggcgagaagatcggcgcggccggtccgatcgtcatcgacaactccagccacttccggatggacccggacgtgccgctggtggtgccggaggtgaacccggaagccgtcaacagcatccccaagaacatcatcgccaatccgaactgctcgacggcccagctggtggtggcgctgaagccgctgcacgatgaggccaagatcaagcgggtggtcgtctcgacctaccagtctgtctccggcgcgggcaaggagggcatggacgagctctgggaccagaccaagggcgtctatgtcctgggcgcgccgccgcccaagaagttcaccaaacagatcgccttcaacgtcatcccccacatcgacgtcttcatggacgacggcttcaccaaggaagagtggaagatggccgtcgagacccagaagatcctggatccggcgatcaagctgaccgccacctgcgtgcgcgtgccggtcatggtcggccactcggagtcggtgaacgtcgagttcgagagcccgctggacgaggatgaggcccgcgagatcctgcgcgaggccgacggcatcgtcgtggtcgataagcgcgaggacggcggctacatcacgcccaaggaatcccagggcgagttcccggtctacatctcgcgcatccgcaaggacccgaccgtcgagaacggcctggcgttctggtgcgtgtcggacaacctgcgcaagggcgcggcgctgaacgcggtgcagatcgcccagctgctgcacgacaagggcctgctgaagcgcaaggtcctggcctag

SEQ ID NO: 40463 - DNA, 1392 bp, Caulobacter crescentus
gtggccgactatatcgtcaaggacatctcgctcgccgatttcggccgtaaggaaatcgccatcgccgagaccgaaatgccgggcctgatggccacgcgcgccgagtacggcccccagcagattctcaaaggcgcccgcatcgccggcagcctgcacatgaccatccagaccgccgtgctgatcgagaccctgacggcgctcggcgccgaggtccgctgggcctcgtgcaacatcttctcgacccaggaccacgccgcggccgccatcgccgccgccggcgtcccggtcttcgccttcaagggcgagaacctcgtcgagtactgggaatacgcccacaagatcttcgagtggcacgacggcggttatccgaacctgatcctggacgacggcggcgacgccaccctgctctgcgtgctgggccccaaggccgagaaggatccctcgatcctgaacaacccgcagaacgaggaagaagaagccctctatgcggtgatgaagaagtacctggccgagaagccgggcttctattcggcgatccgcgcggccatcggcggcgtctcggaagagaccaccacgggcgtgcaccgcctgtaccagatggcccagaaggacgagctgccgttcccggccatcaacgtcaacgacagcgtcaccaagtccaagttcgacaacctctatggctgccgtgagagcctggtcgacgccatccgtcgcggcaccgacgtcatgctgtcgggcaaggtcgccgtggtctgcggctatggcgacgtgggcaagggctcggccgccagcctgcgccaaggcggcgcccgcgtgatcgtcaccgaagtcgacccgatctgcgccctgcaggcggcgatggaaggctatgaggtccagaccctgaacgacgtcgccgataaggccgacatcttcgtcaccgcgacgggcaacaaggacgtcatcacggtcgacgacatgcggaagatgaaaaacaacgccatcgtctgcaacatcggccacttcgactccgaaattcagatcgccggcctgcgcaacttcaagtgggacgagatcaagccgcaggtccaccacgtggaattcccggacggcaagaagctgatcgtgctgtcggaaggccgtctggtgaacctgggcaacgccactggccaccccagcttcgtgatgtcggccagcttcaccaaccagaccctggcccagatcgaactgtggaccaacaaggccaagtacgagaaccaagtctacaccctgcccaagcacctggacgagaaggtcgccttcctgcacctggaaaagctgggcgcgaagctgaccacgctgcgcaaggatcaggccgattacatcggcgttccggaagctggtccgttcaagccggatcactaccggtactag

SEQ ID NO: 40464 - DNA, 1044 bp, Caulobacter crescentus
atgtccgctccgtcatcgctgatcctgcctggccttatgaccccttcgggcggctacaagccgttccgctatccgtgggcctatgacttctggaagaagcagcagcaggtccactggatgcccgaagaggtgccgctgggcgaggacctcaaggactgggccgtcaagctgaacgacaaggaacggaacctgctgacgcagatcttccgcttcttcacccagtccgacgtcgaggtgcaggacaactacatggagcgctacggtcgggtgttcaaaccgaccgaagtgaagatgatgctggcctcgttcgcgaacatggagacgatccatatcgcggcctacgccctgctcctcgagaccatcggcatgcccgagaccgagttctcggcgttcatggaatacgaggccatgaaggccaagcacgactacatgcagaccttcggtgtcgactcgaacgccgacatctgccgcaccctggctatgttcggcggcttcaccgaaggcctgcagctgttcgcctcgttcgcgatgctgatgaacttcccgcgcttcaacaagatgaagggcatgggccagatcgtctcgtggtcgatccgcgacgagagcctgcactgcgacggcatcatcaagctgtaccacgccttcaacaaggaaaccggcgcggtgaccaaggccgtggccgacgacatcgtcgactgctgcaagaccgtggtcggcatggaagacaacttcatcgacctggccttcgaggccggcgacatccagggcatgacgcctgacgacatcaaggcctatatccgcttcgtcgccgactggcgcctgcgccagctacacctgcccgaagtgtacggcgtgaaggaaaacccgctgccctggctgcagtcgctgctgtcgggcgtggagcacgccaacttcttcgaagcccgcgcgaccgagtattccaaggccgccaccaagggtcagtggcacggctcggacggcgtctggaccagcttcgacgagatgatgaagaagcgctcggccgaaacgatcccggcggaatga

SEQ ID NO: 40465 - DNA, 1254 bp, Caulobacter crescentus
atgaataaacgcttcgcctatctgatcatcgcctcgatgatcctcggggtgctggtcggctggacctgcaatcagtttcttgacccggccggcgccaagtcggccgcggacaacctgtcgatcatcaccgacatcttcctgcgcctgatcaagatgatcatcgcgccgctggtcttcacgaccctggtggccggcgtcgcgcacatggaagacgccgccgcggtgggccgcatcggcgcaaagaccatgacctggttcatcggcgcctcggcggtgtcgctggtgctgggccttctgatggtccacctgctggatccgggcgcgggcctgaacatggcccatgtcgatgtggcgatgaagaccacggcgacgaccgacgccttcaccctgaagggcttcatcacccacctggtgccgacctcgatcttcgacgccatggccaagaacgagatcctgcagatcgtggtgttctcgctgttcgtcggcaccgccgtggcggcgctggacgacaaagccccgcagatcctggagctggtcgagcaggccgcccagatcatgctgaaggtcaccggctttgtgatgaagctggccccgctggccattttcgcggccctggcctcgacgatcgccacccagggcctgggcatgctcgccacctacggcaagttcgtgctgggcttctactcggccatgggcgtgctttgggctttgctgttcatcgccggcctgctggtgctgggtaagcgggtgatccccctgttcggcgtgatccgcgatccggtgctgctggccttctcgaccgcgagctccgaagcggcctatccgcgcattctcgacagcctgcccaaggtgggcgtgcgccgccggatcgtgtcgttcgtgctgccgctgggctactcgttcaacctcgacggctcgatgctgtactgcaccttcgcgacgatgttcatcgtccaggcacacggcgtcgagctgacggtccagcagcagatcttcatgctgctgctgttgatggtgacctccaagggcatcgccggcgtgccgcgcgcctcgctggttgtgatcatggccaccctcacctatttcggcctgcccgaggcctggatcgcgctggtcctgggcgtcgatcacctgctggacatgggtcgcagcgccaccaacgtcgtcggcaacagcgtcgccgccgccgtcgtggccaaatgggagggcgagctggacgacatcccgcccgagggcgaagccgccaaggcctga

SEQ ID NO: 40466 - DNA, 1239 bp, Caulobacter crescentus
atggccgaagcctacatcatcgacgcctgccgcacgccgcgcggcatcggcaaggtcggcaagggagccctggccgacttccatccgcagcacctggccgccacggttctgaaggccctggccgagcgtaacgggctcaacaccgctgaagtcgacgacatcatctggggcacgtccagccagcgcggatcgcaggccggggacctgggccgcatggccgctctggacgccggctatgacgtgcgcgccagcggcgtcaccctggaccgcttctgcggctcgggcatcaccacggtaaacctggcggcggcctcgatcatgtcgggcatggaggacctggtcatcgccggcgggaccgagatgatgtcctacacctcggcgaccgcgaacgtgacgtcgccgccgatgctggacagcggcaacctgcgcctgcgcgcccgtcatccgcagtcgcaccagggcgtctgcgccgacgccatcgccacgctggaaggcatcacccgcgccgatgtcgacgccctggccctggaaagccagcgccgcgccgatctcgccatccagggcgggcatttcgccaagagcctgatcccggtgctgcgcgacgacggctcggtggccctggaccacgaggagttcccgcggccccagaccacggccgaagggctggccagcctgaaggcctcattcgcggccctggcggagatcccggtcgacgaggcgggcaacacctatggcggcttgatccggcaggtctatccggacctgaagatccagcacatgcaccatgcgggcaattcgtcgggcgtcgtggacggcgcggcggcggtgctgctggcctcgcccgcctacgcccagcgccatggcctcaagcctcgcgccaaggtcatcgccatggccaatgtcggcgacagcccgaccctgatgctgaacgcgccggtcccggccgcgcgcaaggcgctcgccaaggccggcctgaccgtggacgacatcgatctttgggaaatcaacgaggccttcgcggtcgtggccgagaagttcatccgcgacctgaagctggatcgcgacaaggtcaatgtgaacggcggcgccatggccctgggccacccgatcggcgcgacgggctcgatcctgatcggcacgatcctggacgaactggaacggcgcgacctcaagcgcggtctggtgaccatgtgcgccgccggcggcatggccccggcgatcatcatcgagcggatctaa

SEQ ID NO: 40467 - DNA, 915 bp, Caulobacter crescentus
ttgaccgacgtcgccgaggaagctggctgggccaccgccaagaccctggccgaggccctgccctacatccagatctacgaccgcgagacggtggtgatcaaatacggcggtcacgcgatgggtcaggaagatgtggccaaggtcttcgccgctgacgccgtgctcctgaagctgctgggcgtgcatccggtggtcgtccatggcggcggcccgcagatcagccgtatgctcgacaaggcgggcgtgaaatcgacctttgtcgacggcctgcgcgtcaccgacgaggcgacgatggaagtcgccgagatggtgctgtccggcgcgatcaacaaggaaatcgccaactggatcacgctggccggcgccgaagccgatgtgcgtggcgtgggcctgtcgggcaaggacgcccgtctgatcaccgccgagaaggtgacccgcaccaagaaggatcccgacagcaatatcgagcaggccgtggaccttggctttgtcggcgaacccaccaaggttgatccccagctgatcgaggccctgctgacctcggagcatgactatatcccggtcgtggctccgatcggcgtctcgcccgatggcgacaccttcaacatcaacgccgacaccgtggccggcgcgctggcgggcgcgctgaaggccaagcgcatgctgatgctgaccgacatcaagggcgtgctcgacggcaacggcgaactgatccgtgaaatgacgatcgaacaggctcgcgcgctgatcgacacgggcgtggccaccggcggcatgatccccaagctcgaaaacgccattcacgcgatcgagtccggcgtcgaagcggtcgtcatcctggacggccgacgcccgcacgccatgctggtcgagctgttcagcgagtacggcgcaggcacgctcatcaagcgatga

SEQ ID NO: 40468 - DNA, 1824 bp, Caulobacter crescentus
atgaccgcacaggatcgtccgcagccctcgaaccgcgccctgatgggccggatgtggcgcgagttccttcagccgcgctggaagggcttcctggtctcgatgatcagcgccgtgatcgtggcgcggctgaccgtgatgctgggcgagtatgtcgagcccgccgtcgacaagctgatcgcccatccccagcccggcgccctgatctgggttccgctgaccatcgccgccttggccgtggggcgcggtgtgttccaggtgatccaggccagcctgatcaaccgcatcggcaacggcgtggtcggcgacatgcagacgcgcctgttcggccgcctgatccgggcggatctggcccgcctgcgcggcgcgcattcgggttcttacgtcgcctcggtgctttatgacgccggcctgatccgggaagccgcgaccaccggcgtcgtcaactatgtccgcgaagccctgatcgtcgccatcaccctgtgggcgctgttcaacagcgatccgatcctggctgccggcgtgctgatcatcgtgcccggcgtcagcggggtgatccgtcacttcgccaagcgcacgaccaaggccgccaagggcgccatgggcgagacctccaacctctcgaccgcgatcatggagagcctggacggggtcaagatcgtcaagatggagaaccgcgaggcctatgaggaggcccgcgtcgccgccgtggtcgagcgccgccagcgccacctgatcaagggcagcaacgcccgcgccatggccgccccggccaccgagctcttctcgcagttggtgatcgctgcggtcttcgcctatgcgggctggcgggcgatcaccggcgcgctggtcgtcgggcccttcaccctgccgccgatcacgcccggcgggttcctcaagttcgtgatcctgctgggcatcgcggcccaatccctgcgccaagtcgccaacctgcagaccgtgttcagcgaagggctgaccgccgcccgtcgcctgttcgaggcgctcgatgtggccccgaccatcgtcgatccggccgacgccaaggccctgccgccgggcgagagcatgatcgccctggccgatgtgaccttctcgtacggcgcggacattccggccctgtcgagcgtcaatctgcaggcgcgcaagggtgagaccgtggccctggtcggcccttcgggcggcggcaagagctcgatcctcaacctgatcccccgcttttacgacgtgaacgccggcgcggtgaccatcgacggccacgacgtgcgctcagtgacgatcgcctccctgcgtgaccgcatcgccctggtcacccaggagccgttcctgttcgacgacacgatccgcgccaacatcgcctacgcccgtcccggcgccagccaactcgagatcgaggccgcttcgcggcaagcggccgcccacgagttcatccaggccctgcccgagggttatgacaccgccgtcggcgagggcggcgcgcgcctgtcgggcggccagcgccagcgcatcgccatcgcccgcgcctttttgaaggacgcgccgatcctgctgctggacgaggctaccagcgcgctcgacaccgaaagcgaggcccaggtgcaggcggcgctggagcgcctgatggcgggccgcacgacgatcctgatcgcccaccgcctgtcgaccgtgaagaacgccgaccgcatctatgtgatcgacaaggggcgggtcgtggagacgggctcgcatgccgagctcgtccgcgccggcggtctctatgcgcgcctcgccaaggctcaggatctggaccacccggcgcccgaccaggacggggagatcacggcttga

SEQ ID NO: 40469 - DNA, 1200 bp, Caulobacter crescentus
atgaacatccacgaacatcaagccaaagctgtactcgccgagttcggcgcccccgtgccgcgcggcttcgccgccttcacgcccgatgaagccgccgccgccgccgaaaagctgggtgggccggtcttcgtcgtgaagagccagatccacgccggtggccgtggtaagggcaagttcgagggcctgggccccgacgccaagggcggcgtccgcgtcgtcaagtcggtggaagaggttcgctcgaacgccgaggaaatgctgggccgcgtccttgtgacgcaccagaccggcccgaagggcaagcaggtcaaccgcctctacatcgaagaaggcgcggcgatcgccaaggaattctacctgtcgctgctggttgaccgcgcctcgagcaaggtctcggtcgtcgcctcgaccgaaggcggcatggacatcgaggacgtcgcccactcgacgcccgagaagatccacaccttcaccatcgacccggcgacgggcgtgtggccgacgcatcaccgcgccctggccaaggctctgggcctgaccggcggtctggccaaggaagccgcctcgctgctgaaccagctctatacggcgttcatggccaaggacatggccatgctggagatcaacccgctgatcgtgacggcggatgatcacctgcgcgtcctggacgccaagctgtcgttcgacggcaacagcctgttccgtcacccggacatcaaggcgctgcgcgacgagagcgaagaagaccccaaggaaatcgaagcgtcgaagtacgacctggcctacatcgccctcgacggcgaaatcggctgcatggtcaacggcgccggtctggccatggccaccatggacatcatcaagctgtacggcgccgagccggccaacttcctggatgtcggcggcggcgccagcaaggagaaggtcaccgcagccttcaagatcatcaccgccgatccggccgtcaaaggcatcctggtcaacatcttcggcggcatcatgcgctgcgacatcatcgccgaaggcgtgatcgccgcggtgaaggaagtcggtctccaggttccgctggtcgtccgtctggaaggcaccaacgtcgaactcggcaagaaaatcatctcggaaagcggcctgaacgtcatcgccgccaacgatctgtctgacggcgccgagaagatcgtcgccgctgtgaagggcgcccgctaa

SEQ ID NO: 40470 - DNA, 885 bp, Caulobacter crescentus
atgtcggttctgatcggttcccacaccaaggtcatctgccagggcatcaccggcgctcaaggcacgttccacaccgagcaggccatcgcgtacggcacgcagatggtcggcggcgtcaccccgggcaagggcggtcaaacccacatcggcctgccggtgttcgacaccgtcgccgaagccaaggaccgcaccggcgccgacgcctcggtgatctatgtcccgccgcccttcgcggccgactcgatcctggaggccatcgaggccgagatcccgctgatcgtctgcatcaccgagggcatcccggtgctggacatggtcaaggtcaagaaggccctgcaaggctccaagtcgcgcctcatcggcccgaactgcccgggcgtcctgacgcccaagcagtgcaagatcggcatcatgccgggctcgatcttctcggaaggcagcgtcggcgtcgtgtcgcgctcgggcaccctgacctatgaagcggtgttccagaccacgaacgcgggccttggccaaaccacggccgtcggcatcggcggcgacccggtcaagggcaccgagttcatcgacgtcctcgagatgttcctggccgacgaagccaccaagtcgatcgtcatgatcggtgaaatcggcggctcggccgaagaagaagcggcccagttcctgaaggacgaagccaagcgcggccgcaagaagccgatggtcggcttcatcgccggtcgtacggctcctcctggccgtcacatgggccacgccggcgccatcgtgtcgggcggcaagggcggcgccgaggacaagatcgcggcgatggaagatgcgggcatccgcgtctcgccgtcgccggccaagctgggcgagaccctgctggaagtcctgaagggctaa

SEQ ID NO: 40471 - DNA, 2931 bp, Caulobacter crescentus
ttgaccgagaccagcttcctctacggcgccaatgccgcgttcgtggaagacctctacgcccagtgggcggagaaccccggatcggtcgagccctcgtggaacgccttcttcgccagcctgcaggaacaggccgaccaggttaagcgcgccgcgcaagacccggcctggacccccaagaaggtcgccaccgtccgtccggactggctgtcggccctggacggccagtgggccaccgtcgcccccgccgtcgaagccaaggtctccaaggccatcgaggccaaggcgcccgccgccagcgctgaagccgtccgcgccgccacgctggacagcctgcgcgccatcatgatgatccgcgcctaccggatgcgcggtcacctggccgccaatctcgatccgctgggcctggatccgcccaaggacgccagcgagctggacccggcctcgtacggcttctcggaagccgactacgaccgcccgatcttcctcgacttcgtgctgggccttgagaccgcgacgatccgcgagatcctgtcgatcgtccgccgcacctactgcggcaatgtcggcgtgcagtacatgcacatctccgacccggccgagaaggcctggctgcaggagcgcatcgagggccgcgacaaggaaatcaccttctcgaaggaaggcaaggtcgccatcctgaagaagctgatcgaggccgagggcttcgagcgcttcctgcacaagcggttccccggcaccaagcgcttcggtctggacggcggcgaggccatggtcccggcgctggagcagatcatcaagcgcggcggcgcgctgggcgtgaaggacatcgtcctgggcatgccgcaccgcggtcgcctgaacgtgctggccgccgtgatgggcaagccctaccacgtcatcttccacgagttccaaggcggctcgtcggtgccctcggacgtcgagggctcgggcgacgtgaagtatcacatgggcgcttcgtcggaccgtgagttcgacgacaacaaggtccacctgtcgctgaccgccaacccgtcgcacctggaaatcgtcaacccggtcgtgatcggcaaggcccgcgccaagcaggccttcaccctgcgcgaacagccggacgccggccgtggccacgtgctgccgctgctgctgcacggcgacgccgcgttcgccggccagggcgtggtggccgagtgcttcaccctgtcgggcctgaagggctaccgcacgggcggcaccatccacttcatcgtcaacaaccagatcggcttcaccaccagcccgcgctattcgcgcagctcgccctatcccagcgacatggcgctgatggtcgaggcgccgatcttccacgtgaacggcgatgatcccgaagccgttgtcttcgccgccaaggtctcgaccgagtaccggcagaagttcggcaaggacgtggtcatcgacatggtctgctaccgtcgcttcggtcacaacgaaggcgacgatccgaccatgacgtcgccgctgatgtacgcgaagatcaagggccacccctcgacccgcgaactctattcgaaccgcctgatcggcgagggcgtcatcacccaggccgactgcgacagctgggtttcggagttcgagaagttcctcgacgccgagttcgacgccggcaagatctacaagcccaacaaggccgactggctggacggcaagtgggccggcctgacgctgccgggcgacgaggatcgccgcggcaagaccgccttccccaagacccgcctgctggaactgggccgcctgatcacggcgatccccgagcggatcgacgcccacaagaccgtgcgccgcgccatcgagaaccgtcgcgacgcgttcgagaagggcgagggcatcgactggggcgcggccgagcacctggccttcgccaccctgctggacgaaggcatcccggtccgcctgtcgggccaggactccgtgcgcggcaccttcacccagcgccattcggacatcatcgaccagaagaccgaagagcactacacgccgctcaacaacatccgcgccggccaggcccactatgaagtgatcgactcggccctgtcggaagaggcggtgctgggcttcgaatatggcttctcgctggccgagccgaacaccctgacgctttgggaaggccagttcggcgacttcgtgaacggcgcccaggtcgtgatcgaccagttcatcagctcgggcgagcgcaagtggctgcggatgagcggcctcgtcatgctgctgccgcacggctatgaaggccagggcccagagcacagctcggcgcgtctggagcgcttcctgcagtcgtgcgcggaagacaacatgcaggtcgtcaactgcacgacgccggccaactacttccacgccctgcgtcgccagatgcaccgcgagttccgcaagccgctgatcgtgatggctcccaagagcctgctgcgccacaagcgcgcggtctcgaacctgtcggacttcgccgagggttcggccttccaccgcgtgatggtggacggcgccgaggccggttgcgacgtcggcgggatcacgctgaagagcgacgacaagatcaagcgcgtcatcgtctgctcgggcaaggtctatttcgaccttgttgaccagcgcgccaagcttggccgtgacgacgtctatctgctgcgtctggagcagttctatccgtggccgatgaagtcgctgatgaacgtgctctcccgcttcaagaacgccgacctgatctggtgtcaggaagagccccgcaacatgggcggctggacgtttgttgatccgtggctggaactgacgctcgacaagctggacatcaaggccaagcgcgccaagtacgtcggccgcccggcctcggcctcgacggccgccggtctgatgagccgccacctgaaagagctcgaaaccttcctcaacgaggccttcgcgtaa

SEQ ID NO: 40472 - DNA, 1209 bp, Caulobacter crescentus
atggccgacatcaatacgcccgccctcggcgaatccgtcaccgaagccacggtggcgcgctggaccaagaaggtcggtgaggccgtgaagaaggacgagatcctcgtcgagctggaaaccgacaaggtttcgctcgaggtggcctcgcccgccgacggcgtgctgtcggcgatcggcgctgcggaaggcgcgaccgtcgttccgggcacggtgctgggcgtcgtcgccgaaggcgcgaccgcctcggccgcgccggccgccgcgcccgcgcccaaggctgaagcgcccaagccggctccggctgccccggccccggccgcggctcccgccgccgccccggtcagcccggccccggcccgcatcgccgccgagagcggccttgacctctccaaggtcgccggcaccggcaaggacggccgcgtgaccaagggcgacgccctggcggctctggaagcccgcgcctcggccccggccccggccgccgctgcggccgcgccgcgcgccctgcacgagcgcgaagagcgcgtgaagatgacgcgcctgcgtcagacgatcgcccgtcgcctgaaggaagcccagaacagcgccgccatgctgacgaccttcaacgaggtcgacatgagcgcggtgatggccctgcgcgcccagtacaaggacgtgttcgaaaagcagcacggcgtgaagctgggcttcatgtcgttcttcgtgaaggccgtcgtcgcggccctgaaggcgatcccggacgtcaacgccgagatcgacggtcaggacgtcatctacaagaaccactacgacatcggcgtcgccgtcggcaccgacaagggcctggtggttccggtcgtccgtgacgccgacgccctgaacctggccggtatcgaaaagaccatcggcgacctcggcaagcgcgcccgcaacggccagctggccatcgaggacatgcagggcggcaccttcacgatcaccaacggcggcatctacggctcgctgatgtcgaccccgatcctgaacgcgccgcagtcggggatcctgggcatgcacgccatcaaggaacgcccgatggtcatcaacggcaagatcgagatccgcccgatgatgtacctggctctgtcctacgatcaccgcatcgtcgacggcgccggcgccgtgaccttcctggtgaaggtcaaggaagccatcgaagacccgcagcgcctgctgctggagctctag

SEQ ID NO: 40473 - DNA, 1428 bp, Caulobacter crescentus
atggcgcgtcctgaaggcgatagacccatggctcagtacgacgtcgtcatcatcggtggcggtcctggtggctacaacgcggcgatccgcgccggccagctgggcctgaaggtcgcgatcgtcgaaggccgcggcaagctgggcggcacctgcctgaacgtcggctgcatgccgtccaaggccctgctgcacgcctcggagctgtacgccgccgcgacgggtcccgaattcgccaagctgggcatcgaggtgaagcccaagctgaacctctcccagatgatggcccagaaggccgagagcgtcgaagccctgaccaagggcgtcgagttcctgatgaagaagaacaaggtcgagtacgtgaagggctggggccggatcgacggcgtcggcaaggtggtcgtgaaagccgaggacggttcggaaaccaccctcgagaccaagaacatcgtgatcgccaccggctcggagcccaccccgctgccgggcgtgagcgtcgacaacaagcgcatcatcgactccaccggcgccctgtcgctgcccgaagtgcccaagcgcctggtggtcgtcggcgccggcgtgatcggcctggagctgggttcggtctggaagcgcctgggcgccgaggtcaccgtggtcgagtacctggaccgcatcttgccgggcaccgacactgaagtggccaacgccttccagaagatcctggtcaagcagggcttcaagttccagctgggcgccaaggtcacgggcgctgaagccggcgccaagggcgtgaagctgagcttcgagccggtcgccgggggcgaggcccagacgatcgaggccgactacgtgctggtcgccatcggccgtcgcccgtacacccaaggcctgggcctggagacggtcggcgtcacgcccgacaagcgcggcatgatcgccaacgatcacttcaagaccggcgtcgccggcgtctgggtgatcggtgacgtgacctcgggtccgatgctggcccacaaggccgaggacgagggcgtggcctgcatcgagatgatcgcgggcaaggccggtcacgtgaactacggcatcatcccgggcgtggtttacaccagccccgaggtggccacggtcggcaagaccgaggacgaactcaaggccgagggcgtcgcctacaaggtcggcaagttcccgttcttggccaacagccgcgccaagatcaaccacgagaccgacggcttcgtgaagatcctggccgacgccaaaaccgaccgcattctgggcgcccacatgatcggcccgaacgtcggcgacatgatcgccgagtactgcgtggccatggagttcggcggcgcttcggaagacgtggcccgcacctgccacccgcacccgacccgctcggaagccctgcgccaggcggccatgggcgtcgaaggctggacgatgcaggcgtag

SEQ ID NO: 40474 - DNA, 1260 bp, Caulobacter crescentus
ttgcgcacgtaccattcgcccctggacctggtccgtgagcggtcaccggaacgtcccgtcgcactcgtgcggcctgacgcggttgccgtagctgcgcgctggttccagtccgaatttaaaggtgacgttttctacgcggtgaaggccaacccttcgccgtgggtgatccgcgagctggccaaggccggcgtgcgatccttcgacgtcgcgtcgctgaacgaggtcgagcttgtggccaacgaggccccgggctcgcgcatggccttcatgcacccggtcaagagccgggcggcgatctccgccgcctatttcgaccatggcgtgaagaccttctcgttcgacacccacgaagagctggccaagatcctggacgccacgggccaggccaaggacctcaacctgatcgtccgcatgggcgtgcaggccgagggcgcggcctacagcctgtcgggcaagttcggggtcgagatgcataacgcgccggacctgctgctggccgcgcgccgcgcgacccaggacctgatgggcgtcagcttccacgtcggcagccagtgcatgcgcccgaccgccttccaggcggccatggcccaggcctcgcgggctctggtgcgcgccggcgtgctggccgatgtcgtcgacgtcggcggcggcttcccgtcgatctatccgggcatggtcccgccggatctctccgagtatctggcggccatcgaccgcggcttcgccgagatgatggtccacgagaccaccgagctctggtgcgagcccggccgcgccctggtggccgaagcctcgtcgctgctggtcaaggtcgagctgaagaagggcgatgcgctctatctgaacgacgggtcgtacggctcgctgttcgacgccgcgcacatgaagtggccgttcccggtcaagctgtaccgcaagagcggcgaagtggtggaagaaggcctcaagcccttccgcttctatggccccacctgcgacagcgtcgaccacatgcccggcccgttctacctgccggaaagcgtcgacgagggtgactacatcgagatcggcatgctcggcgcctatggcgtggccatgaacacccgcttcaacggctttggcgagaccgacaccgcccaggtgcaggacgcgccgatggcctcgatgtacggcctggccaagcgctcgatcccggtcgtccgtcaggagacggaagagcgcaagatcgtccgcttctcgcgccccaagggcgcggccggcaagcgcaagcgccgtcgctga

SEQ ID NO: 40475 - DNA, 3444 bp, Caulobacter crescentus
gtgcagttccagcgcctccgcctgtcgggcttcaagtccttcgtcgagccgacggagttccggatcgagccggggctgaccggcattgtcggcccgaacggctgcggcaagtccaaccttttggaagccctgcgctgggtgatgggcgccaactccgccaaggccatgcgcgccggcggcatggacgacgtgatcttcgccggcagcggcgcgcgccccgcccgcaaccacgccgacgtcaccctgaccatcgacaacgccgaccgcacggcgccggcccagttcaatgacgacccgatcctggaagtggtccgccgcatcgatcgcggcgagggctccacctacaggatcaacggccgcgaggtgcgggcgcgcgacgtccagctcctgttcgccgacgcctcaacgggcgccaactcgccggccctggtgcgccagggccagatcagcgagctgatcggcgccaagccgcagaaccgccgccgcatcctggaagaggcggccggggtctcagggctgcacacgcgtcgccacgaggccgaactccggcttcgggcggccgagaccaatctctcgcgtctggaagacgtggcccgcgagctggagaccgcgctgaaccggcttcgtcgcgaggcaaggcaggccgagaagtacaagcgcctgtcgtccgagatccgggccgtgcagggcgcggtgctctacgcccgctggaccgaggcccgcgaccacctggagcgcaccaccagcgaggccacggccgccgcgcgtctggtcgaggagaccgcccgcgccagcgccgcggcccaggtggcgatcaccgaggccgaagccgccatgccgccgctgcgcgaagaggccaccatcgcccaggcgatcctcggccaactggcgatccagaaggaccgcgccgaacgcgaggccgaggccgccgccgccgagttcgagcgcctgtcgaacgacctttcccgcatcgacgccgaccgggcccgcgaggcgcaggccaaggacgacgccgccgccgccctcgcccggatcgcgccagagctggaggaggtccgcgccctcgtcgccgccgcgcctgagcggggtccggagctggccgccgtcgccaaggccgccgaggaggcccgcgccgccgccgaggccgctgtcgaacagctggccgcccgggtcgccgccgaagaagcccaaggccgcgccgccgccgcgcgcctgtccgaggccgaggcgcgcgccaaccgcaccaaccgcgcgcttgagcaggcccgcgccgagcgcgccgctgtcggccccgaggtcgacccggccgccgccgacgcccgccagcgcttcgccaacgccgaggccgctctggccgccgcccgcgccgccctggaagaagccgagaccgcgcgcgtgaaagcggccgaacaggaggcccaggcccgtcagctggcccgcagcgtcgaggaccagctgggccgcctgcgcaccgaagcgcggggtctggcgcagctgaccgcgccccgcagcaagagcggccatgccccggcgctggacagcgtctcacccgacaagggctatggcgcggctctggctgcggccctgggcgatgatctcgatgcggcgctcgatccgaaggccccctcgtactggggcggcgccgaggctcctgcgccggtgtggccggaaggcgccgagcccctggcgccgctggtcaaggccccgccggccctggccgcccgcctgtcgcacgtggccgtggtcacccgcgccaacggcgaccggctgcaaaaggagctgaagccgggcatgcgcctggtctcgaaagacggcgacctttggcgctgggacggcttcgtggcccgcgccgacgcgccccgccccgccgccgtgcggctggagcagcgcacgcgcctggccgaggtcgaggccgagatcgacgtcatggcgccgcgcgccgaagccaccaccatcgccctgaaggccgccgccgatcgcctgcgcgcggccgaggacctgctgcgcgacaaacgccggggcccgcccgacgccgagcgcctcttgacccaggcgcgcgagcaggtcgccaagttcgagcgcgaacaggccctgcgcgccgcccgcgcccagtctctggacgacaccatcggccgcttcgaggccgagaaggtcgaggccgacgccgccttgggtgaggcccgcgaggcccacgccgccgcccagacctcgggcgacctgcaacctcagttggccgaggcgcggcaggccgccgcccaggcgcgcgaggccgccggcgcggcgcgcaccgccctggatgtcgagacccgcgagcgcgccggccgtcagcgccgcttggagagtctcgaacgcgatcgcgccgactggagcaagcgcgccgaggccgccgcaaagcgggcggagtcgttggagggcgatcgcgtcaaggccgccgccgccctggaagccgcgcgcgaggcgccggcggccctgcaggaaaagctggtggcgctgctcgacgagttcgccgccgccgaggcgcgtcgggctaaggccagcgacgccctggagaccgccgagaccactcggttgaacgccgaccgcgcggcgcgcgccgccgagcaggccgccggcgaagcgcgtgagaagcgcgcagccctggtcgcccatctcgacggcgcccgccagcgcttcgccgaggtcgcctcggccatccgcgaacaggcccgcatggagcctgaggagctgggccgccatgtcgccggcgaggccgtggccgtgcccaaggacgccgccggggtcgaggcccacctgttcgccctggagcgcgagcgcgacgccatcggtccggtcaacctgcgcgccgaggaagaagcgcaggaatacgccggtcgtctagagaccatgcgcagcgaacgcgccgacctctcgggcgcggtgaccaagctgcgggccgggatcgaggagctgaacgccgagggacgcgaacggctcttggccgcgttcgacgtgatcaacgccaacttccagaccctcttccaggccctgttcggcggcggccaggccgagctgaaactgatagagagcgatgacccgctggaagcggggctggagatcttcgcctgcccgcccggcaagcgcatggccagcatgagcctgatgagcggcggcgagcaggccctgaccgccagcgccttgatcttcggcgtgttcctggccaatccggccccgatctgcgtgctggacgaagtcgacgcgccgctcgatgacgccaatgtcgaccgctactgcaacatgctggacgagatgcgccgccgcacccagacgcgcttcatcgccatcacccacaacccggtgaccatgagccgcatggaccgcctgttcggcgtgaccatggccgagcgcggcgtcagccaactggtcagcgtggacctgagcacggcggagaagctggtggcggcttaa

SEQ ID NO: 40476 - DNA, 1539 bp, Caulobacter crescentus
atgaacggcgcggacgccctgatcaccaccctggccgacaacggcgtgaccgcctgtttcgccaatcccggcaccagcgagatgcagttcgtctcggccctggaccgcgagccgcgcatgcgcagcgtgctttgcctgttcgagggcgtggcgaccggcgcggccgacggctatgggcggatggccggtaagcccgcctgcaccctgctgcacctgggacccggctacgccaacggcgcggccaatctgcacaacgcccgccgcgccttcacgccggtggtcaatgtgatcggcgaccacgccacctatcaccgcgacttcgacgcgccgctcaatagcgacatcgccgccctggctgcgcccaactctgtctgggtcaagtcggccgagaccgccgacagcgtcgggccgttggccgccgaggcgatcatcgccgcttacgggacgccgggcggcaacgcctgtctcgtcctgcccgccgatgcggcctggaacgaagccacggtcaagggaccgatggtgacgccgcccgccttcgccgcgcccgatgcggcgtcggtcgaggccgtcgccaaggcgctgggcggtgcgaccaagccggtgctgttgctgggctcgggcgcctgtggcgaggcggcgctggcggcggccgggcggctggccgcccacggcgtgcgggtgctgaccgacaccttcaccgcccgccaggcgcggggcgagggccgtttccgtcccgacaagctgccctatttcggcgagctggccctgaaggacctcgacggcgtcgacctgatagtgctggtcgccacccagaccccggtcgccttcttcgcctatcctgatcgccccagcgtgctggttccggaaggctgttcggtcgagaccctgtgcggtcgcgaggtcgatgcggccgccgcgctgaacgccctggccgacgcgttgggcgcgcccgccgccggccccgtcgagacctacgccgcgcccgatgcgccggccggacgtctggacgcctgggccatcggcgcagcgatcgcgcggcatatgcccacggatacgatcatctcggacgacgcggtgacggcgggcctgccgatcttcacccagaccaaggccgcccgggcgcatgactggctgtctttgaccggcggcgcgatcggccagggcatcccgctggcgatcggcgcagcggtggcctgtccggaccgcaaggtcctggcgctcaccggcgacggcgcgggcatgtacacggtccagggcctctggacggtggtccgcgaaaagctggacgtgaccgtggtggtcttcgccaaccacgcctaccgcatcctcggcattgagctgggccgcacgggcgccggcaatccgggtcccgccgccgcgaagctgctggacctgggcgatccgcgcatcgattgggtgaagctcgccgaaggcctgggcatggccgccgagcgcgtcgccaccgccgaggccttcgaggaggccttcgcccgcgccatggccacgccgggtccgcgcctgatcgaagcggcgatgtag

SEQ ID NO: 40477 - DNA, 972 bp, Caulobacter crescentus
atgagcggacggatcacatcggcctttggggccaagtcgacggcgcgtgaggttgtcgccgggcatgacctttccggtcgcgtggcgatcgtcaccggggcggccaccggcatcggggtggagaccgctcgcgccctggccctggccggcgccgaagtgatcatcgccgcccgcaagccggagctgggcgaagaggtcgccaacgccatcaatgaagaggccgggtccaagcgggtcagcttcggcatgctggatctctccagccttgaggccatccgtcacttcgtgaacgtctggggcgatcgccgcatcgacatcctgatcaacaacgccgccgtcatggccagtccgctgatgcgcaccgccgacggcttcgagatgcagttcggcaccaatcacctgggccatttcctgctgtcggtgctgctggccccgaacctgatcgccggcgccaaggccagcggcaagccttcgcgactggtctcgctgtcgtcgatcggccaccggcgctcggggatccatttcgacgatcccaactacaccacccgcccctacgagaagtgggaggcctatggtcaggccaagaccgccaacagcctgttcgcggtgggtttcgacaagcgcttcaaggatcagggcgtccacgccaacgccgtcatgccgggcggcatcctgaccccgctgcaacgccacctgccgatcgaggagcagcgcgctctgggctggctggatgagaacgaccagccgcgcgagggcttcaagacgaccgaacaaggcgcggcgaccagcgtctgggcggcggtgggaagcgagctggagggcgtcggcgggctctatctggaggactgcaaccaggcgctgccctggagcaaggaaaacccctggaccggcgtgatgccgcacgccctggaccccgaggccgccgatcggctctgggacctgtcggtcgacatcgtcggggccggcgcctga

SEQ ID NO: 40478 - DNA, 480 bp, Caulobacter crescentus
atgaccgtcaccgtccgtcccgccacgcccgccgacgccggcctgatccaccagttcatcctcgatctggccgagtatgagaagctgctcgacaccgtccaggcgacgccagccgacacggccgcagccctgttcggcgaaaaggcccgggccttcgccgacatcgccgagatcgacggccagccgatgggctttgcgctgtggttctacaactactccacctttgtcgggcggcacgggatctatctggaggacctgttcgtgcggccgtcggcgcggggctcgggcgcgggcaaggcgctgctggccaacctcgccaagcgctgcctcgacgagggcctgggccgcctggaatggacggtgctggactggaacgccccgtcgatcgccttctatgacagcctggacgcggcggcgatggacgagtggatcatccgccgcatgaccggtgaggcgctacgcaagctggcgggggtctga

SEQ ID NO: 40479 - DNA, 753 bp, Caulobacter crescentus
atgacttcgcgcggcgcggccctggtcaccggcgcgggacgccggatcggccaggtcctggctcttgaagccgcgcgcgccggctacgacgtcgccatccactaccgcgcctcggccgatgaggccgaagagaccgcgcgcgctgtccgggatctggaccgccgcgccctgctcgtccgcgccgacctttcggacgaggacgagacccgcagcctggtcgcccaggccgcgccgttgggtccgctcaccctgctgatcaacaacgcctcggccttcgaggacgaccgcgtcggcggcctgtcgcgcgccagctgggatcgccacctcgagaccaatctgcgcgccccgatcgtgctggccgaggcgatggcggcggccctgccggcggatcgccaggggctggtcgtcaatctgatcgaccagcgcgtctggcggcccaatccgcagttcttcagctacacgctcagcaaggcgggcctgtggtgggccacccagaccctggcccaggccctggcgccgcgcatccgcgtcaacgccatcgggccgggccccaccctgccctcggtgcaccaggcgccgggcgagttcgaggccgaggcggccggggtgctgttgcagcgacgcgccagccccgaggaggtcgccgccgccctgcgctatctgattgacgcgtcctcggtcacgggacagatgatcgccgtggacggcggccagcacctgggctggaagacgccggatattgttgctccctag

SEQ ID NO: 40480 - DNA, 1440 bp, Caulobacter crescentus
atgcgcgagtatacgaagttctatatcgacggcgcctgggtcgacccggccgcgcccaatacgctggacgtcatcaacccggccaccgaagaggtttgcggcgtcatctcgatgggctcggaagccgatgtcgacaaggccgtccgcgccgcccgcaaggccttcgccagcttcagccagaccagccgcgaagagcgcatcgacatcctcgagcgcatcatcgccgaatatcagaagcgcttcgaggacatggccaaggccatcaccgaggagatgggcgcccccgcgtggctggcccagcgcgcccaggccgccatgggcatcggccatgtccagaccgccgccgccgtgctcaagggctacaagttcgaggaagaccgcggcacgacccgcatcgtcaaggagccgatcggcgtctgcgccttcatcacgccgtggaactggccggtgaaccagatcgcctgcaaggtcggtcccgccatcgccaccggctgcaccatggtgctcaagccctcggagatcgcgccgttcagcggctatatctggaccgagatcatgcacgccgccggcgttccggccggggtgttcaacctggtcaacggcgatggccccacggtcggcgcggcgctgtcgcgccatccggaagtcgacatggtctcgttcaccggctcgacccgcgccggcatcgaggtggccaagaacgccgccccgaccgtcaagcgcgtccaccaggagctgggcggcaagagccccaacatcatcctcgacgacgccgacttctcgcgcgccgtcgccgggggcgtggcctcggtcatgatgaactcgggccagtcgtgcaacgcccccacccgcatgctggtgccgggcgcgcgcatggacgaggtgatcgccatcgccaaggccgccgccgagagccacacggtcggcgacccgaacggcaatcacaagatgggcccggtggtctccgagacccagtggaacaagatccagggcctgatccagaagggtatcgacgagggcgccaccctggtcaccggcggcgtcggccgacccgaaggtctggacaagggctactatgtgaagccgaccgtcttcgccaatgtcaccaatgagatgaccatcgccaaggaagagatcttcggcccggtggtctcgatcctgggctacgacacggtggatgaagccgtcaccgtcggcaacgacaccgaatatggcctagcggcctatgtctcgggcggcgaccaggacgaagtccgcaaggtggccagccgcctgcgcgccggccaggtcaccctcaacggcgccggccccgacctgatggccccgttcggcggctacaagatgagcggcaacggccgcgagtggggcgaccacgcgttcggcgagttcctggagaccaaggcgatcctcggctactcggcgaaggtggcggcggagtag

SEQ ID NO: 40481 - DNA, 1503 bp, Caulobacter crescentus
ttgcagagcatggcggacgccgaaaccgctgacactttcggctgccatgctctggtcggagggacccccaaagtgagcttctggacgcgccgcaaggccatcgacaccatcaccgctggccatgcggacagccaccaactgaagaagaccctgagctggccgcatctggtggccctgggcgtcggggccattgtcggcaccggcatctacaccctgaccggggtcggggcgggtctggccgggccgggcgtgatcctgtcgttcctgatcgccggcgccgtctgcgcctgcgcggcgctctgctacgccgagctttcgacgatgatcccggcctcgggcagcgcctacacctacagctatgcggcgatgggcgagccggtcgcctggttcgtcggctggagcctgatcctggaatacaccctggtctgcgcggcggtggccgtcggctggtcggctcacgcccatggcctgttcaagatgatcggcttccccgacgccctgctggcgggccctcaccagggcgggctgatcaacatgccggccgtcttcatctcgatggcggtggcgggccttctggccctgggcacccgcgagagcgccacggtcaacatggtgctggtcttcgtgaagatcatcgccctgatcgtctttgtcgtgctctgcctgcccgcgttcaacctggcccacttcacccccttcatgcccaacggcttccaggcccacgtgccggagggcgcggccgccgacgccgccaaggtcggggtgatggcagcggccagcctgatcttcttcgccttctacggcttcgacgcggtttcgaccgccgccgaggagaccaagaaccccaagcgggacctgaccatcggcatcgtcggctcgatggccgtctgcacggcgatctacatgatcgtcgccgccgtctcgatcggcgcctcgcgcaccgaggtcttctccaagagcgaggccccgctggtcttcatcctggagagcctgaaccacggcaagatcgcccagctggtcgccctggccgccgtcatcgccctgccgaccgtgatcctggccttcatgtacggccagagccggatcttcttcgtgatggcccgcgacggcctgctgccccgcgccctgtcgaaggtgaacgccaagaccggtacgccggtgatgatgaccctgctgaccggcgtcctggcggcggtgatctcgggcctcttgtcgctgaaggacatcgcagagctggccaacgccggcacgctgtgggccttcatcgccgtcggcgcctcggtgatcctgctgcggctgcgcgagccgaaccgtccgcgggtgttctccaccccgctgtggccgatcgtggccccggccggcatcctgggctgcctctatctcttcctcagcctgcccgggaagacccagctctacttcctctacgcccacctgatcggggcggtggtctatctggcctatggcatgcgcaagagcgtgctggcccagcaggagcgggcgtaa

SEQ ID NO: 40482 - DNA, 1149 bp, Caulobacter crescentus
atggccctcgatctggaaacccgtgaacaactgatcgacacggtcgcccgcttcgtggccgaacgtctgcggcccatcgaggcgcaggtcgccgagaatgacgccgtccccgacgatgtgatcgaggagatgaagggccttggcctctttggcctgacgatcccggaagagttcggcgggcttggcctgaccatggaggaagaggcgctggtggccatcgagctgggccgcgcctcgccggcctttcgctcggtgttcggcaccaatgtcggcatcggcagccagggcctcgtcatgttcggcaatgacgagcagaaggccaagtggctgccggggatcgcgtccggcgcggtgatcacctcgttcgccttgaccgagccggaggcgggctccgacagcgccgccgtgcagacccgcgccacccgggacggcgacgactacatcctgaacggctccaagcgctacatcaccaatgccggcaaggcctcgctgttcacggtgatggcccgtaccaatcccgacgccaagggcggggcgggggtctcggccttcctggtgccgcgcgacctgccgggcctgacggtcggcaagcccgaaaagaagatgggccagcagggcgcccacatccacgacgtgaccttcgataacgtccgcgtgccggcctggaaccggctgggcgccgagggcgaaggcttcaaggtcgccatgcaggtgctggatcgcgggcggctgcacatcgccgccgtctgcgtcggtgtggccgagcgcctgatcgccgactgcgtggcctacgcctccgaacgcaagcagttcggccagccgatcgccagcttccagctgatccaggcgatgatcgccgacagcaagaccgaagccctggcggccaaggcgctggtgctggagaccgcccgcaagcgcgacgccggcgtgaatgtcacgctggaggccgcctcgtccaagctgttcgcctcggaaatggtcggccgcgtggcggaccgcgcggtgcaggtgttcggcggcgccggctatgtcgccgactacgggatcgaacgcctctaccgcgatgttcgtattttccggatctacgagggcaccagccaggtccagcagctgatcattgcgcgtgaaacgctgaagcgcggcgggtga

SEQ ID NO: 40483 - DNA, 1092 bp, Caulobacter crescentus
ttggaggcgaccgtcttgacccgtcatgagacccccgcgcccacaggcgcgtcgcctccgagcctggcgccggcctcgacccacatgtttcgggaggccggcgaggccgccagggtcgccgccgtccagctgaccgccaacgccccgaagatccaggcgctggcccagcgcctgcgcgcaaacccgcccagggtcgtggtcacctgcgcccggggcagcagcgaccatgccgccaccttcgcccgctacctgatcgagaccaaggccggggtactgacctcgtctgcgggcccttcggtcagctcggtgtacgacgcctcccctaaccttgagggcgcgctctatctggccatttcccagtcgggcaaaagccccgacctactggcggctgtgaaggccgccaaggcggccggcgcccacgccgtggcgctggtgaatgtcgtcgactcgccgctggcggcgctggcggacgaggtcattcctctgcatgccgggccagagctcagcgtcgcagccaccaagtcctacatcgcagccctcgtcgcggtgacccagctgatcgcggcctggaccgaggacgcagagcttaccgccgctctgcaggaccttcccacagccctggcggccgcctggaccctggattggtccctcgcggtcgagcgcctgaagaccgccagcaacctctatgtgctggggcgcggcgtcggctttggcgtcgccctggaagccgccctgaagttcaaggagacctgcggcctgcacgccgaggccttcagcgccgcagaggtgctgcatggcccgatggccctggtgaaggacggcttccccgccctggtcttcgcccagaacgatgagagccgcgccagcgtcgacgagatggccgccggcctgcgggcgcgcggcgccagcgtgctgatcgccggtggcggcggcgacgcgccagacgcgctgccgacccttgccagtcaccctgtgctggagccgatcctgatgatccagagcttctaccgcatggccaatgcgctctcggtcgcgcgtggctatgatccagatagcccgccgcatttgaacaaggtcaccgaaaccatctga

SEQ ID NO: 40484 - DNA, 2274 bp, Caulobacter crescentus
gtgaccttgaccccgctccgtatcgtcgccgtctcgacgttcgcgctgaccgctgcgctcgcgaccggcgctttcgccgacagtctcacgatcacgccggcgcccgccaaggtcgttcgcgccgaggggaccttcaccctgtcggcctccacccgaatccatgtcgccaggggcgacatcgaggccaagggcgtggcgctgcaactggccgacctgatccagaggtcgcgaggcttccggcccaaggtggttgaggggccgcccgcagccgacgccatcgtcctcacgcgcgaagggccggcgggcgaagcctacaagctcgatatcaacgccaagggcgcgaccatcgccgccgccaagcgcgcgggcctcttctacggcgcgatgtcgctctggcagctggcgaccccggacgaggccaaggggcccgtcgcgcttctcgccgccagcatcgaggatgcgccgcgcttcgcctggcgcggcctgatggtcgacagcgcccgccactaccagtcgctcgacaccctcaaggcggtgatcgacgcgatggccgcgcacaagctcaacaccttccactggcatctggtcgacgatcagggctggcggttggagatcaagaagtatccgaagctgacgcaggtcgccgcctggcgtcgcaaccccggcgcggccgtgaactatcccaagtacggcggcttctacacgcaggaccaagcccgggaactggtcgcctacgccgccgcgcgcaacatcaccgtcgtgccggagatcgaaacgccgggccacgccctggcgccgatcgtcgcctatccccaactgggaaccgcgccgccggacgccagcaagatgggcgactgggggatcttcccgtggctctacaacaccgatgacgccaccttcgccttcctcgacgatgtgctgaacgaggtgatggacatcttcccgtcgaccttcatacacgtcggcggcgacgaggcgatcaaggaccagtggaaggccagcccgaaggtccaggccaagatcaaggagctggggctcaaggacgaacacgagctgcagagctggttcatccagcgggtcggcaagagcttggaaaagcgcggccgccgcctgatcggctgggacgagatcctcgagggcggccttgcgcccaacgccacggtgatgtcctggcgcggtatcgacggcgcgatcgccgccgccaagcagggtcacgacacggtgctgtcgccgcatccggtgctctatctcgaccaccgccagagcgcctcggccgaggagccgaccggacgaggtcacatctccagcctgaaggatgtctacgccttcgacccggcgccggtccaactgacaccggacgagcgcaagcacatcctcggcgtccaggccaatgtctggaccgagcacatgcagaccgaccagcgcatgcagctgatggctttcccgcgcgctgtggccctggccgagcgggcctggtcgcccgaagccagcgccgactgggatggcttcgccaagcggctccccgccgagatggcgcgcttgaaggtcctcggcgtggcggccaatccggttccgttcgagccgcagccggcgctgtcggaggccgaggggggcaagacgcgtgtggcgttgtcgacgggcctcggcgtcggtcagatccgctacaccaccgatggcaaggcgccgacggcgacgtcttcgacctatgccggccccatagagctacccaccggcgcggtgctgaaagcgcagaccttcgttgagggccagccgctgggtcgtgagcggtcctggacgatgtcggcggaccttctccagacgcgaacgagcggtcagctcaagctctgcacccagcaggtgccgctgaccatgatcgacgacgcgcccgccgcgctcgaccagcgtccgatgatgatggtcgacatcttcaatccctgctggatctgggaaggcgcgcgcctcgacaagggcgcgatgctcagcgcccgcgtcacccagatcccgttcaacttccaggtcggcaaagaccgcgacaagatcccgctgcatccgccggccacgccgggcggcgagctggaggtgcgcctgggctgctctggcgaaaggatcgccgcgattccgctgggcgacgcggcgcgcaatcccggcctctcgaccatcacaggccgcctgccggcgcgtgcggaaaaggccgatctctgcctgaccttcacctccaggagcctcgatcctttctgggtggtcgagcgcatgaccctcaagcccgcgaactag

SEQ ID NO: 40485 - DNA, 2559 bp, Caulobacter crescentus
ttgatcgtgtccaatctcgttctcacggcccccttgcagggctgggtttcggcgctggaggaggcgccggatgcggtgttcgccgagcgaatgctgggcgatgggctggcgattgatccgctgggctcgacgctgcacgcgccgtgcgacgggtcggtggtgagcgtgcaccgggcgcgccatgcggtgacgctgcgggcgacgaacggcgctgagatcctgatgcatgtgggcctggagaccgtggcgctgaacggcgagggctttgaggtctttgtcgaggaaggccagacggtgaaggcgggcgatcggctgatcggcttggaccttgacctcctggctcagcgcgcccgcagcctgatcacgccggtggtgatcaccaacggcgaggccttccagatcgtgcgccgcgaccaggaccgccagatcggcgtgggccagttcctgatggagctgtcgccgatcgcgggcgcatcgcgcgccgctgcgtccggagccgcagaccagatcacccgccagatcatcgtgcccctggcccacgggatccatgcccgcccggccgcgcggatcgcgcagatggccaagaccttcgcgtcggacctgaccctggcgaccggcccgcgccgggccaacgccaggagcccggtggggctgatgtccctggccatccgccatggcgacacgatccagctgctggcctcgggaccggacgcccaggcggcggtcacggccctggccgaactgatcgaaggcggcatgggcgagggcgcgccggtggccgccaagacctcctcgaccaagaccgccccgaccaagacagaaccctccgaaccgcccccgcccgcgccactgccgcgcgacggggtgctgaagggcgtgccggccgcgccgggcctggccatcggcaaggccgtgcggctgtcgaccgccgagatcgtcgtgcgcgaggccggcgagggcgtcgcccacgaggaagcggccctggccgtagccctggagacggtccgcgcccggatcggcaaggccgccgagaccggcgacaaggcccgcaaggcgatcctggcggcccaccaggcgttcctcgacgaccccgaactctacgccggcgcccatcgcctgatcgctgagggcaagagcgcaggctttgcctggcgccgggccgtgggcggctatgtccaggcgctgcaggcgctgggcgatcgccgcatggccgaacgggtcgatgacctgatcgacctggaacgccaggtcctgcgcgccctcagcggcgaggaagagacgggcgcggcgctggcgccgggctcgatcctgctggccgacgagctgttgccctcgcagctgatgggcgcagaccccgccgccctcgccggcttcgccaccgcgcggggcggacccacctcgcacgtggccatcctggccgcggccatgggcgtcccggccctggtggccgtcggcggggcgctgtcgaaggtcaaggacggggcgaccctgatcctggacgccgatgcgggaaccctgcgcgtggcccccgacgccaaggccctggaagccgcgcagacggcgctcgcccaacgccagcagcgcaaggccgccgccaaggccgccgcccacgagccggcggtgacgcgcgacggggtgcgtatcgaggtcttcgccaacaccggctcggtcgccgacgcccaggccgccgtggccaacggcgccgagggctcgggcctgttgcgcaccgagttcctgttcctggaccgcgagaccccgcccgacgaggacgagcaggcccgccagtaccaggccatcgccgaggccctggacggccggcccctgatcatccgaacgctggatgtcggcggcgacaaggccgcgccctacctgccgatcccggccgaggagaacccggcccttggcctgcgcggggtgcgggtcagcctgtggcggccgcatctgttgaaggcccagctgcgcgccatcctgcgggtcgagccgcggggccagtgcaagatcatggtcccgatggtggccagcctcgatgagctgcgcgcggtgcgcgcggtgctggaggaggccaagcgcgagcttgggatcaccgatcgcgtccagctgggggtgatgatcgagaccccggccgccgccgtcaccgccgacctgctggcggccgaggccgacttcctgtcgatcggcaccaatgacctgacccagtacgtgctggccatggaccggggtaaccccgaactggccgccggcatcgacgccctgcacccggcggtgctgcggatgatcgaccagacctgccagggcgcggccaggcatcatcgctgggtgggggtgtgcggcggcctggcctcggacctggacgccaccccgatcctgctgggccttggggtcgccgagctgtcgaccacggcctcgatcgcgccggacgttaaggcccgggtgcgggcgctgtcgctggaggcctgccgcgccctggcggcccaggccctggagcagacctcgccgcaggcggtccgcgcgctcgtgcaaggccagaccaacacccccctcggaggcttgaacccatga

SEQ ID NO: 40486 - DNA, 639 bp, Caulobacter crescentus
atggacgcactgacccgcgagcgaaccctgatcggctctgacgacacgaccggtcttgatcttgaacccgttcagcgcccttccaaggacgaggccatggccgccgtgcggacgttgctggcctgggccggcgacaatccggagcgcgaaggcctgatcgacacgcccaagcgcgtcgttgaggcgttcgacgagtggttcgccggctatcacggcgatccggccaaggaactgtcgcgcaccttcgaggacgtgcagggctatgacgacatggtcatgctgcgcggcatcgacgtgcagagccactgcgagcaccacatggcgccgtttctgggcaaggcctggatcgcctacatgccgaccggcaaggtggtgggcctgtcgaagctggcgcgcctggtcgagatcttcgccaagcgtctccagacccaggagaccatgaccatgcagatcgccgacgccatcgaggatcacctgtcggccgccggggtcgccgtgctgatcgacgccgagcaccagtgcatgagcacccgcggcgtccaccaccacgacgtctcgaccatcaccacccagttccgcggcgtgttcaagaccgacaaggtcctgcagcagcgcttcatggatctggtgaagaagtaa

SEQ ID NO: 40487 - DNA, 900 bp, Caulobacter crescentus
atgagccgcttcatccagatcgtcgaggtcgggccgcgcgatggtctgcagaacgagaagacggtgctctccgtcgaggaaaagctcgacctgatcgccaagctggaagcggccggcgcccggcgcaccgaggtggtgtcgttcgtcaatccgagccgcgtaccgcagatggccggcgccgaggagatcatggccgccctgcccgccgatctcgtccattcgcgcatcggccttgtcttgaacatgcgcggctgggagcggtgcgtgtcgacgggatgcgacgaggccaatgtcgtggtctgcgcctcggacggcttcgccacccgcaatcagggctcgacgacacagcagcaggtcgaaaccctcgccgccatcgtcgagcgccaggcggccgaaggcggtccgccgatcaccgccaccatctcggtggcgttcggctgtccgttcgatggcgaggtctcgcaggatcaggtcgtcgcgatcgtccgcgaggccgccgccctgggcgtgcccgagatcgccatcgccgacaccatcggcgtcgccgacccctggaccgtccgccggcggatcgaggccgtccgggccgcagcgccggacacgcgcctgcgcatgcacttccacgacacccgcaatacgggcctggccaacgccttcgccagcgtcgaagcgggggtcgacgtgctggacgcctcggtcggtggccttggcggctgcccgttcgcgccgaacgccacgggcaatatcggcaccgaggatttggtttacatgctggaacgcgccggcttcgagaccggttacgacctggcggcgctgatccagatcggccgcgacatcagccaacgcctgggcaaggctcccgcctcgtccctggcccgcgccggaggcttccccgcatga

SEQ ID NO: 40488 - DNA, 2334 bp, Caulobacter crescentus
atgaccgtcaccatcgccaccctgggctttccccgcatcggccccaagcgcgagctgaagttcgccctagaggcctattgggccgggaagaccgacgcggatgcgctgctcgacacggcgcgcgacctgcgggccaagacctggacgcgccaggccgcgctgggcgtcgcccacgtgcccagcaatgacttctcgctgtacgaccacgtgctggacacggcggtgatggtcggcgcgatccccgccgcctacggctggtcgggcgggacggtcgacctggcgacctatttcgccatggcgcgcggcgaccaggggcgtccggcggccgaggcgtgcggcccgggctgtggccacgcgcccggcgcggacggcgttccggcgctggaaatgaccaagtggttcgacaccaactatcactacctggcgcccgagctgtcgccgggtcaggccttcgcgctgacgtccagcaagccggtggacgagttcctcgaggccaaggcgctgggcgtccacacgcgtccggtgctgctgggcccggtgacgttcctcaagctggccaagaccaaggctgagggcttctcgccgctgtcgctgctgtcggctctgttgccggtctacggccaggtgctgcgggggctggcggcggctggggcggactgggtgcagatcgacgagccgtgcctggcgttggacctgaccgacttcgagcgcgccgagctgcgccgcgcctatggggccctgacccacgccgcgcccggcgtgcggctgatgctgaccagctatttcggcggctatggcgagaacctggcgacggcggtcaatctgccagtggagggcctccacctggacctggtccgcgcgcccgatgagctggaagccgccctggccgccagccgtgagagcctggtgctgtcgctgggcgtgatcgacggccgcaatgtctggcgcgccgacctgccggccctgctggatcgcctggagcccgtggtggcgcgacgcggaagcgaccgggtggtgctggcgccgtcgtgctcgctgctgcacacgccgatcgacctggacctggaaacggcgctggatccggagatccgccagtggctggccttcgcggtccagaaggtcgaggcgctggcggtgctggcccaggcgctgaacggaggccgagcctcggtcgccgcggcgctggaagccagcgcccaggcggcgcgggcgcgggcgacctcgccacgcatccacgatccgaaggtcgccgaacgcctcgcagccgtgacgcccgacatgacccgccgccgctcgccctacgaccagcgtcgcgaggctcagcgggcgcgactgaacttgccgccgctgcccacgacgacgatcgggtccttcccccagacgaccgaggtgcgccaggcgcgggcggccttcgccaagggacagatcagcgacgcgacctatgaggccttcctgcgccaggagaccgcccgcgcggtggcctggcaggagacagtcggcctcgacgtgctggtccatggcgagttcgagcgtaacgacatggtccagtacttcggcgagcaactggcgggcttcgccttcacccagagcggctgggtgcagtcctacgggtcgcgctgcgtgcggccgccgatcctgtttggcgacgtctcgcggcctgcgccgatgacggtggactggtggcgctatgcccaggggctgacgcgacgaccgatgaaggggatgctgaccggaccggtgacgatcctcaactggtcgtttgtccgcgacgaccttccgcgcgagacggcctgccggcagatcgccctggccattcgcgacgaggtcgtcgacctggaggccaccggggcggcgatcatccagatcgatgaggcggcgctgcgcgagggcctgccgctgcgacgcggcgactgggacgcctatctggactgggcggtcgagagcttccggctggcggcgtccggcgtggccgacgcgacccagatccacacccacatgtgctattcggagttcaacgacatcatcgccgcgatcggggcgatggacgctgacgtgatctcgatcgagacggcgcggtcgaagatggagctgctggacgccttcgtcggctacgcctatccggcccagatcggtccgggcgtctatgacatccactcgcctcgcgttccggccgtcgaggagatgaccaccctgctggcggccgctcgtcagcggctggccggcgagcagctatgggtcaatcccgactgtggcttgaagacccgaaagtggccggaaacccaggcggcgatcgtcaatatggtcgaagccgcaaggcgcgcgcgcgcgtcttaa

SEQ ID NO: 40489 - DNA, 939 bp, Caulobacter crescentus
atgaagctgctgtccggcaactccaaccgcccgctgtcccaggcgatcgcggaatatctcgacatgccgctgacccgcgcccaggtgcgccggttcgccgatctcgaggtgttcgtcaccatcgacgagaacgtgcggggcgaggacgtcttcgtcatccagtcgaccagctatccggccaacgacaacctgatggagctgttgatctgcatcgacgccctgaagcgtgcgtcgggcaagcggatcaccgccgtcatcccgtacttcggctacgcccgccaggaccgcaagaccggtggccgcacgccgatctcggccaagctggtggccaatctgatcacccgctcgggcgccgaccgggtcctgacgatggacctgcacgccggccagatccaaggcttcttcgacatcccgaccgacaacctgttgccctcgcgcctgatggccgaggatatccgtcggcactatccgatgggcgatgacctgatggtcgtctctccggacgtcggcggcgtggtgcgggcccgcgcgctggccaagcgcctggacgacgctgacctggccatcgtcgacaagcgtcgctcgggtccgggccagtcggaggtgatgaacatcatcggcgacgtcaaggatcgccgctgcatcctgttcgacgacatcgccgactcggccggcaccctgtgcaacgccgcccaggccctgatggcccacggcgccaagtcggtcagcgcctacatcacccacggggtgctgtcgggcgcggcggccgatcgcgtcgccaattcggtgctgaccgagctggtggtcaccgactcgatcgaggcctctgacccggccaaggcctgcccgaagatccgctacgtctcgtgcgccccgctgatcggcgaagccatccgccgcatcgccaacgaagagtctgtgtccaagctcttcgactaa

SEQ ID NO: 40490 - DNA, 783 bp, Caulobacter crescentus
atgacccccatcctccttctcggcgcgggccgcatgggcggggccttgatccagggctggcaggcggccggcgcgtttgacgccgccgatctcatcatccgcgacccccatgtcgacgctgcggccttcgccggcgcggtggtcaatccgccgctcgagaccctgggcgcggccaagaccgtgttgctggcggtcaagccgcagatctggcgcgaggcgattgcggacgtggttccgcacctggcgccggacgcggtgatcgtgtcgatcgccgccggcgtccgcgccgcggacatctcgcaggccttcggcggccgccgcgtggcgcgggtcatgccgaccacggccgtcgccatcgggcagggcgcggccagtctctatgcggacgacgccgaggctctcgcccgcgcccgcgccctgttcgccccgctggccgccgtggcggagctggcgtccgaggacctgatgcacgccgctaccgctgtgtcgggctcggccccggcctatctctacgccttcatcgaggcgctggaggcggcgggcgcggcccagggccttgatcctgcccagagcgcgcgcctcgcccgggcgacgatcatcggcgccgccgccctgatggcgcagagcggcgaggaaccggctgagctgcgcaagcaggtcacctcgcccggcggcacgacggcggcggcgctctcggtgctgatgggcgccggcggtttcggtgacttgctgcccaaggcgctggacgccgccgtggcgcgatcgaaggaactgggcggctag

SEQ ID NO: 40491 - DNA, 4071 bp, Caulobacter crescentus
atggcgcaatccttcaccggcaagaagcggatccggaagtcgttcggccgcattcccgaggctgtgcagatgccgaacctcatcgaggttcagcgctcctcctacgagcagttccttcagcgcgagacccgtccgggcctgcgccgcgatgaaggcgtcgaggcggtcttcaagtcggtgttcccgatcaaggacttcaacgagcgcgccgtgctcgagtacgtctcgtacgagttcgaagagcccaagtacgacgttgaagagtgcattcagcgcgacatgaccttcgccgcgccgctgaaggtcaagctgcgcctgatcgtgttcgaaaccgaagaagaaaccggcgcccgctcggtcaaggacatcaaggagcaggacgtctatatgggcgacatcccgctcatgacggacaagggcaccttcatcgtcaacggcaccgagcgcgtcatcgtctcgcagatgcaccgctcgcccggcgtgttcttcgaccacgacaagggcaagacccacgcctcgggcaagctcctgttcgccgcccgcgtgatcccgtaccgcggctcgtggctggacttcgagttcgacgccaaggacatcgtctacgtccgtatcgaccgccgccgtaagctgccggccacgaccttcctctatgccctgggcatggacggcgaagagatcctgaccacgttctacgacgtcgttccgttcgaaaagcgttcgggcggctgggccaccccgtacaagcccgagcgctggcgcggcgtgaagccggagttcccgctggtcgacgccgacaccggcgaggaagtcgctccggccggcaccaagatcacggctcgtcaagccaagaagttcgccgatggcggtctgaagaccctgctgctggcgcccgaagccctgaccggccgctatctggcccgtgacgccgtcaatatggcgaccggcgagatctacgccgaagccggcgacgagctggacgtgacctcgatccaggccctggccgatcaaggcttctcgaccatcgacgttctggacatcgaccacgtcacggtcggcgcctacatgcgcaacaccctgcgcgtggacaagaacgccatccgcgaggacgcgctgttcgacatctaccgcgtcatgcgtccgggcgagccgccgacggtggaagccgccgaggcgatgttcaagtcgctgttcttcgacgccgagcgctacgacctgtcgtcggtgggccgcgtgaagatgaacatgcgcctggagcaggacgtctcggacgaagtccgcatcctgcgcaaggaagacgtcctggccgtgctgaaggtcctggtgggcctgcgcgatggtcgcggcgaaatcgacgacatcgacaacctgggcaaccgccgcgtccgctcggtcggtgagctgctggaaaaccagtaccgcgtcggcctgctgcgcatggaacgcgccatcaaggaacgcatgtcgtccgtcgacatcgacaccgtgatgccgcacgacctgatcaacgcgaagcccgctgcggccgctgttcgtgaattcttcggctcctcgcagctgtcgcagttcatggaccagacgaacccgctgtcggaaatcacccacaagcgtcgtctctcggccctcggcccgggcggtctgacccgcgagcgcgccggcttcgaagtccgcgacgttcacccgacccactacggccggatctgcccgattgaaacgccggaaggcccgaacatcggtctgatcaacagcctggcgacgcacgcccgcgtgaacaagtacggcttcatcgaaagcccgtaccgtcgcgtgaaggacggcaagccgcaggacgaagtcgtctacatgtcggcgatggaggaatccaagcacgtcatcgcccagtccaacatcaaggtggctgaaggcgagatcgtcgaagacctggttccgggccgcatcaacggcgaaccgaccctcctgcaaaaggagacggtggacctgatggacgtgtcgccgcgccaggtcgtgtcggtggccgccgccctgatcccgttcctggaaaacgatgacgccaaccgcgccctcatgggctcgaacatgcaacgtcaggccgtgcctctggtgcagtcggacgccccgctggtcggcactggcatggaagccgtcgtcgcccgtgactcgggcgccgtcgtgatcgccaagcgcaccggcgtggtcgagcagatcgacggcacgcgtatcgtcatccgcgccacggaagagaccgaccccgcgcgttcgggcgtcgacatctaccgcatgtcgaagttccagcgctcgaaccagtcgacctgcatcaaccagcgtccgctggtgaaggtgggcgaccggatcgtcgccggcgacatcatcgccgacggtccgtcgaccgagctgggcgaactggccctgggccgcaacgcgctcgtcgcgttcatgccctggaacggctacaacttcgaagactcgatcctgatctccgaacgcatcgtccgtgacgacgtcttcacctcgatccacatcgaggaattcgaagtcatggcccgcgacacgaagctgggtccggaagaaatcacccgcgacatcccgaacgtcggcgaggaagccctgcgcaacctcgacgaagccggcatcgtggcgatcggcgccgaagtccagccgggcgacatcctggtcggcaaggtgacgccgaagggcgagagcccgatgacgccggaagaaaagctgctgcgcgccatcttcggtgaaaaggcttcggacgtccgcgacacgtccttgcgtctgcccccgggcgtcgccggcacgatcgtcgacgtgcgcgtcttcaaccgtcacggcgtcgacaaggacgagcgcgcgctcgccatcgaacgcgccgagatcgaccgcctgggcaaggaccgcgacgacgagttcgcgatcctgaaccgcaacatctcgggccgtctgaaggaactgctgatcggcaaggtcgcgctgtcgggccccaagggcctgtcgcgcggcgagatcacggccgaaggcctggctcaggtcgcttcgggcctgtggtggcagatcgccctggaagacgaaaaggcgatgggtgagctggaaagcctgcgccgcctgttcgacgagaaccgcaagcgcctcgaccgtcgtttcgaagacaaggtcgacaagctgcagcgcggcgacgaactgcctccgggcgtcatgaagatggtcaaggtcttcgtggccgtgaagcgcaagctgcagccgggcgacaagatggccggccgtcacggcaacaagggcgtcatctcgcgcatcctgccgatcgaggacatgccgttcctcgccgacggcacgcacgtcgacgtcgttctgaacccgctgggcgtgccttcgcgcatgaacgtcggtcagatcttcgaaacccacctgggctgggcctgcgccaacctcggcaagcagatcaccaacctgctggaagactggcagcaaggcggtcagaagcaggccctggtcgagcgtctgaccgagatctacggcccggacgaagagctgccggacaccgaagagggtctggtcgaactggcccgcaacctgggcaagggcgttccgatcgccaccccggtgttcgacggcgcgcgcatggacgacatcgagggccacctcgaaatggccggcgtcaacaagtcgggccagtcgatcctgttcgacggtctgaccggcgagcagttcaagcgtccggtcacggtcggctacatctacatgctgaagctgcaccacctggtcgacgacaagatccacgcccgttcgatcggtccgtactcgctcgtcacgcaacagccgctgggtggtaaggcccagttcggcggtcagcgcttcggggaaatggaagtgtgggctctggaagcctacggcgcggcctacaccctgcaggaaatgctgacggtgaagtccgacgacgtggccggccggaccaaggtctacgagtcgatcgtccgcggcgacgacacgttcgaagccggtatcccggaaagcttcaacgtgctggtcaaggaaatgcgctcgctcggcctgaacgtcgagctggagaacagctga

SEQ ID NO: 40492 - DNA, 4191 bp, Caulobacter crescentus
atgaaccaggaagtcctgaacatcttcaatccggtccaggccgctccgaccttcgaccagatccgtatctcgctcgcctcgccggaaaagatccgctcgtggtcgttcggcgagatcaagaagcccgagaccatcaactaccgtacgttcaagcccgagcgtgacggcctgttctgcgcccgtatctttggcccgaccaaggactacgaatgcctgtgcggcaagtacaagcgcatgaagtacaagggcatcatctgcgaaaagtgcggtgttgaagtcaccctggcccgcgtccgtcgcgagcgcatgggccacatcgaactggcctcgccggtcgcccacatctggttcctgaagtcgctgccctcgcgcatcgccatgatgctcgacatgccgctgaaggacatcgagcgcgtcctctacttcgaatactacatcgtcaccgagccgggcctgacgccgctgaagcagcaccagctgctcagcgaagacgactacatgcgcgcccaggaagaatacggcgacgacagcttcaccgctgaaatcggcgcggaagccatccagaacctcttgaaggccatcgacctcgaaaaagaggccgagcgtctgcgcgaggagctgtccggcaccgtttcggacatgaagcagaagaagttttcgaagcgcctgaagatcctggaagccttccaggagtcgggcaaccgtcccgagtggatggtgctgacggtcgttccggtcatcccgccggaactgcgtccgctggtgccgctggacggcggccgcttcgcgacctcggacctgaacgacctgtatcgccgggtcatcaaccgtaacaaccgcctcaagcgcctgatcgaactgcgcgcgcccgacatcatcatccgcaacgaaaagcggatgctgcaggagtcggtcgacgccctgttcgacaacggtcgtcgcggccgcgtgatcacgggcgccaacaagcgcccgctgaagtcgctggccgacatgctgaagggcaagcaaggtcgcttccgtcagaacctgctgggcaagcgcgtcgactactcgggccgttcggtcatcgtggtgggtcccgagctgaagctgcacgagtgcggcctgcccaagaagatggcgctggagctgttcaagccgttcatctatgcgcgcctggacgccaagggcctgtcgggcaccgtcaagcaatccaagcgcatggtcgagcgcgagcagccgcaggtgtgggacatcctcgaagaggtgatccgcgagcatccggttctgctgaaccgcgccccgacgctgcaccgtctgggcatccaggcgttcgagccgaagctgatcgagggcaaggccatccagctgcacccgctggtctgcgccgcgttcaacgccgacttcgacggcgaccagatggccgtgcacgtcccgctgagcctggaagctcagctggaagcgcgcgtcctgatgatgtcgaccaacaacatcctgtcgcccgccaacggtcgcccgatcatcgtgccgtcgcaggacatcgtcctgggcctctactacctgtcggtcgcgcgtgacggtgagccgggcgaaggcaagatcttcgccgacctcggtgaaatcgaagccgccatggacgccggcgtcgtctcgctgcacgccaagatcaaggcgcgccacaccgagatgactccggaaggcgtcctgctgcgcaaggtgatcgacaccacgccgggccggatgaagatcgccgccctgctgccgcaccacccccagattggccaccgcctgatcgaaaaggcgctgaccaagaaggaaatcggcaatctgatcgacatcgtctaccgccactgcggtcagaaggcgacggtgatcttcgccgacaaggtgatgggcctgggcttcaaggaagccgccaaggccggcatctcgttcggcaaggacgacatcatcatcccggtccgcaagaccgcgatcgtggaagaaacccgcaagctggctgaagaatacgagcagcagtacgccgacggcctgatcaccaagggggagaagtacaacaaggtcgttgacgcctgggccaaggccaccgatcgcgtcgccgacgagatgatggccgagcttcagatgaagcataaggacgagaacggccgcgagaaggaaatcaacgccatctacatgatggcccactccggcgcccggggttcgcaagcccagatgaagcagctgggcggcatgcgcggcctgatggccaagccctccggcgagatcatcgagaccccgatcgtctcgaacttcaaggaaggcctgaccgttcaggagtacttcaactccacccacggcgcccgtaagggtctggccgacaccgcgctgaagaccgccaactcgggttacctgacccgtcgtctggtcgacgtcgcgcaggactgcatcatcgtcgaggaagactgcggcaccaccaagggcatcaccctgcgcgccgtggtcgagggcggtgacgtgctggtctcgctgggttcgcgcgtcctgggccgcttcacggccgaggacgtcaaggatccgggcaccggcgaactggtcgttccggccgacacctatatcgacgagaacatcgccgacgccatcgaggcggcggtcgttcaatcggtgaaggtccgctcggtcctgacctgcgaagccaagatcggcgtctgcggcgcctgctatggccgcgacctggcccgcggcaccccggtgaacatcggcgaagcggtcggcgtcatcgccgcccagtcgatcggtgagcccggcacgcagctgaccatgcgtacgttccacatcggcggcacggcccaggtggccgagcagtcgttcttcgaagcctcgaacgaaggtacggtccgcgtgatcggcccgacggtcgtgggttcggacggcgccctggtcatcatgagccgtaacacctcggtcagcgttctggtcgacggcaaggagcgtgaaacctataagccgccgtacggcgcccgcctgcgggtgaaggacggcgatctggtcaagcgcggccagcgcctcggcgattgggacccctacaccaccccgatcatcaccgaagtggccggcaagatccgcgccgaagacctggtcgatggcctgtcgatccgcgaggaagtcgacgaagccaccggcatcgcccagcgcgtggtcgccgactggcgcacctcggcccgcggttcggacctgcgtccggccatgggcgtgctgtcggaagacggttcgtacaagcgcctgagcaacggcggtgaagcccgctatctgctgtcggccggcgccattctctccgtcgccgacggcgacgaagtgaagccgggcgaagtgatcgcgcgtatcccgaccgaaggcgccaagacccgggacatcaccggtggtctgccgcgcgtcgccgaactgttcgaagcccgtcgtccgaaggactgcgccgtcatcgccgagatggatggccgtgtcgaattcggcaaggactacaagaacaagcgccgcatcaagatcacgccggacgtcgacgccgacggcaaccagcccgaggcggtcgagttcctgatcccgaagggcaagcacatcgccgtccacgacggcgactacatcaccaagggcgagtacatcatcgacggcaacccggatccgcacgacatcctgcgcatcctgggcgtcgaagccctggccaacttcctcgtcgacgagatccaggaggtctatcgtctgcagggcgtgccgatcaacgacaagcacatcgagacgatcgttcgtcagatgctgcagaaggtcgagatcctcgagcccggcgacaccggcctgatcaagggtgaccaccttgataagccggagttcgacaaggaacaggaaaaggcgatcgcccgcggcggccgtccggctgtgacccagccggtgctgctgggcatcaccaaggcctcgctgcagaccaagagcttcatctcggccgcgtcgttccaagaaacgacccgcgtcctgaccgaagcctcggtgcacggcaagaccgacaccctggaaggcctgaaggaaaacgtcatcgtgggtcgtctgatccccgccggtacgggttcctacctgcgcagcctgcaacgcgtcgccgccaagcgcgacgaacagctggcccagcagcgcgaagatgcgatggagccgctgccggccgagatcgcgctttcggacgccgaatag

SEQ ID NO: 40493 - DNA, 873 bp, Caulobacter crescentus
atgagcaccgatcaagacctcgacaccaagaaggccgccgcccgggcgtggttcgaaagcctgcgcgaccagatctgcgccgcgttcgagcagcttgaggacgaggcccccgccgacctctatcccggcgcaccgggccgctttgcaaagaaggcctgggatcgtcccgccggcggcggcggcgtgatgggcatgatgcatggccgcctgttcgagaaggtcggcgtgcacgtctcgacggtgttcgggaccttcacccccgagatggccaagaccatgcccggcgcggcggaagacccccggttcttcgccacggggatcagtctgatcgcccacatgaccaatccgcgcgtgccggccgtgcacatgaacacgcgcttcatcgccacgaccaagagctggttcggcggcggcggggatctcacccccctgctcggctaccagcgccagcaggacttcccggacgccatcgacttccacgccgcctacaagcgggcctgcgacaagtacgatccggaatggcaccccaagtacaaggcctggtgcgacgagtacttcttcctgccgcaccgcaacgagccgcgcggcatcggcggcatcttctatgaccaccatgacagcggcgactgggcgcgggatttcgccttcacccaggatgtcggccgcgccttcctggaaatctatccgaccctggtccgccgccgcatgggcgaggcctggaccgccgacgagcgcgagcagcagctgatccagcgcggccgctatgtcgagttcaacctgctctacgaccggggcacgatgttcggcctgaagaccggcggtaacgtggagtcgatcctcagctccatgccgccggcggtgaagtggccctag

SEQ ID NO: 40494 - DNA, 1176 bp, Caulobacter crescentus
atgagcgagattgtcatcgtttccgccgcccgcacgccggtaggctcgttcaatggggccttggccagcctgccggcttcggaactgggcaaggccgtcatcgaagccgccgtctcgcgcgcggggatcgcgccctccgacgtcgatgaagtgatcctgggccaggtgctgcaggccgccgccggtcagggtccggcgcgccaggcctcggtgaaggccggcatcccggtcgaggccccggcctggagcctgaaccagctgtgcggctcgggtctgcgcgccgtggccctggcggcccagcagattgccgacggctcggccaaggtggtggtcgccggcggccaggagagcatgagccaggcgccgcacgcccagaacctgcggggcggccagaagatgggcgacctgcagttcgtcgacaccatgatcaaggacggcctgtgggacgccttccacggttaccacatgggtcagaccgccgagaacatcgccagccgctggcagatcacgcgcgaagaccaggacaagttcgccgtcaccagccagaatcgcgccgaggccgcccagaaggccggcaagttcgatgacgagatcgttccgatcaccatcaagggccgcaagggcgacaccatcgtcgacaaggacgagttcatccgccacggcgcgacgatcgagagcgtccagggcctgaagccggtgttcaacaaggaaggctcggtcaccgccgccaacgcctcgggcctgaatgacggcgccgccgccctcgttttgatgagcgccgaggaagccgccaagcgcggcctcaagcccctggccaggatcgcctcgtgggccaatgccggcgtcgagcccgagatcatgggcaccggtccgatcccggcctcgaagaaggcgctggagaaggccggctggtcggtctccgacctcgacctggtggagagcaacgaagccttcgccgcccaggccctgtgcgtggtgcgcgagctgggcctggacccggccaaggtgaacgtcaacggcggcgccatcgccatcggtcacccgatcggcgcttcgggtgcgcgcattctgaccacgctggtccacgagatgaagcgctcgggcgccaagaagggcctggccacgctgtgcgtcggcggtggcatgggcgtggccatgtgcgtggaagcggtctga

SEQ ID NO: 40495 - DNA, 723 bp, Caulobacter crescentus
atgacgagagttgcgttcgtgaccggcggcacccgcggcatcggtcgagccatctgcgagcggctgatcgctgacggccacaaggtggcggcggggtattccggcaatgaagccgccgccgaggcctgcgccaaggagctgggcgtgatggtcgtgaagggcaatgtcggcgtgttcgaggactgccaggcagccgtgaagaaggtcgaggccgagctcggcccgatcgacatcctggtcaacaacgccggcatcacccgcgacggcatgctgcacaagatgacctatgagcagtggtccgaagtgatccgggtcaatatggactcggccttcaacatgacccgtccggtgatcgagggcatgcgagaccgcagctggggccgcatcatcaacatcagctccatcaatggccagaagggccagatgggccagaccaactattcggccgccaaggccggcctgatcggcttcaccaaggccctggccctggagaacgccaagaagggcgtcaccgtcaacgtgatctgccccggctatatcgacaccgagatggtggcggccgttcccgagaacgttctggcgcagatcgtcgccggcattccggtcggtcgcctgggccgcggcgaggaaatcgccgacatggtctcgttcctggcgggcgagcgcgcgggcttcgtgaccggcgccaccctgaccctgaacggtggccagtacatggcctaa

SEQ ID NO: 40496 - DNA, 1059 bp, Caulobacter crescentus
atgagccttcacgacatcgccgcccgcgctctccatgccttcgatcccgaggacgctcacggctgggccattcgagggctcaagtgggggcttggcccgcgtgatgcgcagccggacgatccgatcctggcggtcaagatcgccggcctggagctgcccaactgcgtgggcctggccgccggcttcgacaagaacgccgaggttcctgacgccatgctggccgccggcttcggctttgtggaggcgggcaccgtcacgccgctggcccaggccggcaatccgcgtccccgacttttccggctgaccgaggaccaggcggtgatcaaccgcatgggcttcaacaacggcggcctggagcccttcgcccagcgcctggccgcgcgtcagggccgcggcggtgtcgtcggcgccaatatcggggctaacaaggacgcgactgatcgcatccaggactatgtgaccggcctgacccgcctgtggggcctgtcggactatttcaccgccaacatctcctcgcccaacaccccgggcctgcgcgccctgcagaccaaggccgcgctggaagagcttctcggtcgtctggcggaaacccgcgcggcgctgaaggtcgcgtccggcgccgactatccgatcttcctgaaggtcgcccctgacctggaggacggcgaggtcgaggccatcgtcgagacggtggtcggcgcggggctcgacgccatcatcgtcagcaacaccaccatcgcccggcccgagacgctgaagtcgcgcttcgccggcgagagtggcggcctgtcgggcgcgccgctgctggaggcctcaaccgccgttctggcgcgcttccatgcggccgccgccggccgggtggcgctgatcggcgccggcggggtggccgacggggcgggcgcctacgccaagatccgcgcgggcgcgagggcggtgcagctctactcggcgctcgtctatggcgggccgggcctggtcacccggatcaagcgcgacctcgccgctcgtcttcgcgccgatggcttcgccgccgtcgaggacgcgatcggcgctgcatga

SEQ ID NO: 40497 - DNA, 2637 bp, Caulobacter crescentus
ttgcaaaagtggccttgccaaatggtattaaaatggaatgtagtgcgttccgccggttggacgctggcggaaagggggattcagatgtcagctttggtgctcacggcccccttgcagggctgggtctcggcgctggaggaggcgccggatgcggtgttcgccgagcgaatgctgggcgatgggctggcgattgatccgctgggctcgacgctgcacgcgccgtgcgacgggtcggtggtgagcgtgcaccgggcgcgccatgcggtgacgctgcgggcgacgaacggcgctgagatcctgatgcatgtgggcctggagaccgtggcgctgaacggcgagggctttgaggtctttgtcgaggaaggccagacggtgaaggcgggcgatcggctgatcggcttggaccttgacctcctggctcagcgcgcccgcagcctgatcacgccggtggtgatcaccaacggcgaggccttccagatcgtgcgccgcgaccaggaccgccagatcggcgtgggccagttcctgatggagctgtcgccgatcgcgggcgcatcgcgcgccgctgcgtccggagccgcagaccagatcacccgccagatcatcgtgcccctggcccacgggatccatgcccgcccggccgcgcggatcgcgcagatggccaagaccttcgcgtcggacctgaccctggcgaccggcccgcgccgggccaacgccaggagcccggtggggctgatgtccctggccatccgccatggcgacacgatccagctgctggcctcgggaccggacgcccaggcggcggtcacggccctggccgaactgatcgaaggcggcatgggcgagggcgcgccggtggccgccaagacctcctcgaccaagaccgccccgaccaagacagaaccctccgaaccgcccccgcccgcgccactgccgcgcgacggggtgctgaagggcgtgccggccgcgccgggcctggccatcggcaaggccgtgcggctgtcgaccgccgagatcgtcgtgcgcgaggccggcgagggcgtcgcccacgaggaagcggccctggccgtagccctggagacggtccgcgcccggatcggcaaggccgccgagaccggcgacaaggcccgcaaggcgatcctggcggcccaccaggcgttcctcgacgaccccgaactctacgccggcgcccatcgcctgatcgctgagggcaagagcgcaggctttgcctggcgccgggccgtgggcggctatgtccaggcgctgcaggcgctgggcgatcgccgcatggccgaacgggtcgatgacctgatcgacctggaacgccaggtcctgcgcgccctcagcggcgaggaagagacgggcgcggcgctggcgccgggctcgatcctgctggccgacgagctgttgccctcgcagctgatgggcgcagaccccgccgccctcgccggcttcgccaccgcgcggggcggacccacctcgcacgtggccatcctggccgcggccatgggcgtcccggccctggtggccgtcggcggggcgctgtcgaaggtcaaggacggggcgaccctgatcctggacgccgatgcgggaaccctgcgcgtggcccccgacgccaaggccctggaagccgcgcagacggcgctcgcccaacgccagcagcgcaaggccgccgccaaggccgccgcccacgagccggcggtgacgcgcgacggggtgcgtatcgaggtcttcgccaacaccggctcggtcgccgacgcccaggccgccgtggccaacggcgccgagggctcgggcctgttgcgcaccgagttcctgttcctggaccgcgagaccccgcccgacgaggacgagcaggcccgccagtaccaggccatcgccgaggccctggacggccggcccctgatcatccgaacgctggatgtcggcggcgacaaggccgcgccctacctgccgatcccggccgaggagaacccggcccttggcctgcgcggggtgcgggtcagcctgtggcggccgcatctgttgaaggcccagctgcgcgccatcctgcgggtcgagccgcggggccagtgcaagatcatggtcccgatggtggccagcctcgatgagctgcgcgcggtgcgcgcggtgctggaggaggccaagcgcgagcttgggatcaccgatcgcgtccagctgggggtgatgatcgagaccccggccgccgccgtcaccgccgacctgctggcggccgaggccgacttcctgtcgatcggcaccaatgacctgacccagtacgtgctggccatggaccggggtaaccccgaactggccgccggcatcgacgccctgcacccggcggtgctgcggatgatcgaccagacctgccagggcgcggccaggcatcatcgctgggtgggggtgtgcggcggcctggcctcggacctggacgccaccccgatcctgctgggccttggggtcgccgagctgtcgaccacggcctcgatcgcgccggacgttaaggcccgggtgcgggcgctgtcgctggaggcctgccgcgccctggcggcccaggccctggagcagacctcgccgcaggcggtccgcgcgctcgtgcaaggccagaccaacacccccctcggaggcttgaacccatga

SEQ ID NO: 40498 - DNA, 1584 bp, Caulobacter crescentus
atgttgcatttgcccccccatcgtcgccagttgctgggcggactgctggccctcggcgtgggcgcctcggcgtcccgcacgcacgccgcgcccacggaggcggtcgccaatgttcgcgacttcggagccaagggcgacggggtcaccatcgactctccggccatcgatcgcgccatcgcctacgccgccgagcgtggcgggggcacggtgctggtcccggcgggaacctatgcctgctacacgatccacctgaagagccggatcaggctctatctcgatcagggcgcgacgatcctggcggcctcgacgccgatcgaaggcatggaaagcggtggctatgaccacgccgagccgatggatcccgcctactcatcctatcaggatttcggtcacagccactggcgcaacagcctgatccatggcgagggcttgaacgacatcgtcatcgaagggcccggcctgatctggggcaagggtctggggcgcggccatgactatgacaaggacatgccgatctcgggcaagcccggcgtcggggacaagtcgatcgccctcaagaactgccgcaacgtcctgttgcgcgacttcaaggtgctgcagggcgggtggttcgcgctgttggccaccggcgtcgataacctgaccatcgacaatcttctgatcgacaccaatcgagacggcctcgacatcgactgctgccggaacgtgcgcatcacccgctgtaccatcaactcgccctgggacgatgcgatctgcccgaagagttcctacgcgctgggctatccgcgcgttactgagaacctcacgatttcggattgctacgtggctggtcgctatcggatcggatccgtgctcgacggcacctggcaggtcttcatgcccgccccgaaggggacgcatggccgcatcaagctcggcaccgagtccaatgggggcttcaagaacttcaccatcaccaactgcgtgttcgacaaatgtcgaggcatcgcgcttgagaccgtcgacggcggcgcgcttgaagacatcaccatcaccaacattacgatgcatggcgggaccacggccccgatcttcatgcgtctgggcaagcgcatgcgtggccccgaggggcggcccatcggtacgctgaagcgcatcctgatcagcaacatcacctcttcagccggtgaccggatgccttcgatcatcgcgggtctcaatgggcacccggtcgaggacatcaagatcagccagtgttttcttgagcaagtcggcggcggcgatgcggccatggccgccttgcgcccgcccgagaacgaggctggttatccagagccgaacatgttcggcgacctccccgcgacgggattcttcgtgcgccacgcccgcaacgtcgagctcgacgggatcgaggtgcgcaccctgacgccggacgcgcgcccggccgtgtggatgcagaatgtggacggcgcgcgcctgtcgcgactgcaactgccgcccagcaagtccagcttccacttggagggagtccgcgatttcgaactccgcacaagctcgccggttcgggacaagcgcgtgcctcatactaagttgatgacgttttag

SEQ ID NO: 40499 - DNA, 1419 bp, Caulobacter crescentus
atgtccgcttctaggctcatctctcgtgacccctatacgggcgaggcgatcgcggatttcgctgtgaacgatgcgcgcagcatcgacgcggcttgccatagtgctcgcgccgcgttcgcggaatgggcgatgacgccgctggccgagcgccgcgcgatcgccctgcgcttcgccgagaccgtccgcgcacgccgggaggagatcgccaccctgatcgcccgcgagaccggcaagccgatgtgggaggcgcttaccgaggccgacagcgtcgcggccaaggtcgccatctcgatccgcgcccaggacgagcgcgcgggcgagcggtccgagccgatggccgacgctactgcgcggctggcgcaccggcctcacggcgtcctggctgtgatcggcccgttcaatttccccatgcacctggccaatggccacatcgttccggccctgttggcgggtaacgccgtggtgttcaagcccagcgaaaagacgcccgcctgcggccagttgatgggcgaactctggcgcgcggcgggactgccggaccacgtcctgaccatcgtgatcggtggcggcgaggcgggcgaggcgctggttcggcacgaggcgctggacggcgttctgttcaccggcggagtccaggccgggcgcgccatccatcgggcgctggctgacgccccgcacaagattctggcgttggagctgggcggcaacgcgcccctggtcgtctgggacgtcgcggacattgaagcggcggcgcacctgatcgtccagtccgcctatgtgaccgccggccagcgctgcacctgcgcgcggcggctgattctgcccgagggcgcacgcggcgatgcgctgctggaggcgctgacgatgctgatggaccgcttggtgatcggcggccccttccaatcgcccgcgcccttcatgggcccggtgatcgacgcgcacgcggcggctcaggttctggcggcccaggaccggatgaccgccgacggcgggcgaccgttgcggctggccgcggtccgcgaagcgcgctcggctctactctcgcctggcctgatcgagctcaccgacgcgccgctacgcgacgaggagatcttcggaccgctgcttcaggttcgccgcgcggcggatttcgacgccgccctggccctggccaacgccacaagatttggtctcgccgccggtctcatcagcgatgacgaggcgctctaccggcgcttctggaccagcgtgcgcgccgggatcgtcaactggaaccgccccacaaccggcgcctcgtcggccgcgcccttcggcggggttggcgggtctggcaaccaccgccccagcgcttattacgccgccgactacagcgcctatcccgtcgccgggctggaaagccccagccccgtctaccgtctgccgatcggcctgaacccatga

SEQ ID NO: 40500 - DNA, 1179 bp, Caulobacter crescentus
gtgtccgccctgatgaacacctatgcgcgcgccaacatcgacatcgtccgcggcgaaggctgctggctctacgaccaggacggccgcgactacctggatctcgccgccggcgtggcggtcaacaccctgggtcacggcgatccgcgtctggtccaggcgctgaagacacaggccgacatcctgtggcacgcctccaacctctaccggctgccggcccaggaagccctggccaccaagctgaccgacgcgaccttcgccgaccgcgtgttcttcgctaactccggcgccgaggcggtcgaggccgccatcaagaccgcgcggcgctggcaaggcgcgaagggccgccctgagcgttaccgtgtgctgaccttcggcaacgccttccatggccgcaccctggcgaccatctcggccaccgatcagatgaaggttcgggaaggctttacgccgctctacgacgccttcgacaccactccgttcaacgatatcgagggcgcagcgcgcgcgatcaccccacagaccgccgcgattctggtcgaaccgatccagggcgaaggcggcctaacgccggcgactcccgggttcctggccggccttcgcgccctgtgcgaccagcatgacctgctgctgatccttgacgaggtgcagaccggcatcggtcgcacgggccacctgttcgcccatgagctctatggcgtgcggcccgatatcatcgctgtggccaaggggctgggcggcggctttccaatcggcgcttgccttgcgaccgaggacgccgccagcggcatgacgcctgggtcacacggcagcacctacggcggcaatccactggcctgcgctgtcgcctcggcggtgctggacgcggtgctggcgcctggctttctggagactgttcgtgaacgggcggcgcttgtggacgctctgctagagcgcctcttgcgtcgacacagcgacctgttcgtccgagctcagggccatggtctgatgcgaggacttcaggttcgtgcgtcggcgcgggacgtcgtcgcgcacttgcgagactttggcgtcatgaccgttgcggcgggcgccgatgtcgtgcgcctcctgccgccgctgacgatcagcgaactggagatcgccgaagccgaagcccgactgctgcgcgctgcggaagcttggttgcctatcgctgcgtga

SEQ ID NO: 40501 - DNA, 2679 bp, Caulobacter crescentus
atggccgacggctccgccgctctgaccgccacccgcacggcctgcccctattgcggggtcggctgcggcgtgatcggcgcgacggcggccggggcgcgcgcggtggcgatctccggcgacgaggctcaccccgccaatcacggccgactgtgctcgaaggggacggctctgggcgcgacggtgtcgctggcgggaaggctgctggagccgacgattcaggggcgcagcgccagctgggacgaggcgacggccctggtcgcccggcgctttcgcgaaacgatcgcccggcacggtcccgacagcgtggccttctatgtgtccggccaactcctgaccgaggactactacgtcgccaacaagctgatgaagggcttcatcggctcgggcaatatcgacaccaacagccgtctctgcatggcctcggcggtggtcgctcacaagcaggcgtttggggccgacctcgtgcccggctgctacgaggacctcgatctggccaatctggtggtgttcagcggccacaacgccgcctggacccatccggtgctgttccggcggatggaagcggccaaggcgcgcggacaaaagcatgtggtcatcgacccgcgccgcacagacaccgccgagggcgcagatctgcatctggccctggccccgcagagcgacgtccggctctggaacgggctgctggccgatctgatccgacgcggcgcggtcgacatggattttctgcgcgaccacgtcgacggctatgcggcggtgatcacgtccctcgctgaggacgaccagtcgccggcggccgtggcggcggactgcggcctagcccttgcggacctgcagaccttcttcgatctcttcgccgcccatccgcgcacggtcagcctgttctcgatgggcgccaaccagtcggcccaaggcgtcgccaagggtctggccatcatcaacgcccacctcgcaacggggcggatcggcaagcccggcgcctgtccgttctcgatcaccggccagcccaacgccatgggcggtcgcgagaccggcggcatggccaacaccctggcagggcacatggacttctccccggaggagcgcgaccgcgtcgcgcgcttctggggcgcgccgaacacggcccgcgcgccgggtctgaaagccatcgacatgttcgaggcggtccgtgacggccggatcaaggccctgtgggtgatggccaccaacccggcggtcagcctgccggccagcggcgctgtgcgcgaagcgctggagcgttgcccgttcgtggtggtctccgactgcgtcgagaccgacaccacggccttcgccgacgtgaagctgccggccctggcctggggcgagaaggacgggacggtcaccaactccgagcggcggatctcgcgccagcggacgctgttcccgccgcccggccaagcccgcgccgattggcggatcatcgccgaggtcgcccgggccatgggtttcgacggctttggttggccgcacgcggcgagcgtgttccgggagtgggcccgtctgacggcctatgagaacaagggtcgcttgctcaatctggagggcctaacccggctggaccctcaggcctatgacgcgctggagcccgtccagtggccggtcgataccgaggggcggggcagggcgcgtctgttcgaggacggccgcttccaaaccgccaatggccgcgcccgtctggttccggtgcggcctcgcggaccggccgaggcgaccagcgacaaattcccgatggcgctgaacaccggccgtatccgcgaccagtggcacaccatgacccgcacgggtcttgcgcccgacctgtgtcgccacgcgcccgagccctatgtcgaagtccaccccgacgacgccagggcggtcgggctgaccgaaggcgctctggcccgggtgatgaccacccgcgccgaggcggtggccgtggccaagctcagcgatcggcagcggcggggctcactgttcatgccgatgcattggacagacgctttcgcgccggccgggcgcgccaacgccctggtcgcgccgatgacggatccgagctccgggcagcctgagttcaagcacacgccggctcggatcggcgcctatcgcgaaacctggagggggttcttcctggcgcgcgaaccggcgctgatcgtcgatcccggcctcgtctggcgacgcattccgcgagacgcctgtcatcaacacgagttcgccgggcgcggggatcgcgcccagcgcgcgaccttgcgcaagcgcctggtccgggcgctgacgggcgagatcgtcgcctacgaagacgccgccacgggcgcgctgcgtgaggcttggatccgcgacgataggctggtcgctgttctctacatgactgaggcgggccgcttgccgccgcgcgactggctggctgatctctttgccgcgccgctgacgccggaaacgcgcgcaaccttgctgcatggcttcccgcccggagcgccggtcgacaaggggccgatggtctgcgcctgcctcaaggtcggcggcaaggcgatcgaggccgccatcatcggcggggcttcgacggccgacgccgtcggcgcggcgaccggagcgggcacgaactgcggttcctgccgcccagagatcagccgcatgatccgcgccttcaccgacgccaaacaggagaccgccgatgtcctctag

SEQ ID NO: 40502 - DNA, 1263 bp, Caulobacter crescentus
gtgcggcatttgaagtccatctatgtgcaggtgctgatcgcgatcgtcctgggggtgctggtcggggcgatatggccgcagatcggggtggcgctgaagccgctgggcgacgggttcatcaagctgatcaagctggtcatcgcgccggtgatcttctgcaccgtggccggcggcatcgcgcgcatgggcgacatgaaggcgttcggccgggtgggcgtgaaggcgctgatctatttcgaggtggtctcgaccctggccctggtgattggcctggtcgtcggccgcctgatccagccgggcgccggcttcaacatcgatccggccacgctcgatgcgtcgatcgccgccggctacgtcgaaaaggcccagcacggcgagggcatggtcgcctatctgctgcacctgatccccgacaccttcatcggcgccttcgccgacggcaacctgctgcaggtgctggtgatcgcgatcctgaccgggtttgcctgcgtgcggatgggcgacttcggcgagaaggtcgcccatgtgctggacgagacgtccaagctgttcttcgggatcatccatatcgtcgtgcgcctggccccgatcggcgcgttcggggccatgggcttcaccatcggcaagtacggggtcgaggcgctggtgcagctgggcgcgctggtggcgaccttctatgtcacctcgctgctgttcgtgctggtggtgctgggggggatcgcctgggtcagcgggttctcgatcttccggttcctggcctatatccgcgaggagctcctgatcgtgctgggcaccagctcctcggagtcggtgctgccgcaaatgatggagaagctggagaacgccggggcccgtcgctcggtggtcgggctggtgatccccacgggctacagcttcaacctcgatggcaccaacatctacatgaccctggccacgctgttcctggcccaggcgacgaacaccccgctgtcgctgggccaggagctggcgctgctgggcgtggcgatgctgacctcgaagggcgcttcgggcgtgacgggggcgggcttcatcaccctggcggcgaccctggccgtcgtgcccgacattccgatcgccgcgctcgccatcctggtgggcgtcgaccggttcatgagcgagtgccgggcgctgaccaacctggtcggcaacggcgtcgccaccctggtggtggcgcgctgggaaggggcgctggaccgacagcggctggatcgggttctgcgcggggcgcctgcgaccgagtga

SEQ ID NO: 40503 - DNA, 738 bp, Caulobacter crescentus
atggcggcgagcaagggcgcatgtctggtggtgggcgtgggcgacggggtgggaagcgccatcgccaaggccttcgcggcgcagggctatacggtctgcatgacccgccggccccggcatctggaccagctggaggccctggcggccgagatccgcagcacgggtcaggacgcccgcgccttcggcgtcgacgcccgccaggaggccgacatgatcgccctggtcgaccgcatcgaggccgagatcggtccgctggagatcgtggtcttcaacatcggcgcgaacgtgcgctttgacctcaccgaaaccaccgcccaggtgttcagcaaggtctgggagatggcctgtttcgccggcttcctggccgcccgcgaggcggcccgcgtcatggtcccgcgcggccggggcaccatcctgttcaccggggccagcgcctcactgcgcggcaaggagggcttttccgccttcgcctcggccaaggcgggcctgcgggccgtggcccagagcgcggcgcgggagctgggccccaagggcatccacgtcgccaatgtggtggtcgacggcgccatcgacggggtcttcatccgctccatgcggggcgaggtcggcgacctcctggagcaggacctgatcctcaagcccgccgatatcgcgctaaactatgtccacctgcacaaccagccgcgctcggcctggacgcacgagcttgacctgcgtccctggtccgagagctggtga

SEQ ID NO: 40504 - DNA, 2181 bp, Caulobacter crescentus
atggttgctcgatcccctctacgcggtcggacgccgttgatggacattcccgctgagttgaacttcgcccgccggcgccggttgccggtcattgtgggggcggaggccgccgaatgcggcctggcctgcatggccatggtcgcgcgctaccacggccatgacgtcgatctgaacggtctgcgccagcggttcaccctgtcgatgtcgggggcgaccctgcgcagcatcatggggttcgccgaccatctgggcttcgcgccgcgcgccttgaaggtcgagctttcggcgttggataaggtccggctgcccgccatcctgcactgggacctgaaccacttcgtggtcttgaagtctgttcagggcggtcgcgcggtggtgcatgatccggcgctgggcgcgcggacctatagtctggacgagctctccaagcatttcaccggcgtggcgcttgagctcacgccctcgggacgtttcgagaagatcaccgctcgcgcgccgatcaagctgaccagtctctggtcgaggatgatcggcttctggccggccttcttccagatcctgggtctgtcgctggcgctgcaggtggccgtgttcgccatgccgttccagatgcagctggtggtggacgaggcgatcttccgggctgaccgagacctactgacggtgctggccctcggattcggcgccctggtgatcatccagtctgcgatcgaagccctgcgcgcctgggcgctgcaggtgttcgggcagatgctgagcttccagatcgtcggcaatctggttcggcacatgatgcggctgcccagcgactggtacgagaagcgccatgtcggcgacatcctgtcccggatcggctcggcctcggccattcaggacgtgctgactcgcggcgtgatcgcggccatcatcgatgggctgatggcggtcgtggcgatcatcatcctgctcctctatgcgccgaccctggccgccgtcgtggtcggcgcggtcgcgctcaatcttggactggcgctggcgctctttccggcgatgcgcgcgcgcaccgaggagcagatcctggaaagcgcccgcgagcagtcccacgtcatggagaccgtgcgcgcggcgaccacgatcaagctcatggggcgcgaggccgaacgggagagttcgtggcgtaacctctacgccaacgccatcaacgctgcggtctcggtgggcaagttccaaatctcgctgagcttcacccaggccctgatcaccgggcttcaaaccgtgatcgtgatctatctcggggccaggacgatcctggccggggatggcttctcggtcggcatgctgttcgctttcctgtcgttccgccaaaccttcaccgatcgcgccaacgccctgatcaaccagttcatccagttcaagttcttgaacctgcacctagagcgtctggctgatatcgtcaccgcagagaccgaagccgccgacaccgccgcgcctcggcttgaggttgctggcgccctgcagctgaaggacgtctccttccgctacggcgcggcggaccgtcccgtcctgcagggagtggacctggaggtcgcgccgggcgagttcctggccatcactggggcgtctggcggcggaaagaccacgcttctcaagctgatgctgggcctgcgcgcgcccaccgaagggacgatcaccctcgacggtcaaccggcgtcgcctcagctctggcgcgcctggcgcgaacaggtcggcgtcgtcgctcaggatgatcgacttctgtccgggaccatcgccgacaatatcgccttctttgatcccgatctcgacatggagcgggttcagcacgccgccatggcggctcaggtccacgacgatatcgcgcgcatgcccatgcagtacctgtccctggtcggcgatatgggctcgacgctttccggcggacaaaagcagcgggttctgctggcgcgcgcgctctaccgccggccgcgcatcctggtgctcgacgagggcacggccaacctcgatgtgcagaccgaggagttgatcgccgacctgatcgctcagctgccgatcacgcggatcgttgtggcccaccgcccggcgctattgaagcgggccagccggattcttgtggtcgagggcggcgtgctgtccaccacctgcagcgagctttcgagggccgagcctaagcgcgcggtcttctaa

SEQ ID NO: 40505 - DNA, 291 bp, Caulobacter crescentus
atgaagtttcgtcccctgggcgaccgcgtcctcgtgaagcgcgtcgaagaagaaaccaagaccaagggcgggatcatcatccccgacaccgccaaggaaaagccgcaagaaggcgaagtcgtcgcggtcggccccggcgcccgcaacgacaagggcgacgtcgtcgccctggacgtcaaggccggcgaccgcatcctgttcggcaagtggtcgggcaccgaagtgaaggtcgacggtcaggacctcctgatcatgaaggaaagcgacgtcctgggcgtggtcgaagcctaa

SEQ ID NO: 40506 - DNA, 1308 bp, Caulobacter crescentus
atggacttcgacatttcccccaagcaacgcgcgttcctggatcgcgtcacggcgttcatggacgagcacgtctatccggcgatcccggcctatgaggccgagatgaacgtcctgggcgccgagcgctggaaggtcgttcaggtcgtcgaagacctgaagaagaaggccaaggccgcgggcctgtggaacttcttcatgccgccgcacagcggtcagacccatgtggacgacaccttccagttcgaaggcgtgcagctgaccaacctggaatacagcctgatcgccgaacagctgggcaaggtcggcttcgcctcggaagtgttcaactgctcggcgcccgacaccggcaacatggaagtgctgatgcgctacggcacgctggcgcagaaggaaaagtggctgcgcccgctgatgaacggcgagatccgttcggccttcctgatgaccgagccggcggtggccagctcggacgccaccaatatcgagacccgcatcgagcgcgacggcgaccactatgtgatcaacggccgcaagtggtggtcctcgggcgtgggcgatccgcgctgcaaggtcgccatcgtcatgggcaagaccgatcccgacaacgccagccgccacgcccagcagagccaggtgctggtgccgctggattcgcccggcatcgagatcgtccgcatgctgccggtgttcggctatgacgacgccccgcacggccacgccgaggtcatcctcaagaacgtgcgcgtgccgattgaggacgccctgctgctgggcgaaggccgcggcttcgagatcgcccaggggcgcctcggccccggccgcatccaccactgcatgcgcaccatcggcacggcggaagtcgcgctggaaaagatgtgccagcgcctgatgagccgtaaggccttcggcaagtacgtctcggaccactcggtgtgggaagagcgcgtcgccgacgcccgcatcgacatcgaaatgtgccgcctgctgtgcctgaaggccgccgacatgatggacaaggccggcaacaagtcggcccgtctggagatcgccatgatcaaggtcgcggccccgcgcctggccctcaagatcatcgacgacgccatccaggcccacggcggcggcggcgtgaccaccgactttggcctggccaaggcctatgccggcatccgcaccctgcgcctggccgacggcccggacgaggtgcaccagcgcacgatcgcccgcatggaatacggcaagtacggcgacctgatgtacaagcagaaggccgagaaggaagccgccctgcacgtgccggggatccggtag

SEQ ID NO: 40507 - DNA, 1914 bp, Caulobacter crescentus
atgcccatccgccgcctgccgcccgagaccgtcaaccgcatcgccgccggcgaagtggtcgaacggcccgcaagcgccatcaaggagctggtcgacaacgccatcgacgccggcgccacgcggatcgaggtcgaggcgcacggcggcggcctgacgcggattctcgtggccgacgacggctgcggcctgtcgcccgaggaactgccggtcgccatcgagcgccacgccacctccaagctggcgcccgacgccgacggcctgtgggacttgctgcgcatccacaccatgggcttccggggcgaggccctgccctcgatcggctcggtggcgcggctgcagatttcctcgcgcgccaagggggccaaggacgccttctcgatcctggtcgagggcggtcaggtcggcgaggtggcgccggccgccttccccggcccgcacggcgcgcggatcgaggtgcgggatctgttctacgccacgcccgcccgcctgaaattcatgaagtccgagcgcgccgaggcgctcgcgatcactgaggagatcaagcgccaggccatggccaatgagagcgtcggcttctcgctggacatcgacggccgccgggtgctgcgcctgccgcccgagcatccggggccgcaggggcgtctggcgcgtctggccgccgtgctgggccgcgagttccaggagaacgccctggagatcgaccagacccgcgacggcgtgcggctgtcgggctttgcgggcctgccgacctataaccggggcaacgccgcccaccagtatctgttcgtcaacggacgaccggtgcgcgaccggctgctgcaaggcgccctgcgcgcggcctatgccgactttctggcccgcgaccgccacccgacggcggcgctctatgtgacgctggagaccaccgaagtggacgtcaacgtccacccggccaaggccgaggtgcggttccgcgatccggccctggtgcgcggtctcatcgtcggcgccctgcgccacgctctcgccggcgccgggcaccgcgcctcgaccaccgtggcggcccaggcgctggacagcatccgcgcccagcagagcccgttcccgggctatcagccccagtatcagccgggcccctcccccgccggcttctcggcctggcgcgagggcggctggacgccgccgacgcagaggccgatggacttgccggggctgaacgaggtgtcggcgcgggtcgagcccagctatggcggcgatctggccggggtggtgcgagaggcctatgcggcggcggctttcgaggatcgtccgcccacggactaccctggcgcaaccgccccgttcgatccggtcgactaccccctcggcgcggcgcgggcccaggtgcacgagacctatatcgtcgcccagacccgcgacggcatggtcattgtcgaccagcacgcggcccatgagcgcctcgtctatgagcggatgaagggcgagatggcgtccggcggcgtgacccgccagaccctgctgctgcccgaggtggtggacctggaccccgccgaggccgaacgcgtggtcgcccgcgccgaggagctggccggccttggccttgtcctcgaaagctttggacccggcgcggtgctggtgcgcgagacgccggccctgctgggcaagaccgacgccgccgccctggtgcgcgacatcgccgatgatctggccgagaacggccaggccctggcgctgaaggagcgcctggaggaggtctgctcgaccatggcctgccacggcagcgtccgcgccggccgcaggctcaacggcgccgagatgaacgccctgctgcgcgagatggaagccacgccccactcgggccagtgcaaccacggccggccgacctatgtcgagctgaagctggcggatatcgagaagctgttcgggcggcggtga

SEQ ID NO: 40508 - DNA, 879 bp, Caulobacter crescentus
atgagtgaaatcaagacggtcggcgtgatcggcgccggccagatggggtcgggcatcgcgcatgtcgtcgccctgggcggctatgacgtacggcttcacgacgtttcgcgcgagcggatcgacgccggcatcgccgtgatcgagaagaacatggcccgccaggtcggccgtgggatcatcgatgacgcggccatgaaggcggccctggcccgcatccagcccgccgagggcctggaggcgatcggcgccaccgacctcgccatcgaggcggccaccgagaacgaggaggtcaagaagtcgatcttccgcagcctgcagccgtacctgaagcccgagacgctgctggcctcgaacacctcgtcgatctcgatcacgcgcctggcgtcggccaccgaccgccccgagcgcttcatcggcctgcacttcatgaaccccgtgccgctgatgaagctggtggagatcatccgcggcatcgccacggacgtcccgacctacgagcgcgccgtgaccttcgcccagtcgctgggcaagatcaccagcaacgccgaggacttccccgccttcatcgtcaaccgcgtgctggtgccgatgatcaacgaggcgatctacaccctgtacgaaggggtcggcacggtcgacgccatcgacacggcgatgaagctgggcgccaaccacccgatgggcccgctggagctgggcgacttcatcggtctggacaccgtgctcagcatcatgaacgtgctgcacgagggtctggccgacagcaaataccgcccctgcccgctgctggtgaaatatgtcgaggccggctggcttggcaaaaagaccggacgcgggttctatgactaccggggcgagacgccggttcccacgcgctaa

SEQ ID NO: 40509 - DNA, 1776 bp, Caulobacter crescentus
ttgcgtccctttgcaacctgcaaaggcgcagctaggactcgatccctagtctcgtttcccaggacatcggccgccttgcccagattcgccgaatggctggaccaggacgtcacctcggtgacggcgcgcagcctgccgaccctgggcgtgcgtctggcgatctgtgcggcgaccgcgctgatctacgccctggcggtcgatctgcagggcggcctgctctggggcctggccgtggccagcgccgaggcggcggtgttcatctgcagcagtccccagcgcgccgaccgcaagatcagccacgcccagcgtctctcctatgtggccgccgtcgcctggatgaacatcgtctggtggtcgctggcgatcatgctgtggcgccaggaccaccctgccctgcggatggcggccctgtgcgtggtctgcgcctttctggtgcatgcgcaagccttcacggcccggtccaagaccctgttgctgatcgtcggcggcggcagcgcgacgttgctgctggtgttgtgcggggtgctgaacgactttccgccgagcgagcgtctggcgctgtgcgcggcggcgatcatcctgatcatctatacggccaaggccgcccagaccaacggccagcagggccgcgccctggagctggccaagagccaggccgaggccgccagccaggccaagtccgagttcctggccctgatgagccacgaactgcgcacgccgctgaacggcatgctgggcctgtcgcaggccctgaagctggagccgctggagccgggcgagcgcgaacaggtcgaactgctggaagagtcgggccgcaccctcctggccctgctcaacgacgtgctcgacatggccaagatcgaggcgggcaagctcgatatcgcccccacccaggaggacctctcgcggctggccgaacgggtggtgcggatcaaccaggcccaggcgcgcgagaagggtacggagatcacgctggagatcgacccggccacgccgcgcgccctactgttcgatccgctgcgggtgcgccagtgcctggggaatctggtttccaacgccgtgaagttcacccccgccggccagatccgggtgcgggtgacctgcgaggccggcgaccagcctgaccggatgctggccaagatcatcgtctccgacacgggcgtgggcatgggccccgccgtcctggccaggatcttcaccccgttcgagcaggccgatccgaccatcgcccgccgcacgggcgggacgggccttggcctcaacatcacccggcgcctggcgcagatgatgggcggctcggtcagcgtgcgcagcaccgagggcaagggctcgaccttcaccctgaccttcggctgcaggctgccgagcgccggcgccgcagagaccggcggaccgctcagcggcgaacaccccctgcgcctgctggtcgtcgacgactatgcggtgaaccgcaaggtcatcgccatgatgctggccccgctgggctgcgagatcgtcgaggccgacaatggccagcgcgccctcgacctgctggccgagcgcgaggtcgacgccgtgctgctggacttcaacatgccggtgatgggcgggctggagaccacccgtcgcctgcgcgccgatccgcgctggcgcaagctgcccatcgtctgcctgaccgccggcgtcatggacgacgaacgcgccgccgccgcgacggcgggcatggacggcttcatcgagaagccgatcgagatgtcgaccctggtctcgaccctcgcccgcgtcgctcgacgttga

SEQ ID NO: 40510 - DNA, 1173 bp, Caulobacter crescentus
atgggcgaagcctatatcgtggcggccgcgcgcacggccggcggacgcaagggcggacgggtctcgggctggcatccggccgatctggcgggcgaggtgctgaacgccctggtcgaccgcagcggcgccgatccggccctgatcgaggacgtgatcatgggctgcgtgggccaggtgggcgagcaggccatcaacatcgcccgcaacgcggtgctggcctccaagctgcccgagagcgtgcccgccacctcggtcgaccgtcagtgcggctcgtcccagcagtcgatccacttcgccgccgccaccgtgatgtcgggcgcgatggacatcgtcatcgccgccggcgtcgagagcatgagccgcgtgccgatgggcctgtcgtcggccctgccctacaagaacggttttggaacctacaagagcccccgcatggaggagcgctatccggggatccagttcagccagttcgccggcgccgagatgctggccaagaagtacgacctgtcgcgcgagcagctggacgccttcgctctggccagccaccagcgcgccatggccgcgaccaagggcggcaagttcgccgccgagatcgtgccgattaaggtgaccctgcccgacggctcggttgagacccacgacgccgacgagggcatccgctgggacgccacgatggagtcgatcggcggcgtgaagctgctcagcgaagacggccgcctgaccgccgccacctccagccagatctgcgacggcgcggcgggcgtgatgatcgtcaacgagcggggtctgaaggccctcggcgtcgcgccgctggcccgcatccaccacatgaccgtcatcggccatgacccggtgatcatgctggaggccccgatcccggccacccagaaggcgctggagcgggccggcatgaagatcgacgacatcgacctctacgaggtcaacgaggccttcgcctcggtgccgaccgcctggctgcaggtgaccggcggcgatccggacaagctgaacgtcaacggcggcgccatcgccctcggccacccgctagggggttcaggcgccaagctgatgacgacgctggtccacgccctgaaggaccgcggcgcgcgctatggcctgcagaccatgtgcgaaggcggcggcctggcgaacgtgacgatcgtcgagcggctttga

SEQ ID NO: 40511 - DNA, 2952 bp, Caulobacter crescentus
gtgggtcttcgaccgcctgtggaacggcgaccagaccgattacggcctcaacttcaccggcggctcgcagatcctgcgggtcaagctcgccacctactgacgggaacagccatgcgtattcttgccctctccgccttcgggctggccctcctggcctcgacctcggccctggccctggacgggggctttgagaaaaccgccgacggcgtggtcatcacgcccgccaatggcccggccaagaaggtccgtctgcaggtgatgagcgaccgggccatccgcgtcaccgcctcgccgaccgacacgatcagcgtcccgcccagcctgcaggtgatcgcggcccccaagaccagcggcttcaccgtcgagcaggtcggcggcaaggtcgtgctgaaggccggcaaggccacggccgaggtgaccttggccaccggcgcggtgtcgttcaaggacgcggccggcaagaccgttctgaccgagcagtcgcgcgcgaacttcaagccgctgaccctcgacggcaagggcttctacgccgtcagccagcgctttaatccgaatacggatgaaggcttttatggcctgggtcagcaccagaacggccagatgaactacaacggccaggacgtcgagctggcccagtataaccgcgccatcgcgctgccgttcgtgctgtccacccgcaactacggcctgctgtgggacaataacggcatcacccgcttcggcgaccccacgccctacgccctggcctcgcgcgacctgaagatcttcgacgccagcggcaagccgggcggcttcaccgccaagtactacatcaacggcgagctgaagctgacccgcgtcgagcaggacatcgactaccagtatctggaggacctgcccaagtggccggcggagctgaccgggcccgacaagaagccgctgcgcggcgccaaggtcgtgtgggaaggttcggtcgagggccaggtcggcggccagcagaagttccagctgtactcgtccagctacgccaagctgtggatcgacggccaactgaagatcgaccgttggcgccagaactggaacccgtggttccacaacttcaccgcgccgatgaaggcgggaagccgccacaaggtgaaggtcgagtgggagcccaacgacggctatatcgcccttctgcacaacaacccgatcccggcggccgagcagaagtcgctgaccctgacctcggacgtcgcccacgcggtcgactactatttcgtggccggcgagaacctggatcaggtgatcagcggctatcgcgacctgaccggcaaggcccaggccatgccgcgctgggcctatggcttctggcagagccgccagcgctacgagacgcaggaccagctggtcggcgtcgtcaaggagtaccgcaagcgcaacgtgccgctcgacaacatcgtgctcgactggcgctactggaaagacgacagctggggcactcacaagttcgacgagacccgcttccccgacccgaagaagatgctgcaggacgttcatggcatgaacgcccgcttcatgatctcgatctggccgaagttctatccgaccaccgacaacttcaaggagctcgacgccaagggcttcatgtacaagcgcaatatcgagcagggcgctctggactgggtggggccgggttatctgaactcgttctacgacccgtacgccaaggaagcgcgggacatctactggcgtcaggtcaaggacaacctgaagggcctgggcgtcgacgcctggtggatggacgccgacgagcctgacctgcactccaacgtcgatgtcgccgagcgcaccctgcgcatgggaccgaccgcgatgggcccgggcgcggagttcttcaattcctacccgctggtccacacgaccggcgtgttcgagggcgagcgcgagctggatccgaacaagcgcagcttcatcctgtcgcgctcgggcttcggcggcatccagcgcaacggcgtggcgctgtggagcggcgacgtggtggcgcgctgggatgacttccgcgaccagatctcggccggggtgaacctgtccatgtcgggcgtgcccaactggaccaccgacatcggcggcttctcggtcgaggatcgctacctgcgcaaggaggcccagcactggcccgaatggcaggagctgaacctgcgctggttccagttcggcgccttcagcccgctgttccgcagccacggcgaagagccgttccgcgagatctggaacctcgccgacgaagggacgccggtctacgagtcgctcgtctggtacaacaagctccgctaccggctgatgccctacaccttgaccctggcgggcgagacctatcaccgcgacggcagcatgatgcgcggcctggtgatggatttccctaacgacctgaaggtccgcaacatcgacgaccagtacctgtacggtcccgcgttcctggtggccccggtcacccagttcaaggcccgttcgcgcgcggtctatctgccggccggaaccacctggtacgacttcgagaccggcaaggcccatgcgggcggccagacgatccaggccgccgcgccgctgaaccgcatgccgctgttcgtgaaggccggcgcgatcgtgccgaccactgaggtccaacagtatgtcggcgagaagcccaacctgccgatcaccctggtgatctatgcgggccaggacggcaagtacgagctctatgaggatgacggcctgtcgacggcctatcagcgcggggcctacagccgcatcccgatcagctatgacgacgctacgggccgagtcgtgatcggcgcgcggtcgggcaagttcgacggcatgcaggacaagcgcatcttcaagatccgctttatcggtggcggcgccaagccgaccgacttcgacgcggcgggcgacgctacggtggcctacgaggggcaaccggtggtggtcgtggcgcggaagcactga

SEQ ID NO: 40512 - DNA, 1548 bp, Caulobacter crescentus
atgggcttcacggccgaggcgcgctcgccggtggtggcgaccaccaacggcaaggtgcgcggctatctcgacggcgaggtcagcgtcttcaagggcctgcgctatggggccgacacgggcggcgcgcggcggttcatgccgccggtcaaacccgagccctggaccgaggtgaaggacgccctggcctatggtccggcctcgatgcagaccggcaagggcgaggagggcgagaccctctccgaggactgcctgttcctcaatgtctggaccccggccagggcctcgcggaagaccggcctggctgacggggccaagcggccggtgatgttttacatccacggcggcgcctataacggcgggtcgggggccagcccctggtacgaggggaccaagctcgccaagcgcggcgacgtggtggtggtgacggtcaaccaccgcctgaacgcctttggctatctctatctcgcccgcctgttcaacgccccgtcggtggccgacagcggcaatgtcggccagctggatctggtgctggccctgcaatgggtgcgcgacaatatcgccaggttcggcggcgatcccgattgcgtcatgctgtttggccagtcgggcggcggggccaagatcgccaccctgatggccatgcccagcgccaagggcctgttccaccgcgccgccaccatgagcggccagcaggtcacggtcggcggcccgttcaacgccacccggcgcgccaaggccttcctcgacaagctgggggtcaaggacctggccgccctgcgcgccctgcccgccgccgagatgctggcggggctgaaggcggtcgatccgatcgccggctcgggcggggtctatgtggggccggtgctggaccagcgctcgctcttgcgccatccgttcttccccgacgccgcgccccagagcctgtcgatcccgatgatggtcggcaacacccacgacgagaccaagggcttcatcggctgggacgccaaggccttcccccagacctgggacgaggtgatcgcccgcctgccgggacagttcgccgcccgcatcgacatcgatcccgagacggtggtggccttctaccgccagacctatccgaactattcgccggccgacgtcttcttcgccgcctcgacggcggggcgctcgtggaaggcggcgatcatccaggacgaggagcgggccaaggccggcgcgccggctttcgcctatcaggtcaactggcgctcgccgatccagggcggcatcttcggcgcgccgcacaccatcgacatcggcctggtgttcggcacgctggacgccaagggctcgatcgtcgggacggggccggactctgtggcgatgtccaacaccatgagcgacgccttcatcgcgtttgcccgcaccggcgatcccaatggcggcgccctgccaaagtgggagccctataccctgccccgccgccagacgatggtgttcgacaccgtctcgcggctggaggacgacccgcgcggcgtcgagcgcgagttcttcaaccgcgtgccgttcacgcagttcgggacgtga

SEQ ID NO: 40513 - DNA, 3090 bp, Caulobacter crescentus
atgaccgattgggacagcctcgacgccggcaagtatcgcgacgaagccgcggtgatcgccgacctgctcgccgccaagccgctctccagcgaagaccgcgcggccgtccgcgccgaggccgaggcgctggtgcgcggggcccgccgcagcgtccgcaagcagggcgtggtcgaaagcttcctgcaggaattcagcctgggcacccgcgagggtctcgctttgatgtgcctggccgaggcgcttctccgcacccccgacgacgacacgcgcgacaagctgatcgctgagaagatcggctcggccgactgggccagccacctgggcggcagcgacagcctgttcgtcaacgcctcgacctggggcctgatgctgaccggcaagatcgtcgagcccgacgagacggcccgcaacgacatgcccggcttcatcaagaagctggccgggcggctgggcgagccggtgatccgcgccgccgtcggccaggcgatccgcatcatgggcgagcagttcgtcctgggccgcacgatcgaggccgccatcaagcgcgccgccgccgaaggcgacatgtgcagcttcgacatgctgggcgaaggcgcccgcaccgccgctgacgccgcgcgctatgaaaaggcctatgccgacgcgatcgagacggtcggcaagctgtcgaacggcgcgggtccggaagccggccacggcgtgtcggtcaagctctcggccctgtgcccgcgctatgaggccacccacgaagaccgcgtctgggaagagctctatccgcgcaccctacgtctggccaagatcgccgcccgccacaacctcaacttcaccatcgacgccgaagaggccgaccgcctggccctgtcgctgaagctcctggacaagctgtgccgcgagccggagctgggcgactggacgggcctgggcctggccgtccaggcctatcagaagcgctgcggcgaggtgatcgctcgcctgaaggccctctccgaagagaccggtcgccgcctgatggtgcgcctggtcaagggcgcctactgggacagcgagatcaagcgcgcccaggtcgccggtcgcccggactatccggtgttcaccaccaagccggccacggatctgtcgtacctcgtcaacgccaaggcgctgatcgaggccgccccgcacctctacgcccagttcgccacccacaacgcccacaccctggcggccgtggtgcgcatggccaagaacaccggcgtcaagatcgaacaccagcgcctgcacggcatgggcgaggctctctataaggccgccgacgatctctatgacgggatcaccctgcgggcctacgcgccggtgggcggtcacgaggacctcttgccctacctggtgcgtcgcctgctggagaacggcgccaacacctcgttcgtccacgccctgctggacgagcgcgtgccggtcgagaaggtcgtcaccgacccgatcgacacggtcgaggcccatcccgaccgccacgccaagatcccgacgccgatcaacgtctatggcgagcgccgcgtgaacagcgcgggcctggatctgtcggtaaaggccgaccgtgagcgcctctccgccgccgtcgcggcccaggacggcgtgaccctgtcagccggtccgctggtcggcggcaaggtcgtcgccggcggcgcgccgctgccgctcatcgccccggccaacgaccagaagacggtcggcgtggtctcggaagcgcaaagcgcgcagatcgacgaggccttcaagctggcccgcgccgcgcaaccggcctgggatcgcgccggcggcgtcgcccgcgcccaggtgctgcgcgccatgggcgatgcgctggaagccaatatcgagcgcctgatcgccctcctgtcgcgcgaagccggcaagaccctgtcggacggcatcgccgaggtccgcgaggccgtcgacttctgccgctactacgcgatgctggccgaagaccagttcggcgaggccgagatcctcaaaggtccggtcggcgagaccaacagcctgcgcctggccgggcgcggcgtctttgtctgcatcagcccgtggaacttcccgctggccatcttcaccggccagatcgccgcggccctggcggccggcaacgccgtgctggccaagcccgccgagcagaccccgctgatcgccttcgaggccgtgaagctctatcacgccgccggcctggacccgcgcctgctggccctgctgcccgggcgcggtgagaccgtcggcgcggccctgaccagccacgaggacctggacggcgtggccttcaccggcggcaccgacaccgcctggcgcatcaaccagaccctggccgcgcgccagggcccgatcgtgccgttcatcgccgagaccggcggcctcaacggcatgttcgtcgacacgacggcgcagcgcgagcaggtgatcgacgacgtgatcgtctcggccttcggttcggccggccagcgctgctcggccctgcgcctgctgttcctgccgcacgacaccgccgaccacatcatcgagggcctgaagggcgcgatggacgccctggtgctgggcgacccggccctggccgtcaccgacgtcggcccggtgatcgacgccgaggccaaggacgcgctggacaagcatctggttcgcctgaagtcggacgccaaggtgctgcacgccctggccgcccccgccggcgggaccttcttcgccccggtcctggccgagatcccgaccgccgacttcctggagcgcgaggtgttcggcccggtcctgcacgtcgtgcgctacaagccggagaaccttgaaaaggtcgccggcgccctggcggcccgccgctatggcctgacgctgggcatccactcgcggatcgagagcttcgcggccgacgtccagcgcctggtcccggccggcaacgcctatgtcaaccgctcgatgaccggcgccgtggtcggcgtccagccgttcggcggcgagggcctgtcgggcaccggccccaaggccggcggcccccacgccctgctccgcttcgcggtcgagcgcgcgctcagcgtcaacatcaccgcccagggcggcgacccggcgctgctgaacctgtag

SEQ ID NO: 40514 - DNA, 1560 bp, Caulobacter crescentus
gtggtcgtcagaaccaccgcttgcgcgctgataccggtaacactaatgtcgccggcaaccaaaggtccgacaaggaccagtagggcatcaacgggccggtacggccccatggggaggacacctgtggcttcagtatccaacgccggtcccagcgccggcatgagcgcggacggcgggaaggtcaacatgaccttcgtcgccgcgatcgtcgccgtcgccacgatcggcggcttcatgttcggctacgacagcggcgtcatcaacggcacgcaagagggcctggaaagcgccttcaatctcagcaagctgggcaccggcctgaatgtcggcgccatcctgatcggctgcgccatcggcgccttcgccgccggccgcctggccgacgtgtggggccgccgcacggtgatgatcatctcggccctgctgttcgtgatcagcgccatcggcaccggcgcggccgagagctcgatcgtgttcatcatcttccgcctgatcggcggtctgggcgtcggcgccgccagcgtgctgtgcccggtctacatctcggaagtcacgcccgcgaacatccgcggccgcctgtcgtccgtgcagcagatcatgatcatcaccggcctgaccggcgccttcgtggccaactacgccctggcccacaccgccggcagctcgacggccgagttctggctgggcctgcccgcctggcgctggatgttctggatgcagatcattcccgccggcgtgttcttcctctgcctgctgggcattcccgaaagcccccgctacctcgtggccaagggcaaggacgcccaggccgaagcgatcctctcgcgcctgttcggcgcgggccagggcgccaagaaggtcgaggaaatccgcgcctcgctgtcggccgatcacaagcccacgttctcggaccttctggatccgacgaccaagaagctgcgcgtcatcctgtgggcgggcctcgtcttggccgtgttccagcagctggtgggcatcaacatcgtcttctactacggctcggtgctgtggcagtcggtgggcttcaccgaggacgacagcctgaagatcaacatcctgtcgggcacgctgtcgatcctggcctgtctgctggccatcggcctgatcgacaagatcggccgcaagccgctgctgctgatcggttcggccggcatggccgtgacgcttggcgtgctgacctggtgcttctcgaccgccaccacggtcaacggcgccctgaccctgggcgaccagatcggcctgaccgcccttatcgccgccaacctctacgtgatcttcttcaacctctcgtggggtccggtcatgtgggtgatgctgggcgagatgttccccaaccagatgcgcggctcggccctggccgtctgcggcttcgcccagtggatcgccaacttcgccatctcggtcagcttcccggccctggccgcggccagcctgccgatgacctacggcttctatgcgctgagcgctgtcgtctcgttcttcctggtccagaagctggtccacgaaacgcgcggcaaggaactggaagcgatgcaggggtga

SEQ ID NO: 40515 - DNA, 870 bp, Caulobacter crescentus
atgaccgctcaagtcacttgcgtatgggatctgaaggccacgttgggcgaaggcccgatctggcatggcgacaccctgtggttcgtcgacatcaagcagcgtaaaatccacaactaccaccccgccaccggcgagcgcttcagcttcgacgcgccggatcaggtgaccttcctcgcgccgatcgtcggcgcgaccggctttgtcgtcggtctgaagaccgggattcaccgcttccacccggccacgggcttcagcctgctgctcgaggtcgaggacgcggcgctgaacaaccgccccaacgacgccacggtcgacgcgcaaggccgtctgtggttcggcaccatgcacgacggggaagagaacaatagcggctcgctctatcggatggacctcaccggcgtcgcccggatggaccgcgacatctgcatcaccaacggcccgtgcgtctcgcccgacggcaagaccttctaccacaccgacaccctggaaaagacgatctacgccttcgacctggccgaggacggcctgctgtcgaacaagcgcgtcttcgtgcagttcgccctgggcgacgatgtctatccggacggttcggtcgtcgattccgaaggctatctgtggaccgccctgtggggcggtttcggcgcggtccgcttctcgccgcaaggcgacgccgtgacgcgcatcgaactgcccgcccccaacgtcaccaagccctgcttcggcgggcctgacctgaagaccctctatttcaccaccgcccgcaagggcctgagcgacgagaccctggcccagtacccgctggccggcggtgtgttcgccgttccggtcgatgtggccggccaaccccagcatgaggtccgccttgtctaa

SEQ ID NO: 40516 - DNA, 747 bp, Caulobacter crescentus
atgtcctcagccatctatcccagcctgaagggcaagcgcgtcgtcatcaccggcggcggctcgggcatcggggccggcctcaccgccggcttcgcccgtcagggcgcggaggtgatcttcctcgacatcgccgacgaggactccagggctcttgaggccgagctggccggctcgccgatcccgccggtctacaagcgctgcgacctgatgaacctcgaggcgatcaaggcggtcttcgccgagatcggcgacgtcgacgtgctggtcaacaacgccggcaatgacgaccgccacaagctggccgacgtgaccggcgcctattgggacgagcggatcaacgtcaacctgcgccacatgctgttctgcacccaggccgtcgcgccgggcatgaagaagcgtggcggcggggcggtgatcaacttcggttcgatcagctggcacctggggcttgaggacctcgtcctctacgaaaccgccaaggccggcatcgaaggcatgacccgcgcgctggcccgggagctgggtcccgacgacatccgcgtcacctgcgtggtgccgggcaacgtcaagaccaagcgccaggagaagtggtacacgcccgaaggcgaggcccagatcgtggcggcccaatgcctgaagggccgcatcgtcccggagaacgtcgccgcgctggtgctgttcctggcctcggatgacgcgtcgctctgcaccggccacgaatactggatcgacgccggctggcgttga

SEQ ID NO: 40517 - DNA, 1437 bp, Caulobacter crescentus
atgaccgacaccctgcgccattacatcggcggcgaacgcgtcgcggccgacgccccggccgagagcctgaacccgtccaacaccaacgacgtcgtcgccaaggtcccgatgggcggccaggccgaggtcgacgccgccgtcgacgccgcgcgcaaggccttcccggcctgggccgacgcctcgccggaggtccgctcggacctcttggacaaggtcggttcgaccatcatcgcccgcagcgccgacatcggccgcctgctggcccgcgaagagggcaagaccctggcggaaggcatcggcgagaccgtccgcgccggccgcatcttcaagtacttcgccggtgaagccctgcgccgtcacggccagaacctggaaagcacccgtccgggcgtcgagatccagacctatcgtcaggccgtgggcgtctatggcctgatcacgccctggaacttcccgatcgccatcccggcctggaaggccgccccggcgctcgccttcggcaacaccgtggtgatcaagccggccggcccgacgcccgccaccgccaacgtgctggccgacatcatggccgagtgcggcgccccggccggcgtgttcaacatgctgtttggtcgcggctcgatgggcgatgcgctgatcaagcacaaggacgtggacggcgtctcgttcaccggctcgcagggcgtgggcgcgcaggtcgccgccgccgccgtggcccgtcaggcccgcgtgcagctggagatgggcggcaagaacccgctgatcgtgctggacgacgccgacctggagcgcgcggtcgccatcgccctggacggctcgttcttcgccaccggccagcgctgcaccgccagctcgcgcctgatcgtccaggacgggattcacgacaagttcgtggccctgctggccgagaaggtcgccgccctgcgcgtgggcgacgctctggaccccaacacccagatcggcccggccgtctccgaagaccagatggagacttcgtaccgctatatcgacatcgctgcctccgaaggcggccgcgtggtcaccggcggcgaccgcatcaagctcgacaatccgggctggtacgtgcgtccgaccctgatcgccgacacgcaagccggcatgcggatcaacaacgaggaggtcttcggccccgtcgcctcgaccatccgcgtcaagagctacgaagaggcgctggagatcgccaacggcgtcgagttcggcctttcggccggcatcgccaccacctcgctcaagcacgcccgccacttccagcgctatgcccgcgcgggcatgaccatggtcaatctggccacggccggcgtcgactatcacgtgccgttcggcggcacgaagagcagctcgtacggcgcccgcgagcagggcttcgcggcggtcgagttcttcacccagaccaaaacctcctactcgtggtcgtaa

SEQ ID NO: 40518 - DNA, 1431 bp, Caulobacter crescentus
gtgactcaattttccgaccttggcctggccaagccgctgctgaaggcgcttgctgaaaagggctacaaggaaccgaccccgatccaggcccaggccattccggtggtgctgcaaggcaaggacctgttgggcatcgcccagacgggcaccggcaagaccgccgccttcgccctgccgatcctgcaacgtctggccgaagaccgtaagcccgcgccgcgccgcggctgccgctgcctggtcctgtccccgacccgcgaactggcgacgcaaatcgccgagaacttcaaggcctacgccgtccacatgggcctgtcggtccacaccatctatggcggcgtgaagtacggcccgcagatgaaggccctggccggcggcatcgacgttctggtcgccacgcccggccgcctgatggaccacatggccgagaagtcggccattgtctcgggcaccgagatcttcgtgctcgacgaagccgaccagatgctggacctgggcttcgtggtgccgatccgcaagatcgccgcccagctgaccaagaaccgccagaacctgttcttctcggccaccatgccgagcgaaatcggcaagctggccggtgagctgctgaacaacccggtgcaggtctcggtcgcgccgcaggccaccacggtcgagcgcatcgaccagcgcgtgctgttcatcgaggcccagcgcaagcgtccgctgctggccgagctgttcgccgacacgagcttctcgcgcaccatcgtcttcacccgcaccaagcgcggcgcggaccgggtggccaagtatctgaacgcggccggtatcgaagccgcctcgatccacggcgacaagacgcagggtcagcgcgaacgcgcgctcgcggccttcaaggccggcgagatgcgggccctggtggccaccgacatcgccgcgcgcggcatcgacgtcaacgacgtcagccacgtgatcaactacgagctgcccaacgtgccggaggcctatgtccaccggatcggccgcaccgcccgcaagggcaaggacggcatcgccatcagcttctgcgccgatgacgagcgtaacctgctgaaggacatccagaaggccacccgccagacgatcccgtccttcgaccgtcgcaacgacaagcagctggccgccgccgccgccgtcgccgacaagctggtcccggccgagaagtatgtcgacccgcgcaaggccgacccgcgcaacaacgtcccgtcggaactgcgccgcaagcgtaaccgcaacggcggcggcggcggcggcggtcgcgccgaaggcgctcagaaggcgcaaggtcgcggccccggacagggcaaggccggcgccaagccgggccagaaggccggtcccggccagaacgagttccgcggtcccaagcgccagtcggccacggccgagaagcgctggtcgcctatcgactaa

SEQ ID NO: 40519 - DNA, 1248 bp, Caulobacter crescentus
gtgtcacgtctggtgatgaagttcggcggcacgtcggtggccgacctggagcgcatccgccgtgtggcgcgcctggtcgccgccgaggtcgccacgggtaagcaggtcgcggtggtcgtctcggccatgtcgggcaagaccaatgagctggtcgcctggaccgacggcgccggccgcgccgctgcgggcctgccggagtcggacgacgagtatgacgccgtcgtcgcctcgggcgagcaggtgaccgccggcctcttggccatgaccctgcgcaacatgggccacaaggcccgctcgttcctgggctggcaggtgccgatcctgaccgacgaggcccacggccgcgcgcggatcgaggagatcccgcccgagaacctcgaggaatgcttcgccaacggtgagatcgccgtgatcgccggcttccagggcgtgaccccgaaccgccgcatcaccaccctgggccggggcggctcggacaccagcgccgtggccatcgccgccgccgtcaagggcgactgtgacatctacaccgacgtggacggggtctacaccaccgacccccggatcgagagcaaggccaggcgcctggccaagatctcctacgaagaaatgctcgaaatggcctcgctgggggccaaggttctgcagacccgctcggtcgagatggccatggcccatcgcgtcccggtgcgggtgctgtccagtttcgtcgaaccgggcgaagccccgggccaaggtacgatcgtctgcgacgaggaagaaatcatggaaaagcgcatcgtctcgggcgtcgcctacagccgcgacgaagccaagatcaccctgctgggcctgcccgatcacccgggcgtgtcttcgcagatcttcggccgcctcgccgaggccaatgtgaacgtcgacatgatcgtgcagtcgcgcgcccgcagcgccgacaccgccaacatggagttcaccgtcggcaagcgtgacgccacgcgcgccgtcgagatcgtccaggccgcccagaaggagatcggcttcgaggccgtcgccgtcaacgaggacgtcgccaaggtgtcggtcatcggcgtcggcatgcgctcgcacgccggcgtggcgcaatcgatgttccaggccctggccgagaagaacatcaacatccaggtcatctcgacctcggagatcaagatctcggtcctgatcgacgcggcctataccgaactggcggtgcgggccctgcacgcggtttacgggctggatcagctttaa

SEQ ID NO: 40520 - DNA, 2265 bp, Caulobacter crescentus
atggcggcatccggcatcgccgttcgaggaccacgcagcctgttgcggcagatccgcgaggccatggccggcgcgggtcccgcccagggcaagctggacgtggtggtgcgcaccatcgccatctcgatggtggccgaggtctgctcgatctatctgcgccgcgcctcgggcgatcttgagctgttcgccaccgagggtctggcccgcgaggccgtccacgtcacgcgcctgaagccgggcgagggcctggtcggcgagaccatgcgcctgggccggccgctgaacctgtcggacgccgccagccacccgtcgttctcctaccgtccggaaaccggcgaagatccctaccacgccttcctggccgtgccgctgctgcgcggcgggcgggccatcggcgtgctggtcgtccagaaccgcaccgagcgcaactatgacgaggaggaggtcgaggacctccagatcatcgccatggtgctggccgagatggtcagctccagcgagctgctgggcgccgacgagctgaaggacgtcgagctggcgccgcacaagcccgagcgcctgaagggctcgcgcttcgccgagggcctggcctatggcgtggcggtgctgcacgagcagccggtcgcgcccgagaccctgctgtccgacgacgccctggccgaggaagcgcggctgacctacgccatcgaggcgctgcagacccagatcgaccagatgctggaaggccagcacggcctggtcggcgcctcgtacgaggtgctggagacctatcgcctgttcgcccacgaccggggctggaaccgctcgctgcaggaggccgtgcgttcgggcctgaccgccgaggcggccgtcgagcgcgtccgttccgagcaccgcgcgcgtcttggccaggcccgcgatccctatctgcgcgagcggctgcacgacctggaagacctgaacgaccggctgctgcggcacctgtcgggcgacgtgcaccatgtgcgccagctgcccgaggacgccatcctgatcgcccggaacctgggtcccgccgatctcctggaatacgaccgcaccaagctgaagggcatcctgctggaggagggcagcgccgccagccacgccggcatcgtggcccgcgctctcgacatcccgtgcgtcgggcgcctggtgggcctgcgcgatcgggtcaacgagggcgaccccgttgtcgtcgacgccgagacccaggaagcctggctgcggccgcgtccggacgtggtcaaggcgctgaaggcccggatggaggtccgcgcccagcgcaaggccgagttcgcccgcctgcgcgacaccccgccgatcaccaaggacggctccaaggtcacgctgttgatgaatgccggcctcgccgtcgatctcgacatcctgggcgagacgggggccgagggcatcggcctgttccgcaccgagttccagttcatggtggccgaggagctgccgcgcctggaggcccagacggcgctctacgaaaaggtgctggacgcggccaacggcatgccggtgaccttccgtacgctcgacctcggcggcgacaagctgctgccgtacatggagctggagcgcgaggacaacccggccctgggctggcgcgccgtgcgtatgggtctggaccgtccggccctgctgcgcatgcagatccgcgccctgatcaaggccgccaacggtcggccgctgcggatcatgttcccgctggtggccaatgtggacgagttccgcgccgcccgttcgttcgtcgaccaggaagtggcctgggccctgaagcgcggccgtccggcgccggcgcgcctggacgtgggggccatgatcgaggcgccgtcgttgctgtggcacctggacgccctgctgccgatgaccgacttcgtctcggtcggcaccaacgacctgatgcagtacatgttcgcggccgaccggggcaatccgcgcgtgtcggatcgctatgacccgctgtcgccggccgcgctgcgggcgctgaagacgatccagcaggcctgcgctgacaccggcacccaggtctcggtctgcggcgagatggccggccggccgctggaggccttcgccctggtggccctgggttttgatcgattgtcgatgccgccggccggcatcgggcccgtcaagcagatggttttgtcgctggatcgcgaggccgcgcggcgcaatgtcgaggccctgctgaagggctccggcggatccttgcgcggcgagatcgaaaccttggcgcgcaagctctacgtcgccgtctga

SEQ ID NO: 40521 - DNA, 2580 bp, Caulobacter crescentus
atgaatatcgacctctattccgaccgcgccaaacaggcggtccagtcggcccagagcctcgcgctcgcccggggccatcagcagttcgcgcccgaacacattctcaaggtcctgctcgaggagaaggacgggctttcccgcgccctgatccagagcgccggcggccgccccgaccagttggacggcggcgtcgagaccctgctggccaagaccccgcgcgtcgacggcgccggcggccagctctacatgaagcccgacaccgcgcgtgtgttcgccgaggccgaaaagtcggccaaggcggcgggcgacgcctttgtcaccaccgagcgcctgctgatcgccatcgccaaggaaggcggcgaggcggccaagctcttcaaggaggccggcgtctcggcccagagcctggagaccgccgccaacgccatgcgcaagggccgcaccgccgacagcgccaacgccgaggaaggctatgaggcgctcaagcgctacgcccgcgacctgacggcggccgcgcgcgacggcaagctcgaccccgtgatcggccgcgacgaagagatccgccgcacgatccaggtcctgtcgcgccgcaccaagaacaaccccgtcctgatcggcgagccgggcgtgggcaagaccgccatcgtcgagggcctcgctctgcgcatcgtcaacggcgacgtgcccgaaagcctgaaggacaagaagctcttgtcgctggacatgggcagcctgatcgccggcgcgaaatatcgcggcgagttcgaggagcggctgaaggccgtgctcggcgaagtcaccgccgccgagggttcgatcatcctgttcatcgacgagatgcacaccctggtcggggccgggaagggcgacggggcgatggacgcctccaacctcctgaagcccgccctggcgcgcggcgagctgcactgcgtgggcgccaccacgctggacgagtaccgcaagcacgtcgagaaggacgcggccctggctcgccggttccagccggtgttcgtcagcgagccgacggtggaagacaccgtctcgatcctgcgcggcctgaaggagaagtacgaggtccaccacggggtgcggatcagcgacagcgccatcgtcgccgccgcgacccttagcaaccgctacatcgccgaccgcttcctgcccgacaaggccatcgatctcgtcgacgaggcctccagccgcgtgcgcatgcagatcgactccaagcccgaagagctggacgagatcgaccggcgtctggtgcagctgaagatcgagcgcgaggctctgtccaaggaaaccgacgcggcctccaagcagcgcctggagaacctggaggtcgagatcgacgacctgcagttccgctccgacgagatgaccgcccgctggaaggccgagaaggagaaggtcggcggcgccgcccaggcccgtgaggcgctcgaccgcctgcgcgccgacctcgccaacgcccagcgcgccggcgacttcgcccgcgccggccagatccagtacggcgagatcccggccctggagcgccgcctggccgaggccgaagccggcgacacccaggccctgacccccgaagtggtcgacgccgagcagatcgccgccgtggtcagccgctggaccggcgttccggtcgagaagatgctggaaggcgagcgcgagaagctgctcaagatggaggacgaactgcgcggtcgcgtggtcggccaggacgaggcgctcgaagccgtgtccgacgccgtacgccgggcgcgcgcgggtctgcaggatccgtccaagccgatcggctcgttcctgttcctgggccccacgggcgtgggcaagaccgagctgacaaagagcctggccgagttcctgttcgccgacgaggcggccatcacccggatggacatgtccgagtacatggaaaagcactcggtcagccgcctgatcggcgcgcctcccggctatgtcggctatgacgagggcggggcgctgaccgaggcgatccgtcgtcgtccctaccaggtcgtgctgttcgacgagatcgagaaggctcaccccgacgtcttcaacgtgctgctgcaggtgctggacgacggtcgcctgaccgacggtcagggccgcacggtcgacttccgcaacacgctgatcatcatgaccagcaacctgggcgccgaatacctggcgagccaggaagacggcgaggacgtcgaagcggtccggccgatggtgatgaatacggtgcgcggccacttccggcctgagttcctcaaccggatcgacgagatcatcctgttcaagcgcctgtcgcgccacaacatgggcgacatcgttcgcatccagctgcagcgcgtcgaaaagctgctggccgatcgccgcatggccctggccctggacgccgaggccctgaactggctggccgacaagggctatgaccccgtctacggcgcgcgccccttgaagcgcgtgatccagaaggaactggtcgacccgatcgccaagaaactgctggccggcgagatcgaggacggcggggtgatcgccgtcggggtcacggacgggcagctgtcgttcggaaaagcggtgctgcagtaa

SEQ ID NO: 40522 - DNA, 1188 bp, Caulobacter crescentus
atgtccgccgctgatcccgtcgtcatcgtcgcctacgcccgcacgccgatgggcggcttccagggggcgctgggcggggtgaaggccaccgacctgggcgcgacggcggtcaaggccgcgatcgaacgcgccggcgtggcgggcgacaaggtcgagcagatcatcatgggctgcgtgctgccggcgggccttggccaggcgccggcgcgtcaggcggcgctgggcgcgggcctgcccctctcggtcgaggccaccaccgtcaacaagatgtgcggcagcggcatgcaggctgcgatcatggcccacgacgccctggccgccggcagcgtcgacgtcgtcgtggccggcggcatggagagcatgacgggcgccccctatctgatgtccaagcaccgggcgggcgcccgcatcggtcacgaccagatgtgggactccatgtacctggacggcctggaggacgcctacacccccggcaagctgatgggcgccttcgccgaggacagcgcccagacctaccagttcacccgcgaggcgatggacgactacgccacgcggggcctgatgaaggccaaggccgccgtcgagagcggcgcgttcaaggccgagatcacgcccgtcagcgtcgtcacccgcaagggcaccgaggtcgtcgacaccgacgagcagcccggcaaggccgacccggccaagatcccgaccctgcgcccggccttcagccgtgacggcggcgtcaccgcagccaattccagctcgatcagcgacggcgccgccgccctggtcatgacccgtgagagcgtcgccaaggcgctgggcctgccgatcctcgccaaggtggtcagccacgccgcccacgcccatgagccgggcctcttcaccaccgccccggtgcccgccatgcagaaggccctcaagaaggccggctggagcgtcgccgacgtcgacctcttcgaggtcaacgaggccttcgcggtcgtggccatgatcgcccagaaggaactgggcatccccgacgacaagctcaacgtcaacggcggcgcctgcgcgctgggccacccgatcggcgcctcgggcgcgcgcatcctctgcaccctgatcaacgccctgcagtcgcgcggcggcaagaagggcctggccagcctatgcatcggcggcggcgaagccacggccatggcgatcgagctggtttga

SEQ ID NO: 40523 - DNA, 1761 bp, Caulobacter crescentus
ttgggctggttggccaaggcatggtccgacgagcggctggatgaggtcgcagccgacacctatcggttaacgttgtcgcgcctgatctcggccgcgctggtggccgtcatcatggtcttcgccctgggcccggcgatcgcgaccggctggctgctcagcctctacatcggcgagggcctggcgctgctggtcacccgcaggttcaaggatggacgcaccggaaccccgcgcgagcgggcctggttcgcctgggcctcgatcccgatcaatatcagctggaccaccctggcgatcctgctgtggctgcacggcgaggacctgatgaagatcgccgctgtggcgatctggtgcggccaggtgatctacacccagaactttcgtcaccaatccgcagcgctgctgttgctgaacgggctgacgccgatggcaagcctgctgatcttcccgttcttcttcatgcccgacgccagcgcggcggcccagaccgcgcgctggggcctggtgctgctggtcggcaccaccctcaacgtgatgatccagaatcgtgcggcggcgcgacggatggacgaactgacgcgcggcctgcgcgaggagcgcgagaaggccctggaggccgcccgcgccaagtcgaccttcatcgccgtgaccagccatgaactgcgcaccccgatgaacggtctgctcggcatggcccacgccctgcaacgctcgacgctggatccggtccagcgcgagcagatcgccttgatgatcaagtcgggcgacagcctgatgcaactgctgaacgacgtgctggacctctcgcgcgtcgagaccggcaaggtcgagttggcgccgatcgacatgagcttgcaggacctcgtcggcgaagttgtcgatgcgtggcgcgatgcggcggtgttcaaaaacctgtccctgagcgtcgactacgcgccggacctgccgcccggcgtccatgccgacccgctgcggatccgccaggtggtgaccaacctcgtctcgaacgccatcaagttcaccgtcgacggcggcgtgaggctggaggtcgccgcccgccccgcgaacggcggcgatcagcgcgtctcgatcaccgtcgccgacacgggtcctggcgtgccggccgacgcgatggagcgcgtgttcgacagcttcacccaggccgaccagaccatctcgcgcgagcacggcggggcggggcttggcctgtcgatcgcccgcgccctggcccgtcagatgggcggcgatctcgtcctggtcccgtccgggcggggcgcgtgtttcgttttcacgttcgcagcccccgcctgcgccgcgcccgtcgctgcgccggaagaggtcggggcgaacggcgacgcgcttggcccccttcaggtgctgatggccgaggacaacgcgatcaaccagctggtggtccgcacgatgctggaaccgttgggcgtggcgctcaccgtggtcgagaacggccaggaggcgctcgaggcgatggccgagcggcggttccactgcgtgctgatggacatcaacatgccggtgatggacggcatcaccgccctggaagccatccgcgacggccgcacgggaaaccccgccatgccggtgatcgccctgaccgcctcggcgatgacaggcgatcgcgagcggttcctggggctgggcttcgacgaccacctgggcaagccggtcaagccggtggacctgatcaccgccatcgccaaggcggtgaatcccgaaccgccgaatgcggggcgtcgagccgcctga

SEQ ID NO: 40524 - DNA, 1539 bp, Caulobacter crescentus
atgcacccctacctccacgcccagtcccaaggcgacaaggccgcctacatcatggccggctccggcgaggtcgtgacctacgcccagctggacgcgcgctcgaaccagggcgcgcacctgttccggtcgctcggtctggttcccggcgacgtcatcgccatcctgatggagaacaacgcccgcttcttcgaggtcgcctgggcggcccagcgctcggggctctatttcgtctgtatctcgaccaagctgaccgcctctgaggccgagtacatcctgcaggactgcggggccaaggtgttcatcacctccacggccatgggcccgatgatcgacgagatcgccgcgctggtcccgggcctgtcgctgttcacggtgggcggcgcgcacggcccctatgccgacttcgtcgcagcgcgcgagggccggccgaccacgccgatcgccgacgagagcgccggcacggacatgctctattcgtcgggcaccacggggcgcccaaagggggtgaaacccgccctcagcggcggtccgatcgacgcccccaacgccctgcagatgatggcccagggcctgttcggcttctccggcgacagcatctatctgtcgcccgcgccgctctatcacgccgccccgctgcgctggtgcatgaccgtgcacaagctgggcggcacggtgatcgtgatggagaagttcgagcccgaaaccgcgctggccctgatcgaacagcacagggtcaactgcggtcagttcgtgcccacccacttcgtgcggatgctgaagctgcccgaggcggtccgcgccaagtacgacgtctcgtcaatgaagtcggcggtgcacgccgccgccccctgccccatcccggtcaaggaacagatgatcgcctggtggggtccggtgatcttcgaatactacgccggcaccgagggcaacggcttctgctggatcaattcgcagaactggctgacccacaagggcagcgtcggccaggccgtgctgggcgaactgcgcatctgcgacgaggccggcgatcccgtgcccccgcgcaccgaaggcacggtctatttcgccaacggcccggcggtgaactaccacaacgccccggacaagacggccgagagctacaacaagcatggctggaccacgctgggcgacgtgggctgggctgacgaggacggcttcctctacctgaccgatcgcaagagcttcatgatcatctcgggtggggtgaacatctatccgcaggagatcgagaacctgctgatcacccaccccaaggtggccgacgccgccgtggtgggcgcgccgcatgaggagatgggcgaacaggtcgtggcggtgatccaaccgatggacctgggcgacgaccaggtcgccctggccgaagagctgatggccttcgcccgcgccaatctcagccacgtgaagtcgccgcgccgcatcgacttcatggccgaactgccccgccacccgaccggcaagctctacaagcgcctgatccgcgatgcgtactggggcaagggcgagagcaagatcgtttag

SEQ ID NO: 40525 - DNA, 1668 bp, Caulobacter crescentus
atgaccgggatcatcgaggccgactacgttatcgtgggcgcgggatcggcgggctgcgtgctggccgcgcggctgtcggagaacggccgctacaaggtcgtgctgttggaggcgggcggcgacgaccgaccgaccaagaacctctcccagttcgcctcgaacatgatgatccacatcccggtcggctactcgtcgaccctgaaggatccgaaggtcaactggctgttcaccaccgagcccgaccccggcacgggcggccgcagccatgtctggccgcggggcaaggtgctgggcggctcgtcctcgatcaacgctatgctctatgtgcgcggccaggccgccgactatgacggctggcggcagctgggttgcgaaggctgggcctgggacgacgtcctgccctatttccgcaaggctcagaatcaggagcgcggcgcctgcgacctgcacgccaccggcggcccgctgaacgtcgccgacatgcgcgacgcccacccgatctccgaggcgctgatcgaggcctgcgaccaggccggcatcccgcgctatcccgacctgaacggcgccgaccaggaaggcgccacctggtatcaggtcacccagaagaacggcgcgcgctgctcgtcggctgtcgcctatctgcacccggccatgaagcgtccgaacctgcgcgtcgagaccaacgccctggccggccgcgtcctgtttgagggcaagcgggccgtcggcgtcgagttcatgcagaacggcgagcggcgcgccgccatggcgcgcggcgaggtgatcctggccggcggcgcgatcaactcgccccagcttctgcagctctcaggcgtcggcgccggcgggctgctgcgcgagcatgggatcgaggtcgtggccgacctgcccggcgtcggcgagaacctgcaggaccactatatcgtcgccgcccgctaccggctgaagtccggcaccgtctcggtcaacgagcagagcaagggcggacgcctggccgccgaggcgatgaagtacctgctgttccgcaagggccttctgaccctgtcggcggcgcacgtggcggccttctgtaagtcccgccccgatctcgcaggaccggacatccagttccacatcctgcccgcgaccatggatctggataagctgttcaacgagcagaagatggaactggaaggcgcgccgggcatgaccatcgccccctgccagctgcgccccgaaagccgtggctacatccgcatcaaatcggccgatccgtcggtctatccggccatcttcgccaactacctggccgatccgctggaccaggaggtcatcgtcgcgggcctgaagtgggcgcggaagatcggccagcaaccggccatcgcccagtatgtcgaaagcgagatgaaccccggcctcgaggtccagactgacgaacagctcctggacttcgcccgccagaccggctcgacgctctatcaccccgtgggcagctgtcagatggggaccgggccgatggccgtcgtggacgcgcaactgcgcgtgcgcggcgtggagggtctgcgcgtggtcgacgcctcgatcatgccacgcctgatctccggcaacaccaacgccccctcgatcatgatcggggaaaagggcgcggacatgatcctggccgccgccaggcagcccgtcgccgcttaa

SEQ ID NO: 40526 - DNA, 912 bp, Caulobacter crescentus
atgaccgttttcgttctcggctcgatcaatctggacgccgtggcgcgcgtcgacgatctgccccgccccggggaaaccgtcgcgggcctgtcgctggagctgtttctgggcggcaagggcgccaaccaggccgtcgccgccgcccgcatgggcgtggccacccgcctgatgggggcggtcggcggcgacgacagcggcgccggcctgaaagccaagctggccggctatggcgtgcaggtcggcgacgtggtcgaactgccgggcgtgcccacaggccaggcccatgtctgggtcgccaacagcgccgagaacatgatcgtggtgaccgccggcgccaacgccatggtcacgccccagcaggtggccgccacgacgatcgagggccagcgggtgctgctctgccagctcgagacgccggccacggcgatcgagaccctgttccgcgccggctcggccaagggcgccctgcggatcctgaacgccgccccggccctgcctcagggcgcggcgctgttcccgctgaccgacatcctgatcgtcaaccagaccgaactggccacctacgccaagctcgaccgcgagccggtcaagctggaagaggtctcggtcgccgcccgcaagctgatgagccgccccgaccagaccatcatcgtcacgctcggcgcggccggcgcggccgtggtgcggcgcgacgaggccttcctggtcgagggcaagaaggtcaaggcggtcgacaccgtcggggccggcgactgcttctgcggcgccctggccgccaccctggccgccggcatggacctggccgaggccgtcgagacggccaacgccgccgccgccctttccgtccagaaagccggcgccgcgccgtcgatgccgaaccgccgcgaggtcgaggcgtttctggaggggtga

SEQ ID NO: 40527 - DNA, 1530 bp, Caulobacter crescentus
gtgaccgagcttgttctaaaccccggcgcggtgccgctggccgagtggaaggcgatctatcgcggcgcgtcggcgcgtcttgcggagagcgcctggccggtgatcgccgagagcgcggcggcggtgcagcgcatcctggccaagggcgagcccgtttacggcatcaacaccggctttgggaaactggccagcgtccgcatcggcgacgctgaccttgagaccctgcagcgcaacatcgtcctgtcgcacgcggcgggcgtcggcgagccctcgcccgtcccggtgatccgcctgatgatggccctgaagctggccagcctggcccaaggcgcctcgggcgttcgggtcgagacggtgcggatgctggaggagatgctggtcgagggcctgacgccggtggtgccctgccagggctcggtcggcgcctcgggcgatctggcgccgctgtcgcacatggccgcgaccatgatcggggtcggcgagatcttcgtcggcggtcagcggctgccggcggcgcaggccttggcgcaagcgggcctagagcccctgaccctgggtcccaaggagggcctggccctgctgaacggcacccagttctcgaccgccaacgccctggcgggcctgttcgaagccgagcgcctgttccagtcggccctggtcaccggcgccctgtcgaccgaggccgccaagggctcggacaccccgttcgacccgcgcatccacaccctgcgccgccacgtcggccagatcgagaccgccgctgcgcttcgcgcgctgatgagcgcctcggaaatccgcgcctcgcacctgaaggaggacgagcgcgtccaggacccctactgcctgcgctgccagccgcaggtgatgggcgcggcgctggatatcctgcgtcaggccgccaccaccctggcgaccgaggccaattgcgtgtcggacaatccgctgatcttcccggaggcggacgaggccctgtcgggcggcaacttccatgccgagccggtggccttcgccgccgacatgatcgccctggcggtctgcgagatcggctcgatcgccgagcgccgcatcgccatgctggtcgacccggccctgtcgggcctgcccgccttcctgacgccgaagccgggtttgaactccggcttcatgatcccgcaggtcacggctgcggccctggtgtcggagaacaagcagcgcgcctatccggccagcgtcgactcgatcccgacctcggccaaccaggaagaccacgtctcgatggccgcccacggcgcacggcgcctcctggccatggtcgagaacgccgacgcggtgctgggcatcgagcttctggccgccgcgcaaggctgcgacttccacgcaccgttgcgctccagcgccgcgctggaggcggtgcgggcgctgacgcggagcaaggttccgcacctttcggacgaccgtcacttccatccggacatggaggcggccaacacgctggtgcgctcgggcgcggtgatcgcggcggtgggtgccttgccgggggtgacagcgtga

SEQ ID NO: 40528 - DNA, 1593 bp, Caulobacter crescentus
atgtccgacgcgatcgacttcgaccgcatgaacaccctgggcgacgtgccgcgctatcacgccgaggcgcggcccgatgcggtggccttcagcttcgaggggcgcgagacgaccttcgcgcagctcgaccggcataccaaccaggtggccaacgccctgctggcggccggcctgtcgaccggcgaccgcatcgcctatgtcggcaagaacagcgaccactatttcgagctcctgctcggcgccgccaaggcgggcgtggtaaccacgccgatcggctggcgcctggccgcgcccgagatcgcctatatcgtcggcgacagcgaggccaagctggtctttgtcggccgcgagctgatcggccatgtcgacgcggtcgccgccgaactgacccatcgtcccgtggtcatcgccatggaggccgagggcgccggcgactatcaaaccttcgaaggctggcgcgacgcggccagcgatgtcgacccgcacaagccgatccagatctcggacatcgccatccagctctacacctcgggcacgaccggacgtcccaagggcgcgatgctgacccatcacaacctgctcggcatgcgccgcgaggcggccaagaaccctttggaatggaaccagtggggccctagcgacgtcagcctggtggccatgccggtggcccatatcggcggcaccggctggggtctggtggggctgatcaacggcgccaagggcgtggtcgcccgcgagtttgatccgaccaaggtcctggacttcatcgagaaggatcgcatctccaagatgttcatggtgccggcggcgctgcagatcgtggtgcggctgcccagggcgcgcgaggtcgactattcgcgcctgacccacatcctgtatggcgccgcgcccattccgctggacttgctgcgcgagtgcatggaggtgttcggctgcggcttcgtccagcagtacggcatgaccgaaacgacggggacggtggtgtatctgccgccggaggaccacgatccggccggcaacaagcgcatgcgcgctgcgggtctgccgatgcccggcgtggagctgaagatcatcgatgaagccggcaagagcctgccgcccaatacggtgggcgaggtggccgtgcggtccagcgccaacatggccggctactggaagctggacgaggccacggccaagaccatggacgccgacggctggctgcgcaccggcgacgccggctatctggacgaggacggctatctgttcatccacgaccgggtgaaggacatgatcatctccggcggcgagaacatctatcccgccgaggtcgagagcgccgtctatggccacccgcacgtggccgaggtggcggtgatcggcgtgcctgatgacaagtggggcgaggccgtcaaggcggtggtcgcgcccaagcccggcgtcacgcccgacgccgacgacatcatcgccttcgcccgcacccgcatcgcccacttcaaggcgcccaagagcgtggacttcatcccggccctgccgcgcaacgcgtcggggaagatcctgcggcgggagctgcgggcgccgtattgggaggggcgtgagcggcaggtgaattag

SEQ ID NO: 40529 - DNA, 654 bp, Caulobacter crescentus
atgctgtcgctccacaagaccctcgagatgccctccgccgacacggccctgcccggccgcgcggcgccgatcccgacggcgcagacccatttcgtcaacggccatgcgctgaagggtccctatcccgagggcctggagacggcgatcgtggccatgggctgcttctggggcgtggagcgcgtgttctggaaggttccgggcgtctatgtcaccgccgccggctacgccgctgggatcacgcccaatcccacctacgaagaggtctgcaccggccgcacgggccacaccgaggtggtgctggtggtgttcgatcccaaggtcgtgacctatgaggcgctgctgaagactttctgggagaaccatgaccccacccagggcatgcgccagggcaacgacatcggcacccagtatcgctcgggcctctatgtgacgagcgacgcccaggcggcggcggcggcggagtcgaaggcggcctatcagcaggctctgtcggcgcgcgggctgggaaccatcaccaccgagatcgcgcccgccggccccttctatttcgccgaagactaccaccagcagtacctggccaagaatccgaacggctactgcggcatcggcggcaccggcgtggtctgcccgatcggtctgggcgtcgagggctga

SEQ ID NO: 40530 - DNA, 1737 bp, Caulobacter crescentus
atgttcaagcgcagcggcgcgaagccgacgatcctcgaccaggccgtgctggtcgcccgcccggcggtgatcaccgccatggtcttcagcttcttcatcaacattctggccctggtcagcccgctgtacatgctgcaggtctatgaccgcgtgctgaccagccgcaacgtttcgaccctgatcgtgttgacggtcatctgcgtcttcctgttcctggtctacggcctgctcgaggcgctgcgcacccaggtgctggtgcgcggcggtctgaagttcgacggcgtggcccgggatccgatcttcaagtcggtgctggactccacgctcagccgcaagggcatcggcggccaggcgttccgcgacatggaccaggtccgagagttcatgaccggcggcctgatcgccttctgcgatgcgccctggacgccggtgttcgtcatcgtctcgtggatgctgcacccgttcttcggcatcctggcgatcatcgcctgtatcatcatcttcggcctggccgtgatgaacgacaacgccaccaagaacccgatccagatggccaccatggcctcgatcgccgcccagaacgacgccggttccaccctgcgcaacgccgaggtcatgaaggccatgggcatgtggggcggcctgcaagcccgctggcgcgcgcgccgcgacgagcaggtggcctggcaggccgccgccagcgacgccggcggcgcggtgatgtcgggcatcaaggtgttccgcaacatcgtccagaccctgatcctgggcggcggcgcctatctggccatcgacggcaagatctcggccggcgcgatgatcgccggctcgatcctggtcggccgcgccctggcgcccatcgagggcgccgtgggtcagtggaagaattatatcggcgcgcgcggcgcctgggatcgcctgcagaccatgctgcgcgaggaaaagagcgccgacgaccacatgccgctgcccgagccgcgcggcgtgctgtcggccgaagccgcctcgatcctgccgccgggcgcgcaacagccgaccatgcgccaggccagcttccgtatcgacgccggcgccgcggtggcccttgtcggtcccagcgcggcgggcaagtcctcgctgctgcgcggtatcgtcggcgtctggccctgcgcggcgggcgtcatccgcctcgacggctacgacatcaagcagtgggatcccgagaagctgggtcgccacgtcggctacctgccgcaggacatcgagctgttctcgggcaccgtcgcccagaacatcgcccgcttcaccgagttcgaatcgcaggaagtcatcgaggccgcgaccctggcgggcgtgcacgagatgatccagagcctgccgatgggctatgacacggcgatcggcgagggcggcgcctcgctgtccggcggccagcgccagcgcctggccctggcgcgtgcggtgttccgcatgccggccctgctggtgctggacgagccgaacgccagcctcgaccaggtgggcgaagtggcgctgatggaagcgatgaagcggcttaaggccgctaagcgcacggtgatcttcgccacccacaaggtgaacctgttggcccaggccgactacatcatggtgatcaaccagggtgtgatcagcgactttggcgaacgcgacccgatgctggccaagctgaccggggctgcgccgccccagacgccgccgccgacgccgccgcccgcgccgttgcagcgcgtccagtaa

SEQ ID NO: 40531 - DNA, 978 bp, Caulobacter crescentus
atggcgaaaacggctttgatcaccggtgtgaccggtcaggacggggcgtacctcgccaagctgctgctggagaagggttacaccgtccacggcatgctgcgtcgctcggcctcggccgatgtgatcggcgaccgcctgcgctggatcggcgtctatgacgacatccagttcgagctgggcgacctcttggacgagggcggtctggcgcgcctgatgcggcgcctgcagccggacgaggtctacaacctggcggcccagagcttcgtcggcgcctcgtgggaccagccgcacctgacgggctcggtgacgggcctgggcacgaccaacatgctcgaagccgtgcgtctggaatgcccgcaggcgcggttctatcaggcctcgtcgtccgaaatgtacggtctggtgcagcacccgatccagtcggagacgacgccgttctatccccgctcgccctatgcggtggccaagctctacgcccactggatgacggtgaactatcgcgagagctttggcctgcacgcctcggccggcatcctgttcaaccacgagagcccgctgcgcggcatcgagttcgtgacccgcaaggtcaccgacgcggtggcggccatcaagctgggtcagcaaaagaccgtcgatctgggcaatctcgacgccaagcgcgactggggtcacgccaaggactatgtcgaggccatgtggctgatgctgcagcaggagacgccggacgactatgtggtcgcgaccggcaagacctggaccgtgcgccagatgtgcgaagtggccttcgcccatgtcggcctgaactatcaggaccacgtgacgatcaatccgaagttcctgcgtccggcggaagtggacctgctgctgggcgatccggccaaggccaaggccaagctcggctgggaacccaagacgaccatgcaacagatgatcgccgaaatggtcgacgccgacatcgcgcggcgctcgcgcaactga

SEQ ID NO: 40532 - DNA, 1074 bp, Caulobacter crescentus
atgaccgatctcaacaccctcgaagccgacgtgctggcccaggtggccgccgcctcggatctccaagcgcttgacgccgtccgcgtggccgccgtcggcaagaccggctcgatctcgggcctgctgaaaaccctgggcgcgatgagccccgaggagcgcaagacccagggcgcggcgatcaacgccctgcgcgacaaggtgcaggacgcgatcacccagaagaaggccgcgctggaagccgccgaactggacgcgcgcctggccagcgagacgctggacctgtccctgcccgcgccctaccgccgcaagggatccgtccacccgaccatgcagaccatggacgaggtcgtggccatcttcgccgagatgggcttcgccgtggccgaaggtccggacatcgaggacgacttccacaacttcacggccctgaacttccccgagaagcacccggcccgcgagatgcacgacaccttcttcttcaatccgaaagaagatggcgaaaggatgcttctccgcacccacaccagccccgtgcaggtgcggaccatggtgtcgcagaagccgccgatccgcatcatcgccccgggtcgcacctatcgctgcgacaacgacgccacccacacgccggtgttccaccaggtcgaaggcctcgtcatcgacaagggcatccacatgggccacctgaagtggaccctggagactttcctggcgcggttcttcgagaccgacgcggtgaccacccagttccgcccgcaccacttcccgttcaccgagccgtcggccgagatggacgtgcagtgcgaccgctccggcggcgagatcaagatcggtcagggcacgagctggctcgagatcctgggctgcggcatggttcacccgaacgtgctgcgcgcctgcggcatcgacccggacgagtaccagggcttcgccttcggcatgggcgtcgatcgcttagggatgctgaagtacggcatgccggacctgcgcgacatgtggtcgtcggacgtccgctggctctcgcactacggcttcagcgcgtttgcggcgccgaacccggcgtcaggcctgagctga

SEQ ID NO: 40533 - DNA, 927 bp, Caulobacter crescentus
ttggtgcggatcacggttctgggcgagtgcatggtcgagctgtcgccggaagccggcgacggcggcgcgccgctctatcggatgggcttcgccggggacaccttcaacacggcgatctacatggcgcggctgggcgaccaggtcgcctactgtaccgcgctggggcagggggacccgttcagcgaaggcgtgctggcggccatgcgccgcgaaggcatggacacccagctggtgcgccaggtcgagaaccgcctgccgggcctctacgccatcgtcctggacgagcacggcgagcggaagttccactattggcgcgagcgggccccgatccgcgatctgttctcggcccacaccgccgaccagctaatcgaggccgccaaggccagcgatcttgtctatctgtcgggggtgaccctggcggtgatcggcgacatcgggcgggcgcggctgcgcgacatcctcgcttacgtccactcgcacggcgtggccgtggcgctggacttcaactaccgcccggccctctggcccagcgccgaggccgcccgcgcggcgctcgatggcgttgttcccgcctgccgctacatctcgctgagcagcgaggacagccggccgctctatggccgtgaagctgaagacctcgccgccgaatgggccgcggccggcgctgaggtggtggcgcgggatgagagccatgccgtcaatgttcacacaccggagggccgcacggcgacgccggcccccgcgcgggtgaaggccgtggacacgaccggcgcgggcgacagtttcaacgccgcctacctgtcctcgcggttggcgggcgcggcgatccccgacgccgtcgccagggcgcacgccttggccgggatcgtggtctcccatcgaggcgcgattgtgccgccggagataggtttagcccccttaggctga

SEQ ID NO: 40534 - DNA, 1230 bp, Caulobacter crescentus
atggccaccgaaacctcggacaagcccgcgctggcgcggcgctccttcctgcgcagcgccgccttcctggccaccgcagcgccgatcatgaccgaggccagcctggcttacgcggcccagacccccgccccgccctcgggcatggcgctgcacggccagagcgccaatgcgccgccgtccggcatggtgctgatcaacgccaacgaaaacccgctgggtcccagcaaggccgcctgcgacgccatcgcgcgcgtggcgccgctgggcggacgctatgacctgaccggcgaaaccgaactcctgaccaagaccatcgcggcgcagagcggcctgaagccggagttcatcgccgtctacgccggctcgtccgagcccctgcactacagcgtcctggccttcacctcgccgaccaagagcttcgtcaccgccgatccgtcctacgaggcgggcatgttcgcggcccggaccagccaggccaagatcatcaagacgccgctgaccagcgccttcgcccacgacgtcaaggcgatggtcgccgccgacgctcaggcgggcgtcatctatatctgcaaccccaacaacccgaccggcacgctcacgaccaaaaaggacatcgtctgggcgctggagaacaagccggcgggctcgatcctgctggtcgacgaggcctatatccacctgaccgacgagcccgacaccctggacctggtcgcccagggcaaggacctgatcgtgctgcggactttctcgaagatctatggcatggccggcatccgctgcggcttcgctgcgggccgtccggaccttttggccaagctgaaaccgttcggccagaacgccatgccgatcaccggctcggccgccgcccgcgcctcgctggaggacccgaagctggtccccgagcgccgcaagatgatcggcgacacccgtcgcgacacgatcgcctggctgaagaccaatggctacaaggtcatcggcgatccgcagaccaactgcttcatgatcgacaccggccgcaacggccgcgcggtgatggcggcgatgaaggccaggaacgtcatgatcggccgcacctggccgatctggcccaacgccgtgcgcgtctcggtcggcacgcccgaggagatggcggcgttcaaggtggccttcaaggcggtgatggacggcccgcctctcgcggaggcggatcacgttcagttggcgcagctcgacggttacgtggcgctgtag

SEQ ID NO: 40535 - DNA, 1605 bp, Caulobacter crescentus
atgagcggatctgacgcgtcaccggcggcgagcgtgctcacgcgccgacggttctttgaaagcctggccgcggtcggcggcatgtcgctggtgctgtcgggcatggaagcgctgggcttcagccaggcctcggccaccgagctgccgccgaccctgaccggcggcgccaagaacaccaaggtcatcatcctgggcgcgggtctggcgggcatgaccgccgcctacgagatgtccaaggccggctatcaggtgcagatcctggaggcgcgcgactatgcgggcggtcgctgccagacggcgcgcaagggcttcaagcacaccgacctgctgggcaacacccaggtctgcgagttcgacgacgggcactacatcaaccacggcgcctggcggatcccgtaccatcaccgctcgaccctgcactacaccaagagcttcggcgtcctgctggagagcttcgtcaacgacaacgacgcgtcttacgtctatttcgagaagggcaagggcccgctgaacggcaagcccgtgcgcaagggcgagatcgccgccgacgtccgcggctacaccgccgaactggtcgccaaggccgccagcgccggcgctctggacgcgcccttgagcggcgtcgatcgtgagcggttcgtcgcttacctcgtcaatgaaggacgcctgtccaagagcgacctgacctacaagggcaccgaggggcgcggtttctcggtgcatccgggcgccggcgtcaatccgggccccggcaaggagctggagcccttcgccttcaaggacgtgctcgacagcaacgcctggcgggtgctcagctcggtcaccggctatgagcagcagcgcaccatgctgcagccgatcggcggtatggaccagatcgccaaggcgttcgaaaagcgcgtcgcgccgatgatccgctactcgaccgtggttcagaagatcaagcagtcgcccaccggcgtgacggtctcgttcaaggggccggacggcaagctgggcgaggtcaccgccgactattgcgtctgcaccattccgctcagcgtgctcaagcagattgatctggacgcctcagccccgttcaaggcggcgatggagggcgtggcctatgcgccggtcaacaagatcggcctgcagatgaagagccgcttctgggaagacaggcaccacatctacggcggtcacatctataccgatctggccggcataggctcgatctccctgccctcttatggctggcaagcccagaagggcgtgctcttgggttactacgccttcggcggcgaggccgcgcggatcagcgccaagagcccggccgaccgcgccgccttcgctgtcgccggcggccagaaggtgttccccgaatatgccgagaacttcgagaacgctttctcgttcagctggcacctggccgagcacaatctgggcggctgggccgagtggggcgagaacggccgcaaggaggcctatcccatcctgtgcgagcccgacggtcgtctctatctagcgggcgagcacctcagctaccttggcggctggcaagccggggcgatcgagtcggcctggcagcagatcgccaagatccacgcccgcgtccaacaagcctga

SEQ ID NO: 40536 - DNA, 7440 bp, Caulobacter crescentus
gtgggggcgtccaccagcaaggatggacgaatggcgatctccaatctttccgccgcgcagatctcgaccctttcggtcaccgcgatccaaggtctgacgacgaccgacattcaggcgctgaacggaacccagatcgccgccatcagcgcgacgggcatcggcgcgctcgccaccacccaggtcgccgcgctttccaccacccaggtcaaggcgctcaccgcgactcagatcccgaagttcgcgacttcggtggtcttcgacgtcacccagctgacgcagctttccacccagcaggtttcggcgctgacctccacccagctggcggcgctcgacacctcccacatcgccgtcctcagcgcgacgcagcttggcgcgctttcggcgaccaacttctcgggtttcgacaccacccaggtcggccaactgaacgagacccaggtcaaggggctgacggccagccagatcagggggctgaccaccaccgacatcggcgaactggccggtacgcaagtcgccgcgcttgccgctgatcgcgtcgccgccctcagcgtcaccaacctgtcggcgctggacgcgacgcaggtgggagcgctcagcaccacccaggtggcggcgctgtcgacgacccaaatgaaggggctcagcaccaccgatatcggcgagttggcgacgacccaggtcgcggccctctccgccgcccaggtcggggccctgacggccaccaacttctccgccctcagcgccacccaggtgggcgcgctgtccgtgacccaggtcaggggtgtcacggtcgaccagatcaaggcgctgacgaccaccgacatcggcgagctggctgacacgcaggtcggagctctgaacacgtcgcagatcggcgcgctggtgaccacccaggcccagcagctgtcgaccacccaactggcggtactggcctcgacccaagtcgccgcgttgggcgccaccaatttctcggcgctgaacgccacgcaggtgggatccttgagcgagacgcagctcaagggtctgacgacgtctcaactggccgcgctgaccaccaccgacatcggtgagctcgcggacacccagatcgcggcgctgtcggcgacccagatcggctcgatcacggccacggcgatctcggcgctgaacgcaacccaagtggcggcgctgtcgacgacgcaggtcaaggggctgacgacgacccagctcaaggggctgtcgacgaccgatatcggcgagctggccgacacccagatcggcgcgctggcgaccagccagctggccggggtgacggcgaccaacgtctcggcgcttagcgcgactcaagctgcggcgctgtcggtcacgcaggtcaagggcctgacggctgaccagctcaaggggctttcgaccaccgacatcggcgaactggccgacacccaggtggcggcgctgtccgccgatcagatcaagaatctttcggcgaccaatgtctcggcgctgagccagacccaggtttcggccctgaccaacacgcaggtcgccggtctcaccacgacccagctcaaggggttgtcggtcacggatgtcgaggaactgtcggccacgcaggtcggggccctcacgacggcccagatcggctcgctggcctcgacccaggtgcaggagctgtcgaccacccagatcggcgggctgtcctcgactcaggtcggggcgctgaccgccacgaatctgagcctgctcgacgccacccagttgggcgccctgaccaccactcagctgaaggggctgaccaacgcccagatggccgggctgacgacgaccaatgtcagcaatctggcggacacccaggtcggcgccctgtcgtccacccagctgggcgccctgaccgcgacgggcttctcgaccctcaacggcacccaggtcgccgccttgtcggaaacccaggtgaagggtctgaccgcaacccagctgaaggggttgaccaccaccgatatcggtgaactggcgaccacccaactggcggcgctgtcgacggcgcaactgggcgcgctgacggccaccaacgtgtcggcgctgaacgcgacccagacggccgcgctgaccaccacgcaggtcaagggcctgacggcggaccagctcaagggcctgtcgaccacggacatcggtgaactggcggacactcagatcgccgccctgaccgctgaccagatcaagaatctctcggccaccaatgtctcagctctgagccagacccaggtcgcggcgctgaacgccacccagatcaagggtctgacggcgacccagctgcaaggcctgacgaccaccgacgttagcgaactggccgacacccagatcgccgctctggccacgtcgcagatcaccgcgctgagcctgaccaatgtgaagagcctgtcgaccacgcaggtcggcgctctgagcgcgtctcaagtgggagccctgtcggcgacgaacttctcggcgttcgacgcgacccaggtcggggcgctcaatgaaacccagatcaagggcctgaccacggctcagctcggcgggttgacgacgacggacatcggcgaactggcgaccacccaattggcggcgctggcttcgacccagatcggcgcgctgacgcccaccgccttctcggcgctggacgccacccagaccgccgccctgacgacgaaccagatcaagggcctgaccgcgacccagctgaaggggctgtcgaccaccgacatcggcgagctcggcgacacccaggtgggcgccctgagcgccacccaactcggcgcgctgacggcgaccggtttctcggccttgaacggaacccaggtcgcggcgctgaccacgacccaggtcaagggccttactgcggatcaggtgaaggggctgacgaccaccgacatcggcgagttggctgacacccaggtcgcggctctgtccgccgaccagatcaagaacctgtcggcgaccaatgtttcggcgctgagccagacccaaatcgccgcgctgagcaacacccaggtccaggcgctgtcgacgacgcagctgaagggcctgacgacgaccgacatcgacgagttgtcgtccacccaggtgggcgcgctgtcggcggcccagatcacggccctggcctcgacccaggtgcaggagctgtccaccacccagatcggtggtctctcctcgacccagatcggcgctctcacgccgacgaacttcagcctgatggacgccacgcagttcggggcgctgacctcgacgcagctcaagggcgtcacgaacggccagctggctgcgctgacgacgaccaacgttggtaaccttgcagacacccaggtcgctgcgctttcggcgagccaactgggcgctctgaacgcgaccaacttctcgaccctgaacgccacccaggtcggcgcgctcaccgagacacagatcaagggcgtgacggccacgcagctgaagggcctgacgaccacggacgtcgccgaactgtcgacgacccaggtcgccgcgctttcggcggtgcagatcggcgccctctcggcgacgaacgtatcgtcgctgaacggaactcaggtcgcggcgctcacgaccacccaggtcaagggccttacggctgaccagctgaagggtctgtcgaccaccgacgtctccgagctggccaacacccagatcggcgcgctgacggccgatcagatcaagaacctttcgcccaccaacctgtcggctctggacgccacccagaccgccgccctgaccgtcacccagctcaagggcctgacgaacacccagttggccgggctgagcaccaccgacatcagcgacctggccgatacgcagatcgcagcgctgtcgtcggcgcagatcaccgcgctgaatgtccaggacctgacgaccactcagatctcgggtctgagctccacggtcatcggggccatcgggccgaccaagttctcggcctggaacgccacccaggttgccgccctgaacgcgacccagctgaagggtctgaccaccagccagctgacgagcctgacgacgaccgacatcggcgaactggcggacacccaggtggccgccttgaccgcgacccagctgggcgcgctgtcgcccacgggcttctcggcgctggacgccacccaggttgccgcgctgtcgagcacacagatcaaggggctcaccgccacccaactgaaggggctgaccaccaccgatatcagccagttggccgacacccaggtggccgctctggcggcgacccagatcggcgccctgaccgcgaccggactctcggcgctggacgcgacgcagacggcggcgttgagcgcgacccagatcaaggggctgagcgccgatcagttgaagggtctgacgaccaccgacatcggtgaattctcgacgacccagatccaggccctgacggccgaccagctcaagaacctgtcggcgaccaacatctcggccctggcgaacacccagatcgcggcgctgagcaacactcagatccaggcgctttcgacgacccagctgaagggcctgtcggtcaccgatatcgacgagctgtcggcgacccagatcggcgcgctctcggcggcgcagatcggggccctggccaccacccaggtccaggaactgtcgaccacccagatcggcggcttggcggccacccaggtggcggcgatctccacaaccaatctgacgcagctcaacgccacgcagctcggggcgctcagcactacgcagctcaagggcctgacggcggatcagctgaagaacctgacgacgaccaatatcggcgatctcgccgatacccaggtcggcgcgctttcggcgacccagttgggcgcgttgaccgcgacgggcttctccaccctcaacgccacccaggtcggcgcgctcagcgagacgcaggtcaagggtctgacggccacccaactgaaggggctgaccaccaccgacatcggtgaactggcgacgacgcaagtcggcgcgctcaccgcagtgcagatcggggccctgaccacgaccggcttctcggcgctgaacgcgacccaggtcggagcgctcaccaccacccaggtcaagggcctgacggcggatcagctgaagaacctgaccaccaccgacatcggcgaactggccgacacccaggtggcggccctgacggctgaccagatcaagaacctgtcgaccaccaacatctccgcgctgtcggcgacccagtcggcggccctgacctcgacccagatcagggggctgaccaacacccagatccaggggctgagcaccacggatgtgggcgaccttgcggacacccagatcgcggcgctgcagacctcgcagctcgcggccctggccacgacccaggcccagaccctgtcgaccacccagctcggcgcgttgaacgctacgcaggtcggtgcgctgacgacccaggccttctcggcgctggacgcgacccaggtcggcgctctgacgacgacccaggtcaaggggctgaccaatagccagctgtcggcccttacgaccacggacgtcggccagctcgcggacacccaggtgggcgccctgagcgcgacccagctcggcgctctgacggccacggccttctcggccctggacgccacccagacggcggcgctgacgacgacccaggtcaaggggctgaccgcgacgcagctgaagggcctgacgaccaccgacatcggtgacctcgccgacacgcaggtcggcgcgttgagcgcgacccagctgggcgcgctgacggccaccggcttctcgtcgctcaacgccacccaagtggcggtgctttcggccacgcagatcaaaggtctgaccgcagatcagctgaagggcctgagcaccactgacatcggcgagctctcgaccacacagatcacggccctgaccgccgatcagctcaagaacctctctgcgaccaacatctccgccatggcggacacccaggtcgcggcgctgagcaacacccagatccaggcgttgtcgacgacgcaactgaagggcctgtcggtgaccgacatcgacgagctgtcggcgacccaagtcggcgctctgtcggcggcccagatcgcagcgctggcctcgacccagatccaggagctgtcgaccacccagatcggcggcctctcggccacccagatcggcgcggtctcggcgacgaacgtcagcctgctgaacgccacgcaggtgggggcgctcaccacgacccaggtcaagggcctgacggtcgcgcaacttgccggtctgagcaccaccaatatcggcgacctcgccgatacgcaggtgggggcgctgagctcgacccagttgggcgcactgacagcgaccggcttctcgaccctcaacggcacccaggtcgctgcgctcaacagcacccagctcaagggtctgacgaccacccaactgaaggggctgaccaccaccgacatcagcgagctggctgacacccaggtggccgccctgacggcggctcagatcgcagcgctgtcggcgaccaacgtgtctgcgctcaacgccacccaggtcaccgccttgaccacgacgcaggtcaagggcctgaccgtggatcagctgaagggtctgacgactaccgacatcggcgaactggccaacactcagatcggggccttggcgaccagccagctggtcgcactgtccacgaccaacctctcggctcttaatgccacccagatggcggccctgaccgtgacgcaggtcaagggtctgagcgttgaccaggtgaaggggctttcgaccacggacatcggcgaactggccgatacccaggtcggcgctctgaccaattcgcagatcggggccttggcgacgacccaggcgcaacagttgaccaccacccagctgtccgccctgaccggcgcccagttgggcgctctgacggtcacggccttctcgacgctggacgccacccaggtgggcgcgctgacgagcacccaggtcaagggcctgggcacaacccagctggcggctctgagcacgacggatatcggccagttcgccgacacccagatcgcggcgctcaccacgcagcagctcggcgccctgtcggcgaccaacctgtcggcgctggacgccacccagactgccgcgctgtcgacgacccagctcaggggtctgtccaccacgcagctcaagggcctgagctcgacggacgtctcggacctcagcgccacccagatcggcgctctggcctctacacagcttggcgctttgaccacgacggttatcaacagcctgaccacgacccagatcggacagctgcagaccacccagatctccggcttgacgacgacccagctggacttcctctcgacgaccaatatcgaggcgatgaccagcacccaggccaacgctctgaccgccacgcaggtgcaaagcctgagcgacgcccaggtcagctcgtacctgaccgtcacctga

SEQ ID NO: 40537 - DNA, 1164 bp, Caulobacter crescentus
gtgtcgctcgccgatcccgaactgatcgaggccctgcgccacacggtgcggtcgctgtgccgcgacttccccccgccctattggcgcggcctggaccgcgagaaggcctatccgaccgacttcgtggccgccatgaccaaggccggcctgctgggcgttctgatccccgaggaatacggcggcggcggccttggcctgacggcggcggcggcgatcctggaagaggtccacgccagcggcggcaacgctgcggccctgcacgcccagatgtatacgatgggcacagtcctacggcatggatcgacggcgcagaaggaaacctggctgccgcgcatcgccgatggttcgatccgccttcaagccttcggcgtcaccgaacccacggccggcaccgacacgacctcgatctcgaccttcgcccgccgcgagggcgacacctatgtgatcaacggccagaaggtctggacgagccgggcagagcactccgacctgatggtgctcttggcccgcaccacgcccaaggaccaggtgacgcgcaaggccgacggcctgtcggtgtttctggtcgacatgcgcgccgcgctcggccagggcctgacgatcaagccgatcgccaccatgctgaaccacgccacgaccgaggtgttcttcgacaacctcgtcattccggccgacagcctgatcggcgaagagggcaagggcttccgctacatcctcgacggcatgaacgccgagcgcatcctgatcggggccgaatgcctgggcgacgccgcctggctgatcggcaaggcgcgagactacgccaacagccgcgtcgtcttcggtcgtcccatcggccagaaccaaggcgtgcagttcccgatcgcccgcgcctacgcccagacccacgccgcgcgcctgaccatctatgacgccgcggcgcgctatgacgcgggccagccctgcggcgagcaggccaatatcggcaagatgctggcctccgaggcttcgtgggcggcggctgacatgtgcctgcaaacccacggcggcttcggcttcgccgaggagtacgacatcgagcgcaagttccgcgagacgcgcctctatcaggtggcgccgatctcgacgaacctgatcctggcctatgtcgccgagcatgtgctcggactgccccgctcctactga

SEQ ID NO: 40538 - DNA, 1200 bp, Caulobacter crescentus
atgaccgccgcctatatctgtgacgggatccgcaccccgatcggtcgctatggcgggtcgctctcaaaggtgcgcgccgacgatctggcggcgatcccgctgaaggccttggtcgcgcggaacccgagtctggacctggctgcgatcgacgagatcgtcctgggcagcgccaaccaggcgggcgaggacaaccgcaacgtcgcccgcatggccctgctgctggccggctatcccgtgtcggttccgggcgtgaccgtgaaccgcctctgcgcctcgggcctggaggccgtgggctacgccgcccgcgccatcgcctcgggccacaacgacctcgtcatcgccggcggcgtcgagagcatgagccgcgcgccgttcgtgatgggcaaggccgacagcgccttctcgcgcagcgccgagatcttcgacaccaccatcggctggcgcttcgtgaacccggccatgcgcaagctgtacggcgtcgactccatgcccgagacggccgagaacgtcgccacggactatggcgtcaaccgcgaagaccaagacgctttcgccttgcgtagccaagcccgcgccgccgccgcccaggccaacggcttcctggccggtgagatcacgccggtcgagatccccggcaaggcgggtccgacgatcgtcgaccgcgacgagcacccgcgcgagaccaccatggaggccctggccaagctgaagccgatcgtccgcgagggcggcacggtcacggccggcaacgcctcgggcgtcaatgacggcgcggtggccctcatcatcgcctccgaggacgcggtgaagcgccacggcctgacgccccgcgcccggatcaccggctacgccagcgccggggtcgagccgcgcgtgatggggatcgggccggttcccgccgtccgcaagctgatggccaagacgggtctcgccatcggcgacttcgacgtcgtcgagttgaacgaggccttcgccgcccaggggctggccgttctgcgccagctgggcctgcccgacgatggcgcgcatgtgaacgccaacggcggcgccatcgcgctgggccatccgctgggcgcgtccggcgcgcgcctggtcctcaccgccttgcgccagctagaagccatcggcggccagcgcggccttgccaccctctgcatcggcgtcggccagggcgcggccctggccttcgaacgcgtctag

SEQ ID NO: 40539 - DNA, 1659 bp, Caulobacter crescentus
atgtatcagtacgatctcatcgacaaggaattcctggccgaccgctcggccgagttccgggggcaggtcgcccgccgtctctccggcgagttgaccgaggaccagttcaagccgctgcggctgatgaacggcctctatctgcaactgcacgcctacatgctgcgggtggcgatcccgtacggctcgctgaactcgacccaggcccgccgcctcgcgcagatcgcccgcgacttcgacaagggctatggccacttcaccacgcgccagaacatccagttcaactggatcaagctgaaggacgcgccggagatcctcgacaagctggccgaggttgatctccacgccatccagaccagcggcaactgcatccgcaacaccacgtccgacccttacgccggcgcgacggccgaggaggtcgatgatccgcgcgtgtggtccgaggtgatccgtcagtggtcgaccctgcacccggaattctcgttcctgccgcgcaagttcaagatcgccatcaccgcctcggccaaggaccgcacggcggccaaggtgcacgacatcggtctgatgctgcgcaaggggcgtgacgggacgctcggctttgaggtgatcgtcggcggcgggcaggggcgcacgccctatgtcggcccgaccatcaacgagttcctgccgaccgaccgcctgctgagctatctggaagcggtgctgcgcgtctacaaccgccacggtcggcgcgacaatatctacaaggcccggatcaagatcctggtcgccgccctcggcgccgaagagttcgcccgccaggtcgacgaagagtgggccaagatcgacgccgcccgcgccgacctgccgaccgcagaactggcccgcatccgcgccgccttcgccaagaccccgttcgagaccttgccggcgcgctctgacgcctttgaaaccgccaaggccaatgacgcggccttcgcgcggtttgtgcgcaacaacgtcaagccgcacaagcagccgggctacgcgatcgtcgaggtctcgctgaaggctcaggagcagacgccgggcgacgcttcggcgcagcagctcgaagtggtcgccgatctcgccgaacggttcagcctgaacgacctgcgggtcacccatgcgcagaacctcgtcctgccgcacgtgaagctggacgacctgccgacggtgttcgcgacgctgcaggcgtccaatctcgcaacgccgaacatcgacctcgtcagcgacatcatcgcctgcccgggcctggactattgcgccctggccaacgcccgggcgatcccggtcgcgcaggacatcgcgcggcagttcgcggacctggatcgcgccgaaaaggtcggcgagctgaagatcaagatcagcggctgcatcaacgcctgcggccaccaccacgtggcccacatcggcatcctgggcgtcgataagaagggcgaggagttctaccagctgtcgctgggcggctcgggcgccgaagacgcctcaatcggcaagatcctgggcccggccttgccggccgacaaggtcgccacggcggtcgatcagctggtcggcgcctatctcaacgttcgaaacgacggcgagcgtttcctcgacacctatcgccgggtcggcctcgagcccttcaaggaggcggtctatgcccaagctgattga

SEQ ID NO: 40540 - DNA, 735 bp, Caulobacter crescentus
gtggcctacgaccagacgagcgcgacggctccaggccttgccgcccggctggacgccgagctgcgcgacgcccatcccagcgagatcctccgcacggcccatgagcacttcggcgacaagctggcgctggtgtcgtcgttcggcgccgagtcggcggtgctgctgcatctggcctcgcgcgtctcgccgggcctgccggttctgttcctcgacaccgggatgctgtttggccagacgctggactatcgaaagaatatcgcggcccagttcggcctgaccgatgtccgcgatctgcggccggctttcgcggacctggcgacccaggaccctaactccgacctctggcgcaccagcgtcgacggctgctgccacattcgcaaggttctgccgctggatcgcgcgttgggcggcttcgacgcctggatcaccggtcgcaagcgcttccacggcggtgatcgcctgagcctgccagtggtcgaagaggccgacggcaagatcaagttcaacccgttggccaactggtccaaggccgagctcgacgcctatgtcgccgaacatgacctgccggcccacccgctggtggcccagggctatgcctcggtcggctgttggccgtgcacgcagccttccgacgacggaaggtccgggcgctgggcgggtcaggaaaagaccgagtgcggcatccacgtcgcgcgggcgcccggtgtcgcgccgaacgtgggcggggatatctga

SEQ ID NO: 40541 - DNA, 588 bp, Caulobacter crescentus
atggcgttgcggatctatggcgactcgatttccggcaactgcctgaaggtcaaatggaccgctgatcggctcggcatcgcctacgactggatcgagaccaacgtcctgaccgccgagacgcgcacctcggcgttcatggccttaaaccccgctggccaggttcctctggcggtgtttccggacggccgaccgctggcgcaatcgaacgcgatcattttccatctggcggaaggttcggatctgatccccggcaacgccttcgatcgcgcgaagatgctcgagtggatgttctgggagcagtatagccacgagccctatatcgcggtcgcgcgcttccaggtgctctacctgggcaaaccggtcgagagccttgagccgcgcctcatcgagcgcggagcggacgcgcttgcgcgcctcgaaacacagctgcaacgatcaacatttctggtcggggacaagctgaccctggcggatgtcgccctggtggcctacacccgcgtcgcgcatgagggtgggttcgatctttcgctctatccggccgttgaggcgtgggtggggcgcgtcgaagccgatctcggcattagataa

SEQ ID NO: 40542 - DNA, 1755 bp, Caulobacter crescentus
gtggaatcgcggttcgccaagctctatggcgcggatgcgcgcggccccgccgtcctcgaacgcctgaagaccaatcttctcaaagccgcccatgcgcggccagagcccctgcgcgcgctcgatgcggcgcgggcggccgatcccgcgtggctgcacgcgccggggcagaccgcctacaccttctatgtcgatcgcttcgccggcgatctcaacggcgtccgcggcaagctggactatctgaccgagctgggcgtgcgctggctccacccgctgccgctgctggaaccgcgccccggcgacagcgacggcggctttgcggtcgccgactatcgcaaggttgatccgcgcctgggcacgatcgacgaccttgaggccctggccggcgaccttcgccagcgcgacatgggactgatccttgatgtggtgtgcaaccacacggcccgcgagcacgcctgggcggccaaggcccgcgcgggcgaccccgcctatcgcgactactacatcgtgcttccggatgcgcagagcgccgccgcgcgcgatcgcgagctgatcgacgtctttcccgacaccgcgccgggcagcttcacctacgacgcggcgatgggtggctatgtctggaccaccttctatccgttccagtgggacctgaactacgccaaccccgccgtcttcgccgagatgctggaggtgttgatcttcctggcggccaagggcgcccaagggttccggctcgacagcgcgccgttcctctggaagcaggcgggcaccacctgtcgcaaccttccgcagacctacgagattgttgaagcctggcgcgcggcgctgtcgatcgtcgcgccgggcgtcgtgctgctggccgaggcgatcgagagcgtcgaggacgttctgcccttcttcggcggtgaggagtccggctgcaacctcgcctacaacaacgtggtcatgacggccctgtgggcggcgttggccgacggcgatgcggtgatcgcccggcgctgcctggcggtcgcggcgcgcaagccggcccagggcgcgtggctcaactatgtgcgctgccacgacgatctgatctggaacgccctggcggcctatgccccggccagtgacctgcgacgttggtcaaacgcctatgggaatggcgagggcttctcgcgcggtcgcgccttccagaccgccgaagggggcgttccgtcgaccaacggcatggcggccgcactggccggcctcactgctgacgccgatggcgactgcctcggcgcgcggcggcttcgcttgctctacgggatcatccacgcgctggacggctggccgctgatctatatgggcgacgagatcggtctcgataacgacgaggcctatcaggacgacccgctgcgcgccggcgacggacgctggctgcaccgcccgcagatggactggtcgctggccgagcgtcgaggcgaggccggcgcgctgcaggccgacctgttcgccaccttcgccaggctgggccagcgcgcgcggcgcctggcgaccctgggcgtcgccggtcctgcgcggccggttgaagtgtcctcgccggctgttctggctttcctgcgcgatgaaggcgcgcggccgttcctgtgcgtcgccaatgtctcagatgcgccgcaagacttcgaactgcccccggcgttcgcccaaggcgccgaggacgtgcttgatggcgccccctcccccgccggagccgtcagcctgccgccctatggcatcacgtggctggtcgcccgatga

SEQ ID NO: 40543 - DNA, 870 bp, Caulobacter crescentus
atgaagggcatcattctcgccggcggctcgggcacccggctgcatccgatgaccctggtcacgtccaagcagctgatgcccgtctacgacaagccgatgatctattatccgctgtcgacgctgatgctggcggggattcgcgagatcctgatcatctcgacgccgcgcgatacgcccaacttccaggcgctgctgggcgatggctcccaatggggcctcgatatccagtacgccgtgcagcccagcccggatggcctggcccaggcctatgtgattggcgcggatttcgtcggccgtgatccctcggcgctgatcctgggcgacaatatctatttcggtcacggcatcaccaatctgttcacgcgggcgatggcgcggcccaagggggcgacggtgttcgcctatcacgtcaacgatcccgaacggtacggcgtggtcgagttcgacaagcagatgaccgcactctcgatcgaggagaagccgaaggttcccaagtcgaactgggcggtgacgggtctgtacttctacgacggcgatgtggtcgacatcgcgcgggacctcaagccgtcggcgcgcggcgagcttgagatcaccgacgtcaatcgcgcctatctggagcgcggcgacctgtcggtggagctgatgggccggggctacgcctggctcgacaccggcacgcccgacagcctgctggaggccgccgagttcgttcgcgtgctggaaaagcgccagggcttcaagatcgcctgccccgaagaggtggcctaccagaagggcttcatcgacgccgcccaggtggagcgcctggccgacgccttgggcaagagcgcctatggcagctatctgcgtaccgtgatcggcgtccgctag

SEQ ID NO: 40544 - DNA, 987 bp, Caulobacter crescentus
atggcgggcctcgccccgagcgatcttggctccatagagacggagccgaccatgtcatcccaatccaccgcgccgcccatcgcgatcctcagcaaggttctcaaacgccggggcccgaccctggcgctgaatggcctggacctggacatccgtcccggacagtgcgtggccctgctggggccgaacggcgcgggcaagagcaccagcgtggccctgctgaccggccgcctgcgccctgacgccggcgaggcgttcctgttcggcggtgatcccaggaccctggccagccggggccgcatgggcgtgatgctgcagagcgccgggctgcccggcgccttgagcgtccgcgagcagatcgacctcttccgcggttactatcgcaagcctcgctcgctggatgaggtggttcgcttagcgggtctggaggggctggagaagcgccgttgcggcgcgctgtcgggcggtcagcaacgccgcgtccagttcgctctggccatcgcgggacggcccgatttcctcgtcatggacgagccgaccaccggcatggacatcgacgcccgccgggcgctctggagcgcggtgcggtccgagatcgcgcgcggctgcgccgtgctgctgaccacgcaccatctggacgaggccgaggccctggcggaccgcatcgtggtcatcgaccacggccaggtgatcgccgacggtacgcccgaagccatcaagtcccgcgtgtcgggtgtcgcgatccgctgccggacgcgcctttccgaccctgagctggcgtcgctggcgcgggtcaccggcgtcagccgcgacggcggcaaggtcacgctgctgaccacctcggcccccgccaccctgcgcgagctgctcgcgcgcgatgaaaccgtggatgacctgacggtctccggcgcgtcgctggaagacgccgtcgatcgcctcgtccaagccggccaagcggccgccctgcaacgtcaaaccaaggtcgcctga

SEQ ID NO: 40545 - DNA, 1215 bp, Caulobacter crescentus
atggggctatttgataagcacctggcctatcgcgatgcgtacaaggccatccaggatgtgggtgcgaaccccttcaaggtgcgctttgacgctgtccactcgccgactgaaggcgtggtcgatggccgtcccaccatcctgctgggaacgaacaactatctgggcctgacctttgacgagcaggcgatcgccgcctcggtcaaggcggtacaggaacgcggcaccggcacgaccggttcccgcatcgccaacggcagcttcgagtcgcacgtcgagctcgagcaggagttggccaagttctatggccgcaagcacgccatggtcttcacgaccggctatcaggccaatctcggcgtgctgtcgaccctggtcggtcgcggcgaccacctgatcctcgacgccgacagccacgcctcgatctatgacggctcgcgtctgggccacgccgaggtcatccgcttccgtcacaacgatcccgaagacttggccaagcgcctgcgtcgcctgggcgatgcgccgggcgagcgcctgatcgtcgtcgaaggcatctattcgatgatcggcgatgtcgcgccgctgaaggaaatcgccgccgtgaagcgcgagatgggcggctatctgctcgtcgacgaagcgcactcgatgggcgtgctgggcgcgaccggccgtggcctcgccgaagcggcgggcgttgaggaagacgtcgacttcatcgtcggcaccttctccaagagcctgggcgccatcggcggtttctgcgtctccgaccacgacgacttcgacgtcatgcgcgtcatctgtcgtccctacatgttcaccgcctcgctgccgcccgcggtggcggcctcaacggtgacggccctgcgccggatgatcgagcagccggagctgcgcgaccgcctgaaccgcaacgccaagcgcctctatgacggtctgaccgccatgggcttcctcacgggtcccagcgccagcccgatcgtggcggcgaccatgcccgaccaggaacgcgccatcgccatgtggaacggcctgctgcaggccggcgtctatctgaacctggccctgccgcccgccacgccggacagccgtccgctgctgcgcgccagcgtcagcgccgcccacaccgacgagcagatcgacgccgtgctcaagacctacggcgaaatcggcgcggccctgggcgtgatcgaaccgctcaagcgcgcccgcgcctga

SEQ ID NO: 40546 - DNA, 1566 bp, Caulobacter crescentus
atgctggccaaggcccggcagccgaagatcgaagccaatatgccggtgacctgggccaagggcccgcaagcgccgccggcggacggtcagcggccgcccaatatcgtgttcattctcgccgacgacctcggctacaacgacattacgctgaatggcggcggcgtcgcgggcggcacagtacccacgcccgccatcgactcgatcgccaaggagggggtcaccttcgccaacggctacagcggcaacgccacctgcgcgccctcgcgcgcggcgatcatgaccggccgctatgccacgcgctttggctttgagttcaccccaacgcccgtggccttctcacgcgtggtcggcggccatgccggcgatcctctgcacccctcgcgcttcaatcaagccgaggtgaagaacatgcccaaggacgagaacgtcctggccgtgcccgccgccgaggtgacgatcgccgaggcgctcaagaccaagggctatcacaccattcacctgggcaagtggcatctgggcggcgtcaaaggttcgcgcccggaggatcagggttttgacgaaagcctcggcttcatggcgggcgccgcgctgttcgcgccggtcggggaccccggcgtggtggagtcgcgccaggactgggatccgatcgacaagttcctctggggcgcagcgccgttcgccgtgcagttcaacggcggcaagctgttcaatcccagccactacatgaccgactacctgacagacgaagcggtgaaggcgatcgacgccaacaagaaccggccgttcttcatgtatctggcctacaacgccgtccacacgccgttgcaggcgcccaaggccgactatgatgcgctgtcgcacatcaaggatcaccggatgcgcgtctatgcagccatggtccgcaacctcgaccgcaacgtcggcaaggtgctgcaggcgctgaaggaccgggggctggacgacaacaccctggtgatcttcacctcggacaacggcggcgcgaactacattggcctgccggacatcaacaagccctatcgcggctggaaggcgaccttcttcgagggcgggatcaaggtgccgttcctgctgcgttggcccgagcagctgccggccggcgcagtctatcgcagcccggtgggccatgtggacatcttcgccacggccgccggcgccgccggtgcgcccacacccaaggatcgggtgctggacggcgtcgacctcgtgccgttcgtgaagggacagtcctcgggcgatccgcacaaggcgatcttctggcgttcgggcggctacaagacggtgctcgcaggcggctggaagctgcaggtggccaaggagccaaacaagacctggctctttgacctgtccaccgatccgaccgagcgccaggagctgtccaaggcgcggcccgagaagctgcgtgagatgcaggcgatcatggcgcagctggacggacagatgatgaagccgacctggccgtcgctgatttcgggcgccttctatatcgaccatccgggcggccagaaggccaagcccagcgacgagtacatctattgggaaaactga

SEQ ID NO: 40547 - DNA, 1641 bp, Caulobacter crescentus
atgcctgaccggcggaggttcgctggtcgttggggaaacgcacacatggccggaaacaggctatttttgaaaaagtcgatcgcgagcatccagaaggaggccgcgcatagccagcttaagcgtacgctgggtcccatcaatctgatgagcctgggcgtcggcgccatcatcggcgccggcatcttcgtgctgacgggtcaggtggcctcggccaacgccggccccgccatcatgctgtcgttcatcgtcgcgggcatcgcctgcgccctggccggcctgtgctacgctgaactggcctcgaccatgccggtttcgggctccgcctacacctacgcctacggcaccctgggcgaggttttcgcctggatcatgggctggctgctcgtgctcgagtacggcgtggccgcctcgaccgtggcggtcggctggtcgggctatgtggtcagcaccctgcacgccctggggatcaacttcccgatgatccaggtcgccggcgctgacgccccgatgtgggcgacgccgctgatccaagccgtggccgcgcccggcggtggcacgatgttcgccatgaccggcacgctgaacctggtggccgccatcggcatcgccatggtctcggccctgctggtggtcggcgtcagcgagtccgccaacgtcaacaacgccatcgtggtcatcaaggtgatcgtgctggtcacgttcatcgcggtcggcgcgcagtacatcaatccggccaactggcaccccttcatccccgagccgaccggtcagcccggcgagttcggcatcggcggcatcttccgcggcgccgccatcatcttcttcgcctatgtcggcttcgaagccgtttcgaccgccgccgccgaggccaagaacccctcgcgcgacgtgccgatcggcatcctgggcgccctgatcatctgtacgctgatctacatggccgtggccgccgtcatgactggcgtcgtccccttccgtgaactggccagcccggccccgatcgccgtcgctatcgaccgcatgggtctggaatgggccgacatcccgtacgccgcggctgagggcggcaagctgaacctgctcagcttcgccatcaagatcggcgccatcacgggtctgtcgtcggttatgctggtgctgtgctacggccagacccgcatcttctacaccatggcccgcgacggcctgctgccgaaggtgttcgccgagatccaccccaagttccgcaccccctggctgggcaccatcctgctgggcgtggtgatcgccatcgccgcctcgttcctgccgatcagcctgctgggcgatctggtgtcgctgggcaccgccgtggccttctcgatcgtctgcctgtcggtgatctatctgcgcatcaagcaccccgacctgccgcgtccgttcaaggtgccgggcggcatcttcacggcggcggccggcatcgcggcctgcttgttcctgccctatcagaacttccagccgatgatcgttcacgcgatgaacgacaatccgctgccgctgatgatcctgggcggttacgccgccgtcggcgcaatcatctatatcgcctacggctactggcactcgaagctggccaagggtatcgacatcaccgaagagaccgacccgaactcgcccgcctag

SEQ ID NO: 40548 - DNA, 2442 bp, Caulobacter crescentus
atgctgccgatcgagaatgtcctgcccgcgctgaaggcggcgctgctcgcaaacaacgcgaccgtcttggtcgcgccgcccggcgcgggcaagacgacggctgttcccttggcgctcctggatgcgccgtgggtcgagggccgcaagatcatcgtcctggagccaaggcgtctggccgcccgcgccgcggccgcgcgcatggcgtccaatctgggcgaatccgtcggcgatacggtcggtttccgcgtcaggctgcagtcgaaagtctcggcccgcacgcggatcgaggtcgtcaccgagggcgtgttcacccgcatgattcttgacgatcccggtctggacggggtcgcggccgtgttgttcgacgagttccacgagcgcagcctcgacgcggatctgggcctggccttcgcccgcgatgtccagagcgtgctgcgcgaggacctgcggctgctgatcatgtcggcgacgctggacggcgcccgcatctcctcgcttttgaatgatgcgccggtcgttgagagccaggggcggatgttcccggtcgatacgcgctatctgggtcgcgacgagcgccagcggctggaggagcgcgtcggacgggcggtcgagcgggctctggccgaggagagtggatctatcctcgtatttctccccggccagggcgagatccgacgcgcggaaagctggctgaatgagcgcctgcgccgttccgacgtcgatatcgcgccgctgtatggcgcgctggagccggcggcgcaggatcgcgcgatctctccagccccggccggccgacggaaggtcgtgctggccacctcgatcgccgagaccagcctgaccatcgagggcgtgcgcgtcgtgatcgatgcgggccaggcgcgtgtgccgcgctttgatccggcctcggggatcacgcggctggagaccgtgcgtgtcagccgcgccgccgccgaccagcgccgaggtcgcgccggccgcaccgaacccggcgtctgctaccgcctgtgggacgagcccgagacgcggtcgctgcccgccttcgcccggcccgagatcctggaggcggacctgtcgcgtctggcgctggatctggcgcgctgggggaccaaggaccccagcgacctgaccttcctcgacccgccgcccgccgccgccttcgccgaggcccggaccctactgatgcgcgtgcaggccctcgacgcacagggtgacctgaccgctcacggcaaggccctggccgacctgccgctgccgccgcgtctggcccacatggtcgcgcgcggcgcagcctcgggccaggcgcgagaggcggccgagatcgccgccgtgctgaccgagcaggggctgggcgggcgcgatgtcgatctacgacgacggttggagggcctgcaccgggaccgctccccgcgcggccgtgacgccatggccctggtcgagcgttggagccgcgcggcgggaagatcatccggcgccaagccgctagaaatcgggttgctgctggccgaggcctatcccgagcgggtggccaaggcgcggggcaagcccggcgagttccagctggccggcgggcgcggcgtctatctcgaaccgaccgatccgctggcccgcgaggcttggctggcggtcggcgagctgggcggcggcgacagccgcgaccgcatcctgctggccgccgccgttgatgaggcgcagctgcgcgagaccttcgccgaccgcctcgtcgccgaggaccgcctggagaccaccggcggcaaggtccgcgccaagcgcctgctgcgcctgggcaagctcgtcctggaagagcgactgatcgaaaaccctgatccggcgatgattgccggcgcgctcttggaccaggtccgcgccgatggcctctcggctttgcgcctgggcgagcggggcagggcgctgctggaccgcgtggccttcctgcgcgacgttgatggcgaggcctggccggacctttcggagagcgccttgatcgaacgcctcgacgagtggctggagccgctgctggccggtcgctcgtcgctgtccagtcttgacgaggggacgctgtacgatgcgctgaagaccctcgtgccgtgggatcttcagcggaagatggacgccctgctgccggcgcgcttcgaagcgcccacaggcaacagcttcgccatcgactattccgctgaaggcggcccccgcgtcgaggtgcgggtcggggagctctacggcctctccgaacatcccagcgtcgccggcggcaaggtgccgctgacgctctctctgctctcgcccgcccaccggccgatccagatcaccaaggacctgccgggcttctggaaaggctcgtggcgcgaggttaaggtggagatgaaggggcggtatccccggcatgtctggccggatgatccggcggccgccgcgccggtgacgcgggcgaagccgcgggggacgtga

SEQ ID NO: 40549 - DNA, 885 bp, Caulobacter crescentus
atggtccagtctcacttcaagggcgtcattccggccctcgtcacgccgttccgggacggtgaggtggacgaaaaagcgttcgtggcgctggtcgagcgccagatcgccggcggtgtgcatggtctagtccccgtcggtacgacgggcgagacctcgaccctgtcgcacgaggagcaccgccgcgtcgtcgagttgtgcgtgaagaccacggcgggccgcgtcccagtgatcgcgggcgcgggcagcaattcgaccgatgaagccatcgaactggcccgtcacgccaagaccgtcggcgccgacgcctgtctggtggtgacgccgtattacaaccgccccagccaggagggcatgtatcagcactacaaggcgatcaacgacgccgtggagctgccgatctttgtttataacgtgccgggtcggaccggcgtcgacatcagcaacgacacccttgagcgtctcgccaagctgccgaacatcgtcgggatcaaggacgccacgggcgacctgacccgcatcagcttccagcgcctgatgtgcggccccgaatgggtgatgctgtcgggcgatgatccgaccgcgctcggctacatggctcatggcggccacggtgtgatctcggtgacgtccaacgtcgcgccagacgcctgctcggccttcatgaacgcctgcatgcagggcgaatgggagaagggtctctactggcaggaccgcctggtgcgcctgcacaaggccctgttcctggattcctcgcccgccccgaccaagttcgccatggcgcaactgggcctgtgcacggaagatgtgcgcctgccgatcacggcctgcgccgaaggggtgcgccccgcgatccttgaggccatgcgcgaggctggtctgcgctga

SEQ ID NO: 40550 - DNA, 1524 bp, Caulobacter crescentus
atgacacaagtcttcccgactcccgccgcccatgcccgcgagatcctggccaagctgggcgcgccgccgctgcccgccgacgccggagagcctgtgcgcggcccgatcgacggcgcgatcctgggccatgtcgtctacgacgacgcccggcagatcgaggccaaggtcgctgccgcctgccgcgccttcgccgactggcgcgtggtccccgccccgcgtcgcggcgagctggtccggctgttcggcgaagagctgcgcgcggccaaggccgatctggccgccctcgtcaccctggaagccggcaagatcgcctccgaggcggccggcgaggttcaggagatgatcgacatctgcgacttcgccgtgggcctgtcgcggcaactgcacggcctgaccatcgcctcggagcgccccggccacgccatgcgcgagacctggcatccgctggggccggtggcggtgatcagcgccttcaacttccccgtcgccgtctgggcctggaacgcctgcctggccttggtctgcggcgatccggtaatctggaagccgtccgagaaaaccccgctgacggcgcttgcgacccaagcgatcctggagcgcgcgctcgcccgcttccgcgacgcgccgcagggtctctcctcggtcgtgctgggcgcccgcgacgccggcgagcgactggcgcgcgatccgcgcattccgctggtcagcgccaccggctccacccgcatgggccgggccgtcgcccccatggtcgccgagcgcttcggccgctcgatcctggagctgggcggcaacaacgccatgatcgtcacgccctcggccgacctgtcgctggccttacgcgccatcgtcttctcggcggcgggcacggcgggccagcgctgcacgtccctgcgccgcctgatcgtccacgagagcctcgtcgacaaggtcagcgacgcggtcgaggccgccttccagcgcctgtcggtcggcgatccgcgcgatcccaagaccctgctgggcccgctgatcgacaaggccgcctatgacgcctttatcgcggcgatgaaccaggtccgcgccgagggcggaagcgtcgccggcggcgagcgcgtgctgatcgacgaacaccccgacgcctactatgtgcgccccgccctcgcccgcctgcccgcccccgcgccctgcatgcagcgcgagaccttcgcgcccttgctgcacgtcgtgccctacaacagcttcgacatggccatcgcgattcagaacgacgtgccccaggggctgtcctcctgcgtgatgaccaacgacgtccgcgaggccgagcgcttcctggccgccgccggcagcgactgcggcatcgccaacgtcaacatcggcccctcgggcgccgagatcggcggcgcgttcggcggcgaaaaggaaaccggcggcggccgcgagagcggctccgacagctggaagcaatatatgcgccgccagaccgcgacggtgaactactccggcgccctacccctggcgcagggggtgcggtttgatctgtag

SEQ ID NO: 40551 - DNA, 1035 bp, Caulobacter crescentus
atgggcggcgggagtcgggaagacttgtgtcatggcgcgaggacacgccggggcggggaggcggtcaagtccccaggcggccgagcgccgttgcgagtctcgcgcccagaggctagggacgggcaacgcaggagaacccctatggcgcaggcgaaactcatcgacggcaaggccttcgcggccgatctgagggccaagatcgccgaggaggtcgccgccctgaaggctgagcatggcgtgacgccgggcctggcggtcgtgttggtcggcgaggatccggccagccaggtctatgtccgcaacaagggcgagcagaccacggcggcgggcatgtattccgagacccatcgcctgccggaaaccaccactcaggacgagctcctggccgtcgtcgccaagctgaacgccgatcccaagatccacggcgtgctggtgcagtttccggtgccgccgcacatcagccagatggacgtcgtggccgccctgtcgcccgacaaggacgtcgacggcctgaccgtgaccaacgccggccgcttggccagcggcctgccggccctggcgccctgcacgccgaccggctgcatgatgctgatcagggacgcgatcggcgacctgaagggcaagaccgccgtcgtcatcggccgctcgaacctgatgggcaagccgatggcccagatgctgctggccgccgactgcaccgtcaccatcgcccactcgcgcagccaggatctgccctcgatcgtgcgtcaggccgacatcgtggtggccgccgtgggccgggccgagatggtcaaggctgactgggtgaagcccggcgccgtggtcattgacgtcggtatcacccgcttcccggcccgcgatcccgaagccgccgccgccggcaagacccggcttgtcggcgacgtcgccttcgacgaggttagggaggtcgccggcgcgattacgccggttccggggggcgttggaccgatgacgattgcttgcttgctggccaatacgctgacggcggccaagcgcctgtcggggatcgcctga

SEQ ID NO: 40552 - DNA, 1491 bp, Caulobacter crescentus
atggcgcaagacctgatcctggccctggaccagggcaccaccagcacgcgcgccatcctgttcgatcgggcggggacggccctgggcgacgcctcgcgtcctctgcgtcaaagctatccggccgacggctgggtcgagcatgacgccgaggagatctacgccgccgccgtcgctgtgctgcgcgaggtcaccgaggcctccgggcggatggcggacatcgctgcgatcggcgtcaccaaccagcgcgagaccgtggtcgtctgggatcgggctacgggccgtccgatccatccagccatcgtctggcaggatcgccgcaccgctgacgtctgcgcgcgcctcaaggccgaggggcatgagccgagggtgaccgaggttacgggcctgctgctcgacccctatttctcggcgaccaagatcgcctggatcctcgacaagacacccggcgccagggcccgggcggaggccggcgagcttttgtgcggcaccatggactgctgggtgatctggcgactgacgggtggcgccgtgcacgcgaccgacgccaccaacgcttctcgaaccttgctgttcgatatcggcgctcaggcctggtcgagcgagatgctggcgttgttcaatgtgccctcgacgatcctgcccaaggtgctggactgcgtcgacgactatggcgcgacgcaggccgacatcctgggccgcgaggtccccattcggggcgtggcgggcgatcagcaggcggcgctgatggggcagggctgtgtcgctccgggccagatgaaggccacctacggcaccggctgcttcatgctgatcaatacggggactgaccgcgccgtctcgcgggcgcgcctgttgaccaccgtcgcggcgcgggtcggcggcaagacgacctacgcgctggaagggtcgatcttcgttgcaggcgcggcgatccagtggctgggcgaggggctcggaatcacgggcggtccccgcgccgctgaggcgctggcccgggcggccaagccggatcacgcggtggtggtggttcccgcgttcacgggtcttggcgccccctggtgggacgccgaggcgcggggtgggatcttcggtctgacgcgcgatgcaggactacccgagatcgccgccgccaccttcgacgcctgtgcgctgcagagccgcgacctgatcgaggcgatgcgcgccgatgcgcccacggcctttggcgaagcggcgcaactgcggatcgacggcggtatggccaagagcgcctggttctcgcagcggctggccgatctcacggggctctcggtgcgccgcgccagctatcaggagaccacggccctgggggcggcgttgttcgccgccgtcggcgcgggtctctacgggtcgatcgaagaggccgccgaagccagtccagccgccgagaccttagcgccggccatggacgaccatgtgcgggaagccgcctacgcccgttggctcgacgcggtgccgcgcgttcgactttag

SEQ ID NO: 40553 - DNA, 1044 bp, Caulobacter crescentus
atgaccactcgacgcgccatgctcggcgcaggtgtcgccctgatcgctggggcgcaagggtttgcggcccaggcgagaggcgccggctcccccaagatcggccgtatccgccggttgtcgccggagctggatgcggttgtcgacgccaacgcgccaatcgagcagctgaccgacgggatcacctgggcggagggaccggcctgggtcgcgaacggaagctatctgctgttctccgacgtgcccggcaacgtgatgcaccggtgggacgcaaagggcggcaagaccgattttctgcggccctccggctatgatggtccgcccaccaagatcttccgcgaggccggcaccaacggtgcgatcatcagcacggccggtgaactgctggtctgcgactgcggcaaccgcgccgtggcgcggatcgacctttcgacgcgcaagaagacgctgctggccacgaccttcaacggcaagaagttcaacagccccaatgatctggtcgaggttcgtcacggaccgctgaagggctcgctctatttcaccgacccgccctacggcctcgaagggggggatgcgtcgccggccaaggagcaggccttcaacggcgtctacctgctgcgcccgaacggcgaggtcgccctggtcgatgggtcgctgagcttccccaacggggtgggcctgtcgccggacggccggcgtctgtatgtcgccatctccgatcccaagcgtcccgtgatcatggcctatgacctgggcgccgacgggcttccgaccgcgtcccgcgtcttcttcgacgcctcggacctgctgaaggccggcggccccggcctgccggacggcatgaaggtcgacgcccagggacggctcttcgccagtggccctggctgcatcatgatcctgacgccggacgccaagctgctgggcgtgatcgagaccggcttcccggcggccaattgcgtattcggcgaggacggcgggacgctgttcatcacctccaaccatctcgtggcgcgggtgcgcaccaagaccaaagggctggggcgctag

SEQ ID NO: 40554 - DNA, 840 bp, Caulobacter crescentus
atggccttgaagcaatttaacccgaccagccccggccagcgcggcctggtgctgatcgaccgcagcgaacttcacaagggtcgccccgagaagaagctcgttgaaggcctgaccaagtcgggcggtcgcggcggcaatggccgtatcgcggtccgtttccgcggcggcggcgccaagcgcctgtaccgtctggtcgacttcaagcgccgcaagcaaggcgtggctacggtcgttcgtctcgagtacgaccccaaccgcaccgccttcatcgccctgatcaagtatcaggccgacggtgagctggcctacatcctggccccgcaacgcctgaaggccggcgacgaagtcgtcacggctgaaaaggtcgacgtgaagccgggcaacgcctcgccgctgcgcacgctgccgatcggtacgatcatccacaacatcgagctgaagcccgccaagggcggtcagatcgcccgttcggctggcgcctacgcccagctggtcggtcgtgacgccggctacgcccagatccgcctgaactcgggcgagctgcgcatggtgctcgatacgtgcatggccaccgtcggcgccgtttcgaaccccgaccacatgaaccagaacctcggcaaggccggtcgttctcgtcacatgggccgtcgcccgcacgtccgcggtgtcgccatgaacccggtcgaccacccccacggtggtggtgaaggccggacctcgggcggtcgccacccggtgaccccggctggtaagccgaccaagggcgccaagacccgcgtcaacaaggccacggataagttcatcatccgctcgcgccacaaagcgaagaagggccgctaa

SEQ ID NO: 40555 - DNA, 1623 bp, Caulobacter crescentus
gtgggcgacgaagcgattcatctgggcgactacgactacatcgtggtcggcgccggctctgcgggatgtctgctggccaatcgcctgtcggctgatcctcggcggcgggtgctgctgctggaggcggggggcgacgacaactggatctggtttcacgtcccggtcggctacctgttcgcgatcggcaatccccgcgccgactggatgctggagaccacgccgcaggcggggctggacggacgggttctggcctatccgcgcggcaaggtgatcggcggctcatcggcgatcaacgccatgatctatatgcgcggccaggctcgggactatgacggctggcgacagcggggccttgcgggctggggctggccggatgtgctgccttactttctgaagcacgaagaccacatcgacccgcgcggcgagcatcatcgggccggcggcgagtaccgcgtcgagcacccgcgcgtgcgctgggatgtgctggacgccatccgtcgcgcgggtgagcaggccggtatcgcccaggttgacgacttcaacggcggcgacaacgcgggctcgtcatacttccaggtcaaccagcgcgccgggcgccgctggagcacagccacggcctttctgaagcccgtcctgtcgcgtcccaacctgcggctggtgaagggcgttgaggtcgagcggctcattatcgacggcaagcgggtgcggggcctgcgcgggcgtcggggtggagcggcggtgaccgccagtgtgtcgggtgagttgatcctggcggccggcgcgatcggttcgcccgtgatcctgcagcgctcggggatcgggcgcggcgagaccctgtcgcgcgccggtgtggcgatggttcacgatctgccaggcgtcggggccaatctgcaggaccatttgcagatccgacctgtgttcaaggtcagcggcgtgaggacgctgaacaccgactacgccaacctcttccgccgagcaggtatggggttggactatctgctccgacgctcgggtccgctgaccatggcgccgtcgcagttggggatgttctgccgctcggggcctgagtacgagagcgccaatctggagttccatttccaaccgctcagcctggaccgctggggggaggggctgcaccggttcggcgcggtgaccgccagtgtctgtaacctgcgtccaagcagccggggcgcggtctccctctccgggccgggcctggagcactcgccaaggatcgatcccaactacttggcgaccgaggaggaccgccgcgtggccgtcgagtccctgaagtgggcgcggcggatcatggggcaggcggccttggcggcctatgcgccggaggcgttccggcccggtccggaggtggacggcgacgcggcgctgcttgccgccgcgaaggcgctggcgacgacgatcttccacccggtcggtacggcggccatgggcgcggatggtgatcccctggcggtgctggacgcgcggctgcgcgtgcgtggcgtcgagggtctgcgtgtcatcgacgcctcggcgatgccgaccatcacctcgggcaacaccaacgcgccgactgtcatgatcgccgagaagggcgcggcgatgatcctggaggattcccgctga

SEQ ID NO: 40556 - DNA, 783 bp, Caulobacter crescentus
atgtcatcgcccctgcacaagctctttgacctgacgggccgggtggcgatcgtgacggggggctcgcggggtcttggtctgcagatcgcccgggcgttggcggagtatggcgcagcggtggcgctggtcgcccgcaagcaaggcgaactggacgccgccgtcgcggccctgaccgccgaagggcgcaccgccgtgggtcttgtggccgatctcgggcaggcgggctcagcgcaagacctgaccgcgcgcgtgctcgagcgtttcgggcggatcgacattctggtcaacaacgccggcgccgcctggggtgcgccggccgaggactatccgcttgagggctggaacaaggtcatggatctgaacgtcaccggccttttcctcctcacccaggccgtcgcccgcgaggcgttcctgaagcagggcaagggggcggtcgtgaacgtcgcctcgatcgagggactgcagggacaccatcacagccagctcggcaccatcgcctacaacacggccaagggtgcggtgatcaacatgacccgggcgttggcggcggagtggggaccaaggaacatccgggtcaacgcggtggcgccaggctacttcccctcgaagatgaccatgacgaccctgggccagcacggcgacgacatgctgcgccagacgccgcttggcaaactgggcggggacactgacctgatggggccggcgctcctgttggcctccgacgccggcggccacatcaccggtcagatcatcgtcgtcgacggcggcatgacgatcatctga

SEQ ID NO: 40557 - DNA, 1500 bp, Caulobacter crescentus
atgcgcgacattccccatttcatcggcggccagaaggtcgacggagcctcgggccgtttcggcgaggtgttcgaccccaacaccggcaaggtccaggccagggtggccctggcctcggccggcgaactgaacacggccatcgccaatgccaaggtcgctcaagccgcctgggccgcgaccaatccccagcgccgcgcgcgggtgatgttcgagttcaagcgcctgcttgaagtccatatggacgaactggcggcgctgctgtcgtccgagcacggcaaggtcatcgccgacagcaagggcgacattcagcggggcctggaggtgatcgagttcgcctgcggcgtcccgcatcttctgaagggcgagtacacccagggcgcgggtcccggcatcgacgtctattcgatgcgtcagccattgggcgtcgtagcgggcatcaccccgttcaacttcccggccatgatcccgatgtggatgttcggcccggctatcgcgacaggcaacgccttcatcctgaagccttctgagcgtgatccctccgtgccggtgcgtctggccgagttgatgatcgaggccggcctgccgcccggcgttctgaacgtcgtccacggcgacaaggactgcgttgaggccattctcgaccatccggacatcaaggccgtcagcttcgtgggcagttcggatatcgcccagtcggtgttccagcgcgccggcgcggccggcaagcgggtccaggcgatgggcggggccaagaaccatggcctggtcatgcccgatgctgatctcgatcaggccgtggccgacattatcggtgcggcctacggctcggccggcgagcgttgcatggccctgccggtcgtcgtgccggtcggcgagaagaccgccaccgccctgcgcgagaagctggtcgcggccatcggcggccttcgggtcggcgtctcgaccgatccggacgcccattacggaccggtggtcagcgccgcccacaaggcgcgcatcgaaagttacatccagatgggcgtcgatgaaggcgccgagttggtcgttgatggccggggcttttcgctgcagggccacgaggaaggcttcttcgtcggtccgaccctgttcgatcacgtcaagccgaccagtcgctcctatcacgacgagattttcggcccggtgctgcagatggtccgcgccgaaagtctggaggaggggatcgcgctggcctcgcgccaccagtacggcaatggcgtggcgatcttcactcgtaacggcgacgccgcgcgcgagttcgccgaccaggtcgaggtcgggatggtcgggatcaacgtcccgatccccgtgccggtggcctatcacagcttcggcggctggaagcgctcgggctttggcgacctcaatcaatacggcatggacggcgtgcggttctacacccgcaccaagaccgtgacccagcgctggcccaagggcggggcggtgctggaccagagctttgtcatccccaccatgcggtga

SEQ ID NO: 40558 - DNA, 1215 bp, Caulobacter crescentus
atgaatctcgacttctcgcccgaggacctcgccttccgcgacgaggtccgcgcctttatcgccgaaaactatccggccgggctgcgcgacaagcaggaggagggcgaggagatggccaaggaggatttcctctcctggcaccgcgttctcgccaacaagggctgggtggcccccgcctggccgacccagtacggcggaccgggctggacctcggtgcagcgctatatctggtcggaagaaaccgcccgcgccgactgcgtgccgatcctgccgttcggcatcaacatggtcggcccggtgatctacaccttcggcacgcccgagcaaaaggaacgcttcctgccggggaccctgtcgggcgacatctggtggtctcagggctacagcgagccgggcgcgggttccgacctcgccagcctgaagaccaaggccgagcgcttcaccggtgatgacggcaaggaatactacctggtcaatggtcagaagacctggaccaccatggcccagcacggcgactggatcttctgtctggtccgcaccgacccgaacgccaagattcaggaaggcatctcgttcctgctgatcgacatgaagtcgccgggcgtgaccgtgcgtccgatcatcaccctgggcggcgagcacgaggtcaacgaggtctggttcgagaacgtcaaggtgccggtcgagaaccgcatctacgacgagaacaagggttggacctgcgccaagttcctgctggctcacgagcgctcgggcatcgccggtgtggcgcgctccaagcgcggcatcgagcggatccgccagatcgcctcgaccgagctgagcgacgacggcgacgcgctgatcaaggatccgatgttcaagcgcaaggtcgccgagctcgagatcgacctgacggcgctggagtacactgaactgcgcaccctggccggcgaagccgcgggccgcgggccgggtccggagtccagcgtgctcaagatcaagggcaccgagatccagcaacgcctgaccgagttggcgctagaggccgctggtcactacggcgcgccttacttccggggcttcccgaaggacggcgacaacgcccatccgatcggtccggagttcgcgcaccgcgccgcgccgacctatttcaacgtccgcaagacgtcgatctacggcggctcgaacgaaatccagcgcaacatcatcgccaagatggtgctgggcctctaa

SEQ ID NO: 40559 - DNA, 1932 bp, Caulobacter crescentus
ttggcgcatcgactgggtgacgccaggcggtggcgtacagaccaccttgctgatccgaagggatgggcgatgagggggttgggcggcccgccgtctcctggacgcgaggcggtcgccggcgcggtcgcgaaggccgaccagccgatccgcttctggaaggcgatgagcgacctgctccaactggtgctgcgatcccaggcgccgggtttgcgctggcgtctgaccgtcgccttgcttctgacgcttaccggcaaggtgctcggcgtcctggcgccgttgatgctggggcaggcggtgaaccagctctccgtcggtcagggcgttgcggtgacggtcaccctggcgttcgcgagtctggcgatcggctgggcgctggtgcgatttatctcggcggcggcgccccaggcgcgagacacgatcttcacgccggtcgcccaggcggcccagacccgcgcggcggtcgagaccttcgcgcacgccctgtcgctgtcgatcgattttcatcagtccaagcggaccggctcgctctcgcgggttatcgatcgtggcgcgcggtcgatggattttctgctgcgaggtctggtgttcaacctcgcccccaccgggatcgagctgatcctcgccgccgtggtgctggccaaggcctacgattggcggttcgccgctgtggccttggtgacggtcgcgatctacggctacgtcaccttcgccatctcggactggcggatcggccaccgtcgggcgctcaatgaagccgacgccgaggcggccggccgcgcggtcgatgcgcttctgaactacgagaccgtgaaatcgttcggtggggaggcgagggcggtcgccagttacgagcgcgcgctggacacctatggacgcgccaatatcaaggcgacccagtcgctcaatctcctgaatctcgttcagtcgggcgtgatgagtgtgggcttgggcgtgatggcggtgctggccggatccgaggccgcgcacgggcgcatggggcccggcgacgtcacggcggccgtactgatcctgatcaacctctacgcgccgctgaacatcctgggcttcgcctaccgcgaaattcgccagtcgctgatcgacatggaggcgatgcttgacctgcgtcggcaggccgccgacgtcgccgacgctccggacgcccaggacctgccgccgtgcgccgaccagagaggcggggcggtggcgttcgaagcggtctctttccgtcacggcgcgcggtccgaggggctgagcgaggtgtcgctgaccgtcgcgccgggctcgactgtggccatcgtgggcccgtcgggcgcgggcaagaccaccctggtgcggctggccctgcggatgatcgatcctcagtcggggcgggtgacgctggacggctatgacctgaaggctctgaagcagagctcgcttcgccgggccgtcgccctggtgccgcaggacgtggccctcttcaacgacaccctggcggccaacatcgccttcgcacggcccgaggtgggtgaaaccgaggtctgggcggccgccgaggcggcggaactgggtgactttattcgcagcctccccgaaggcatggcgacaaaggtcggagagcgcggtctgaagctgtcgggtggcgagcgtcagcgtgtcgggatcgcgcgcgctctgctggcggagccgcgagtgctgatcctggacgaagcgaccagcgcgctcgacagccgcaccgaagccgccatccaggcgaccttgcgcaaggcgagggcggggcggacgaccctggtcgtcgcgcatcggctgtcgaccatcgccgacgctgacgagatcgtcgtgctgcgccggggcaagatcgttgagcgcggtcgccatgaggccttgttggcggccggcggcgaatacgccgcgctctggcgtcgtcagacgcgggaccgcgagacggtttag

SEQ ID NO: 40560 - DNA, 1752 bp, Caulobacter crescentus
atgacccaggccgcccccgcgtccgttccgtggcccgccatgtccgtccagcaggcctatgcgctgatcacacagcctggaaccccgggcgagatggaagaggtcgagatccggggcgtgaagactcgcacctggaagaacgcgccgccgaccctgcgcgagaccctgctgatgggccgctcccacggcgacaagatattcctggttcacgaggacgagcgggtcaacttcgaggccttctatcgcgccgtcacacatatggcggcggaactggaatcgttcggtgtccagaagggcgatcgcgtcgccatcgtcatgcgcaacctgccggaatggccggtggccttctacggcgcgctgtcgctcggcgcgatcgtcacgccgctgaacgcctggtggacggggccggagctggagtacggcctggtcgattccggcgccaaggtcgcgatcgtcgatgtcgagcgctacgagcgcatgggcgagcacctgcataactgtccagacctcaagcgcgtctatgtcagccgcgcgaaggaggagatcacccatccgtacgtgatcccgctggagtccaagatcggcggcgcgaacgactgggccaagctcgacgagaagccgctgccgacggtggcgatcacggccgatgacgacgccacgatcttctacacctcgggcacgacgggtaagccgaagggcgccatcgcgacccaccgcaacatcaacagcaacatcttcgccgccgccgccgccggggcgcgcgccttcctgcgccggggcgaggcgccgccccagcccgatccgagcgcgccgcagaagggcgccttgctgtcggtgccgttcttccacgcgacgggctgcttcgccgtgctgaacccgtcgctgttcgccggcgccaagctggccatgatgcgcaagtgggatcccgagcgcgccatgcaggtgattcaggacgagaagctgacccagatgggcggcgtgccgaccatcgcctggcagatcatcgagcatcccaatcgcgccaactacgatctctcctctatcgaagccgtcgcctatggcggcgcgccgtcggcgccggagctggtccgcaagatcaaggagatctggcccaagtcatcgccgggcaatggctggggcatgaccgaaacctcggcgacggcgaccagcaactcggccgaggactatgaaaaccgtcccgacagctgcggccccgccgtgccggtcaccgacctgaagatcatgacggtcgaggcgccgtatcgcgagctgccgatcggcgaggtcggcgagctgtggtgcaaggggccgcaggtcgtgcgcggctattggaacaagccggaagccaccgcccagaccttcgtcgacggctgggtgcggacgggcgatctggcccgcctggacgccgaaggcttctgcttcatcattgaccgcgccaaggacatgctgatccggggcggcgagaacatctactgcatcgaggtcgagaactgcctctatgaccacccggcggtcatggacgccgccctggtcggcgttccgcacaagactctgggcgaagagcctgccgccgtcgtcaccctgaagccgggtgcggaagccacggaggccgaacttcgcgccttcgtcgccgatcgcctggcggccttcaaggtgccggtgaaggtggtgttctggcccgagaccttgccgcgcaacgccaatggcaagatcatgaagaacgaactcaagaaggtgttcgtggaggggtag

SEQ ID NO: 40561 - DNA, 888 bp, Caulobacter crescentus
ttgagtcacgagatcatgcggctgtcagcgttcgccccggccaaggtcaatctgttcctgcatgtcggcgggccggacggggagggctatcatccgatctccagcctgatggtgttcgccgatgtcggcgaccgggtgaacctccagcccgccgacgcgccggcgttcgagacgtccgggccgttcggggatcagattcccgccggcggcgacaatctggtggtccgcgcaggccaggctttccacaggcggctcggcggtccggttccgccttatcggctgatcctggagaagcacttgccgatcgctgcgggcctgggcgggggctccagcgacgcgggtgcggcgctcaagctgttgcgtgacgccctggccccggcgctttccgatgacgatctggaggcgctggctgcgagccttggcgcggacggcgcggcctgtctgcgcgcgcgcgcccttatcgcagaagggcgaggcgagcggctgtcgccggcgccgcggttgcccgagttgaacgcagtgctggtcaatcccggcgcgccgtcgccgaccggcgcggtctatcgcgcctatgacgcgggcgtgcacccagacggcgccgccatgccccccatgcccgaccatctggagagcgctgaggaggccgccgcctggttggcctttgcgacacgcaacgacctggaggcgccggccgtgaggcttgagccgcacatcggcgaggtgctggacgtgctgcggggcgagccggaaagtctgctggtccgcatgtcgggttcgggtgcgacctgtttcgcgctctgcgccagcgatatcgaggccgaaggtctggccgagcgcctggagacgatgcgtccggactggtgggtgcggcgctgccgcctgagctga

SEQ ID NO: 40562 - DNA, 1005 bp, Caulobacter crescentus
atgaccacgccgcccctcgccccctatccgcacacccgcctgcgccgcgtgcgccagagcgactgggtccgtcgcctggtccgcgagaccgaggttcgcccgtccgacctgatctggtcgatggtggtgcacgagggcgaaggaaccatcccggtggcctccatgcccggcgtcgaacgcctgtcggtgaaggaagccgccaaggccgccgtccgcgcccgagatctgggcatcccggccatcgccatcttcccgcatatcgacgggtcgcggaaagacgcggccggctcgatcgccgccgatccggacggggtgatcccccgcgcggtcaaggccatgaaggacgccgcccccgaggtcgggatcatgtgcgacgtggcgctggaccccttcacggaccacggccacgacggcgtggtcgagggcggcaagatcctcaacgacgccacgatcgagcgcctgatcgaacagggcctgatgcaggccgatgccggcgccgacattctggcgccgtccgacatgatggacggccgcatcggcaagctgcgcgccgcgctggaaggcgcgaactatcaggacgtgatgatcatgtcctacgcggccaaatacgcctcggccttctatggcccgtaccgcgacgccatcggctcggccaagctgtcggccggccagggcgacaagaagacctaccagatggacccggccaataccgaggaagccatccgcgaagtcgccctcgacatcgccgagggcgccgacatggtcatggtcaagccgggcatgccttatctggacatcctgcgccgcctggtcgaggagttccgcatgcccacctacgccttccaggtgtcaggcgagtacgcgatgatcatggccgccgctcagaacggctggatcgacaaggaccgcgccatcctggaaagcctgaccgccttcaagcgcgccggcgcggccgggatcatcacctatttcgcaccctgggcggcggagaagctgggggcttga

SEQ ID NO: 40563 - DNA, 1140 bp, Caulobacter crescentus
atggatttcgcgctgaacgaagatcaagtcgcaatccaggacgccgcccgcgctttcgccgaaggacagcttgccccgcattcggccgactgggacgaaaataagcacttcccggtcgacgtgctgcgccaggcggccgagctgggcttcgccggcatctatgtgaacgaagacgttggcggcagcgggctttcgcgcctcgacgcctcgatcattttcgaggcgctcagctatggcgatgtgccggtcgccgcgtatctcaccatccacaacatggcgtcgtggatgatcgaccgcttcggctcggacgatctgcgccagcgctatctgccgcgcctgacgaccatggagctgatcgccagctactgtctgaccgaaccgggctcgggctcggacgcagcggcgatgcgtacaaccgccaagcttgacggcgaccactatgtcctcaacggcggcaaggctttcatttcgggcggtggcgtctcggacatctatgtcgtcatggcgcgcacgggcggcgagggggccaagggcgtctcggccttcgtggtcgagaagggtatggaggggctgagcttcggcgccaatgagcggaagatgggctggaacgcccagccgaccgctcaggtcaatttcgacaactgccgcgtgccggtcgccaaccgcatcggccaggaaggcgaaggcttccgcttcgccatgatggggctggacggcggtcgcctgaacatcgcgtcgtgctcgctgggcggggcccagttcgcgctcgacacagccaaggcgtatctcgagacccgcaaccagttcggccgcccgctgaaggacttccaggccttgcagttcaagctggccgacatggcgactgaactggaagccgcccggctgatggtgcgccgcgccgcccacgcgctggacagcaagcaccctgaagcgaccaagctgtgcgccatggccaagcgcttcgccaccgacgccggcttccaggtggccaatgacgccttgcagctgcatggcggctacggctacctccaggactatccgctggagcgcctcgtccgcgacctgcgggtgcaccagatcctggaagggaccaacgagatcatgcgcgtcatcatcgcccgcgagatgttccgccaatga

SEQ ID NO: 40564 - DNA, 1227 bp, Caulobacter crescentus
atggactacaaagccgcgttccgcagcgccgttgagcagatccgcgaagagggtcgctaccgggtgttcgccgacctgaagcgtcagcgcggccagtttccgcgcgcgacctggacgcgccaggacggttcggaacatgaagtcgttgtctggtgcagcaacgactatctcggacaaggccagaatccggtggttctggaggccatgaaggccgccgttgacgagcacggttcgggttccggcggtacgcgcaacatttcgggcaccaaccatgaccacgtcctgctggagcaggaactggcggatctgcacggcaaggaagccggcctgctgttcacctcgggctatgtctcgaacgaggcgacgctctcggtggtccagaagattctgcccggcctgatcatcttctcggacgaactgaaccacgcctcgatgatcgctggcatccgcaacggcggtggtccgcgcaagatcttcaagcacaacgacctggcgcatctcgagcaactgctggccgaagcgccggctgacgcgcccaagctgatcgccttcgaaagcgtctactcgatggacggcgacatcgccgacctcgccggcaccgtggccctggccaagaagtacggcgcgatgacctatctcgacgaggttcacgcggtcggcatgtatggcccgcgcggcggcggtgtcgccgagcgcgatggcctgatgggcgagatcgacatcatcgaaggcacgttgggcaaggcgttcggcgtgatgggcggctacatcaccggcgacgccgaggtgatcgacgccattcgcctgatggcttcgggcttcattttcacgacgtctctgccgccggccctgacggccggtgcgctggccagcgtccgctggctcaagcagcaccccgaggttcgcgagatccaccaggagcgcgcggcgaccctgaaggccatgttcaaggcggcgggcctgccggtcatggacagcgtcagccacatcgttccggtgctggtcggcgatccggtccactgcaagatgatcagcgatatgctgctggccgatttcggcgtctatgtgcagccgatcaactatccgaccgtgccgcgtggcaccgagcgcctgcgcttcaccccgacgccgttccataccgacgacatgatgcgcaagctggtcgcggcgatggagaagctttgggcccactgcaacgtcgcgcggatgggcggctacgcggcctag

SEQ ID NO: 40565 - DNA, 969 bp, Caulobacter crescentus
gtgcgaagcgttgtaacgggcgtcggcgcctatctgccgtccaaggtcgtgaccaatgacgacctggcgaagtttgtcgacaccagcgacgagtggatcgtcgagcgcaccgggatccgtcagcgccatcaggcggcggacgatcagcctgtttcggatcttgcgttcgaggcggccaaggaagccctggcggcggcgggcaagacggccgcagacgtcgatctgatcatcgtggcgacgacgaccggggatcttaccttccccgcgaccgctacgatcgtacagcgcaagctgggcgcgccggtcggcgtcgccttcgacgtccaggccgtctgctctggcttcgtctacgccatgagcgtcgccgacggcttcgtcgcgcgcggccattccaaatgcgcgctggtgatcggcgctgaagccatgacccgcctgatggactggagcgatcgcggcacttgcgttctcttcggcgacggcgccggcgcgatcgtgctcgagccgggggaaggcgaggggaccaccgatgaccggggcatgctgggcttcgccctgcgcgccgacgggaccaagcaggatctgctgtatgtcgacggcggcccgtcgacgaccggaacggtcggcaagctccggatgctgggcaatcaggtcttcaagcacgcggtcgtcaatatctccgaagcgattcacgccgccgccggcaaggcgggcgttgcggtcgccgatgtcgactggttcattccgcaccaggccaatcagcgcatcctccaaggcgtggcgcatcgctgcggcattgacgaggaaaaggtcatctcgaccgtggccatccacgccaacacctcggccgcctcgatcccgctggcgttcgcgcacgggatcaaggacggccggatcaagaagggcgacttgctgcttctggaggcgatgggcggtgggctgacctggggcgcctgcgtcgtccgtctctag

SEQ ID NO: 40566 - DNA, 954 bp, Caulobacter crescentus
atggcgaacgctcccaaggtcttcatcgacggcgaagccggcaccaccggcctgcagattcgtgagcgtctggtcggtcgcaccgatctgcagctgatctcgatcgatccggacaagcgcaaggacgccgacgcacgcgccgagatgctgaacagcgccgacgcggtgatcctgtgcctgcccgatgacgcggccaaggaagccgtctctctggtcagcaatccgaacacggtgatcatcgacgcctcgaccgcctatcgcacggccgagggctgggcctacggctttgcggagctcgacagcgagcagcgcggcaagatcgcggcctccaagcggatctccaatcccggctgctatccgaccggcgcaatcgccctgacgcggccactggtcagcgccggcatcctgccggccgagctgccggtctcgtacaacgccgtctcgggctataccggcggcggcaaggcgatgatcgcccagttcgaggatgagagcgccgccgaccacacccgggcgccgtacttcatctacggcctctcgctgagccacaagcacgtgccggaaatgcagaagcacggcggtctgctgacccgtccgatcttcacgcccgccgtcggccgctacgcccagggcatgatcgtcgagatgccgctgcatctctcgaccctgaatggcgcgccgtcgctggccgacatccatgcggcgctggtcaagcactacaagggcgaggcgttcgtcgaggtcgcgtcgctggacgaggccaaggcgctgacgaccctggaccccgagggcctgaacggcacgaaccgcctcaagctcttcgtgttcggctcggacgccggaggccaggcgcgtctggtggcgctgctcgacaacctcggcaagggcgcgtccggcgcggcggtgcagaacctgaacatcgcgctcgggctggatgaggccgcaggcctgtag

SEQ ID NO: 40567 - DNA, 1221 bp, Caulobacter crescentus
atgagcaccgatttccaccgtatccgtcgcctcccgccctacgttttcgaggaggtcaacaagatcaaggcccggcttcgcgccgagggcaccgacatcatcgacttcggcatgggcaatcccgacatgccgacgccgcagcatatcgtcgacaagctgatcgagaccgcgcgcgatcccaaggctgggcgctattccgcctcgaagggcgttccaggccttcgcaaggccatggccaactattatggccgccgctttggcgtgaagctgaacccggacaccgaggtcatcgccacgctgggctccaaggaaggcttcgccaacctagcccaggccctgacgggaccgggcgacgtgatcatctgcccgaacccggcctatccgatccacgccttcggcttcatcatggccggcggcatcatccgccacgtgccggcgctgtcgcccgaggagtatctgtccaacatcagccgcgcggtgaagcactcggtgccgccgcccagcgtgctgatcctgtcctacccgtcgaacccgacggcccagtgggtcgacctggacttctacaaggacgccgtggcgctggcgaagaagcacgacctgctggtcatcagcgacgtcgcctatggggaaatctatttcgacaacaatccgccgccgtcgatcctgcaggtggacggggccaaggacatcgccgtcgaagtgaactcgctgtccaagacctacgccatggccggctggcgcgtgggcatggtggtcggcaacgcccgcatctgcgcggcgctcgcccgcgtgaagtcttatctcgactacggcgcctatacgccggtgcaggtggccgccgcgacggccctgaacggtccccaggattgcgtcgacgagatccgcggcatctacaagagccgccgcgacacgctgatcaagtcgatgaaggccgcgggctgggacatcccgaacccgccggcctcgatgttcgcctgggccaagatccctgaagcctatcgcgaagccggctccatgctgttctcgcgcctgctgatcgaggaggcgggcgtcgccgtcgcgccgggcatcggctttggcgagtacggcgaaggctatgtgcggatcggtctggtcgagaatgagcaccgtatccgccaggccgcgcgcaacgtgaagaaattcatcgccaacgccgactccatcctggccaaggcccacaacaagatggaacaggcctaa

SEQ ID NO: 40568 - DNA, 1290 bp, Caulobacter crescentus
atgacgaacaagacctggcgcgtcggcgtcgcgggcctgggtacggttggcggcggtctcctgcagttcctggcggaacggcccggcttcgcgccggccggcgacctggccgtcgtgacggcagtgtccgcccgctcgaagtcgcgcccgcgcacggtcgacatctccaacctcgtctggttcgacgaccccgtggccctggccgcctcgccggagatcgacatcttcgtcgagctggtcggcggctcggatggtccggccaaggccgccgtcgagaccgcgctgaaggcgggcaagccggtcgtcaccgccaacaaggccctgatcgccgagcacggcgccgagttggccgccctggccgaagccaccaacaccccgctgctgttcgaggcggcggtgatgggtggcgttcccgccgtgaagatgatgcgcgaggccctggtgggcgacgacatcatctcggtggccggcatcctcaacggcacctgcaacttcatcctgtcggagatggagaagaccggtcgctcgttcgccgacgtgctgcgcgaggctcaaggcctaggctatgccgaggccgatccgaccatggatgtcggcggcttcgacgccggtcacaaggtcagcatcctggccgcgctggcgttcggttgcgcgcccaacttcgccgccgccgagatagagggcatcagcgaggttgatctgctcgacatcaagctggccaaggacctgggctaccggatcaagctgatcgccggcgcggccaagtccgaggatggcgtagcggtgaaggtgcatccgtcgctggtgccgctggatcatccgctggcccaggccggtggggcgctcaacgccctgttcatcgagggcaagcgcatcggccggatcttcctgcaagggccgggcgcgggcgcgggtcctacggctgcggcggtcgcggccgacatcgccgacgtgatgaccaaggctgtgcgcccggtgttccaggcgccggccggcgacctgaagcccttcgtctcgatcgatccgtccaaggcggtgggcaaggcctatctgcgcgtgatggtgcaggaccagcccggggtgatcgcggcgatctcggaaaccctggccgaatgcggcgtgtcgatcgacagcttcctgcaaaagcctgtcgaaggggcgggtggggtgccgatcgtgctcgttacccatgcgacgccagaatcaaacctcctggacgcgattagccgcatcgaaaagctgcagaccgtgctagagcgtccgcgccttctgcgcgtcgcgcgcatctaa

SEQ ID NO: 40569 - DNA, 1011 bp, Caulobacter crescentus
atgggccgctctgctttcggttcgaggacgagaatgactgcttttgtcgacctggccgcccggctcgcggccgagccggcggacgccgccctgaaggacgtggtcctgaccatcgccgagacgtgcgcgcagatcagccgcgtcgtggcctcgggcgccctgtcgggaagcctgggcgcggcgggcagcaccaacgtgcaggacgaagagcagaagaagctcgacgtcatcaccaatgacatgctgagcgacgccctgaaggcctgcggtcccgtggcgggtctggcttctgaagagctggaagaggtcgagcccacgggtcgtgtcggcggctatctcgtcaccttcgatccgctggacggctccagcaatatcgacgtcaacgtctcggttggaacgatcttctcggtcttgcccgcgccggccggccatgcgccgaccgaaggtgacttcctgcagccgggccgcaaccaggtggcggcgggttatgccgtctacgggccccagacgatgctggtcgtcacgctgtcgggcggcgtcaacggtttcacgctcagcgccgacggccgctggttgctgacccacccggacctggccatcaagccggacaccgctgagttcgcgatcaatatgtccaatcagcgccactgggcgccagctgtgcgccgctatatcgacggctgcctgcagggcaaggacggcgcgcggggcaagaacttcaacatgcgctgggtcgcctcgatggtggcagacgtccaccgcatcatgatgcgcggcggggtcttcatgtacccctgggatgcgcgcgagccggacaagcccggcaagctgcgcctaatgtacgaggccaatccgatgagccttctcgccgagcgggcgggcggcaagtcgatcgaaggcctgaacgaaatcctggatatcaacccggccaagctgcaccagcgcgtgcccgtcgtcctgggctcggccaatgaggtcgaggtcatccgggccgagatgcgcgccggctga

SEQ ID NO: 40570 - DNA, 1110 bp, Caulobacter crescentus
atgccgtccacgtccaccgctcacctcgtcaccctgcccgttccgaccgatgatctgcggatcgagaaactccagaccctgagcccgccggctcaggtcatcggagaagctcccgccacctcgtcagtggccgagatcgtcggcggggcgcgtcaggcggttcatcagatcctgcacggccaggacgaccgcctcgtcgtggtcatcggcccctgctccattcacgaccccaaggcggcgatcgactacgcccggcgcctcgccgccgagcgcgagcgccacgcgggcgaactggaagtgatcatgcgggtctatttcgagaagccgcgcacgaccgtgggctggaagggcctgatcaacgatccgggcctcgacggcggcttccggatcaatgacggcctgcgtctggcgcgacgggttctgctggacgtcagcgcgcagggcctgccggccgcctgcgagttcctggacgtgaccaccccgcagtacatcgctgacctggtatcctggggcgcgatcggcgcccgcaccaccgagagccagattcaccgcgaactggcctcgggcctttcctgccccgtcggtttcaagaacggcaccaatggcgatgtgaagatcgccgtcgacgccgtaatggccgcgtcccagccgcaccacttcctggccgtcaccaaagagggccgcgcggcgatcgccaccacgacgggcaatggtgactgtcacctcgtgctgcgcggcggcaagaccccgaactacgacgccgccagcgtcgccgccgccgcagaggttctgagcaaggccggactgccgcagcgcctgatggtcgatgtcagccacgccaacagcggcaagaaccatgagaaccaacccgccgtgatcgccgacgtctgcgcccaggtcgcgaccggcgcctcgccggtcatgggcgtgatgatcgagagcaatctcgtggccggccgccaggatatcgtccaaggccagggcctgacctatggtcagtcggtcaccgacgcctgcgtcgactgggaaacctcggtgcggctgctggacgacctggcgggcgcagttcgcgcgggtcgcctggcgcggggctctaaatcaagcacttag

SEQ ID NO: 40571 - DNA, 2175 bp, Caulobacter crescentus
atgagccacagcctcgccctgcatcgtgacctggaggccttcgttcggcgcgacgacgccgggcgagggcgcttcgaactgctcgtgcgcggcgcgcgctgcgccggctgcatcagcaagatcgaaaaggcggtgcgcgcccttccgggcgtggaggcggcgaggctgaacctgacgaccggcaagctgtcggtcgagctggccggcaagatctctgatccggggcgcgtgctggaaaccgtcgaggacctcggctatcgcgcctgcctgttcgacccggccgaagccgaggcggcgcaggacaaggagggcaaggaactggccctcgctctcggcgtcgcgggtttcggcgccggcaacgtcatgatgttcaccgtgccggcctgggcgggcctgttcggacaggaactgacccctgccacgctgaccctgatgtactggatggcggcgatcgtcgccacgccctgcgcactgttcgccggccgcccgttcttccgctcggcctgggcctcgctgcggcgcggcaaggccaatatggacgtgccgatctcgatcggggtgatcctgaccctgatcgtcagcttctccgagacccttctgggcgggaagcatgcctatttcgacgcggcggtgacgctgctgttcctgctgctgatcggccgctacctggaccaccgtctgcgggccggagcgcgttcggcggcgcgggatctgctggcgctgcaggcgccggtcgccaggcgcctgaccgatggcgtcgagcaaggcgttcccgtcgcggacatccgcgtgggcgacctgttggcggtcgcgcccggcgagcgcatcccggtcgacggcttggtcgagcaaggcgcttccgaactggacaacgccctgatcaccggcgagacggcgctggcgcccgtcgccgccggggcccgactgcacgccggcgcgctgaacctatcgggtcgactggttatgcgggcctccgcgcgcagcgaggactccacgctcgccgccatcgcccgactgatggaagccggcgcccaggcgcgctcgacctatgtgcggctcgccgacaaggccgccgcgctctatgtccccgtagtccacacggcggcggcgctgaccttcgtgggcggttgggcgctggggctggggccgcgcgaggcgctgctccgcgccgcagcggtgctgatcgtgacttgcccgtgcgccctgggcctggcggtgccggcggtccagatcgcggccagcagccggctgtttcgcagaggcgttctggtcaagtccggggcggctctggagcgtctggccgaggccgatcacgttgtcttcgacaagaccggggtgctgacgcaagggcgtccggcgctgatcgacgcgcccgcccatctggtggcgcaggccgcgccgctggcccgcgcctcgcggcacccgctggcgcgcgccctggcggccgaagccggcgcgggtcctgtggcgcaggactgcgtcgagacggctgggcagggcgtggagggcgtgatcgacggtcgccgcgctcgcctggggcgcgccgcctttgtcggcgtccaggcgggcgatgttcgggagaccgagctgtggttcggcttcgagaacaacgtgaagatccgcttcgctttcgaggaccgtccaagagccgacgcccgggatacgatcaccaagcttcgggcgctgggcctgtctgttgagatcctgtcgggcgacgtcgagggtccggtccgcgacgtggcgcgcgaggtcggggtcagcgattggcgcgcgggcctcacgcccgtcgagaaggcggcggcgatcgatgcgttgaaggcgcagggccgaaaggtgctgatggtgggagatggcctcaacgacgccgccgccctgtccaaggcgcacgcctcgatggcgccaggcgcggcggtggatgcggcccagaacgccgccgatctcgtctttaccggtgacgaattggcggcggtcgtcgagtcgatcgagaccgcccgggaggcgcgccgacgggcgctggagaacttcggtttctcggcgctctataatctcgtcgccacgccggcggcgatgttcggactggtcaatccgttcgtggcggccctggcgatgtcgggctcgtcgattgtggtgttgctcaacgcggcgcgtccgcgtcttcggagtttcaaccgatga

SEQ ID NO: 40572 - DNA, 1551 bp, Caulobacter crescentus
atgggcggcaagtggttgggcgcggcgatcgcgctactggccgtggcgacgagcgcgcgggcgggcgaaatcagcgcgacggcgacgctgcgggccgatcaatcgggtccggcgatctcgcgctacatctacggccagttctccgaacatctgggcgcgggcgtctatgacggcatctgggtcgggccggattcgaagattcccaatgtccgaggcgtccgcagcgacgtcgtcggcgcgctgaaggcgatcaagactccggtgatccgctggccgggcggctgcttcgccgatgagtaccactggcgcgacggcattggcccgcgcgacaagcgtccgtcgcgcaagaacaactggtggggcggctcgcctgagaccaacgccttcggcacccacgagttcatggatttcgccgagcaggtcggcgccgacccctatgtcgccgtcaatgtcggctcgtccaatccgaccgtgatgcgcgagtggatcgagtacatgacctcgccgggcgaagacaccttggcccaggagcgccgcgccaacggtcgcgacaagccctggaaggtgccgttcatcggcatcggcaacgagagctggggctgtggcggggagatgacgccagagtactacgccaatgagtaccgtcgcttctcgtcattcttccacaagaacagcgacaatccggcggtgcgcgtggcgtcgggcgccaattcattcgacgtgaactggaccgacgtggtgaccaaggcggcggccaagcggatggacgccatttcgctgcactactacacgatccaaaccggcgactggaacaagaagggcgcggccaccggcttcgacaaggccgcctggggcaagtccttcgctcagacgttgcggatggatgatctgcttcgccagcacatcgcggtgctggaccgcaatgatcctcagaagcgcatcggtctctatgtcgacgagtgggggacttggtacgacaccgaaccggggaccaatcccggccatctttatcagctgaacactttgcgcgacggcgttctggcggcggtgaacttcaatatcttccataagcacgcggagcgcgtgcggatggccaacatcgcccagaccatcaacgtgctgcaggcggtgatcctgaccaagggcgaccagatggtgctgacgccgacctactatgcgcaccagatgtacatgccgttccaggactcgaccgccattccgcttgagatcacggcgcccgagatcgatgtcgcgggcagcaagatcccggccttcaacgcctcggcggccaagggcaaagacggcaaaatctatgtcgcagtcgcgaacatggctctcgacgacagcgtgaagttgaacgtctcgctggcgggcctgaaggccaagatggtgagcggccaggttctgacggccgacaagatggacgcgatgaacgacttcggcgccaagcccgccgtggttccggtcccgttcaaaggcggcaagctctccggggaccggctgaccctcgacattccctcgaaatccgtcgtggttgtgaggttggactaa

SEQ ID NO: 40573 - DNA, 1161 bp, Caulobacter crescentus
atggatgaagaaacccgcctgatccacacgggctcggagcctgctcgcctggggcggaccgtcaatccgccgatccagcggggctcgaccgtcctgctgccggacgccgcctcgctctacgacgacgaccagctgacctacggaatcacgggtctctccacgcccgtggcgctgcagaacgccctggccgaactggagggcgcgacgaacgtcaccctctacccctcgggtctcgccgcgatcaccggcgccatgctggccgtgctgaaggccggcgatgaggtgctggtcgtcgacagcgcctacaaacccacccgccggttctgcgatcgcgtgctgggccggttcggcgtcacgacgcgctactatgacccgaagctctcgcccgaggcgctgatgggcctggtgacctcgagcacccgcctgatcgtgctggaagcgcccggctcgttgaccttcgagatgcaggacatccccgctatcgccgccgcggcgaacgcgcgcggcgtcctgaccctgatcgacaacacctgggcggccggcctgctgttcaagccgctggcgcatggcgtgacgatgagcgtccaggccctgaccaaatatgtcggcgggcactctgactgcttcatgggctcggtcgccacctgcgacgacgcggtcgccaagctcttgggcgacgccatgtgggacatcggttggtcggtgtcgtccgacgacgcctacaccatgctgcgcggtctgcggacgctcgcgacgcgcctgccccgccacgcggagaacggcctcgccatcgcccgctggcttcaggagcgacccgaggtggcgcgggtgctgcaccccgccctccccggcgacgccggacacgcgatctggaagcgcgacttcaccggcgcctgcggcctgtttggcgtcgtgttgaagccctgctcgcagaaagcggtccacgccttcctcgatagcctgaagctctttggcctgggcttctcgtggggcggctatgagagccttgcgctgaactgcgacccgcagcttggcgcgcgatcaatcccggtcgatctggagggtccgctgctgcgcttccacatcgggctggaaggcatcgaagacctcaaggccgaccttcggcgggggttcgaggccctgaacgccgcgaaggcctga

SEQ ID NO: 40574 - DNA, 858 bp, Caulobacter crescentus
atgagcaccccgtccgatccgctggtcaccaccgcctggttggctcagcatcttgaggctccggacgtgcgcgtggtcgacgcctcctggcacatgccggccgcccagcgcgacccgcacaaggagttcctggcggcgcacattccaggcgcggtgttcttcgatatcgacgagatcgcggacgagtccactgaccttccccacatgatcccgtcgccgaccaagttcgcctcgcgggttcgcaagctgggcctgggcgatggctcgcggatcgtggtgtacgacagcaccggaatcctgccggccgcccgcgtctggtggcatttccgggccatgggccacgaggacgtcgtcgtgctggacggcggtcttcccaagtggatctccgagggccgcccgatcgaggatggtccggcctttccgcaggaacggcacttcacgccgcgctaccaggccgacgtctatcgctcgctcgaccagatgcgcgacatcgtcgcgaccggtcgcgagcagatcgtcgatgcgcgcgccgccggtcgcttcgagggcgtcgatcctgaaccccgcgccggcctgcgcggcggccacatgcccggcgcccgcaacatcccgctgtcggccctgatcgcgccggatgggacaatgctgtcggcggaaaagctgaagtccgtgttcgaggctgccggcgtcgacatcaacaagcccgtcgtctccacctgcggctcgggcatcaccgcctcggtcgtggccctggcgctggcgcgcatgggcaagccccgttcggcggtctatgacggctcgtggacggaatggggcggcctggcggatacgccggtcgtcacgggaccggcccagtag

SEQ ID NO: 40575 - DNA, 1203 bp, Caulobacter crescentus
atgcctcaaggtatccgcgacaaggtcgccattctcgggatgggctgttcgaagttcggcgagcgctgggacgccggccccgacgacctgatggtcgaagcctatctggaggctatgcaggacgccggcatcgagccgacccagctggacgccgcctggttctccacccacatcgacgagatcggctcgggcaagggcggcacgccgctgtcgatcgccctgcgcctgcccaacatcgccgtcacccgcgtcgagaacttctgcgcctcgggctcggaagccttccgcggggcggtctacgccgtggcggccggcgcggccgacatcgccctggcggtcggggtcgagaagctgaaggacaccggctatggcggcctgccggtcgcaaatcccggtacgctgagcccgcaggtgatgcccaatggctcggcccccggcaacttcgcgcaactggccagcgcctatcgcgccaagcacggcgtctccaaggaagacctcaagcgcgccatcgcccacgtttcggtcaagagccacgccaacggcgccaagaaccccaaggcccacctgcgcaagccgatcaccgaggagcaggcccttagtgcgccgctgatcgccgagccgctgggcctgttcgactgctgcggcgtgtcggacggcgcggcggcggccatcgtcaccacgcccgagatcgcccgggccctgggcaagcacgacctggtcacggtcaaggcgctgcaactgtcggtctcgaacggctatgagagccagtacaacggctgggacggcagtcacttccacaccgcccgcatcgctgcgggcaaggcctatcgcgaggccggcatcgagcggccgcgtgagcagatctcgatgatggaggtgcacgactgcttctcggtcaccgagctggtgacgatggaggacctgttcatctcgccggaggggcagggctggcgcgacgtgttggacggcttctacgacgccgacggcggcgtgccgtgccagatcgacggcggtctcaagtgcttcggccaccccattggcgcgtccggcctgcggatgctctacgagatgtacctgcagctccaaggtcgcgccggcgagcggcaactggccaacccggtgttcggcatgacccacaacctgggtggcgcgccggccagcaacgtctgctcggtcgccatcatcggccaggaaggggcttaa

SEQ ID NO: 40576 - DNA, 1179 bp, Caulobacter crescentus
gtgtcagaacgcggacccgtctcttctgcagcgaggtccgcgcgtatcatcgggaccgtcgtcttgccgcaagccgtcatcgccgccacggggctgtacaccccgcctcacagcatctcgaacgccgagttggtcgaggctttcaacaccttcgtcgagcgcttcaacgccgccaacgccgaggccatcgcggccggcgaggtcgtcgccctgcccccctcctcgcccgagttcatcgagaaggcttcgggcatcaagtcgcgcttcgtgatggacaagagcgggatcatcgatccggagatcatgcgcccgatcctccccgagcgcccgaatgaggaaatctcgatcctggccgaaatggccgtcgaagccgccaagcaggcgatcgcccgctggggcaagccggtgtcagagatcggcgcggtgatctgcgcggcctcgaacatgcagcgcgcctatccggccatggcgatcgaggtgcagcaggctctggggatcgagggcttcgcctttgacatgaacgtggcgtgctcgtcggcgaccttcggcatcaagaccgccgccgacttcatcacgaccggcagcgccaaggcggtgctgatggtcaatcccgagatctgctcgggccacctgaacttccaggatcgcgacagccacttcatcttcggcgacgtcgccacggcggtgatcatcgaggacgccgaccaggcgaagggcggctgggagatcgtcggcacgcgtctgaagacccagttctcgaacaacatccgcaacaacttcggcttcctgaaccgcgccgcgccggaaggggtcggcgccaaggacaagctgttcgttcaggaaggccgcaaggtgttccgcgaggtggtgccgatggtcagcgagatgatcgtcgagcacgccaaggacctgggcgtcgatccgaccggcctcaagcgcctgtggctgcaccaggccaacatcaacatgaacgagatgatcggccgcaaggtgctgggccgcgacccggccccgggcgagaacgtcatcatcctggacgaatacgccaacaccagctcggccggatcgatcatcgccttccactcggccaacgacgacttcgcgccgggcgagacgggcctgatctgcagcttcggcgccggctattcggccggcacagtgttcgtccgtaagcgttga

SEQ ID NO: 40577 - DNA, 2703 bp, Caulobacter crescentus
gtgaattcaaagatgccggttgagacgctgaccaaggcccagtgggtttatgcattcggcggaggcggcgcggatggcgacgcctcgatgaagaacctccttggcggcaagggggccaatctcgcggagatgtcgtccctgggcctgcccgtgccgcccggcttcacgattacgaccgaggcctgcgtccactactacgccaacggcaagcagtatccggccgaactggccgaacaggtgcaggctggcctcgccaagatcgaagagatcaccggcaagcagttcggcgatgtgaccaacccgctgctggtttcggtgcgctcgggcgcccgggcctcgatgccgggcatgatggacacggttctgaacctgggcctcaacgacgagaccgtcgaagggctggccaagctgtcgggcgaccggcgcttcgcctatgacagctatcgccgcttcatccagatgtactcgaacgtcgtgctcaacctcgagcaccacatgttcgaggagatcctcgacgatcacaaggatcgcctggacgtcaatgtcgacaccggtctgacggccgacgactgggccgcggtgatcaaggactacaaggccgccgtccgcgagcagctgggcaagccgttcccgcaggacgcccaggagcaactgtggggcgcggtgggcgccgtgttcgccagctggatgaacgaccgcgccaagttctaccgccgcatgcacgacatccccgaaagctggggcacggccgtgaacatccagtcgatggtgttcggcaacatgggcgagacctcggccacgggcgttgccttcacccgcaacccgtcgaacggcgacaaccgcctgtacggcgagttcctgatcaacgcccagggcgaggacgtggtggcgggcatccgcaccccgcagtccctgaccaaggccgcccgcgaggagatgggtgacaccgccccctcgatggaagaggcgatgccggaggtgttcggtcagttcaagacggtcgtggagacgctggagcgtcactaccgcgacatgcaggacatcgagttcacggtagagcagggcaagctctacatgctgcagacccgcaacggtaagcgcaccgccaaggccgcgctcaaaatcgcggtcgacatggcggccgagggcgtgatctcgacgtcggaggccgtcggccgcgtcgagccggcctcgctggaccagctgctgcacccgaccattgatccgtcggcccatcgcgatgtgatcgccaagggcctgccggcctcgcccggcgcagcgaccggcaagatcgtcttcaacagcgacgccgccgaaaaggccgccgccaatggcgagtcggtgatcctcgtacgtgaggaaaccagccccgaagacatccacggcatgcacgccgcgcgcggcatcatcacggcgcggggcggcatgaccagccacgccgccgtcgtggcgcgcggcatggggcgcccttgcgtctcgggcgccggcgatgtggccatcttcgagaaggaaggcctgttccgcgttcgtggccgcgatttcagggccggcgagatcatcaccatcgacggctccaccggcgacatcctggccggcgcgccgaagatgatcgagcccgagctgaccggcgatttcgccaccctgatgggctgggccgaccaggtccgtcgcctgaaggtgcgcgccaacgccgagactccgctggacgccaagaccgcccgccagttcggcgccgagggcattggcctgtgccgcaccgagcacatgttcttcgacgacacccggatcgccgccgtgcgcgaaatgatcctggccgatgacgagaagggccgccgcgccgcgctggccaagatcgcgccgttccagaaggccgacttcgtcgagctcttcacgatcatggaaggcctgccggtcacgatccgcctcctggatccgccgctgcacgagttcctgccgcacaccgaggaagacgttcaggccgtggccgtggccaccggtcttgacgccgccaagctgatgcgtcgcgccaaggagctgcacgagaccaaccccatgctcggccatcgcggctgccgcctgggggtttcctatcccgagatctacgagatgcaggtccgcgccatccttgaggcggcctgcgaggtcaaaaaggcgggcaagcagccgccggcgcccgaaatcatgcacccgctggtcgccaagggtgaggagatgaagtacctgcgcgacctgaccgaccgcgtcgctaaggcggtgctggaagagcagggcgtggcgctggagtacaccgtcggcaccatgatcgagctgccccgcgcggccctgcgcgccggcgacctggccgccaacgccgagttcttcagcttcggcaccaacgacctgacccagacgacgttcggcatcagccgcgacgacgccggcaagttcctgaacgcctatatcgagaagggcatcttcgagaaggaccccttcgtcagcctcgaccaggacggcgtgggcgacctgatccgtatcgccgctgagcgtggccgcgctgtgcgtccgaacgtcaagctcggcatctgcggcgagcatggcggcgatccggcctcgatcggcttctgcgagaaggtcggcctcgactatgtgtcgtgctcgccctaccgcgtgccgatcgcacgtctggccgccgctcaggcggctatggccaacaaggtcgagtag

SEQ ID NO: 40578 - DNA, 2271 bp, Caulobacter crescentus
gtgccgatttcgtatctgtccgccgcccagatcgccgccctggcgacgacgacggtacagaccctgtcgaccaccaagatggaggggctgaccagaacgcaggtcggcgcgctgtcggactcggcgatcggcgtgctgaacgccacgcaggtctcggccctgacatcgacccaggtcaagggcctgacggcgacgcagattccggccttcgcccagaacctcttgttcgatgtcgatcaacttcaggcgttcagcggcgcgcagctcaacgccctgacctcgacccaactggccaagctggacgcggatcgcctgcaggcgctcagcgccatccagatcggcgcgatggacgccacccgtttcaccgccctggacgccacccagatcgccgcgctcagcacgacgcagctggcgcagctgaccaccacgcagatcgccgccttcagcgccaccgatctggaggagctgtcggccgaaaagatcgcgtctctgaccggaacccagatctccgccctgcccgctgatctcgttccgtccctgcagggcgcccgcctgtcggcgctgagcacgacacagctccagcgcatgaccgcaacccaggtcgccgccttgtcgacgacccagatcaagagtctgggcgacaccctgaccgcgctcggcgacacccagatcggcgccctgtcctcagcccagaccggcgtgctttcggacgccgtggtcgccggcctgacgggagcgcagcttggcgcgctcagcacccaagggctgtccggcctgtccgcgacccaggtcgcgggcttaaccggcactcagctggcggggttgaagccgacccagctgcgcgcgttgagcgagaataatctcgccgagttcacggcggctcagatgcgccaattcagcaccgctcagctctcggccttgagcacgacggggttgaacagcctggccgccgaccgggtccaagtcttcgatgcgacgcagttgacggcgttgacgaccacgcagatcgcgggcctgaccggcgatgatctggccgagttcaccccgacccaggtcgaggtgctggccacgacgcaactggccgcgctgtcgccgaccgtcctcaacggcctcggccgcgaccaagtccatgcgctgaccgcgacacagttgaaaagcctgagcagaacccagatcggcggcctgtccgaaaccagcatggccgcgttcacgcctgaccaggtacaggttttcagcacgacgcagttgaacgccctgtcgccccgcgccatcaacagcctgagcgccagccaagtccaggcgctgaccgccacccaattggcgggactgaccacgacgcagatcgcgggactgtcgacaaccggcttcgacaagttctcaagcactcagctcaaggccttcgcgccctcgcagttggcggccctggaggccaccaacttcaatcgcttgggcgccagcacgatccacgctctatcggcctcccagctctcagcgatcagcaccacccagctcaacgccttgagcgagacggacttcgcgcgcttcacgacgacccaggtggccagcttcagcggcgaacagatcggcgcgctgtcgacgaccagcttcaacggcctcagcccaagccagatcgcggccttgtcttcaactcagctggccggcgtcagcgcgacccagatggcgggcctgaccgacaccgatctggccgaactgtcgacgacccagttcgccgccctgactggaacacagatcggcggtctttcgacgcgacacctgaccagcctggaccaaacagccttccaggccctgacggccgggcaagtttcaggcctgagcgcgagccagctcagcaccttgtccatgactgatatgggcgagttcaccacgacccagatggccgctctgacgccaagccagatgatggcgatttccgtcaccaatctggcggccctgtcggccgatcagtacgccgccttgacgcccagcgcgctgaggggcctgtcgtccttccagctgcgcaacatttcgcccggcgccttcagccagctcagccagacccaggtccaggcgttgaacgccagccagcttggctcgctgtccacggcggtgatcgccagcctgaccacgacccaggtgggctatctgaccccgacccagatccccggcctgacgatcaaccaactggactggctgtcgaccaccaacatcgcggccatgacgccgcttcaggtcggggccttcacgccggctcaagtcgagagcctgggctga

SEQ ID NO: 40579 - DNA, 768 bp, Caulobacter crescentus
atggccaatccgttcagcctcgaaggcaaggtcgcgctcatcaccggcgccaacaccgggatcgggcaggggatcgccatcgctctggccgccgccggcgcggacatcgccgctgcgggccgcagcgcaccgaccgaaacccaagccgccgtcgaggccctgggccgcaagttcctgtcgatcaaggccgacttcagttcgatcgaaccggtccagcgcgtggtcgacgaaacggtcgccgcgttcggcaaggtcgacatcctggtcaataacgccggcatcatccgtcgcgcggactcgatcgagttcagcgaggccgactgggatgcggtgatggacaccaacctgaaggtggtcttcttcttgacccaggccttcgccaagcaggccctgaagcagggtttcgagggcggtcaggccaaggtcatcaacatcgcctcgctgctctccttccagggcggcatccgcgtgccgtcctatacggcctccaaatcgggcctggcgggcctgaccaagatcctcgccaacgagtgggcgaccaaggggatcaacgtcaacgccatcgcgccgggctatttcgacaccaataacaccgaggccctgcgcgccgaccaggaccgcaacgccgccatcctggcgcgcattccggccggtcgttggggccgtccggaggatatcggcggcgcggcggtgttcctggcgtcgtcggcgtctgactatgtgcagggcattactctgcccgtggatgggggttggctggcccgctag

SEQ ID NO: 40580 - DNA, 2730 bp, Caulobacter crescentus
atgcgcaacccggccctgtcgatcgacgtcgaccgtccgaccagccgccacgtccgccagaacgcccatctgctcagcgatctgctgatcgaggcgatcacctatctggagggcgaggagaaggccgagctggtggccaaggcgcgcaaggccgcctcgcgcgaagacgtggtcaatggcgatgcgccgctgctcgaccacctgttctccgacctgacgaccgagcaggccgtgtttctggcgcgggccttcgccagccactcgctgctggccaatatcggcgaggacgtcgccggccgccgtcgccacgccgaggccgacgcccagcccggtgacgagcgcccccgcaccctgatcgacgccgtgaaggcgctgaaggcggcgggcaagtctgacgccgaactggccaagatcttcgcggcgatgaacgtcgtgccggtgctgaccgcccacccgaccgaagtgcgtcgccgcagcatggtcgaccgcgagaccgagatctcgcgcctgatggccctgcgtcgccatcacctgccgccggatctcgaggccgagatccgcgagagcctgttccgcgagatcgctctgatgtggcgcacgcgcctctatcgtcccgagcggatcacggtgaaggacgagatccgcaacgcgctgtcgatcgtccgcacctcgatcctgccggcgatcatcgacctttacggcgactggaccggcaagatcggccagcacggccaattggcgccgctgctgaagatggggtcgtggctgggcggcgaccgcgacggccatcccggcgtcaacggccaaacgctgaagttggccttgagctcgcagtcccgcgtgatcctcgactggtacgccggcgaggtgcgcaagctgtggtccaatctggcggtctcgaccgcctatacgccggtgtcggacgagctgctggccctggccgcccaggccaaggacccttcggtccaccggatcgacgagccctatcgtctggcgctggagctgatctttgaccgcctgaccgccgtctcgcagaagctgaccggcgctccggtggcctttgcgtcgggggtgaccagcgtcgagccgtacgcgcatccggacgccttcgtcgccgacctgtcggtgatcatcgacagcctggagcgcaatggcggcgagcgcctggtgggctcggcgttgcgcaccctggtcgaggtggccaaggcctgcggcttccatctgatgagcctggacctgcgccagaacgccgatgtccatgagcggaccctggacgagttgttccgccgcgccggtacgggcgttgagtatctgaagctcgacgaagacgcccgctgcaaggtgctgatcgacgagctgtcgcaccagcgcccgctggtttcgccgttcaccgcctatggcgaggagacgagcaaggagctggccacgatggaggcggccgcccaggcggtgcgcgactacggtcatggctgtctcggcgcctacatcatctcgaaatcggcgaccctgtccgacatgctcgagccgctcgttctgctcaagcaggtggggctggtctggggcggggccgcgccgcgcgcctcggtcaaggtcgcgccgttgttcgagaccatcggcgacctcgagaacggcccggccgtgctgcgccagtggctggagctgccgctgagccgcacgatcctgggcgaccgtccggtgcaggaaatcatgctcggctattccgacagcaataaggatggcggctatgtcgccagccggcggggcgtggcgacgggcgcttcggccctggcccacgaggccgatcggatgggcgtcggtttgcagctgttccacggccgcggcggcagcgtcggacggggcgggggaccggccgccgaggccgtgctggcccagcccgccggcaccgtccaggggcgcatccgcatgaccgagcagggcgagatgatcgcccgccgtttcggcgaccagcccaccgcgcgccgcaatctcgacggcctggccgccgcggtcctgatggccagcgagcgcccgatccccaagcgcgatcccaaggttgagggcgccatgaccgccctggcccagagctcgttcgaaggctatcgggccctcgtctatgacgacgccgccttcgaggacttcttctggtcggtcaccccgatcagcgagatcgtcggcctcaatatcggcagccgtcccgccagccgcacggccagccgcaagatcgaggacctgcgggccatcccgtgggtgttcagctggtcgcaggcccgcttcatgctgccgggctggtacggcttcgcctcaggcgtcgagcgggcgggcctgtcggtcgagcaattgcgcgatctggctggaaatttcgacttcttcgcctccctgctgtcgaacatggagctggccctggcccagagccagatgggcatcgccgcgcgatatgtcgccctgtcgcccgacaaggccaacgccgagcggatctttgcgaccatccggcgtgagcacgaggccgcgaccggcctggccctggcgatccggggtggggccgcgctgctcgataaccagcctgatctcgccgagtcggtcgccttggccagccgctcggtcgatccgctgaaccatctgcagctggagcttctgtcgcgccgccgggcgggggacatcgacgaagagctgcgtctggcgattcagctcaccgtcgccgggatcgcggcgggcctgcgcaacacgggctga

SEQ ID NO: 40581 - DNA, 2418 bp, Caulobacter crescentus
atgtttcccgacaccgactcgccgagccccatcggggatttccccggcgacctcccctccccgcgcatctccgacctggcccgagcccggccgcccgccggcgccgcgcccggctatctggacggcctgaaccccgagcagcgcgaggcggtcgagaccaccgaaggccccctgctcgtcctggccggcgccggcaccggcaagacgcgcgtgctgaccacgcgcctggcgcatatcctggccaccggccgcgcccgtccctgggagattctagcggtcaccttcaccaacaaggccgcccgcgagatgcgcgagcggatcacccacatcatcggtccggaggccgagggcctgcgttggctgggcaccttccactcggtggccgcccagatcctgcgccgccacgccgagctgatcggactgaagtccaactacacgatcatcgacaccgacgataacgagcggctgctcaagcagctgatcgaggccgagaacatcgacgccaagcggtggacgccccgcatcctgtcgcagatcatcgacggctggaagaaccgcggctggacgcccgaccgcgtgcccacgtcggaagccggtgagttcgcgaacggcaagggcatcagcctctatcgccagtatcaggagcggctacgcatcctgaacgcctgtgatttcggcgaccttttgctgcacaatatcagcctgttcaccggccatcctgacgtgctggacgagttccagcagcgcttcaaatacgtgatggtcgacgagtaccaggacaccaacgtcgcccaatatctgtggctgcgtctgttggctcagggccgccagaatgtctgctgcgtgggcgatgacgaccagtcgatctatggctggcgcggggccgaggtcgacaacatcctgcgcttcgagcgcgacttccccggcgccaaggtcgtgcgcctggagtgcaactaccgctcgacggagcacatcctggccgccgcctcgggcctgatcaccgccaacaaggggcgcctgggcaagaccctgtggaccccgtccaagggcggcgagaaggtcaaggtgtcaggcgtctgggacggcgaggccgagagccgcctgatcgccgacgagatcgagcgcgccaagaaggccggccgcaagtacagccagatggccatcctggtgcgggccagcttccagatgcgcgccttcgaagagcgcttcgtgctgctgcagatcccctacaaggtggtcggcggcccgcggttcttcgagcgcgccgagatccgcgacgctcacgcctatctgcgcctgatccagtcgcccgacgatgacctggccttcgagcgcatcgtcaacacgcccaagcgcggcatcggcgacacctcggtgcagaagctgctgcagatcgcccgcctgggcgggatctcgaccgtcgaggccgcccgtcagatcatcaccagcgacgagctgccggcccgcacccgcacggccctgtcgaacttcatccgcgacctcgaccgttggcgctcgctggtcggaacggcgcaccaccaacgcctgctggaaaccgtgctggaagaaagcggctatacggacgccctgcgcctcgacaagggtccgaccagccagacgcggctcgagaacctgaaggaactcgttcagtcgatgggcgcgttcgacacgctggaagcctatctcgagcacgtgtcgctggtcatggacctcgaccgcgaggccaccggcgacgccgtctggatcatgaccctgcactcggccaaagggctggagttcccgctggtcttcctgccgggctgggaggaaggcgtcttccccagccagcgcagcatggatgacaagggcgagaaaggtctcgaggaagagcggcgcctggcctatgtgggcatcacccgcgcccgcgaggaggcccgcatcagcttcgtggccaaccgtcaggtctacggccggtggacgtcgcaactgcccagccgcttcgtcgacgagttgccgatcgcccacgtcgatgcggcgtccgagaccggctattacggcggcggccccggcatgcagtcgacggccgcctcgcgctgggacgatccgggcacgagcgcctttcaggccggcagctatgacagtcccggctggaaacgcgcccaggagcgcacctcgggctttggcgagcgcggcggatcctggcgcggcgcccaaggcgttcgatcgggttcgtccgcccgctcggcgccgatcgagggcgaaggccgtctggtcgccgtctcggccccgaccaacagcgcctatgcgcgcggcgaccgggtgttccacgtcaagttcggctacggaaaggtcacggggatcgagggcaacaagctgaccgtcgccttcgacaaggccggcgaaaagaaggtcatcgacagcttcgtcgagaaggcctga

SEQ ID NO: 40582 - DNA, 636 bp, Caulobacter crescentus
atgtacacgctctatggttcgcccagcaccgccggcacggccatccactggatgctgctggagcttggcgtcccgttcgatctgaagatgctggatttcgacaagggcgagcacaagacggccgagtacctggcgctcaatccggatggtgtggttcccaccctgatcgtcgatggccggccggtgacccagatggcggcgctgctgaccctgctcgccgagcgtcatcctgaggcgggctttgcgccgacgccgggatcggccgaccgcgccgcctatctgagctggagcttctggctggccaacagctttcagcctcacttccgggcctggttctattcgcacgagccggccggcggcgatgctcaggaggccgtgcaggccgccgctcgggcgcggatcgaggccggtctggcgcggctggacgcgcatttggccgatcaagactacatggtcgggaagggtttcacgaccgtggatctgctggtcacgatcctgtgccgctggagccgcaacatgcccaagcccgcgaccgaatggccgaacctgaagcgctatctcgatcgcatccgccagcgcccggcgctgcgcgaggcccatacgcgcgaggggctgaccgactggattgatgggtag

SEQ ID NO: 40583 - DNA, 828 bp, Caulobacter crescentus
gtggagctggacgcctatttccggcgtatcggctatgacggcccgcgcgagccgaccctggatacgctgcgggccatcgccttccgccacccggacgccatcccgttcgagaacctcgacgtcctcttggggcgcgggatcagcattgtccccagcgatgtcgacgccaagctgatcggcgccgggcggggcggctattgctacgagcagaacgggcttttgaagcgcgtgctacaggcgctgggcttccaagtcgaggggctgatggcccgcgtgctgtggatggcgccggaaggtgcgccgccgcgtccgcgctcgcaccaggtgctgggtgtcacaatcgacggcgagacctggctggccgacgccggctttggcggctgcgtgctgaccgcgccgctgcgcctgttctcggacgaggtccaggacagtccgcacggcaagttccgcatcgtcgacacgcagacgaacggcgtcgccgaacgccaggtccaggccgatttgtcgggccgctgggcgccgctctatcaggtgtcgcaaggcgcctgggccgaggtcgactacgagcaggccaatttctacacctacacccaccccagctcgcacttcacctggagcatgacggtggggcgcacgacgccgaccgcgcgctacgccctgaagaacaaccgcttcacccatcgcgacgtcacgggcgctgtggtcgagcagcgtgaccttaccgttgatgagctggaggcgacgttgcgccaggtgatcggcctgccggtggaggccgactggcggccggtgctggaacaggtcgtagcgtggggaacccccgcttga

SEQ ID NO: 40584 - DNA, 768 bp, Caulobacter crescentus
atgcagaacctgttttcgcttgagggccgcgtggccctggtcaccggcggctcgcgcggtatcggcgcgatgatcgtcaagggtttcctgacgcacggcgccaagcgcgtctacatcaccgctcgcaaggccgccgcctgtgacgccgccgccgaggaactgagccagtacggcgagtgcgtctcgctgccgggcgatgtctcgaccatggaaggtatccagggcctggcggcccgcatcaaggagcgcgagcccaagctcgacatcctggtcaacaacgccggcgccgcctggggcgcgggctttgacgagttccccgagagcggctgggacaagaccgtcgacctgaacatgaagacgccgttcttcctgacccaggccctgatcggcgaactgcgcgccgcagccaaggaccgtgtcgccaaggtgatcaacatcgcgtcgatcgacggccagtcggtgaccaaggacgagacctatccctatggcgcctccaaggccggcctgctgcacatgaccaagcgcatggccctgcgtctggcgccggagaacatcgccgtcagttgcatcgcgccgggcgccttcgcctcggacatgaacaaggtcgcccgcgaccacgccgacgccgtggccaagatgatccccgccggccgcatcggcgaggccgaggacatggcgggcgcggccatctatctggcctcgcgcgccggtgactatgtgatgggcggtgcggtgaccgtcgacggcggcgtcagcttcgcgcggtga

SEQ ID NO: 40585 - DNA, 1323 bp, Caulobacter crescentus
gtggcgacgaccggcagtggaggcctggcggtcttcatctggcagtacgggcgccagacgtgcggtgcgccttcggttagccagcgaggatcggacatgtcgctttccgtttgcggactcggggcgccttgcctatcccccggctcgatcctcggaaaggaaaatgacatgcggagcctcgacgccttcgccggccaaaagctggcggctctcgacgcccagagcctcaggcggcgcctgtccccgacccgtcgccacgacggcgcggtggtcgaacgcgacggcaagcggatgatctcgttctcctgcaacgactatctgaacctgtcgcagcatcacctagtgcgggctgcggcggctgaagcggcgttgaactacggcgccggcgcggcggcctcgcgcctcgtcaccggcgatcatccgctgctctccgacctcgaaaagcggctggcgcacttgaagggaaccgaagccgcctgtgtcttcggctccggctacttggccaacaccggggtaatcccgaccctggtcggccccggcgacgtcatcctcatcgacgctttggcccacgcctgcatctgggcgggcgcgcagctgtcgggcgccaaggtcgtcaagttcgcacacaacgatccggccgatctcgagcggcttctgctcgccgagcgcggcgcggcccgccacgccctggtggccacggacggcgtcttttcaatggacggcgacatcgcgccgctggacgctttgtcggagctttgccagcgccatgacgcctggctgctcagtgacgacgcgcacggcgtcggcgtcctcgccgagggacgcggctcgggcgcgctcttcccgaccgccaagatccccctgcagatgggcacattgtcgaaggcgctgggatcgtatggcggctatctgtgcggctctcaggcggtggtcgaccttctgaagacccgcgcccgaaccctggtctatgcgaccggcctgccccccgcctccgctgcggcggcgctggcttcgctggacctgattgcggccaacccgacgatgaccgaagtcccgctggccaaggcgcggctgttcacgcgccgtctgggcctgcccgaggcctgcagccccatcgttcctgtggtgctgggatcggcggaaagcgccctcgccgcctctacggaattgcagaaccagggcttcctcgtcgtcgcgatccgcccgccgacagttccagacggcacggcgcgcctgcggatcgcattcagcgccgcccatgaagacgccgatatcatccgactggccgacgccatcgccaagctccgggagaccgcctcgtga

SEQ ID NO: 40586 - DNA, 1203 bp, Caulobacter crescentus
atgaagaccgccaggcctccactgccggtcgtcgccacgcgcggcgcccgcctgatccttgaggacgggcgtgaactggtcgacggtctggcgtcctggtggacggcctgtcacggctacaaccacccccatattgctggcgcgctgcgcaagcagatcgagaccatgccgcatgtcatgttcggtggtctggcgcatgaacccgcctatcgcctcgccaagcggctggcccgcctgctgccgggtgatctggaccatgtcttcttcgccgaaagcggctcggtcgcggtcgagatcgcgatgaagatggcgctgcagtaccagatcaatcgcggcgtgggcggtcgtacacggttcctggctttccggggcggctaccacggcgacaccctggcgacgatgacggtctgcgatcccgaggaagggatgcacagcctgttcgccggcgtgatgcccgctcaggtgatcgccgacctgccccgggaccctgcgtccgaagcggcgctcgacgctctgctcgccgcgcgcggacacgagatcgccgccatgctggtggagcctctgatccagggcgcaggcgggatgcttccgcacccgcctgaggtgctgcggacccttcgccgcctggccgacaagcacggcgtgctgctgatcttcgatgagatcttcacaggctttggccggacgggatccttgttcgccatgcaggcggcgggcgtcgagccggatatcgtcaccctgtccaaggcgctgacgggcgggacgttgccgctgtcggcggcggtcgcccgccgtcatgtgttcgaggccttctggtcggatgatcctgccgcggccctgatgcacggccccacctacatggccaatccgctggcctgcgccgccgccaacgcctcgctggatctgttcgaggatggcgcctgggcgcgcgacgtcgcgcgcgtgtcggcggcgttggccgaagggcttgagccctgtcgcgccggcgagggcgtggtcgatgtccgcaccttgggcgcgatcggcgtcgtcgagttcgaggcgcccgtgcctgtatcggatctctgtgcgcggttcgccgccctgggcgtctggatccggccgatgggcaaggtggtctatctgacgccggccttcacgacgccagacgaggatctttcgcggctcacctcggcggtgcgacaggttgtcggcgtcgattga

SEQ ID NO: 40587 - DNA, 1458 bp, Caulobacter crescentus
atgagcggcggactgttcatcgatggcaagtggcgcgcgggccaaggcgcaggcctgagctccaccgatccggccacgggcgaggacgtctggagcgccgccacggccaccccggctgatgtggcggacgcggtggcggccgctcgtaaggcctttcccgcctgggctgatcgcccgcgtgaggaacggatcgcgatcctgcggcgctacaaggacatcctggtcgagcgcgctgcgccctacgctgaggccttgagccgcgagaccggcaaggccctctgggagaccagggctgagctcgcctcgatggcgggcaaggtcgatctgtcgatccgggcctatgacgagcgcaccggcgtcaccgagaacgccatgccgttcggacgcgccgtcctgcgccatcgcgcgcatggcgtcatggccgtgctgggaccgttcaacttcccgggacacctgcctaacggccacatcgtcccggcgctgttggcgggcgatacggtggtgttcaagccttcggaagagacgccgctggcgggccagctgatggtcgaggccctggaggccgccggcgcgccggccggcgtggtcaatctcgtccagggcgggcgcgagaccggacaggcgctgatcgcccaggacatcgacggcctgttgttcacgggctcggccgcggctgggacctacttccgtcgctacttcgccgatcgtccggacgtgatcctggccttggaactgggcggcaacaacccgctggtggtctggaacgccgacgatgcgccggaggccgtggcggccctcatcgtccagtcggccttcatcaccaccgggcagcgatgctcgtgcgcgcggcggctgatcgtgcccgatgacgcctcgggcgcggcgatcatcgaggcgacggtcgcgttggcggagcggctggtgatcggcgcctggaacgctgagaacgagcccttcatgggaccgctgatctccggccgcgccgccaaggccgcgcgtgaggtggcctcggcgacgccgggaaagaccatcctcgccttggacggcgtcgcgggtctaggcgacgcgtttctgaagcccggcattgtcgacgtgacgggtctcgagacacccgacgaggaactgttcgcgccgctgctgcaggtgcggcgggtctcgagtttcgacgaggcgctcgcggcggcgaacgcgacgcgctacgggctctctgcgggacttatctccaatgaatcagagctttgggataagttcctgagccgtatccgcgccggcgtggtcaactggaaccgaccgaccaccggcgcggccggctctatgccgttcggaggcctcggcgcctcaggcaaccatcgcccgagcgcctattacgccgcagactactgcgcctatcctgtcgcgagtttcgaggcttcaatggtcgttgataccttgaaggatatcaagggcttgaaggcgtga

SEQ ID NO: 40588 - DNA, 1464 bp, Caulobacter crescentus
atggagattcgcgaagggctcaccttcgacgacgttttgctcgaacccgcagcgtccgacgtcatgcccacccaggtgacgaccgagacccggttcacgcgtgaaatcagtctgaacattccgctcgtgtccgccgccatggacacggtgaccgaaagccgcctcgccatcgccatggcccaggccggcggcatgggcgtcctgcaccgcaacctctccaacgaggagcaggccgaccaggtgcgcgaggtcaagcgctacgaaagcggcatggtcatcaatccgctgactatccaccccgacacgaccctggccgagatccgtgagatcaaggcccgccgcaagatctcgggcttcccggtggtcgagcgtggttcgggcaagctggtcgggattctgaccaatcgcgacatgcggttcgagggtgacgacaaggtcccggcctctcagctgatgacccgcgacaacctgatcaccgtctcggaaggcgtggatcaccgcgaggcgcgtgagctgctgcgcaggcacaagatcgagcgcctgatcgtcgtcgacgaggcctatcgcgccgtcggcctgatcacggtcaaggacatcgagaaggcccaggcccatccgctggccgccaaggacgacaagggtcgcctgctggtcggcgccgcctcgaccgtcggcgacgcgggcttcgagcgctcgatggcgctggtggacgccggcgtcgacgtcgtcgtgatcgacacggcccatggccattccagccaggtcgcagccgccgtgacccgtctgaagcgtgaagccaatcgcgtccagatcgtcgccggcaacatcgccacctacgacgccgcgcgcgcgctgatcgacgccggcgccgatgcggtgaaggtcggaattggtcccggctcgatctgcaccacccgcatcgtcgcgggcgtgggcgtgccgcagctgaccgcgatcatggaagcggttcgcgccgccaaggaaagcaacacgccggtcatcgccgacggcggcatcaagtattcgggcgacctggccaaggccatcgccgccggggcctcgaccgccatgatgggttcgatgttcgccggcaccgaagaggcgccgggcgaggtgttcctgtaccaagggcgctcgtacaagagctatcgcggcatgggctcggtgggcgccatggcgcgcggctcggccgatcgctacttccagaaggaagtcaccgacaacttcaagctggtgccggaaggcatcgagggccagacgcccttcaagggccccatctcgccggtgctgcaccagctggtcggcggcctgcgcgcggccatgggctatctcggcgcgccgacgatccctgagctacaaaagcgcgccaggttcgtgcgcatcacgggcgcgggcctgcgggaaagccacgtccacgacgtgatgatcacgcgcgaggcgcccaactatccgagcgcggtctaa

SEQ ID NO: 40589 - DNA, 1242 bp, Caulobacter crescentus
atggggacgagtttccgtctgttcgtgatgatggtgctgcagctggcgatctggggcgcctgggcgcccaagatcttcccctacatgggcatgctgggcttcgcgccctggcagcagtcgctggtcggcagcgcctggggcgtggcggcgctggtgggcatcttcttctcgaatcagttcgccgaccggaacttctcggccgagcggttcctggcggtcagccacctgatcggcggcgtggcgctgctgggcacggccttctcgacggagttctggccgttctttgcctgttacctcgttttcagcctggtctatgtgccgacgctgtcggtcaccaactcgatcgccttcgccaatctgcgcgatccggcggccggcttcggcggggtgcggatgggcggaaccgtcggctgggtgctggtcagctggcccttcgtgttcctgctgggcgcccaagcgacggtggagcaggtccgctggatcttcctggtggcggcgatcgtctccttcgttttcgccggttacgctctgaccctgccgcacacgccgccgcgcaaggccgatgacgctgtcgacaagctggcctggcgacgggcgttcaagctactgggcgcgcccttcgtgtttgtcctctttgtcgtgaccttcatcgattccgtgatccacaacggctacttcgtgatggccgacgccttcctgaccaaccgggtcgggatcgcgggcaatctcagcatggtcgtgctgagcctgggccaggtggccgaaatcatcaccatgctgctgttgggccgcgtgctggccaagctgggctggaaggtcaccatgatcgtcggcgtgctgggccacgccgcgcgctttgcggtcttcgcctacttcgccgacagcgtgccggtcatcgtggcggtgcagctgctgcacggcgtctgctacgccttcttcttcgccacggtttacatcttcgtcgacgccgtcttcccgaaagatgtccgctccagcgcgcagggtctgttcaacttgctgatcctgggcgtcggcaatgtggccgccagcttcatcttccccgcgctgatcggtcgcctgaccaccgatgggtccgtcgactacacgacgctgttcctcgtgccgaccgccatggctttggcggcggtctgcctgctggcgctgttcttccggccgcccacgcggggacctgtttcggaggcggattccgcttcatccgccgccagttcggcccaagcctag

SEQ ID NO: 40590 - DNA, 756 bp, Caulobacter crescentus
atgacttccgactcctccaagccgctggccggccgcatcgctcttgtcaccggcgccacgcgcggcatcggcgaagccgtcgccctgggcctggccaaggccggcgcgcacgtgatcgccgtggggcggacgcaaggcgctctcgaggcgctggacgatgcgatccttcaggcgacgggcgagcgcgccacgctcgtgccgctggacctgcgtgaggccgatggcctggatcacctcggcgcggccattcacaagcgctggggcaagctcgacatcctggtcggcgccgccggcgtgctgggccccctgacgcccgtcagccatctggagcccaagggctgggacatgatcctgtccaccaacctgacggccaactggcgcctgatccgcagcatggatccgctgctgcgcgcgtcggacgccggccgggcggtgttcttctccagcagcgtcgccaagagccgtcccgccttctggggcgcctacgccgcgaccaaggccgccctggaggccctcgtcgacgtctatgccgacgagatggagaacacgactgttcgcgccttctgcgtcgaccctggcgccatgcggaccaagatgcgctccgccgctttcccgggcgaaaaccccgcgacggtccccgcaccagagaccatcgcgccgttcatggtcgatctgctgcgcactgatcgcgaggcggccaagggtgtggttcgcttcaaggaacgcggccaggaatcagcgtcgatcgacgcctga

SEQ ID NO: 40591 - DNA, 825 bp, Caulobacter crescentus
ttgccggagcccccgatgctagaccacctgatccccttcgcccgcaactggctgatcggcatgcagatcgacgtgacacgctatgctgtgttctcgatcggcgtctggttcgtcctctgggtgctgctcgccaagcccatggcgggccgcaagatccgcgacacccgacctgctgggcggcaactgctgaccgagttcgcgatctcgatccgctcggtgatggtgttctcgaccttcggactgatcaccttcggcctgttccgcgccggctggctgcccgggccactgatcgccaagggctggggtccggtgtggttctggaccagtctggtcctgatgatcatcgcccatgacgcctggttctactggacgcaccggatgatccacgaccggcgcctgttccgcaccttccaccggcgtcatcaccggtcgaacaacccctcgcctttcaccgcctacagcttcgacctcggcgaggccgccatcaacgcgctgttcgtaccgctgtggatgatcctggtccccacccagtggccggtggtgggcctcttcatgctgcaccagatcgttcgcaacacgctgggccattccggctatgagctgttcccggctcgcaaggacggccggccgctgatcccctggctgacgacggtcacccatcacgacctgcaccacgcgcaggcggggtggaactacggtctctacttcacctggtgggacaagctgatgggcaccgagcacccggaatatctgcagcgcttcgcggccgttacggcccgcaaggacaaggctctggcggctaccagttcgccttcaccagcttga

SEQ ID NO: 40592 - DNA, 945 bp, Caulobacter crescentus
atgagcatcgccttcattttcccgggtcagggcagtcagtcggtcggcatgggcgccgatctcgccgaagcgttcagcgcggcgcgcgaagtcttccaggaggttgatgacgccctgggccaaaagctgttcgccctgatgaaggaaggtcccgaaggcgacctgacgctgaccgagaacgcccagccggccctgatggccgtcagcctggcggtgacgcgcacgctggagaaggaattcggcgtcggcatcgacaaggccgccttcgtcgccggtcactcgctgggtgagtactcggccctggccgccgccggcgccatcagcctgtcggacactgcgcgcctcctgaagctgcgcggccaggccatgcagcgcgccgtgccggtgggcgagggcgcgatggcctcgctgatcgggcccaagacggatctggccttggccgaagccgccgccgccgccggctcggaagtcggcgtctgcgtcgtggccaatgacaacaacaacggcaatgtcgtgatctcgggcgccaaggccgccgtcgacaaggccatcgagaaggccaaggaactgggcgcacgggccattccgctgaacgtctcggcgcccttccactgcccgctgatgcagccggccgccgacgagatggcgaccgccctggccgccgcgaccatcgtcgccccgcgcgcgccgctggtggccaatgtcaccgccgcgccgatccatgatccggacgtgatccgcaagctgctggtcgagcaggtcaccggccgcgtccgctggcgcgaaagcatgacctggatggcgaccgaaggcggtgtcacgcgtttcgccgaggccggcgccggcaaggtgctgtcgggcatggccaagcgcatcgccccggacgctgaagctgttcccctcaacacgccggcggacctcgaagcgttcgccaagtcgctctaa

SEQ ID NO: 40593 - DNA, 741 bp, Caulobacter crescentus
atgtttgatctcaccggcaagaccgcgctcgtcaccggcgccacgggcggcatcggcggggctatcgcccgcgccctgcacgcccagggcgcgcatgtcgtgctctcgggcacgcgggaatcggccctggccgagctgaaggcggaactgggcgagcgcgcctcgaccgtcgtcgccaacctctccgacgccgaacaggtcgatggcctggtggccaaggccgaagaagccgccggcgcgccgctggatatcgtgatcgccaacgccggcgtcacccgcgacggcctgatcgtgcgtatgaaggacgaggactgggacaccgtcatcaaggtgaacctggaaggctatttccgcctgtcgcgcgctgcggccaagggcatgatgaagcgccgcgccggccggatcatcggcatcacctcgatcgtcggcgtcacgggcaatcccggccagaccaactacgccgcctccaaggccggcatgatcggcttctccaaggccctggcccaggaactggccagccggggcgtgaccgtcaactgtgtcgcccccggcttcatcgccagcccgatgactgacgccctgaacgagcaacagaaggccggtattctgtcgaccattcccgccggcaagctgggcgagggggcggatatcgccgccgcctgtgtctatctggccagcgaccaggccggttacgtcacgggtcagaccttgcacgtcaacggcggcatggcgatgatctaa

SEQ ID NO: 40594 - DNA, 237 bp, Caulobacter crescentus
atgtccgacattctcgagcgcgtgcgtaagatcgtcatcgagcacctggatgccgatcccgagaaggtcaccgagaaggcttccttcatcgacgacctgggcgccgacagcctcgacaacgttgagctggtgatggcgttcgaagaagagttcgacatcgaaatcccggacgacgccgccgagcacatccaaacggtcggcgacgccgtgaagttcatcacggaaaagaccgcctaa

SEQ ID NO: 40595 - DNA, 1281 bp, Caulobacter crescentus
atgcgtagagtcgtcgtcacgggtatcggcctgttgaccccgctcggccaaggtgtcgacatcacctggaagaacatcctcgccggcaagtccggcgcgaaccgcatcagcgcgttcgaccccaccgactattcgtgccaggtcgcctgcgaggtgccgcgcgtcgatggtcgcggcggcggcggcccggatgtcgaaggctcgttcgatcctgaccagaccatgagcccgcgcgatcagaagcgcgtcgatgacttcatcctgtacggcgtcgccgccgccgatgaggccatcaaggattcgggctgggttccggaaaccgacgaggacaagtggcgcacgggcgtcatcctgggctcgggcatcggcggtctgtcgaccatcgccgacacggcgctggagcttgaggccaagggcccgcgacgcgtcagcccgttctttatctcgtcagccctgatcaacctgatctcgggtcaggtctcgatcaagtacggcttcaagggcccgaaccacgcggtcgtgaccgcctgcgccaccggtgcccatgcgatcggcgacgccgcgcgcctgatcaagtatggcgacgccgacgtgatggtggccggcggggccgaggcggccgtctgcaaggtcggcatcgccggtttccaggcctgccgcgccgtggccaccgcgttcaacgacacgcccgagaaggcctcgcgcccgtacgacaaggaccgcgacggcttcgtcatgggcgagggcgcgggcgttctggtgctggaagagtacgaacacgccaaggcgcgcggcgccaagatctatgctgaagtcgcaggctatggcctgtcgggcgacgcctaccacatcaccgccccgtcggaagacggcgagggtggcgcgcgggccctggccgccgccgtgcgtgacgcgggcctgaagccctcggacatcaactatgtcaatgctcacggcacctcgaccatggctgacggcatcgaggctaaggcggtcgagcggttcctcggcgatcacgccaagaacgtcgtcatgtcctcgaccaagtcgatgacgggccaccttctgggcgcggccggcgcgatcgaggcggcgttctcgatcctggcgatccgcgatcagatcgccccgccgaccatcaacctcgacaatcccgatgtcgaggtcgcgatgaatctcgccccgcacaaggccgtgccgatgaagatcgatgtggccgtgtccaacagcttcggcttcggcggcaccaacgcctccgtcgtgttcaagaaggtctcgtga

SEQ ID NO: 40596 - DNA, 420 bp, Caulobacter crescentus
gtgaccgaacgcaccttctcgatcatcaagccggacgccacgcgtcgtaacctgaccggcgccatcaacgctgtgatcgaggccgccggcctgcgcatcgtcgctcagcgccgcgtgaagctgaccgaagcccaagccaagaagttctacgaagtccacgccgagcgtccgttctacggcgaactcgtgggccagatgaccgccgagccggtcgtcgttcaggtgctgcagggcgacaacgccgtcctgaagtaccgcgaagtcatgggcgccacgaacccggaaaacgctgacgaaggcaccatccgcaagctgttcgccctgtcgatcggtgaaaactcggtccacggctcggacagcctggagaacgccggcatcgaaatcgcccagttcttcacggaagacgaaatcgtcggctaa

SEQ ID NO: 40597 - DNA, 771 bp, Caulobacter crescentus
atgctgctcatcgaacgacgcggcgccatcgccattgtgacgctcaatcgccccgaggcgatgaacgccctctccaaggcgctgagattggccctccatgacgctatcgtccaactcgaccaggatccggacgtcagcgtcgtgatcctgaccggcgccggcgatcgagccttcaccgccgggttggatctcaaggagcttggcggcgatccggccgccatgggcgcggcgaacgatcaggatgcgcggtcgaaccctgtgcgagcggtggagacctgccgtaagcccgtgatcggggcgatcaacggcgtcgcgatcactggcggtttcgaactggcgctggcgtgcgacgtgctcctggcttccgagaacgcgcggttcgccgacacccatgcgcgggtcggcatcatgccgggctgggggctgtctcagaagctgtcgcgcctgatcgggccctacagggccaaggagttgtccctcaccggcaacttcctcgacgcccgcaccgccgctgactgggggctggtcaatcgggtgacgacagcgagcgagctgttgcccaccgcattgcgtatggcccaggacatggcgtccattccggtggaagccctgtcgttctacaagtccctgatcgacgacggatacgccgtggcgtttggtgaggggctggcgctggagcacgagcggtccagcgctcacaatcgcacggtgacgcccgagcgtgtcgaggcgcagcgacgccaagtcatggagcgcggccgaggccagtag

SEQ ID NO: 40598 - DNA, 1281 bp, Caulobacter crescentus
atgaccgagatcgtcgacatcatcgcccgcgaaattctcgacagccgggggaacccgaccgtcgaagtcgacgtcattctcgaggacggcgcgttcggtcgcgccgcagtgccctcgggcgcctcgacgggcgctcacgaagccaacgaaaagcgtgatggcgacaaggctcgctatctgggcaagggcgtccagcaggcggtcgacgccgtcaatggcgagatcttcgacgcgctgtcgggcgtcgacgccgaagaccagcgtcgggtcgacaacctgatgatcgagctcgacggtacgccgaacaaggcccgcctgggcgccaacgccatcctcggcgtctcgctggccaccgccaaggccgccgccgagtccgccggcctgccgctctacaagtatgtcggcggcgtcaacgcccgcgtgctgccgaccccgatgatgaacatcatcaacggcggcgctcacgccgacaatccgatcgacatccaggagttcatgatcctgccgaccggcgccaaggacttccgcgaaggcctgcggatgggcgcagagatcttccacgccctgaagaaggctctgaaggacgcgggtcacaacaccaatgtcggcgacgaaggcggctttgcgccgaacctggcgtcggctgaagccgcactcgacttcatcgtcaaggcgggtgagaaggcgggctacaaggccggtgacgactttgtcctgggcctcgacgtcgcctcgaccgagttcttcaagaacggcaagtacgagcttgaaggcgagggcaagtcgctggatccggccgccatggtcgactacctggctggtctggtcgccaagttcccgatcctgacgatcgaggacggcatggccgaagacgacttcgacggctggaagctgctgaccgacacccttggcaagaaggtgcagctggtcggcgacgacctgttcgtcaccaaccccaagcgcctgcagatgggcctggacaagggtctggccaactcgatcctggtgaaggtcaaccagatcggcacgctctcggaaaccatcgacgcggtcgagctggcgcatcgtcacggttacaccagtgtgatgagccaccgttcgggcgagaccgaagacagcacgatcgcggacctggcggtcgctctgaactgcggtcagatcaagacgggctcgctggcgcggtcggaccggacggccaagtacaaccaactgcttcgcatccaggaaatgctggatgatcagggcgtctacgccggccgagcggccctcaagggtcgctaa

SEQ ID NO: 40599 - DNA, 1032 bp, Caulobacter crescentus
atggcgcgcacgcgcaaggctgaagcctccgaggggaaggcgccggaaaccggtgtcaacgccttcgtcggcaaggacgaactcctgaaattctatcaggacatgctgctcatccgccgcttcgaggagcgggcgggtcagctgtacggcatgggcctgatcggcggcttctgccacctgtacatcggtcaggaagccatcgcggtcggcatgcagtcgatctcgcagaagggcgaccagatcatcacgggctatcgtgaccacggccacatgctggcggcgggcatggatccccgcgaggtgatggctgaactgaccggccgtgccggcggctcgtccaagggcaagggcgggtcgatgcacatgttcgacatcgccaccggcttctacggcggtcacggcatcgtcggcgcccaggtcgcgctcggcaccggtctggccttggccaacagctaccgcaacaacggcaacgtctcctacgcctatatgggcgatggcgcggccaaccagggtcaggtctacgagagcttcaacatggcccagctgtggaagctgccggtcgtgtacgtgatcgagaacaaccagtacgccatgggcaccgccgtcgagcgcgccgcctcggaaaccgcgttccacaagcgcggcgtctcgttccgcattccgggcgaggaagtcgacggcatggacgtcatcgccgtccgcgaagccggcgctcgcgccaccgaacacgcccgtagcggccaaggtccctacatcctcgagatgaagacctaccgctatcgcggtcactcgatgtcggatccggccaagtaccgcaccaaggaagaggtcgacgaggtcaagacgacccgcgatcccatcgatcacatcaaggaacgcctggccaaggccggcgtgaccgaagacgacctgaagggcgtcgacgccgaagtgaagcgcattgtcgccgaggccgccgaattcgcccgcacgagccccgagcccgatccctcggaactgtataccgacgtctacctggaggccgccgagtga

SEQ ID NO: 40600 - DNA, 1353 bp, Caulobacter crescentus
gtgacggacatcctgatgcccgcgctttccccgacgatggaggaaggcaccctggccaagtggctggtgaaggaaggcgacaccatcaaggccggcgacgtgatcgccgagatcgagaccgacaaggcgacgatggaagtcgaagccgtggacgagggcgtgatcgaagccatcctggttccggccggtagcgagaacgtcaaggtcaacacgctgatcgcccgtctgaagggcgacggcgaagctgcggctccggctgtggccgctcccgtcgccgaggccgccacggttgtcgtcgccgctccggccgctggcggaccgatctcggccgcttcgaccttcgccgatccggaaatcccgaccggcacggcgctgaagaagatcacggttcgcgacgccctgcgcgacgcgatggccgaggaaatgcgccgcgatgaccgcgtgttcctgatgggcgaggaagtcgcccagtatcagggcgcctacaaggtcagccgtgagctgctgcaggagttcggcgaccgtcgcgtcatcgataccccgatcaccgagcacggcttcgcaggcatgggcgtcggcgcggccatggccggtctgaagccgatcgtcgagttcatgacctggaacttcgccatgcaggcgatcgaccacatcatcaactcggcggccaagacgctctacatgtcgggcggccagatcaagtcgtcgatcgtgttccgcggcccgaacggcgcggcctcgcgagtcggcgcccagcacagccaggactacgccgcctggtacggcaacgtcccgggcctgaaggtcatcgcgccctacgacgccgctgacgccaagggtctgctcaaggccgccatccgcgatccgaacccggtcgtcttcctcgagcacgagatgatgtacggccacgagttcgacatcccggacgtcgaggactgggtcgtgccgatcggcaaggccaaggtccgtcgccaaggctcggacgtcacgctggtggcctacagccgcatggtcggtttcgccctgaaggcggccgaggagctggaaaaggaaggcatcgccgccgaggtcgtcgacctgcgcacgatccgtccgatggaccacgcgaccatcctggaaagcgtcaagaagaccaaccgcctggtcacggtcgaggaaggctggggcccgatgggcgtcggcgcagagatcgtcgcccgcatcaccgagttcggcttcgactacctggacgccccgccgctgcgggtctgccaggaagacgtgccgctgccctatgcggcgaacctggaagcgctcagcctgccttcggtcgagaagatcgtgaaggcggccaaggcggtctgctacaagtag

SEQ ID NO: 40601 - DNA, 1287 bp, Caulobacter crescentus
atgtcgatcgacatcctgatgcccgccctgtcgcccaccatggaggagggaaccctcgccaagtggcacgtcaaggtcggcgacaccgtcaaggccggcgacgtgatcgccgagatcgagaccgacaaggcgacgatggaagtcgaagccgtcgatgaaggcgtcgtggaagccatcctggttccggccgggaccgagaacgtcaaggtcaacgccctgatcgccaagctggcgggcgagggcgacagccccgcgccggccccgaaggtcgaagccccgaaagccgccgccgctgcgccggttccggccgccgccccggctccggccgtgcccgcgccggccgctccggtcgccgctgacggctcgcgcgtcctggcctcgcccctggcccgccgtctggcttcggccgccggtctcgacttgaaggccctcaagggcaccggcccgcacggccgcgtcgtgaagtcggacgtcgaagccgccaagtcgggcgcgccggccgctaaggctgctccggcctcggcgcccgccgccgtcgctccgaccgccgccgcgccgcgtcagattcagtcgctggagcagatgggcattcccgccggctcctacgacctcgtcccgctggacggcatgcgcaagacgatcgcccgtcgcatgacggagagcttccgcgacgtgccgcacttcccgctcacgatcgatctcgagatcgacgccctgctggccgcccgcgccaagatcaacagcctgctggaaaagcagggcgtgaaggtctcggtgaacgacatcgtcatcaaggccgccgccgtggccctgaagcaggtgccggaagccaacgccagctacacgccggaaggcatcgccatgcaccaccacgccgacatcgccgtcgccgtggccgtcgatggcggcctgatcaccccgatcatccgcaaggccgagaccaagggcctggcgcagatctccgccgagatgaaggacctggcccagcgcgccaaggacaagaagctgaagcccgaagagttccagggcggcaccttctcgatcagcaacctcggcatgttcggcatcaagtcgttcgcctcgatcatcaacgagccgcaaggcgcgatcatgagcgtcggcgcgggcgaacagcgtccggtcgtcaagaacggcgagatcaaggtcgccacggtcatgaccgtgaccttgacctgcgatcaccgcgtggtcgacggctcggtcggcgccaagttcctggcggccttcaggccgctgattgaagagccgctgaccctgatcgtctga

SEQ ID NO: 40602 - DNA, 1401 bp, Caulobacter crescentus
atgtccacggaattcgatgtcgtcgtcatcggcgccggtcctggcggctatgtggccgcgatccgcgccagccagctgggcctgaatacggccatcatcgagcgtgagaatctgggcggcatctgcctgaactggggctgcatcccgaccaaggcgctgctgaagtccggcgaggtctacgagcagctgtcgcatctgggcggttacggtctgtcggtcgagaaggcctcgttcgacttcggcaagatcatcgagcgctcgcgcggcgtggccaagaacatgtcgggcggcatcgccttcctgatgaagaagcacaagatcgaggtgatcgagggcgaggccaagcttgagaagggcgcgccggctccgaaggtcgttgtcgccttgaaggccggcggcagccgcacggtgcaggccaagaacgtgatcctggccagcggcgcccgcgcccgcgagatcccggccatcggcgcggtctcggacggcgacaagatctggacctaccgcgacgccctggcgcccaagtctatgcccaagtcgctggtcgtgatcggctcgggcgccatcggcatcgagttcgccagcttctaccgtgcgctgggcgccgaagtgaccgtcgtcgaagccattgaccgcatcatgccggtcgaggacgaggaagtttccaaggccgcccagaaggcgttcgagaagcgcggtatcaagttccgtgtcggcgcgaaggtcagcaagatcgagaagaccaaggacggcgtcgccgtcaccgtcgaagccggtggcaagatcgagcagctgaccgccgagaagtgcatcgtcgccgtcggcatcgcgcccaacaatgacggcctggaagcgctgggcgtgagcctggatcgtggtcacgtcgtgaccgacaagcactgccgcaccaacgtgcccggcctttacgccatcggcgacatcgccggcgcgccgtggctcgcccacaaggccagccacgagggcatccacgcggccgaggcgatcgccggctacaagacgcccaacgtcctttcgccgatcccgggctgcacctacgccaatccgcaagtggcctcggtgggctacaccgaagccggcgccaaggcggcgggtatcgaggtcaaggccggccgcttcccattccgcgtcaacggcaaggccgtggcgtcgggcgagaccgaaggcttcgtcaagaccgtgttcgacgccaagacgggcgccttgatcggcgctcacatgatcggccacgaagtgaccgagatgatccagggcttcgtcaccgccatcaccctggaagcgaccgaggaagacctgcacggcgtcgtctacgcccacccgaccatgtcggaagcgatgcacgaagccgctctggacgcctacggacgcgtgctgcacatctag

SEQ ID NO: 40603 - DNA, 1554 bp, Caulobacter crescentus
atgccggtagcttacgacgtgcggaacggccaaaaggccatcttcgacgccctcatcgacgcccgcgacaagttcggcgcaaagaagccgatcctggaggaccaggatcgcaacccgctgacctatacggatctgatccgggccagctttgcgctcggccgcaagatcgccgccatgaccaagcctggcgagcatgtcggcgtgctgctgccgtcgggcgcgggctcggtggtcacgttcttcgcgctacacgccttcgggcgcgtgccgacgatgctgaacttcaccgccggcatccggaacatcaaggccgcctgcaagctggccaagatcaaccgcgtgctgacggctcacaagttcatcgaactgggcaagctgcacgacatcgtcgatgcgatcgccgagcaggcgcaggtgacctatctggaagacgttcggggcacgatcggcctgccggacaagctgttcgccgccgcagccggtatgttcccacgccagttccgggcgccggccaagccctcggacaagggcgtggtgctcttcacctccggcagcttcggcgccccgcgcggcgttgtgctgacccaggagaacctcgtccagaacgccatgcaggtcgcggcgcacatcgagctcgacccggattgggtgatgttcaatcccctgcccgtcttccactgcttcggcctgaccggcggtgtgatcctgccgatcctgaccggcatgaaggcgttccagtatccctcacccctgcacaccaagcagatcccgccgctgatcaaggacgccaaggcctcgatcctgctggcgaccgacaccttcgtgaaccagtacgcccgcgcggccgagtccgacgagctgtcgggcctggagttcgtggtctgcggcgccgagaaggttcgcgatgagacccacaccctgatcaaggaacgcttcggcggcgtgccgctgctcgagggctacggcgcgaccgaggcctcgcccgtgatcgcggtgaacaagccgaccgacaatcgccccggcaccgtcggcggactgctcccgggccaggaggtgcggatcgaacccgtcgagggcatccccgaaggcggacgcctgttcgtgcgcggtccgaacatcatggcgggctatctgcgcgaggacggcggcgtcgacgcccctgagggcggctggcatgacaccggtgatgtggtcaccatgtccgacgaccagtggatcaccatcaagggtcgcgtgaagcgcttcgccaagatcggcggcgaaatggtctcgctgaccgctgctgaagacctcgcttcggcggtctggccggacggtcgccatgcggtgatctcgatgcccgacaagaagaagggcgagaagctcatcctggtcaccgatcgccacgacgctgacgtcgcgccgcttgtcgcgcacgcccaaacgatcggcgcgcccgagctggcggtcccgcgcaagattctgaaggtcaccgaagtgcccgtgctcggcagtggcaagacggactatgtcgcgatccagcgcatggcggaaaccgacacgcaagcggcctga

SEQ ID NO: 40604 - DNA, 1410 bp, Caulobacter crescentus
atgcgccttcgccttttgtccatcacggtcgcggcgctggccgcgacctcgccggtcctggccgcgcccaagctccgcgcctgggtgacgaccggcgacaagagccagctcctggccgcgcaggcgccagtggcggcctcgtccgccgaggcgctggccggactgccggtgatcgcggtcgacgcccaggagcgtcatcagtcgattgtcggcttcggcgcgtcgatcaccgacgcctcggcctggctgatccagaacaagctcaagcccgccgaccgtgacgcgctgctgcgcgaactgttcggacgcggggcgggcggtctgggcttcagcttcacccgcgtgaccatcggcgcgtccgacttttcgctggaccactacagcctcaatgacacgccggacggcgcgccggatccggagctgaagcacttctcgctggcgcggcccaagcagcacgtgtttcccaccgtccgggcggccttgaagatcaatcccgagctgaaggtcatggcctcgccctggagcgcgccggcctggatgaagaccacgggctcgctgctcaaaggccagctcaaggccgaggcctaccccgtctacgctacgttcttcgcccgctacgttcaggaagccgccaaggtcggcgtgcccaccgactatctcagcgtccagaacgagcctgacttcgagcccgagaactatccgggcatgcggtggctgccgcaggatcgcgcgcggttcttcggcgagcacctggccccggtgttcaagcgcgataagatcaagacccgcgtgctcgactgggaccacaactgggaccagccccagcagccactgacggtcctggccgacccgaaggcgcgggctttcctgacgggcgtggcctggcactgctacgcgggcgaggtctcggcgcaggacaaggtgcgcgcggcctatcccgacaaggaggtgttcttcaccgagtgttcgggcggcgagtgggcgccgaagttcgacgacagcttcgcctggatggtcgagcaactgatcatcggctccacgcgcggcggcgcccgcggcgtgctgatgtggaacctggcgctggacgagaagttcggcccccacgcgggcggctgcggtgactgtcgcggggtggtttcgatcgacagccaaaccggcgctttgacccgcacccaggaatactacgcctttggccacgccagccgctttgtgaagcccgacgcggtgcggatcggctcgccggccaaggtcgagggacttcggaccgtggcgtttcagaaccccgatggtcagcgcgtgctgatcgtgctgaacgtgtcgaccgctgcggtcgacttcgcaattgcgtcggccggagcgcgcttcaaggcgtccttgcccgccagatcggcgggcaccttcgtctggtag

SEQ ID NO: 40605 - DNA, 1146 bp, Caulobacter crescentus
atgacagatccagatacgctcagcgccctcatcgatgtcatccaacgcttcgtcgccgagcgccttcgtcccatcgaagggctcgtctccgaaacggacgaggtgcccggatccatcatcgaagagatgaagcagcttggtctctttgggttatcgatccccgaaagctatggcggcttggggctaagccttgaggaagaagctcgcgtcatagtagcgttttgccacaccgcccccgctttccgctcgaccttcggcaccaatgtcggcatcggcagccagggtctggtgatgttcggcgacgaagctcagaaggcgcgctggctgccgtcaatcgcctccggtgagaccatcaccgccttcgccttgaccgaagccgaagccggatccgacagcgcctcagtgcagacccgcgctgtgcgcgacggtgaccactatgttctgaacggggtgaagcgctacatcaccaacgctggccgggccaacctgttcacggtgatggcgcgcaccgacccgaacaccaagggcggcgccggcgtgtcggccttcctggttcccgccgaccttccgggccttagcgtcggcaagccggaaaagaagatgggccagcaaggcgctcacattcacgacgtcgtcttcgaggacgtccgcgtgccggtggagaaccgcctcggcgccgagggcgagggcttcacagtggccatgcgcgtgctggatcgcggccgggttcatatctcggcggtctgcgtgggcgtggccgagcggctgatcgccgactgcgtggcctatgccagcgagcgaaagcagttcggccaaccgatcgccagcttccagctgatccaggcgatgatcgccgatagcaagaccgaagcactggccgccaaggccctggtctttgatacggctcgcaagcgcgacgccggcgccaatgtcacgctggaggccgccgccaccaagctgttcgcctcggagatggtcggccgggtcgctgaccgggctgtgcaggtgttcggcggcgcgggctatgtagccgactacgggatcgagcgcctgtatcgcgacgtccgcatcttccggatctacgaaggcgccagccagatccagcagctgatcatcgcgcgcgagacgctgaaacgcggtggctag

SEQ ID NO: 40606 - DNA, 1686 bp, Caulobacter crescentus
gtgatttatcggccgctcatagggcccggcgcggcgcccatcccgccgccccatagacctttggcaaagagacctcgggaggccgccgtgagctggaactatggagacatcttcgacgcggtcgcccgcgccgcgccgcccgagcgtcccgctctgatctggcgcgacgtcgtcgtgacgtggggcgaatttgatcaccgcaccaacaatatggccaaggccctgatcgatctcggactcaagccggacgcccggatcgggattctgtgccgcaatcacccggcctatctggagttcctggtcgccggcgtgaaagcgcgcctgctgaccgtcaatctcaactaccgctacacggccgacgagatcgcctacgtcctgaacgactgcaacgccgaggtgctgttctaccagtcagacttcgacgggatgctggagccgttgcgagcgcgactgcccggcgtgcaggcctgggtgcgcatcgagaacgagcgctcgcccgaagcagccccggagggcgcgctgtcctacgaaaccctggcgcggacgggcgacggcaagccgctggacatcacccgctcggccgatgacggctatctgctctacaccggcggcacgaccggcaagcctaagggcgtgcactggtccaccgaccagtcgcgccgcgtccagctggaatcgccgctgatcgcccgcgtcccccagaccatggacgagcatctggagaccgtccgcgccaccgacagccggatcattccagcctgtccgctgatgcacggctcgggcagcaactcggccatgggcgatctgctcaatggcgggacggcgatcatcctgtcgggcgaccggttcgacgccgtccagctgtggcgcgaggtcgagaagcatcgcgccacgcgagtctcgatcgtcggcgatgtcttcgccaagcccatgctgaaggccctggacgacgcgccgggcgcctttgacctgaccagcatgcgggcgatcagttcagcgggtctgacctggtccaaggaggtcaaggaaggcttgctccggcacatgcccaatatcgcgctggtcgacatcctgggtgcgtcggaagcctcaggtctgggctattcggtcgccaaggcgggcaagatcccggagaccggcgtgttcgacgccgcgccgctcaccgtgctgatcgacccggatacgggcgccgtcatgccgaaggatcggccgtccgagggcttcatcgcccgcagcggggtgatggccaacggctatttcggcgatccggagaagacggcggccacctaccggacgatcgacaacgtgcgctacgccgtgcccggcgatttcgcccgctggatgccgcccaaccagttcaccctgatcggccgaggcaacctgtcgatcaacaccggcggcgagaaggtgttccccgaggaggtcgaggaggcgctgaagctgcagccgggcgtcgccgacgtgctggtggtcgggcagcccgacgagaagtggggcaagatcgtcgtggcgatcctgaaggccgatggcgtgttcgacgaggcgcaggtccgggcgggtctggcccagacgctgtcagcctacaagcaccccaagcgcttcgttctcgtcgacaccgtgccccggcacgagagcggcaaggccgactaccgaaccgctattgcgctggcggccgagacggcctga

SEQ ID NO: 40607 - DNA, 882 bp, Caulobacter crescentus
atgacctttaccgtcgagatcatcggcaaggagcgctgtcggctgggcgagtcgccgctgtgggacgccgacgcaggggtgctctactgggtcgacagcatggcgccggccatctggcgctatgacccgttcacgagcgagcaaagatccatccccgcgcccaagcccatcggcagcgtggttctgggccgccctggcgagctgatcgccggtctcgcggacggggtctatcgcgtccagctggacaccggcgccttcacaccgatcgccctgcccgacaccctggcgccgatcgaacgcttcaatgacggcaaggccgatcgccagggccggttcgtcaccggaacgatggcgatgcacaacgagaccggacggatcggcaagctttatcgcttctcggccggcggcgcctgggaagtgctgcccaccgagccgatcgagatcgccaacagcacctgcttcagccccagcggcgacacgctctatttcgccgacagcctgcgccacatggtgtgggcgttcagctatgatcccaagaccggggcggtgggcgagaagcgcgacttctttgacaccaccggcttcaacagcgcgccagacggggcgactgtcgatgccgagggccatatctggctggccctggtgcaggcccagaagctgatccgcatttcgccggacggccgcctagatcgggtcgtcgaaagccccgcgcccttctgctcttgcccagccttcggcggcgaagacctcgacattctttatgtgacctcgatttccgacagcggcggccggctgaaaaccgacgtcgacgcttccggtcgcctgatggcgttccacggtcttggcgtgcgcggcatcgccgagacccgttgtttcctctga

SEQ ID NO: 40608 - DNA, 1068 bp, Caulobacter crescentus
atgcgcctggagccccacgagttcacccagtggcagaagctgctgtacgcccgtggctggggcgctccgtcgtggccaaaagagtatggcggcacgggctgggacccgacgaagctctacatcttcgagaccgaagcctcgcgcgccgacgcgcccgtgcagtttcaccagggtctggagttgatcggcccaatcatcttcaccttcggcagccccgagcagaaggccaagtacctgccggccatcgtctcgggcgacgactggtggtgccagggctattcggaacccaactccggctcggacctcgcctcgctgtcgacccgcgccgtgcgcgacggcaatgagtacgtgatcaacggccagaaggcctggaccagctacgcccatgtggccaaccggatgttcctgctggcccgcaccgatcctgacgcgcgcaagcaggctggcatctcgctgttcctgatcgacatcgacacgcccggcgtgacgatccgccctgtcgtgaccatggacgagatccaccacaccaacgaggtcttcctcgacaatgtgcgggtcccgccctcggccctgctgggcgaagaaggcatgggctggagctacggcaaggtgctgctggatcgcgagcgcggcgtcaccgccgccaccacgacgcgcctggcccagcaactgcgcggcgctcgcaaggtcgccgccgagaccatggtgggcgggcgcagcctgctggacgatccccgcgtcgccgatcgcctagcccagttcgagctggaggtcatggctctggaaggcatggtcatgcggaccatggccgaagccacctcgggtcaggactcggggccccgcgcctcgatgatcaagatccgctggtccgagctgctgcagcagatcaccgaatactgggtcgagctgcagggctacgacgccatggccttcgcgccgctgggcccattcgaagcgcccgacgcctgggcggccaaggggatgatctattcccgagtgaccagcatctacggcggctcgaacgaaatccaacgcaacatcatcgcccgtcgggcgctcggtctctga

SEQ ID NO: 40609 - DNA, 1149 bp, Caulobacter crescentus
atgaacttcgacctttccgaagagcagcagctcctgaaggacagcgccaggcggtacggcgccgaccacggcgacttcaccgcctggcgggcccgcgtagagcgcggcgaggcctatgacgcggccagctggcggcgcatggccgatctgggctggctgatgctgaacgttcccgaggatgacggcggcctgggcgcgggcccgacggaaaccatggtcgtggccgaggctgtcggtcgctacctgatgctggtaccgttcgtctcgaccggcgtgatcgccccgacgctgctgaccgccgcgaccgaagcgctccgcgcccacctgatggccggattggctgaaggcaagctggtgatcagcctggccgacgccgaaccgaacggccgctttgacctcaaccgcatcgccacccgcgcggaagccgtcgagggcggtttccggctcacgggcgcgaagagccacgctctggatggcggcgccgccgactggttcatcgttcccgcccgcacgaccgccgccgacgatagccaggacggcgtcagcctgttcctggttccggcagagatcgagggcctcacggtcatgcgcagccgcgccatggacaaccgccacaacgccagcctgaagctggacggcgtggtggttcccgccgccaacctgatcggcggcctgggcgaaggctttccgctgctgcgcgacgccgtcgaccgcggcgtcgtggcgcgcctggccgaggcggtcggcgccatggacgccgtccgcgagatgacgatggagtatctgaagacccgcaagcagttcggccagacgctaggcgccttccaggcgctgcagcaccgcgcggtcgacatggcgatcgcctgcgaggaggcccgctcgatgatgtacctggcgacgctcgcgctctcgggcgcccccgtcgaacgtcgaaaggtgatcgcggcggccaaggcgcgcgtgggccagaccagcctctatgtcggccgtcaggctgtgcaactgcacggcggtgtcggcttcaccgaagagctggccgtggcccactacctcaagcgcctgatcatgatcgacatggcgttcggcaacgccgaccatcaccgcgccgaactggcggccagcctgcggcccggcgccgtagcggcctga

SEQ ID NO: 40610 - DNA, 1635 bp, Caulobacter crescentus
atgctcggcctgatgcaggatacgcctctgacgttgtcctcgctccttgatcacgcagcgcgttttcacggcgaggtcgagatcgtttccagggaacccggcggcgtgactcgaaccaactacgcgcgggtcgcggttcgggcgcgcaagctggcggccgccctgcgccgacgaggactgcgcgaaggcgaccgtgtcgccagcctggccctgaacagcgcccgacacctggaactgtactacggcgccaccggggcgggcggcatcctgaacaccgtcaatccgcgtctgtttcccgagcagatcgccttcattctgcgtcacgccgagaaccggatcgtgttctttgatccggccttcggacccctgctggagaccctggtcgaccaggcgccgcaggtcgaagcctatgtctgcctgtccagcgcgggcgacatgccgagcctgcgcctgcccaatctgatcgcctatgaagacctgctcgcgcctgaggccgacgatgcgccctggaccgttgtctccgagaacgccggcgccatcctttgctatacctcgggcaccacgggcgatcccaagggcgtgctctacagccaccgttcgttggccctgcacgccttcgtggcgacgggcgcggacggcatggcgatctcgcgccgtgacagcatcctgctggtgacgccgctattccacgtcaacgcctggggcattcccttcagcgccgccatgtgcggggccaagcttgtcctgcccggcgccgccgtcgacggcgaaaacctgttcaacctgatgcgagccgagcgctgcaccttcagcctgggcgtgccgacggtctggctgggcttcctcgactatgtcgccacccatcgcgaggaactggatctggcggggctggcgctggagcggatcctggtcggcggctcggccgcgccacgcagcatgatcgagcgtttcgactacatgctgggcgtctatgtcatccatgcctggggcatgaccgagaccagtccgttggccacgatcggcacgccgctgcccgagcacgccttcctcgatcgccaggcgcgatacgacattcaggccctgcagggccgggccatctacggcgtcgagctccgcatcgttgacgccgacggcgtggtcgcgccgcatgacggcatggccgtcggcgaccttcaggtgcgcggcccctgggtcgtgcggcgctacttcaaggccgacgcgccggccaccaccgaggacggctggttccccaccggcgacgtggccaaaatccatcccaacggctacctgcagctgacggaccgctcgaaggacatcatcaagtccggcggcgaatggatctcgtcggtcgaccttgagaacgtcgccatcgcccatcccgacattcgggaggctgcggtcatcggcgtgccgcatccaaaatggcaggagcgtcccttgctgatcatcgtaccggcgccggagacgacgcccgacaaggacgacatactcaagttcctggcctcgcgcgtggcgcgctggcaggtgcccgacgacgtggtgatcgtcgagagtctgccgcacacggcgaccggcaagctgttgaaggccaagctgcgcgagacctatcgcgactacctggccgagcccgcctga

SEQ ID NO: 40611 - DNA, 1566 bp, Caulobacter crescentus
atgacctccaaggcgcagtcgcgcgtggttctggtgaccggcggcgcggatggtatcggctgggcggcgtgccagcgcttcgcccgcgcgggggaccaggtgctggtcgcggaccgaaacgtcgagcgcgcgcgcgaacgcgccgacagcctgggccccgatcaccacgcgatcgctatggacgtctcctcggaggcccagatccgcgaagggttcgagcagctgcatcgcgagttcggccggctcgacgtgctggtcaacaacgccggcgtcaccgaccctcagccgaccgccaccctggaccagacggccgaagaggtggcccggctgcaggcgatcaacgtcacgggcgccttcctggccgcgcgggaagccggacgcctgatgatcgagcaaggccacggcgcgatcatcaacctggcctcgggcgcggggctggtcgccctggccaagcgcaccagctatagcgccagcaaggcggcggtgatctcgctgacccggaccctggcctgcgagtgggcggcgaagggcgttcgcgtcaacgccgtcctgccgggctacacccgcacccagatggtccaggaccagatcgatgcgggtcttctggatccctcgatcgtactctcccgtattccgctgggccggatgggcgagcccgaggagatggccgaaggcgcgttcttcctggccagcgacgccgccagctatgtcgtcggcgcgaccttggtcgtggacggcggctacacggtctatggcggttcggggccagcctcgacgacgcccgcgccaagccccttagccccctcgccccgcgtcagcgcgatcaccggcggcggccgggggatcggccgctgcgtcgtggatctttttcacgctgctggcgaccgtctgctggtgatcgagcgcgatgcggagggcgccaaggcgctcgccgaggccctgggcgacgagcacatcgtcgttcaggccgacatcaccgacgtcgcggcggtcgaggcggccttcgctcaggcccaggcgcgctgggggcgactggatgtcttgatcaacaacgccggcgccgccgacgtcttcaagccctcgctggagcagaccgcccaggacttcaccagcgtctacgacctcaactttagcggcccgctggccaccgccaaggccgccgcgcgcctgatgagccagggcggcgtcatcgtcaatctcggctccatagcgggcctgggcgccctgccccagcgcaacgcctactgcgccgccaaggcggccgtgacgatgatgagccgcagcctggcctgcgaatgggcctccgccggcatccgcgtgaacacggtcgcgcccggctatatcgagacccccgccgtcctggccctcaagtccgccggacgggcgcagttcgacaagatccggcgccgcgcgccgatcggccgtctgggcgatcccatggaagtcgcccggaccatcgcgttcctggcctcccccgccgccagctacgtggccggcgccaccctgaccgtcgacggcggctggaccgccttcggcgacgccggcgacgccagcgacatcctataa

SEQ ID NO: 40612 - DNA, 1554 bp, Caulobacter crescentus
atgactgaattcaccgacctagggctatcgcccacgaccctgcaggcggtcgccgacaccggctataccactgcgacccccatccaggcccaggccattcccgtcgccctcgcgggccaggacgtcctcggcatcgcccagacgggcaccggcaagaccgccgccttcaccctcccgctgatcgaccgcttgcagtcgggtcgcgccaaggcccgcatgccgcgcgccctggtcatcgccccgacccgcgaactggccgaccaggtggccgccagcttcgagaagtacgccaagggcaccaagctctcctgggccctgctgatcggcggcgtgtcgttcggcgaccaggaaaagaagctcgatcgcggcgtcgacgtgctgatcgccacgccgggccgcctgctcgaccacttcgagcgcggcaagctcctgatgaccggcgtgcagttcctcgtcgtcgacgaggccgaccgcatgctggacatgggcttcatcccggacatcgagcgcatcttcaagatgacgccgcccaagaagcagaccctgttcttctcggcgacgatgccgccggaaatcacccgcctgaccaagcagtttctgcgcgatccggtgcggatcgaggtggcgcgtcctgcgaccaccaacgccaacatcacccagctgttggtcaaggttccctcttctgatccgaaggccaagcgcttggcgctgcgggccctgatcgaaaaggccggcatcgagacgggcatcgtgttctgcaaccgcaagaccgaggtcgacatcgtcgccaagtcgctgaaggtgcacggctatgacgccgcccccatccacggcgacctcgaccagacccagcggatgaagaccctggcggacttccgctcgggcgcgctgaagatcctggtggcctcggacgtcgccgcgcgtggcctcgacatcccggccgtcagccacgtcttcaactatgacgtgccgcaccatgccgacgactatgtccaccgcatcggccgcaccggccgcgcgggccggacgggtatcacctacatgctggtcacgccggccgacgacaagggcttcgacaaggtcatcaagctgatcggttcgacgccggacgaagaaaagctggacctcgactactccaacgccgtcaccgtcaagcgcgagggcgaccgcaagcgcgggggccgcgaccgtgatcgtggcgagcgtggtgaacgcagcgagcgccccgcgcgcggacgcggtcgtggccgcgagcgcgccgaagaaacggtcgaagcgccggcggaggctgtcgccgaaatcgtcgacacccccgctatggccgaggagcgccctgcgcgcgaacgccggccgcgccgtgagcgcgagcccaaggcggccgcgcctgcgccgaccgcggtcgaagccgagcgcccggcccgcgccgagcgtcctgaacgcccggtgcgcggggttcagccggtccgtgaccgcgacgacgatgatcgtcgcgtggtcggcttcggctcggacgtgcccgccttcctcgcgcgcccgccgcgcggcgcgaagtag

SEQ ID NO: 40613 - DNA, 1458 bp, Caulobacter crescentus
atgaacgcaccggtgaatttgtcttccgacgcgcacaaggcggtgatgaacgacgtgttgcagcgccagaaggccgcccatcttcgggatggtccgcccagcgctgaaaagcgaatccaatggctgaaccgatgcattgacctgctggtcgggcaccaggccgagatcgccaaggcggtgaatcaagacttcggctcccgatcgcccgaggcgacgtcgctgacggacgtggccggctcgatcggcccgctgaagcacgcccgcgagcatctgaccaagtggatgaagccggagaagcacaagacgacgccggcgatcctgggtctgttcggggccaaggcgacggtgcagtggcagcccaagggcgtggtcggggtgatcagcccctggaacttcccggtcaacctgacctttgcaccgctggcgggcgtgttcgccgccggcaaccgcgcgatgatcaagccgtccgagttcacgcccgcgacgtccgatctgctgaaggccatgttcgccaaggcgttcaacgaggaggaagtcgccgtcttcgtcggcgggccggaggtcgggcaggcgttctcgggcctggccttcgaccacctggtgttcaccggcgcgacctcggtagccaagcacgtgatgcgcgccgccgccgaaaaccttgttcccgtcaccctcgagttgggcggcaagagcccggtgatcctctcgcgcggcgccgacatggcgaccgccgccgctcgggtgatgaacggcaagaccctgaacgccggccagatctgcctggcgcccgactatgtcctggccccgcaggaagacgtcgaagccttcgtcaaggaagcccaggccgcggtcagccgctacttcccgacgatcaaggacaatcccgactacacggctgtggtggcccagcgccactatgatcgggtcaaaggctatgtcgacgacgctcgcgccaagggcgctcgggttatcgagatcaatccggccggcgaggatctgtcgcagcaagagcaccgcaagattccgccgaccctgatcctcgaccccaccgacgacatgaaggtgatgcaggaagagatcttcggtcctgtgctgccggtgaagggctacaagaccgtcgacgaggcggtcgactatgtgaacgcccacgaccgcccgttggcgctctattggttcgggaccgacgaggccgagaaggaccgggttctggaacgcaccaccagcggcggcgtcacggtcaatgacgtgatcttccacgtggctcaggagaacctgccgttcggcggtatcggtccggccggtatgggcgcctatcacggctatgacggcttccgcgagttcagtcaccgcaaggcggtgttccagcagctgaagaaggatatcgctccgatgctgggcctgcggccgccctatggcgagggcatccgcaagtatctggcgggccagatcaagaagtag

SEQ ID NO: 40614 - DNA, 441 bp, Caulobacter crescentus
atggtaaaaccgatccacgtgctgagcgggcccaacctcaacctgttgggaacacgcgagcccgagatttacggcaaggacaccctcgatgatgtccggacgcgctgtgaggcgcgggcggcttcgcgtggcgtttcggtggtcttccgccagtccaaccatgaaggcgtgctgatcgattgggtgcacgaggcgcgtgagtcggcctcggcgctggtcatcaatccggccggatacggccacacgtcgattgcgctgctggatgcgctcaagaccttgagcatccccgtgatcgagtgtcacttgtccaacccggcggcgagggaggaattccgccgccatacctacgtttcgctggcggccacggggatcgtctccgggttcggcgcggcgagttacgaactggcgatcgaggccgctttcggcctgatccgcgcatag

SEQ ID NO: 40615 - DNA, 1347 bp, Caulobacter crescentus
atgttcgacaagatcctcattgcgaaccggggcgagatcgcgctccgggttcaccgcgcctgtaaggaaatgggcatcgccacggtggcggtccattccgaggccgaccgcaactctatgtgggtgcgcctggccgacgaaagcgtctgcatcgggccggctccggccgccaagagctatctgaacatcccatcgatcatcgcggccgccgagatcaccggcgcccaggcgatccacccgggctatggcttcctgtcggaaaatgcccgcttcgccgagatcgtcggcgcgcacggcttcaccttcatcggtcccaagcccgagcacatccggatgatgggcgacaagatcaccgccaagcaggctgtgaaggacgccggcatcccggtcgttcccggctcggacggcggcgtgtcgaccgaggaagaagccttcgaggccgccgagaagatcggcttccccgtcctgatcaaggccgccgccggcggcggtggtcgtggcatgaaggtcgcccagacccgtgaggacctggccgaagcggtctcgaccgcccgcgccgaggcccgcgccgcctttggcgacgacacggtctatatggagcgctacctccagaagccgcgccatatcgaactgcaggtcatcgccgacagccacggcaacgtcgtgcacctgggcgagcgcgactgctcgctgcagcgtcgtcaccagaaggtgctggaagaagccccctcgcccgccctgtcggccgaaggtcgcgccaagatcggcaaggtcgtggtcgatgcggtcaaggccatcggctatctcggcgtcggcaccatcgagttcctgtgggagaacgacgagttcttcttcatcgagatgaacacccgcctgcaggtcgaacacccggtcaccgaagccatcaccggcatcgacctggtgcgcgagcagatccgcatcgccgccggcctgccgctgtcgttcacccaggacgatgtcgtcttcgagggtcacgccatcgagtgccggatcaacgccgagaacgcgcgaaccttcacgccctcgccgggcgtgatcaccgacttccacgcccccggcggcctgggcgttcgcctggattcggcgatctacaccggctacgcgatcccgccgtactacgacagcctgatcggcaaactgatcgtgcatgggcgtgaccgcgccgaatgcatcgcgcgtctgaagcgctgcctgggcgagatggtggtcggcggtgtcgaaaccacgattccgctgttccaggaccttctggtgcagcccgatatcctggccggtgactacaacatccactggctggaacgctggatcaaagcccaagaagcttaa

SEQ ID NO: 40616 - DNA, 762 bp, Caulobacter crescentus
atgaccctttcgagcacaacgccccggcctctgatcgccggaaactggaagatgaacggcctttcggtcgccctcgacgaggcccgagccgtcgccgccgccctggaggcgaaacctccggccgcccgcgtcgcgatcttcccgcccgccaccctgttgcatcgtctgagccaggcggtggaaggggcgcatctccttaccggcggtcaggattgccatggcaagtcgagcggcgcgcatacgggcgatgtctccgccgagatggtcgcggacgcaggcggatcgctggtgatctgcggccactccgagcggcgcactgaccacggtgaaacctcagcccaggtggccggaaaggctgaagccgccgccgcggcgggcctggagccgatcgtctgcgtcggcgagaccctggagacccgtgaagcgggccaggcggtaagctttgtcgtgagccaggtgcgggactcgctgccaacctcgctggccggcaaggcgttcagcgtggcctatgagcctctgtgggcgatcggcacgggccgaacggcttcggtcgacaacatcgtcgagatgcacgcggccatccgcgccgagctggtctcccgtttctgcgagcagggccggaccgtcctgatcctctatggtggctccgtgaagcccgaaaacgctcgcgagatcctcgccgcgcccgaggttggtggcgcgctggtcggcggcgcttcgctgaaggccaaggacttcctggcgatcatccaggcgctttaa

SEQ ID NO: 40617 - DNA, 1413 bp, Caulobacter crescentus
atgtcgaaccccacccctaccggcgtcgtcacgcgcttcgccccctcgcccaccggtttcctgcatatcggcggcgctcgtacggcgctgttcaactggttatatgcacgccatacgggagggaagttccttattcgcgtcgaggacaccgatcgcgagcgctctaccgaagcggccgtcgccgcgatcttcgaagggctggactggctgggcctgaaatccgacgacgaggtgatcttccagcacacccgcgcgccgcgtcacgtggaggtggtgcatgagctgctggccaagggccgcgcctatcgctgctggatgagcatcgaggagctggaggtcgcccgcgaaaaggcccgcgccgagggccgcgcgatccgttcgccgtggcgcgacgcgcctgaaggcgacctctccgcgccccacgtgatccgcttcaagggaccgctggacggcgagaccctggtcaacgacctggtcaaggggcctgtcactttcaagaacatcgagttggacgatcttgtcctgctgcgcgcagacggcgcccccacgtacaatctcgcggtcgtggtggatgatcacgacatgggcgtgacccacgtgatccgaggcgacgatcacctgaacaacgccgcccgccagaccctgatctatcaggccatggactgggcggtgccggccttcgcccacatcccgctgattcacggcccggacggcgccaagctctccaagcgccacggcgcccaggccgtcggcgaattcgctgaccttggctacatccccgaaggcatgcgcaactatctggcccgcctgggctggggtcatggcgacgacgaagtcttcaccgacgagcaggcgatcagctggttcgacgtcgccgatgtcgtcaaagcccccgcgcgcctggactgggccaagctcaatcacatcaacgcccagcacctgcgcaaggccgacgacgcgcgtctgacggccctagccttggcggcggcggaaacgcgcggcgagcccctgcccgccgacgcggccgagcgcatcgcccgcacggttcccgaggtcaaggaaggcgccaagacgatcctcgaactggtcgatcactgcgcattcgcgctgaagacccgcccattggcgctggaagagaaaacccaaaaacagcttaccgaagagacggtcgagcggctgaagcgtctgcgcgaccaactggccgccgcgcccgacttcgacgctgcaaccctggaaaccgtgttgaaatcattcgcggaatccgaaggcgtcggctttggcaagttcggtcccgcgctgcgcggagtcctcacgggcggggcgcaggctcccgacttgaacaagaccatggcggccctctcccgcgatgaggcgattggccgtcttgacgacgcgctagcgcctcgcgcatga

SEQ ID NO: 40618 - DNA, 1281 bp, Caulobacter crescentus
atgaccgataaagccacgctgacgatcggcgacaagagctatgagctgccgatcctcaagggcagcacgggtccggacgtcatcgacgttcggaagatctacggtgaaagcgatcacttcacgttcgatccaggcttcacctccaccgcctcgtgcgagagcaagatcacctatatcgacggcgacgcgggcatcctgctgcaccgcggctatccgatcgaccagctggccgagaagtcctcgttcctcgaggtctgctacctgctgctgaacggcgaactgcccaaggccgacgagttcgccaagttcgagcacaacatcacctaccacacgatgttgcacgctcagttcgaccgcttcttcgagggcttccgccgcgacgctcacccgatggcggtcatgaccggcgccgtcggcgctctgtcggccttctattcggacagcatcaatgtcgacgacgcccgtgagcgcgagatcagcgcccatcgcctgatcgcgaagatgccgacgatcgccgcccgcgcctacaagtacacggtcggccagccgttcgtgtcgccgcgcaacgacctgtcgtattcggaaaacttcctgcgcatgtgcttcgccgtgccggccgaggactggaagccgaacccggtgctgacccgcgccatggaccggatcttcatcctgcacgccgatcacgagcagaacgcctcgacctcgaccgtccgtctggccggttcgtcgggcgcgcacccgttcgcctgtatcgccgccggcatcgcctgcctgtggggcccgtcgcacggcggcgccaaccaggaagcgcttgagatgctggagaccatcggttcggtcgacaacatcaaggactacgtccagggcgtgaaggaccggaagtacaagctgatgggcttcggccaccgcgtgtacaagaacttcgacccgcgcgcgaaggtcatgcaaaagaccgcgcacgaggttctggccgagctgggccataacaacgatccgctgctgcaggtcgcccaggagctggaaaaggtcgccctgaacgacccgtacttcgtcgatcgcaagctgtacccgaacatcgatttctattcgggcatcaccctgcgcgcgatgggcttcccgaccaacatgttcaccgtgctgttcgccctggcccgcaccgtgggctggatcagccagtggaaggaaatgttcgaggaccccacccgcaagatcggtcgtccccgtcagctctacacgggcgccacgcatcgcgactacgtcacgctcgacaagcgctaa

SEQ ID NO: 40619 - DNA, 480 bp, Caulobacter crescentus
atgggcgacaacgcagagcaagcggtgcagaccgatatcgacatcgcggagatcctggcgcgcatcccgcaccgttatccgttcctgctggtcgaccgggccgaggactacaatccccaccagtcgatcgtcggcatcaagtgcgtgacgatcaacgagccgttcttccagggccacttccccggcaacccggtcatgccgggcgtgctgatcatcgaggccctggcgcagaccggcgcggtgctgatgagcaagtcgctggaagtcgacaccgagggcaagacgatcttcttcatgtcggtcgacaacgcccgtttccgcaatccggtccgccccggcgacgtgatccgcatggaagtcgaggtgctgcgcgcgcgctcgtcgatcttcaagttcaagggcgtggccaaggtcggcgacaaggtggcggccgaggctgagttcgccgccatggtcgtcgagacgggacccaaggcatga

SEQ ID NO: 40620 - DNA, 2061 bp, Caulobacter crescentus
atggcaatcgccaaggtcaatggcgtcgaggtcgagttcgaacccggcatgacggttctgcaggtcgcggagctggccggggaagagatcccgcgcttctgctatcacgaacgtctgtccatcgccggcaactgccggatgtgcctggttgaggtgaagcccggcccgccgaagccgcaggcctcgtgcgccctgccggccgccgaaggtcaggagatcttcaccaagactccgatggtcaagaaggcccgcgaaggggtgatggagttcctgctcatcaaccacccgctggactgcccgatctgcgaccagggcggcgaatgcgaccttcaggatcaggccgtcggttacggccgtgacgacagccgctatgaagagaacaagcgcgccgtcgaagaaaagtcgatgggcccgctgatcaagaccgtgatgacgcgctgcatccagtgcacgcgttgcgtccgcttcatcaccgaggtcgccggctcgccggagatcggcctgatctcgcgcggcgaagacgttgaaatcacgacctatctgggcgcggcggtgacgtcggagctcagcgccaacgtgattgacctgtgcccggtcggcgccctgacctccaagccctacgccttcgaagcccgtccgtgggaactgaagaagaccgagagcgtcgacgttatggacgccctgggctcttcgatccgcgtcgacgcgcgcagcgccgccgttctgcgcgtgcttccgcgcatcaacgacgaggtcaacgaggaatggatctcggacaagacccgctacgcggtcgacggcctgggccgtcagcgtcttgaccgtccctatgttcgcgtcggcggcaagctgaagcccgcaacctgggccgaggcctttgcggccatcgccgccaaggtcaagtcgaccgcgccggagcgcgtgggcgtgatcgccggcgacctgcaggacgccgaaagcctgaaggccaccaaggacctcttcaccgccctgggcgtgaagaacctcgacagccgtcaggacggttcggccctgggcgcgggtccgcgcgaaggctggctcttcaactcgacgatcgccggcatcgagaacgccgatgtggtgctgttcgtcggcgccaatccgcgtcttgaggccccggtgctcaacgcccgcttccgcaagcagtggctggccggcaagacccgtttcggcgtgatcggcgagcaggccgatctgacgttcgactacgattatctcggcgccggcgccaagaccctctcgggcctggccaagagcaagaacgactttgtcgccgccctgaaggccgccgaacgtccggcgatcatcatcggccaaggcgctctggcgcgcgccgacggcgcggcgatcctcaaggccgccgcgggcctggccaagtccgtgaaggtcgtccgtgagggctggaacggctggaacgtgctgcacaccgccgccgcgcgcgtggcgggcctcgacatgggcttcgtcccggccgagggcgggctgtcgaccgccgagatgctgaagccgggcgcgctggatgtgctgttcctgctgggcgccgacgagtgcgagaccgctgcgtcggacgccttcaagatctatctcggcacccacggcgacaacggcgcccacaaggccgacgtgatcctgccgggcgcggcctataccgaaaagaacggcctctatgtgaacatggaagggcgcgtccagatgggccgccgcgcggtgttcccgaagggcgaggccaaggaagactggtcgatcctgcgggcgctgtccgaggttctgggtcacaagctgccctacgacagcctggaccaactgcgcgccaagcttttcgccgatcacccgaccttcggtcagatcgactatgctccgggctcggtggccacggtgttcgatgtcggcgccctgggcgttgacggtgaggtctcggacgcgccgttcgaaagcccggtcaaggccttccacctgaccaaccccatcgcgcgcgccagcgtgaccatggccgagtgcgcggccgtggcctcgggcgccgccaagatcgcggcggagtag

SEQ ID NO: 40621 - DNA, 2400 bp, Caulobacter crescentus
atgtccgaactacgtacgcttcctgtcttgccgctgcgggatatcgttgtgttcccgcacatggtggtgccgctatttgtgggccgcgataaatccgtgcgcgcgctcgaagaggtgatgcgcggcgacaagcagatcctgctcgtgacgcagaagaactcggctgacgatgatccggcgccgggcgacatctttgaggtcggcgtgctggccaccgtgctgcagctgctgaagctgcccgatggcaccgtgaaggttctggtcgaaggcaaggcgcgcgccgccgtcgtgagcttcaccgatcaggagtcttactatgaggctcagatcggcgaggtttccgaagacgatggggcgggccctgaggccgaggcgctgtcgcgggcggtcgtcgagcagttcgaaaactacgtgaagctgaacaagaaggtgccgccggaggccctggcgtcgatcccgcagatcgctgagcccggcaagctggccgacagcatcgctgcgcacctctcggtgaagatcggcgacaagcagaacctgctggaaatcttcgacgtcgtgaagcgcctggagaaggtcttcgccctgatggagggcgagatctcggtgctgcaggtcgagaagaagatccgctcgcgcgtgaagcgccagatggagaagacgcagcgcgagtactatctgaacgagcagatgaaggcgatccagcgcgagctgggcgatcctgacgatgcgcgcgacgagctgatcgatctcgaaaagcggatcaagaagaccaagctttccaaggaagcccgcaccaaggccgagagcgagctgaagaagctgcgcaacatgagcccgatgtcggccgaaagcactgtggtccggaactacctggactggctgctgtcgatcccgtggggcaaggccaagaccaagaagatcgacctcgtcgagagcgagggcatcctggacgccgaccactatggtctggagaaggtcaaggagcggatccttgagtatctggccgtgcaggcgcgcaccaactcgctgaaggggccgatcctttgccttgtcggccctccgggcgtgggcaagacctcgctgggcaagtcgatcgccaaggcgaccggccgcgagttcgtgcgcatgagcctgggcggtgtgcgcgacgaagccgagatccgcggtcaccgccgcacctacatcggctcgatgcccggcaaggtcgtccagtcgatgaagaaggccaagacgaccaacgccttcgtcctgctggacgagatcgacaagatgggcagcgactatcgcggcgatccggcctcggcgctgctcgaggtgctggacccgtcgcagaactcgaccttcggcgatcactacctggaggtcgactacgacctgtcgcaggtgatgttcgtcacgacggccaacagcctgaacatgccccagccgctgctggaccgcatggagatcatccgcatccccggctacaccgaggacgagaagctggagatcgccaagcggcacatcctgcccaagctggccaaggaccatggcttgaagccggccgagttcatcgtccccgacaaggcgatccgcgaccttatccgctactacactcgggaagctggcgttcggtcgttggagcgggaactgggcgccctggcgcgcaaaacggtgcgggatctggcccgggaaaaggtcgcctcgatcacgatcgacgacgagcgtctggccaagtacgcgggcgtgaagaagtaccgctacggtgagaccgacgaggtcgaccaggtcggtatcgtgacgggcctggcctggaccgagttcggcggcgacattctcacgatcgaagccgtgaagatgccgggcaagggtcgtatgcagatcaccggcaatctgaaggacgtgatgaaggagtcgatcgcggccgcgaacagctatgtccgctcgcgcgcgctgcagttcggcatcaaaccgccggtgttcgagaagaccgacgtccacatccacgttccggacggcgccacgcccaaggatggtccgtccgcaggcatcgccatggccttggccatggtgtcggtgctgaccggtatcccgatccgcaaggacatcgccatgaccggcgagatcaccttgcgggggcgcgttacagcgatcggcggcctgaaggagaagctgctcgcggcgctccggtcgggcgtcaagacggtcctgatcccgcaggagaacgagaaagacctggcggacgtgccgcaaaccgtgaaggacggtcttgagatcatcccggtgtcgaccgtggatgaggtgctcaagcatgccctgaccggccccctcacgccggtggagtggaacgaggctgaggagccgatcaccacctctgcaaagaaggatgacggcgacagcgacgccatgctgacgcactaa

SEQ ID NO: 40622 - DNA, 669 bp, Caulobacter crescentus
atgagcggagggacgacgaaggccgccgagaacgccaaggccgatctgccgcgcctgatgaaggcgttgcgcgaccagggcgtcaccgatcctcaggtgctcaaggccatcgagaccacgccgcgcgacctgttcacgcccgacctcttcaaggaccgctcgtgggaagattcggccctgccgatcgcctgcggccagaccatcagccaaccctatatcgtcggcctgatgacccaggccctgacggtcgagccgcgctcgcgggtgctggagatcggcaccggctcgggctaccagacgacgatcctgagcaaggtgtcgcggctggtctatacgatcgagcgctatcgcaccctgatgaaggaagccgaagcgcgcttcaacacgctgggtttgaccaatgtcatcaccaagttcggcgatggcggcgaaggctgggccgaacaggcgccgtttgaccgcattatggtcacggctgcggcggaagatgatccaaagcggctgctctcgcagctgaagccgaacggcgtgctggtcgcgccggtcggcaaggggcctgtccagagccttcggcgctacgccggagacggcaagggcggcttccgggtcgagattctctgcgacgtacgcttcgtgcccctgctggccggcgtcgccaaggatcagtga

SEQ ID NO: 40623 - DNA, 789 bp, Caulobacter crescentus
atgcgtatcgccacctggaacgtcaattcgatcaatgctcgcctggaaggggtattggcgtggttcgaatcggaagctcccgacgtggccgtgctgcaggagatcaagtgcgtcgacgaaaagttcccgaccgaagcctttgaacggcttggctataacgtcgcggttcacggccagaagacctataatggcgtggccctgctctcgaagcatcccatcgaggatgtccgcaagggcctgcccttcctgtccgaggacgaggtcgacgagcaggcgcgctatatcgaggcggtgatcgccgcgccgacgccgttccgcgtcgtgggcatctatttgccgaacggcaatccgatcgggactgagaagttcgcctacaagctttcctggatgcgccgcttgcacgcccacgcccaaggcctcttggcgttcgaggaaccgctggtgatcgccggcgactacaacgtcattccggaggtcgaggacgtcgccaacccgcaggcctggctgggcgacgccctgtttcagccggagagccgcgcagccttccgcgccttgaagaacctgggcttcgccgacgcctatatgcaggccgacggcgcgccgggcggctacaccttctgggattatcaggccggcgcctggcagcggaacctcggcatccgcatcgaccacctgctgctgtcgccgcaggcggccgaccgtttgacgggcctcgtcatccaccgcgacgaacgcgacaaggaaaagccctcggaccacgtgccggtggtcggtcgtttccgtatctag

SEQ ID NO: 40624 - DNA, 1002 bp, Caulobacter crescentus
atgcatctcgctcgctttcctcgcgcccgcttcgcccacctgcccacgcccctggaacccatgccgcgcctcggcgcggagctggggatcgacctctgggtcaagcgcgacgactgcaccggcctggccggcggcggcaacaagacccgcaagctggagttcctcctcggcgaggccctgatccagggcgccgacaccctggtgacccagggcgcggttcagtccaatcacgtgcgccagaccatcgctgccggcgcgcgctttggcctcaagaccgaggtgatcctcgaagagcgcaccggctccaaggccagcgactatatgggcaacggcaacgtgctgctcgacaagctgatgggcgcgtcgctgcgctatgtgccgggcggcacggacatggtcgccgagctcgacagcactgcggagaacgttcgtcagcgcgggggtaagccctacgtgatccccggcggcggctcgaacacggtgggcgcgctcggctatgtcgattgcgcgcgcgagctcgtcgtccaggccgaccagatggacttgaagatcgatcgcctggtcacggcgaccggcagcgccggcacgcacgccggcctggtcgccggcttcgccgcgctgtccgtcgatatcccgatcctgggcttcggcgtccgcgcgcccaagcccaagcaggaagagaacgtctataaccttgccgtcgccacggccgagacgatcggcgctggtggccgggtcaggcgcgaagcggtcgtcgccgactgcgactatgtcggtgagggctacggcctcgtggaccaaggcgtgatcgacgcgctggccctggccgcccgcaccgaaggtctgctgctggatcccgtctattcgggcaaggcgatgaaggggctgatcgaccaggcccgcaaaggcgcgttcaagggcgagcgggtcgtcttcctgcacaccggcggcgcccagggcctgttcggctatcagacggtgctcgagccggcgctgggatag

SEQ ID NO: 40625 - DNA, 1206 bp, Caulobacter crescentus
atggccgatttcggggcaaccgatctcgacgccttccgcgccgacacccgcgcctggctcgaagccaactatccaaaatccctgaacgcgccgatgggcgaagacgaggccccgtggggcggccgcaagatggtgtggaagaaccccgacgccaagctgtggctcgaccgcatggccgaacgcggctggaccgccccgatgtggcccaaggaatacggcggcggcggcctctccaaggcccagaacaaggtgctggaacaggagcttcgccgcctcaaggcgcgcccggccctgatgagcttcggcgtctggatgctgggcccggtgctgctggaatacgccaccgaggagcagaagcagcgtttcctgcccgcgatcgtccgcggcgaaacccgctggtgccagggctacagcgaacccggtgcgggctctgacctcgcctcgctgcagaccaagtgcgaggacaagggtgaccactatctgatcaacggccagaaggtctggaccagctacgccgaccaggccgactggatcttctgtctggtgcgcaccgacaccagcaagaagcacgagggcatctcgttcgtgctgttcgacatgacctcgcccggcgtcgaggcccgcccgatcaagctgatcagcggctcctcgcccttctgcgagaccttcttcgacaatgtgaaggtcccgaaggaacagctcgtcggcaagctgaacggcggctgggacatcgccaagcgcttgctgcagtacgaacgccagaacatcagcgcctcgggctttggcggcggcggcggcctgtcggttgtcgaagcggccaagaaggagctcggcgtcgacagcgagggccgcatcgctgatggcgatttccgcgcgcgtctggcggctcactcgatggacgcccacgccttcatgctgaccgtgcgccgcgccgaggcggagtccaagcagggctcgggccccagcgccgccgtctcgatcatcaagtacgccgccgccaagatgaaccaggagcgcaccgagctgctggtcgaggccctgggacttcagggcctgggctggtcgggcgaagacttcagcgccgaggaactggccgcaccccgcgccatgctgcgcgccaagggcaactcgatcgagggcggcaccagcgaggtcaacctcaacgtcgtcgccaagcgggtcctgggccttctggatcaccagtaa

SEQ ID NO: 40626 - DNA, 1134 bp, Caulobacter crescentus
atggccgtcctgaccgaagaacagacgatgctgcgcgacgccgccaagggctgggccagcgaaagcgcgcccgtcggcgccctgcgcaagctgcgcgacagcaagagcaagcagaccttcgaccccgccgcctgggccgagatgggccagatgggctgggccggcgtgatcgtgcccgaggcctatgacggctcggccttcggctatctgggcctgggcctgatcctggaagagaccggccggaccctggccgcctccccgctcctctccaccgccatgatcgccgcttcggcgctgcagctgggcggctccgacgctcagaagcaggcttggctgcccaagatcgccaccggcgaggccgtggcgacgctggcgatcgacgaaggcgctcaccacgcccccgcccgcaccgccctgtcggcgacccaaagcggcgcaggctacgtgctgaacggaaccaagaccctggtgctggacggtgaggccgccgacctgctgatcgttgcggcccgcaccagcggcgcgccgggtgacaccaacggcatcaccctgttcctcgtcgcgggcgacgccgccggcgtgacccgctcgcacctgtcgctgatcgactcgcgcggcgcggccaagatcgcctttgacggcgtcgaggtcggcgcggacgcggtgctgggcgaggtcgacaagggctgggccgtgctggagccgaccctggaccgcgcctatgcgggcctcgccgccgagatgctcggcagcgccagcgccgccttcgacatcaccctggactacttgaagacgcgcacccagttcggccaggtcatcggcacgttccaggccctgcaacaccgcgccgccaagtggttcaccgacctggagaccacccgctcgtgcgtcgaagccgcgctcgaggcgctggacgccggcgccgacagccgcgcgctggcctttctggccaaggccaaggccagcgagctggtgcacctggcgtcgaacgagatggtgcagatgcacggcggcatcggtatgaccgacgcccacgacgccggcctgtacatgaagcgcgcgcgcgtcaccgaggccctgttcggcggggccagcttccaccgcgaccgctatgcgcgcctgatgggattctga

SEQ ID NO: 40627 - DNA, 1431 bp, Caulobacter crescentus
atgatccgcgcccgtcgctcgcgcatcgtcgccaccctcggtccggcgtcgagctctttcgacatgatcgtcaccctggccaaggccggggctgacgtctttcgcctgaacttcagccacggcgcccacgagacccacgcggccgtctatgcggccattcgcgaggcggagaaggtcgtcaatcgcccgctgggcgtgctggccgaccttcaggggcctaagctgcgcgtcggcaagttcgccgatggtccggtgatgctgaaggccggccaggcgttccgcttcgacagcgatccggcgccgggcgacgagacgcgcgtgcatctcccgcacccggaaatcctgaccgccatgcggccgggcgcgaccctgctgctggacgacggcaagctgcggatgaccgtgacggatgcgggccccggctacgccaacaccaaggtcgtcaacagcggcaaactgtcggaacgcaagggcgtagcggtgccggatgtcgtcatcccgatgtcgccgctgaccgccaaggaccgtgaggacctggccttcgccctgcgcctgggcgtggactgggtggcgctgtcgttcgtgcaggcccctgaggatatggccgagctgcgccggatcgtcgaaggccgcgccgccgtgctggccaagatcgaaaagccgcaggcgctgaaggtgctgggcccgatcctggatctctgcgacggcgtcatggtggcgcgtggcgatctcggcgtcgaaatggcgcccgaggaggtgccggtcgcccagaaggaaatcctgcgcgcggcgcgtgagcggggcattcccgtgatcgtcgccacccagatgctggagtcgatgaccagctcgccgacccctacgcgggccgaggcgtcggacgtcgccaacgccgtctatgagggcgccgatgcggtgatgctgtcggcggagtcggcggcgggtgactatcccgaagagtcggtctcgatgatgaaccgcatcatcgaacgcgttgagcgtgacccgaagtggccagagctgatgtacgccgagcagagccacgacgacgtggacgccgacgtgctggtggtcgccgccgccggggcggccaagtcggggtccaccaagtgcctcgtggccttcaccaccacgggcgcgaccgcgcgccgcctctcgcgcgagcgccccttgcagccggtgctggccctgtcgcccgagatcagcgccgtgcgtcgcatgtgcctggtctggggtgtggagccgcgcgtcagcgctcagcccgacagcctggaggtcgtcacgacggacgcgtcgagcaaggcgttggagcttgggctggtggcgcccggtgagcgactgctggtcgtcgcgggcacgcccttcggcgctccgggcgcagcgaaccttctgcgcctggcgcatgcgcccgcgccggcgcgccggcgttag

SEQ ID NO: 40628 - DNA, 1422 bp, Caulobacter crescentus
ttggtgctgctgggcggagcgggcgatttggccctccggatgctgctgccttctctgtatttcctggagctcgaccgactgctgccgcacgatctgcggatcattggcgtcgcccgggccgaccatgacgcggccagctacaaggcgctggtccgcgagcaactgggcaagcgcgcgacagtggaggaggcggtttggaatcgcctcgccgcgcgcctcgactacgtgcctgcgaacatcaccagtgaggaagacaccaagaagctggccgaacggatcggtgcgcatggcacgctggtcatcttcttctcgctgtcgcccagcctctacggcccggcttgccaggctttgcaggccgccggcctgacggggcccaacacgcgcttgatcctcgaaaagccgcttggccgcgatctcgaaagctccaaggccaccaacgccgccgtcgccgctgtggtcgacgagagccaagtgttccgcatcgaccactatctgggcaaggaaaccgtccagaacctgacggccctgcgcttcgccaacgtgctgttcgagcccctgtgggatcgcaacacgatcgaccatgtgcagatcaccatcgccgagaccgaaaaggtcggcgaccgctggccctactacgacgaatacggcgcgctgcgggacatggtgcagaaccacatgctgcaactgctgtgtctggtcgccatggaagcgccctcaggcttcgatcccgatgcggtgcgcgacgagaaggtcaaggtgctgcgctccctgcggcccttcaccaaggagaccgtggcccacgacaccgtgcgtggccagtacgtcgccggtgtggtcgagggcggcgcgcgcgctggctatgtcgaggaagtgggcaagcccaccaagaccgagactttcgtggccatgaaggtcgcgatcgacaactggcgttgggacggcgtgccgttcttcctgcgcaccggcaagaacctgccggaccgccgcacccagatcgtcgtccagttcaagcctttgccgcacaacatcttcggtccggcgaccgatggcgagctgtgcgccaaccgcctagtcatcgacctgcagccggacgaagacatctcgctgacgatcatgaacaagcgtccgggtctctcggacgagggcatgcgactgcagtcgctgccgctgtcgctgtcgtttggccagaccggcgggcgccgtcgcatcgcttacgaaaagctgttcgtcgacgccttccgcggcgaccgtacgctgttcgtgcgtcgcgatgaggtcgagcaggcctggcgcttcatcgacggcgtctcggcggcctgggaagaggccagtatcgaaccggcgcactatgcggcgggcacctggggaccgcagtccgcccagggcctgatctcgcccggcggccgagcctggaaggcctga

SEQ ID NO: 40629 - DNA, 1923 bp, Caulobacter crescentus
atgtcttccaaaactcctctgctcgacacgatcgcctcgcccgccgatacgcgcggtctctcgctcgccgagctcaagcagctcgcggcggaagtccgggctgagacgattgacgccgtgtcggtgacgggcgggcacctgggcgcgggcctgggcgtggtcgaactgacggtggccctgcaccacgtgttcgagacgcccaaggacatcgtcatctgggacgtcggccaccaggcctatccgcacaagatcctcacgggtcgccgcgaccgcatccgcaccctgcgccaaggcggcggcctgtcgggcttcaccaagcgggccgagagcgaatacgacccgttcggcgcggcccacgcggccacctcgatctcggcggcgctgggcttctgcgccgcgcgcgacgccaagggcgaggataacagcgtcatcgccgtgatcggtgacggctcgctgggcgcgggcatggcctatgaggcgatgaacgcggcgaccgatacgaccaagcgcctgatcgtcatcctcaacgacaacgacatgtcgatcgccccgccggtgggcggcatgagcgcgtacctggccaacctcgtgtcgggcggcgcctatcgctcggtgcgcaagctgggcaagaccgtcgtcgagaaactgcccacgccgatgcgcgaagccgcgcgcaaggcggaagagtacgcccgcggcatggtcaccggcggcaccttcttcgaggagctcggcttctactatatcggcccgatcgacggccacgacatggacgccctggtcagcgtgctcaagaacgccaaggcgttcggcgacaagcccgtgctggtccactgcgtcacccagaagggcaagggctacgcgcccgccgaaggcgcggccgacaagctgcacgcggtggtcaagttcgacgtcgtcaccggccagcagcagaaggcggccggcggcccgcccagctacaccaaggtcttcgctcaggaactgatcaagcaggccgagaaggacgacaagatcgtcgccatcaccgccgctatgccctccggcaccggccttgatctgttcggcaaggccttccccgagcgcaccttcgacgtcggcatcgccgagcagcacgcggtgaccttcgccgcgggcatggcggccgacggcatgaagccgttcgcggcgatctattcgaccttcctgcagcgcggctacgaccaggtggtccacgacgtcgccatccagggcctgccggtgcgcttcgccatggaccgcgccggtctcgtcggcgccgatggtcccacccacgccggcagcttcgacatcggcttcatgggcgctctgccgggcatggtgctgatggccgccgccgacgaggtggagctggcccgcatggtcgccaccgccgccgagatcgacgaccgtccaagcgccttccgctatccgcgcggtgagggcctgggtctcgacatgccggccatcgccgagccgctggagatcggcaagggccgcatcgtccgcgaggggaccagcgtcgccatcgtctcgttcggcacgcgtctgtcggaaagcctgaaggccgccgacctgctggccgcgcgcgggctttccgccaccgtctgcgacgcccgcttcgccaagccgctcgatctcgacctcctgctccgactggcccgcgagcacgaggccatcatcacggtggaagagggttcgatgggcggcttcggcgccttcgtgctgcaggccctggcccagcacggcgccctggaccgcggcctgaagatccgcaccctgtgcctgccggacgtcttccaggatcaggacaagcccgacgcgatgtacgcccaggcgggtctggacgccgaaggcatcctgcggggcgcgctgtcggccatgggcatggacaatgtcagcgcggcgggcgcggggcggcgggcttaa

SEQ ID NO: 40630 - DNA, 885 bp, Caulobacter crescentus
atgagcgaccttgccaagcggatcgtccaagccgccgacatcgtcaccgtggcgctggacgagctgttgccgcgcgccgacggccccgagagccgcctgaccgaagccatgcgctatgcggccctggggcccggcaagcgcctgcggccgttcttcgcgcttgagaccggcaagatgttcgatctgcccgagcggccggtgctgcgcgcggcgtgcgcgctggagtgcatccacgcctacagcctggtgcatgacgacctgcccgcgatggacgatgacgacgtgcgtcgtggtcgcccgaccgtgcacaagcaatacgacgaggccacggccatcctggcgggcgacgccctgcagacggcggccttcgagatcatggcccacccggacacccacgacgacggccatgtccgctcggaactggtgcgcaagctggctatcgcctcgggcgcgcgcggaatgtgcggcggccagatgatcgatctcctgggcgttcgcgacgatctgggcgctgtggcgcgcatgcagcggctgaagaccggcgccctgatcgccttcgccttcgagatcccgctgatcatcgcccgcgccaaggagtccgagcgctcggccctgatggccttcgctcaggacctgggtctggcctaccagatcgtcgacgacatcctcgacgccgagggcgatgaggagaccctgggcaaggccgccggcggcaaggacgccgccaagggcaaggccaactacgtcactttgttggggctggatgcggccaaggagcgcgtgacccttttggccgagcagacgcgttcccatctcgaaatctttggcgaacgggccgaacatctccgcgcgagcgttgatttcgtgctggaccgccgcaactga

SEQ ID NO: 40631 - DNA, 1059 bp, Caulobacter crescentus
atgaatcgccgcgccctgatcttgtcagcctgcgccgccgcgctgtcggcgtgcgcgccgctgcgccagcggccggagctggcggcgctggggtttcgagggccgcgtctaacggatgaagctttcatcagttttgatggcgcgcaccttggtctgatgcgctggctgcccgccggcgagcccgactgggtcgtggtcggcctgcacggcatgaacgactatgccaacgcctatcatctggccgccgcctggtgggcgggcagggggatcgcgacctatgcgctggacgtgcgcgggttcggtcgctcgcccgcgcgcggcgtctgggcgcagccggagctcgtcatcgaggatgtccgcctgctggtcgaggccgtgcgcgagcgccatccgcgcgccaaggtcgccctggccggaatcagcatgggcggcggtctggcgatcagcgccatggccacgcccgacccgccccgcgtcgacaagctgatgctgttcgcgccggcggtctggggttggtcgaaccagccgttgcccaacaagctgagtttgtggatcaccgcccatgcgaagggcgactgggtggtcaagcctcccgagtggctggtgcgcaacgtcatgccttccgacaacatcgacgaactgcgccgcatgggtcgtgatccgctgatgatctggggcgcgcgctccgacaccctctatggcctggtcggactcatggagcgcgcctggaggtcgccgggcgcgatctcgaccccggtcgcctggttctatggcgccaacgaccacgtcattccccgcgcgccgacggtcgaagcggtgagccgcctcaagtctggcgcgcttacggcctactatcccaagggctatcaccttctgctcgtcgatctgcaggctgaagcggtctggcgggacgccgaggcgttcctgcgtgacgcgccgggggcctggccgccgtcggatgttccggccattccctccagtctcgcggcgatgacagcgttggatccgcccaagacggccaaacgcggcttgtcgcaaggtcagcgttcgggcttgtga

SEQ ID NO: 40632 - DNA, 906 bp, Caulobacter crescentus
atggcggacatccgcttcgacggcaaggtggcgatcgtgacgggcgccggcggcgggcttggccgacagcacgccctggaactggcgcgtcgcggcgccaaggtcgtggtcaacgacctgggcggctcgatggacggctcgggcggttcgtccgaagcggcccagaaggtggtcgacgagatcaaggccttaggcggcgaagccatcgccaacggctcttcggtcaccgacgacgcgggcgtcgccctgatgatcaagcaggccatggacacctggggccgcatcgacatcctgatcgccaacgccggcatcctgcgcgacaagaccctgaccaagatggagctggccgacttcgagctggtcatgcaggtccacgtcttcggcaccttcaagccgatcaaggccgtctgggacatcatgaaggcccagaactatggccgcatcgtcgtgacgacctcgtcgtcgggcatgtacggcaacttcggccagagcaactacggcgcggccaagatggcggtgctgggcctgatgaacaccctcaagctcgagggcgccaagaacgacgtcaagatcaacgccatcagcccggtcgcggccacccgcatgaccgagggcctgatgccgcccgaagtgctggccaagctggcgccggaatatgtgacgccgggcgtcgtctatctctgctcggacgaagcgcctaccggcgcgatcctgaccgccggcgccggcgccttcgccctgtcgcggatctatgagaccgagggtgtctatctgggcgaaggcggcctgtcggccgaggaagtccgtgacagctggggtcagatcaccgccgaggatggccagaaggcctatttcaacggcggcgaacaaggccagaagttcttccgcaagatggccggcggctga

SEQ ID NO: 40633 - DNA, 666 bp, Caulobacter crescentus
gtgagttttccccgccgcgtcgagggcgtggtcttcgacatggacggcctgctgctggacaccgagatcgtctatcgcgcggccatgatcgaagccggccaagtgttcggcatcggcttcaccggcgagatctacgcggcgatggtgggcaagacgacgccggagtgcggggtcatgctccgcgagctgttcggcgagaccttcccggttcaaagctatttcgagcgggtctgggccgatgtcgaggacctgctggaggccgagacgcggctgaaggccggcgtcatcgagattctcgacttcctcgacgaccagggactgccgcgcggcattgcgacgtcgaacggcaagccggcggtggagcgctatctgggtcgctttgatctgttgccgcgcttccatgcggtggtcgcgcaccacgatgtggtccgccacaagccccatcccgacccgtaccttgaggcggcccgccgcattggcgttgatccggccgcgtgcctggcgctggaggactcgcaccccggcgttcgcgccgcccatgcggccggcatgatgacggtgatggtgcccgacatcctcgatccgaacgaggagatgcacgacaagtgcgtgcacatcgccgacagcctgcaccatgtgctggatttgctgaaggcctcggcctga

SEQ ID NO: 40634 - DNA, 1392 bp, Caulobacter crescentus
atgaccgccacgcgtatcgagaccgacacctttggcccgatcgaagtcgccgccgaccgctactggggcgcgcaagctcagcgcagcctgggcaacttcaagatcggctgggaaaagcagcccctgcccgtcgtccgcgccctgggcatcgtcaagcgcgccgccgccgaggccaacctcgccttgggcaagctggacccgaagatcgccgagacgatcatcgccgccgccaacgaagtgatcgagggcaagctgaacgaccacttcccgctggtggtctggcagaccggctcgggcacccagtcgaacatgaacgccaacgaggtgatctcgaaccgcgccatcgagatgctgggcggtgagatgggcagcaagaagcccgtccaccccaacgaccacgtcaatatgagccagtcgtcgaacgacaccttcccgacggccatgcacatcgcctgcgccgaacaggtggtccacgacctgctgcccgcgctgaagcacctgcacaaggccctggccgccaaggccgccgagtggaaggacatcatcaagatcggccgcacccacacccaggacgccaccccgctgacgctgggccaggagttcggcggctacgctcagcagatcgagaacggcatcgctcgtatcgagatgaccctgccgatgctgatgcaactggcccagggcggcaccgccgtcggcaccggcctgaacgcccccgtgggcttcgccgagctggtcgccgagcagatcgccggcatcacgggcctaggcttcaccacggccccgaacaagttcgaggccctggccgcccacgacgccatggtcttcacccacggcgccatcaacacggtggccgccagcctgttcaagatcgccaacgacatccgcttcctgggctctggcccgcgcgccggtctcggcgagctttccctgccggaaaatgagccgggcagctcgatcatgccgggcaaggtcaatccgacccagtccgaagccctgacccaggtctgcgcccaggtgttcggcaaccactcgaccctgaccttcgccggcagccagggccatttcgagctgaacgtcttcaacccggtgatggcctataacttcctgcagtcggtccgtctggtcgccgacgcggcgatcagcttcaccgacaactgcgtggtcggcatcgagccgcgtgtcgacaacatcaagaagggcgtcgagaacagcctgatgctggtcacggccctgaacggcaagctcggctacgacgcctgcgccaagatcgccaagaccgcgcacaagaacggcaccaccctgcgcgaggaggccgtcggcggcggctatctgacgaacgaagagttcgaacagtacgtccgccccgaaaagatgatctcgccgggctga

SEQ ID NO: 40635 - DNA, 1017 bp, Caulobacter crescentus
atggttttggacgcagccgcagcgaccctgccccggaagtcgggatcggtggatcgtctcgtgcgcctcgccgaggccgacatggcgggcgtcaaccgtctgatcaccgatcgcatgcagagcgatgtggcgatcatccccgccctggccgagcatctgatcgccgcgggcggcaagcgcctgcgtccgctgatgaccgtggccgccgcgcgtctggccggcgccgacaacgaccacttccagaagctggccgccgccgtcgaattcattcacaccgccaccctgctgcatgacgatgtcgtcgacggcagccagctgcgccgcggcaaggtcgccgcgcacctgatctggggcggcgcgcagagcgtgctggtcggcgacttcctgttcgcccgcgccttcgagctgatggtcgagaccaactccatgaaggcgctggagatcctcgcccgcgccagccgcgtcatcgccgagggcgaggtgctgcaactgatgcgcagccacgacctgaatctgtcgcaggcggtctatctggagatcatccaggccaagaccgccgagctgttcgccgccgcttcggaagccggggcggtttcggccggtgtcgatgtggcgaagtccgaggctttgcgggattacggcctgaacctgggtctggcgttccagctggccgacgacgccctggattacggcggcgcgaccgaaaccctgggtaagaacgccggcgacgacttccgcgaaggcaaggccacactgccgctgctgctggccatcgcccgctcgggtccccgcgaagccgagttctgggagcgcgctatcggtcggcgtgagcagactgaggccgatttccgtcgcgcccgcgaactgatcatcggctcgggcgcgctggacgcgacgctggatctggccgctgactatgccgacaaggccaaggccgcgctggcgatgttcccggccaatgactggcgcgaggcgcttgaggagctggccgactttgcggtcagccgccgcgcctag

SEQ ID NO: 40636 - DNA, 516 bp, Caulobacter crescentus
atgagcatgcccaccctcgccattgtcgtcgcccgcgccgccaatggggtgatcggtcgcgacggcgacctgccctggcgcctgaaatcggatctggctctgttcaaggccaacaccctgttcaagcccatcatcatgggccgcaagacctgggacagcctgccgcgcaagcccttgcctggccggaccaatatcgtgctgtcccgcgaccagagcttcgagcccgagggcgcggtggcctgcgagacctggatggaggcgtttgagatcgcgcgcgaacaggccgccgatgatggcgctgacgaggtctgcgtgatcggcggcagcgccttgttcgaactggccctgcccaaggccaagcgcctctatctcaccgaggtggccgccgaggtcgagggggacgttcgctttcccgccttcgacgagtccgcctggaccgaggtacgccgcgaggcccacccggctggcgacggcgatgatcacgccttcgtctttcgcgttctggagcgacgctaa

SEQ ID NO: 40637 - DNA, 1212 bp, Caulobacter crescentus
atggatctggcgttctcggccgaggacctggccttccagcaagaggtgcgcgactggatcgccaccgcctatgacgatgatctgcgccgtcagatgagccagtccaagaacggctatctggacaaggccggccaggtgaagtggcaaaagaagctggctgagcgcggctgggcggcgccggactggcccgtcgagctgggcggcgcgggcttcacgccctcgcagcgctacatcttcaatatggagatgagcctggccggcgtgccgacctcgtcgccgatgggcctgaagatggtcgctccggtgatcatggcgttcggctcggacgcgcagaaggcccagcacctgccgccgatcctcaactcagacatctggtggtgccagggttattcggagccgggctcgggctcggacttggccagcctgcagatgcgggcggtgcgcgacggcgacgactacgtgctcaacggctcgaagatctggactacccacgcccagtgggccgactggatgttctgcctggtgcgcacctcgaccgagggcaagccgcaggaaggtatctcgttcctgctgctgcggatggacacgcccggcatccagatcaagccgctgccgaccctggacggcccaccggacaacgagcaggagatcaatcaggtcttcttcgacaatgtccgcgtgccggtcgccaatcgcatcggcgaagagaacaagggctggacctacgccaagtacctgctcgagttcgagcgcggcaacgcctatgcgcccggcctgatgaatatgctcaagaaggtcaagcgtatcgccgcgctggagcgggccgacgatggcggacgcctgatcgacgatccggatttccgcagcaagatcgccaacctggagatccaggtcgaggcgctcaacgcctccgaattgcggatcttctccgggcgcggcgcgggcaagaatatcggcccggcctcgtcgatgctgaagtgcgtcggctcagagcatcagcaggcgatcaccgaactgacgctcgaggcggtgggcaactacgccacgccgttcgtgcgtgacacctggtcgcccgccaacgatggccgcgcgggtcccgactatgccggtcccgccgcgccggcctatttcaactatcgcaaggcctcgatctacgccggttccaacgagatccagcgcaacatcatggccaagatggtgctgggtctctag

SEQ ID NO: 40638 - DNA, 1410 bp, Caulobacter crescentus
ttggccctgggcggcgcggctctggggctatcggcgtgcgaggggccgggcgaaacggacctgacccccaagggtcggcagtttccgaaggactttgtctggggcgtggctacggccgctttccagaccgaaggttcgcaaaccgccgacgggcgcgggcccagcatctgggacgtgttcgagagagttccgggccacgtcaagaatggcgacaccgctgcggacgccaccgacagctatcggcgctaccaggacgatgtcgacctgatcgccggcgccagcctgagcgcttatcggttctcgatgagctggtcgcggattctgccgaccggggcgggcgcggtgaacgccgcaggcctcgatcactattcgcggctggtcgacgcgctgctggccaaggggatcacgccctacgccaccctgtttcattgggacctgccgcaaggcctgcaggacaagggcggctgggcgaaccgcgacacggcccagcgtctggcggactatgcgcgcgccgtggtcgagcggctgggcgaccggctgaagaactacatcattctcaatgaggcggcggtccataccgtgttcggccacgtgctgggcgatcatgcgccggggctcaaggacgctgcgctgctgggtccagtcacgcaccatatgaatctgggccagggtctggcgatccaggctctgcgcgcggcgcggagcgacctttcggtaggcaccacgatggcgcttcagccgtgccggccggcgggtgggccattggcgttctggaaccggctggcgtcggatggtctggacgagatctggaaccttgcctggctcgacccgctgttcaagggaacctaccccaaggcgatggaggagccgctcaagggcgtggttcgcgacggcgacttgaagaccacgcgccagcctgttgatttcctgggggtgaactactacgcgccggcctacgtgcggctggatctgtcggcgcccagcaagatcgccgccgccgccgcgcccaatagcgccgagcaggacgcgttcggccggcacatagatccgtccggcctgttcgaggttctggatcgtgtgcgccgcgagtacggcgcgcccaagatgctggtgaccgagaacggatgttccgacccgttcagcagcggtccagcgatcttggatgacaccttccgcatcaagtacttgcgccgccaccttgaggcggtgctggcggcccgcgaggcgggttgtgacgtccgggggtatttcgagtggaccctgatcgacaatttcgagtgggacctgggctacacctcgaagtttgggatcacgacgatggaagccgccagcggccgtaggatcccgaaggcgtcctacggctggttcaaggccttggcgcagaccgggaccttgccgtcctccccctga

SEQ ID NO: 40639 - DNA, 1077 bp, Caulobacter crescentus
atgaccgatctctccatccgcgccaaccgcgtcgccgccctgaaggccgccgccaaggagcgtattctcattctcgacggctcctggggcgtgatgttccagaagaaggggctgaccgaggccgactaccgcgccgagcgcttcgccgcctacaacggccagatgaagggcaataacgacatcctgtgcctgacgcggcccgatctcgtggccgagctgcacgacgcctatttcagcgccggcgccgacatctccgagaccaacaccttctcgggcaccaccatcgcccaggccgactatcatctgggtgaacaggatgtctgggacatcaacctggaaggcgccaagatcggccgctcggtggccgaccgctggaacgcgcagaatcccgaccgcccgaagttcatcgccggctcgatggggccgctgaacgtcatgctgtcgatgtcgtcggacgtgaacgatccgggcgcgcgcaaggtgaccttcgaccaggtctacgaggcctatcgccagcaggtggatgcgctttaccagggcggggtcgatctcttcctgatcgagaccatcaccgacaccctgaactgcaaggccgcgatcaaggcgatcctggactggcgcgacgagggccacgaggagctgccgatctggatcagcggcaccatcaccgatcgctcgggccgcaccctgtcgggccagacggccgaggcgttctggaacagcgtcaagcacgccaagccgttcgcagtgggcttcaactgcgccctgggcgcggatttgatgcgtccgcacatcgccgagatggcccgtatcgccgacaccctggtcgcagcctatcccaacgccggcctgcccaacgccatgggccagtacgacgaggagccgcacgagaccggccacgccctgcacgagtgggccaaggacggcctcgtcaacatcctgggcggctgctgcggcacgacaccggaccacatccgtcacgtcgccgacgaggtgcgcggcgtgacgccgcgccagatccccgagcgccccaaggccatgcgcctggcgggcctcgaaccgttcgagttggcttag

SEQ ID NO: 40640 - DNA, 2217 bp, Caulobacter crescentus
atgaaaaagccctcgctcacggcgctcgcggccgttctcgccctctctacgcccgccctggcgcagaaactcacccctgaacgtattttcggcgatcccagcctgagcggccccaccgcgcggggcgtcgcgctttcgccggacggcaagcgcgtgacctatctgaagggcaagcccgaggcggccaacatccaggacctgtgggcggccgacgtgaagggcggcgagccctatcgcctgatcgacagcgccgcgctgtcctcgggcgacaaggagctgtcggaagccgagaaggcccgccgtgagcgcgcccgcgtctcggcccgcggcatcgtcgagtacagctgggaccgccagggccgcttcatcctggtcccgctggacggcgacctctatctagacgccgtcgccgacgggaagatcacccgactgaccgaaaccccgggcgacgaggtcgacgctaaggtctcgcccaagggtggctacgtctcttatgtccgcgaccagaacctgtacatcaagcccgtcgcaggcggcgccgagacggcgctgactaccgacggcaaggacgcgctgtccttcggcgtcgccgagttcatcgtccaggaggagctcgaccgcttcaccggctactggtggagcccggacgagagccgcatcgtctacacccgagtcgacgaaagcggcgtcgacatcgtgccgcgcgccgacatcggtccgggcggagccaccgtcgtcaatcagcgctatccgcgcgccggtcgccctaacgccgtggtggatctgttcgtgcgcgacctggcttccggcaaggtcacggccctcgacctcggcgccaacaaggacatctatgtcgcgcgcgtcgcctggtcggcagacggcaagaccgtctatgtccagcgcctgtcgcgcgaccagaagacgctcgacctcctggccttcgacgcagccaccggcgccggcaagaccatccttaccgataccgatccgcatttcatcgaggtcagcaacgacttccgcccgcttacggacggcacgttcctgtggggctcggagaaggacggcaaccagcatctctatcgctacgccgccgacggcaagctgatcgcccagatcaccaagggcgactggccggtcatcggcctggagggtgtcgacgaggcccgcaaggtcgccatcttctcggcctcgatcgatacgccgatcgagcgtcgcctgtatgaggtgagctacgccaagccgggcaagcccaaggccctgacctcggccggcggctggtgggccgcaaaggtcgccgacaacggcggcgccttcgccggcacctacagcgatcccaaaaccccgtcccagaccgccctctattcggccgacggcaagcgcgtgcgctggatcgaggagaacaagctggccgagggacatccctactggccctacgccgccaatctgccccagcccgagttcggctcgctgaaggctgcggacggcgaaacgctgcactatgagatcctcaagcccatcggcttcgatccggccaagaagtaccccgccatcgtctcggtctatggcggcccgcacgctcagcgcgtgatgaagaactggcatagcccgtcggagcgcacctatctcgaggccggctatgtgatcttcaagctggacaatcgcggcagcggcaaccgctcggccaagttcatgcgcgccctggaccgcaagctcggcaccgtcgaggtcgaggaccaattgctgggcgccaagttcctggccagccagccctatgtcgacgccgacaagctgggcgtgatgggctggtcctatggcggcttcatggccctgatgctgctgaccgccgagaacaccccgttcaaggccggcgccgccggcgcgccgccgaccgagtggagcctgtacgatacggcctacaccgagcgctacatgggcaagcccgacgagaacaaggccggctacgcctattcggacatcaacaaccggatcgacaaactggcgccgggcagcctgttgctgctgcacggcatggccgacgacaatgtgatcttcgagaacagcacccggctgatggccgccctgcaacgcaaggcgatcctcttcgagatggccatgtatcctggcgaacgtcacagcgcgcccggtagcaaaaccaagggcctcagcgtgctgaagacccacctggacttcttcgatcgcaaactgaaggggcgctga

SEQ ID NO: 40641 - DNA, 1965 bp, Caulobacter crescentus
ttgctctcctccgtcctgatcgccaatcgcggcgagatcgcccgtcgcatcatccgcaccgctcgcgagctgggcgtgcggacgatcgccgtctattccgaggcggacgccaatgcgccgttcgtcatggaggccgacgcggcgatcctgatcggtccggctccggccaaggagagctatctggacccgcgcaagatcctggcggcggccaggcagatgggcgccgaggcgatccatccgggctatggcttcctgtccgagaacgccgagttcgcgcagagcgtgatcgatgcgggcctcgtctggatcggtccgcccccgtcggcgatccgggccatgggcctgaaggacgccgccaaggcggtgatgatcaaggccggcgtgcccaccacgcccggctatctgggcgaggatcagtcggtcgaacggctcacggtcgaggcggccaagatcggctatccggtgctgatcaaggccgtggccggcggtggcggcaagggcatgcgcaaggtcgagcgtgcggaggacttcgaggcggcgctcggctcgtgccgtcgcgaagcctcggccgcgttcggcgatgatcgcgtgctgctggaaaaatacgtcactcggccgcgccacatcgaggtgcaggtgttcggcgacagccacggcaacgtcgtccacctgttcgagcgcgactgctcgctgcagcgtcgccaccagaaggtcatcgaggaagcgcccgcgcccggcatggacgaggcgacccgtgaggcggtctgcgctgcggcggtcaaggccgcccaggcggtgaactatgtcggcgccggtacggtcgagttcatcgccgacgccagcgaaggcctgcgcgccgaccgcatctggttcatggagatgaacacccgcctgcaggtcgagcacccggtcaccgagatggtcaccggccaggacctcgtcgagtggcagctgcgggtggcctcgggcgagccgctgccgctggagcaggacgagatcaccttggacggctgggccatggaggcgcggctctacgccgagaacccggccaccggcttcctgccgtcgaccggcaaactcaagcactttcgcctgcccgaaggcgatgttcgcgtcgacagcgcggtcgaggagggcggcgaggtcacgccgttctacgacccgatgatcgccaagctgatcgctcacggcgccgaccgcgaggacgccgcccagcgtctggccgaggcctgcgccctggtcgaggtctggccggtcaagaccaacgccgccttcctggccaagtgcgccagtcatccggacttcgtcgacggcgccgtcgataccggcttcatcgaggcccgtttggacgagctgaccgaacgcgccttcagcgacgagccggccatggccgcgatcggctggcggctggacagcttcctcgaagcggaagcccgccgcgatccgtgggagggcgcgccgtccaagctgctcggtttccgcatgaacgcgccgcgcgcgtcgatgcatctgccgatgtcgaccgacggcaaggccacgccgctgcgtgtggcgctgatcggcggcggaactgaggactggtcctgggatatccgccacgccgacggctcgacctttgatgaggtcacccgcctgccgaccacctatggcaagggtccgatccaggtgttcgagggcggcgacgtccaggagttcgacttcgtggccaagatcggcggggcgggcgagggcggggcctcggacggcgccatcctgtcgccgatgccgggcaagatcgtctcggtctcggtctcggccggtcagacggtgagcaagggccaaaccctgctcacgttggaggccatgaagatggagcacgccatggccgcgccgttcgacggcgtggtggctgaactgtcggcggtggccggcggccaggtcagcgagggcgtggtgctggcccgtctggaaccggctgtggcctga

SEQ ID NO: 40642 - DNA, 1137 bp, Caulobacter crescentus
atggacttcgcgctgggcgagaccgctgacgcgatccgtgagaccacggcccgtttcgccgccgacaagatcgcaccgatcgccgccaagatcgacgagaccaacagcttcccccgcgaactctgggtcccgatgggggatctgggtctgcatggcatcaccgtcgaggaagagttcggggggctgggtctgggctatctcgaacacgtcgtggcgatggaagaggtcagccgcgcctccgcctccgtggggctcagctacggcgcccactccaatctctgcgtgaaccagatccgtcggtgggccacgccggagcagaaggcgcgctatctgcccaagctgatcagcggcgagcatgtgggctccctggcgatgagcgaagccggcgcgggctctgatgtcgtctcgatgaagctgcgcgccgagcaggtgggcgaccgctacatcctcaacggcacgaagttctggatcaccaacgccccgcacgccgatacgctggtggtctacgccaagaccggcgagggcagccgcggcatcaccgccttcatcgtcgagaagggcatgaagggcttcagcgtctccaagaagctggacaagatgggcatgcgcgggtcggacaccgccgagctggtgttcgaagactgcgagatccccgaagagaacgtcatgggcccggtcggcggtggcgtcggggtgctgatgagcggcctcgactacgagcgggccgtgctggcggccggtccgctgggcatcatgcaggcttgcctcgatgtcgtgctgccctacgtccgcgaccgcaagcagttcggccagccgatcggctcgttccagctgatgcagggcaagatcgccgacatgtacgtggccctgaactcggcccgggcttacgtctacgcggtggccaaggcttgtgacgcgggcaagaccacgcgcttcgacgccgccggcgcgatcctgatggcgtcggaaaacgccgtgaaggtgtcgctggaggcgatccaggccctcggtggcgctggctataccaaggagtggccggtcgagcgcctgctgcgcgacgccaagctctatgacatcggcgccggcaccaacgagatccgccgcttcctgatcggacgcgagctgatcggcggctga

SEQ ID NO: 40643 - DNA, 2010 bp, Caulobacter crescentus
atgttctcgaagatcctgatcgccaaccgtggcgagatcgcagtccgggtgatcaagacctgccgtcgtctggggatcaagacggtggtcgtctactccgacgccgatgcgggcagcctcgctgtggagatggccgacgagaccgtacacatcggcgcctcgccggccaatcagtcctacctcgtcgccgacaagatcatcgccgcctgcaagcagacgggcgcgcaggccgtgcatccgggctttggcttcttgtccgagaacgccggcttcgcccagcgctgcgccgacgagggcatcgtcttcatcggccccaaccccggcgccatcagcgccatgggcgacaagatcgagagcaagaagttcgctcaagccgcgggcgtctcctgcgtgccgggccacatcggcgagatcgccgacaccgccgaggccgtgaagatctccgaggagatcggctatccggtgatgatcaaggcgtcggccggcggcggcggcaagggcatccgcgtggcctggacccgcaaggacgtcgaggagggcttcccggctgtccgcgccgaggccaaggccagctttggcgacgaccgcatcttcatcgaaaagttcatcgagagcccgcgccacatcgagatccaggtgctgggcgacaagcacggcaatgtcgtccacctgttcgagcgcgagtgttcgatccagcgccgcaatcagaaggtcatcgaggaagcccccagcccgctgctggacgaggccacccgcaacgccatgggcgcccaggccgtcgccctggccaaggccgtgaactatgactcagccggcacggtcgagttcgtcgccggtcaggacaagagcttcttcttcctggaaatgaacacccgcctgcaggtcgaacacccggtcaccgaactgatcacgggcctcgacttggtcgagcagatgatccgctcggcctacggggagaagatggcctttggccagtcggacctctcgatcaacggctgggccatcgaaagccgcatctacgccgaggacccgtaccgcaagttcctgccctcgatcggccgcctggtgcgctacgacccgccggccgaaggcgacaaggacggccccaatggtggttatgtggtccgcaacgacgctggcgtccgcgaaggcgacgagatctcgatgttctacgatccgatgatctccaagctctgcacctgggcgccgacccgcctggccgccatcgatggcatgggccgggcgctggaagatttccacatcgagggcctgggccagaacatcccgttcctggccgccgtgatggacgaggagcgcttccgctcgggcaagctggcgaccagctacatcaaggacgagttccccgacggcttcaacggcacgaccccgacggctgtgcagctggacattctgaccgccgtgggcgcggcgatgcagcgggtctatgcgacccgggcccgcagctacgagtccggcctgatcggcgaagcgcgcgacgagtgggtggtggcgatcggcgaaacccgtcttcgggtcaaggtcggcggcgaggacggcgcagtggcggtcgaactgctcgacgagggccggaccctgttcctgaccgacatcgactggcgcccgggcaagccggtgttcaaggccgtgctgaacggcctggccttcaccgtccaggccgccccggccgccgagggcttcaccattcgccaccgcgccgccaagacccgcgtgctggtcctgaccccgcgctcggccgagttacacgacaagctgcccgaaaagcaggcggccgacacctccaagctggtgctgtcgccgatgccgggcctggtggtctcgatggacgtcaccaccggccagcaggtccgcgagggcgaggtcgtctgcgtgctcgaagccatgaagatgcagaacatcatccgcgccgagcgcgacggggtggtcaaggcggtcaacgccaagggcggcgatccggtcgcggcggacgaggtgctggtcgagttcgcgtag

SEQ ID NO: 40644 - DNA, 840 bp, Caulobacter crescentus
ttgacgttcgtcacccggttcgcgccttcccccacgggttacctgcatcgcggccacgcctattcggcgttgaccgccttcgaggcggcgcgcgtgacgggcgggcgcttccttcttcgcatcgaggacatcgacgccacccgttgccggccggagtacgaggcggcgatccttgaggatctcgcctggctgggcctgaactgggaagcgcccgtgcgccgacagtccgagcacctggccgactacgaggcggccatcgcgggcctgcgcgaccggggtctggtctatcgctgcttcaagacccgcaaggaaatcgacattgggcgcgcgccgcacgagcccgctatcgcctatgtcggcgcaccgctcggcgctgacgaggaagcccaacggctggcgcgcggcgagcccttcgcctggcggctgtctctggccgcagcacgagaggccctcggcggctttgatcacctcagtttcctggaggaaggcgcagacggatcgtcaccgcgcaccgtccaagccctgcccgaaactgcgggcgacatcgtcctggcccgcaaggatgtcggcgtggcctaccatctggcggtcgtccatgacgacgcgctgcaaggggtcacccatgtgacccggggcgaggacctgttcgaggccacccacatccagcgtctgctgcaggccctgctgggcctgccgaccccgatctatcgccaccacggcctgctgaccgggcctgacggcaagcgctacgccaagcgcgacaaggcccagaccttgcgggagctgcgggcgtcgggcgtgagcgcacaagatcttcgggcggaactcggcttttcctag

SEQ ID NO: 40645 - DNA, 1329 bp, Caulobacter crescentus
atgcaggcgatcaacgtctccatcggcttcgacaagcgcctgtgggcgcaagacctggcaggctcccgcgcccacgcgcggatgttgatgaaccaaggcgtgattgcaagccatgacggcgaggaaatcctggagggtctcgcccgcgtcgaggacgagctgctgtcggggaccttcccgttccgcgacgaatacgaagacatccacatgaacatcgaagcgcggctgcgcgagctgatcggcccgacggccggccggctgcacaccgcccgctcgcgcaacgatcaggtggctgtcgacttccgcctgtgggtccgcgacgcctgcgaccgcacggtcggccagctcgaggcgcttcagaaggcgctgctgacccaggccgaagcgcacgccgagtcgctgatgccgggcttcacgcacctgcaaccggcccagccggtgaccttcggccaccacctgatggcctatgtcgagatgttcggccgcgacgccggccgcttccgcgacgcccgcgcgcggatgaacgaatgcccgctgggcgctgcggccctggccggctcgcccttcccgatcgaccgccagcagacggcgagcgcgctgggctttgatcggccgaccgccaactctctcgatagcgtctcgtcgcgcgacttcgcgctggaggccctgtcggccgcctcgatcaccgccacgcacctgtcgcggctggccgaagagatcgtcctttggacgacgccgatgttcggcttcatcaagctgaccgacgccttcaccaccggcagctcgatcatgccgcagaagaagaaccccgacgcggccgagctgatccgcgccaaggtcggccgcatcctgggctcgctgaccaccctgacggtggtcatgaagggcctgccgctggcctattcaaaggacatgcaggaggacaaggtcccgaccttcgaagccttcgacgccctggaactgagcctgctggccatggccggcatgatcgccgacctgacgcccaacacagaaaacatggccaaggcggccggcgcgggcttctccaccgccaccgatctggccgattggctggtgcggacgttgaacatgcctttccgtgacgctcaccacgtgacaggctccgccgtgaagacggccgaaggcttgggcgtcgatctggcggatctttccctggcgcagttccaggcgatcgagccgcagatcacgaaagaggtctacgccgtcctgactccggccgcctcggcggccagccgcatgagctacggcgggacggcccccgcccaggtgcgcgcccagatcgcgcgttggaaggaattgctggcatga

SEQ ID NO: 40646 - DNA, 1266 bp, Caulobacter crescentus
ttgaatcacttcgagtacggcccgcagggcctggcctgcgaaggcgtgcccctggctaagatcgcggccgaggtcggcacgccggtctatgtgtacagccgcgccacgctggagcggcacttcgttgtcttccgcgacgccctggcgatgtccggcgtggtcgatccgctgatcgcctacgccgtcaaagccaattccaacgtcgcggtgctcaaggtgctgggcgacctgggcgccggcgccgacacggtgtccgagggcgaggtgcgccgcgccctggccgccggcattcccggcgagcggatcgtgttttcgggcgtcggcaaggcccggcgcgagatcgccttcgcgctgcaggccggcgtcgccgagatcaatgtcgagtccgagcctgagctgaacctcatcgccgaggtcgccgcagagctcggggtccgcgccaaggtcgccttccgggtcaatccggacgtcgcggccggcggtcacgccaagatcgccaccggcaagtccgagaacaagttcggcgtctcgttcgccgaggccgcgcgcctctacgccaacgccagcaacaacgccaatctccagcccgtcggcgtcgcctgtcacatcggcagccagatcaccgatctggcgccgatgcgcgcggccttcaccaagatgcggggcctcgtcgagcagctgctggccgagggtctgtcggtcgagcgcctcgatctgggcgggggcctgggcgtgccctatttcaatcaccccgaaccgccctcgccggccgagttcgccgccatggtcggcgaggtcacccagggcctgcccgtcaccctggccttcgagcccggccgggtgatcgccgccaacgccggcgtgctggtctcggaagtcatccatgtccacgagcgccccgaaggccgcaagttcctggtcatcgacgcagccatgaacgacctcgtccgtccggccatgtacgacgcgttccacgacatccgtccggtcatccagcgcaccggcgagacggtctatgacgtggtcggtccggtctgcgagacgggcgacaccttcacccgcgaccgcgccctgccgccgttcgcagcgggcgacctggtggccttcatgtcggcgggcgcctatggcgcggccatggccagcgagtacaatacccgcccgctagtgcccgaggtgctggtcgacggcgaccgttacgcggtgatccgccagcgtccgacctatgacgagatgctggcgcgggatctggtgccggactgggtgtaa

SEQ ID NO: 40647 - DNA, 531 bp, Caulobacter crescentus
atgaatgaccttcccaagcccgaagtcctgatctcggaagccgagatcgctgaacgggttcaaaaactggccgagcagatcgcgccgcgcatcgacgacgacaccgtcgtggtctgcctgctcaccggcggcctgtggtttgccgccgacctcacccgcgcgctgtggaaggccggacgcgacgtccgcttcgacgccctgtggctggcctcctatcacgacgagcgcaagagctcgggccgttgcgaggtccgcgccgacctgcagcgcccgctggtcggccgccgcgccctggtcgtcgacgacgtcttcgacaccggcctgtcgctgtcggaagccgcgcgcctggtgaaggacgccggcgccagcgaagtgctgaccgccgtcttcgctcgcaagccctggcccaaggatcgcggcatggagcccgacttcgtcgcctgggaagcgccggcccgctatctcgtcggctacggtctcgatgatgaaggcaagagccggggactgccgtacatcggcgcgatggattga

SEQ ID NO: 40648 - DNA, 1080 bp, Caulobacter crescentus
atgcccaagcccgggatcatggacatccacgcctatgtcggcggcaagtccaaggtcgagggcatcgcccatccggtgaagctgtcgagcaacgagaacatcctgggcagcagcgacaaggccaaggacgcctatcgcaacgccgtcgaccgcctgcacatctatccggacggcaaggccaacttcctgcgcgccgccgtggccgagcgctacaagctcgaacccgagcgcctgaccttcggcgacggcagcgacgagatcttcgccctgctgtgccaagtctatctcgagccgggcgacaacatcgtccagggcgagcacggcttcgccgcctacgccatcggagcccgcgcctgccagggcgaggtgcgcatggccaaggaggtcaaccaccgcgtcgacatcgacgaggtgatcaagtgcgtcgacgagcgcacgcgcctggtgttcatcgccaaccccgccaacccgaccggcacctggctgaccggcgaggagatccgcgccctgcacgcggccctgccgccttcggtggtgctggtgctggacggcgcctatgcggagttctgcagcgatccgcacttcgaggacgggctggagctggcccgtacggctgagaacgtcatcgtcacccgaaccttctcgaagatccacggcttggccgccctgcgcgtgggctggggctacgcgcccgagcatatcatcgcgccgatcgagcgcatccgcccgccgttcaacacctcaatccccgcgcaggaagcggcggtcgcagcgctgttcgacgacgacttccaggatcgctcgcgcgccctggtcgagcagtggcggccgtggctggcccagcagcttggcggcctggggctggaggtcacgccctcggcggccaacttcgtgctggcgaccttcccgaccacgccgggcaagaccgcgccggaggccgaggccttcctcgcatccaagggttatctggtccgcgcggtgggcaactacaacctgccccatgcgatccgcatcaccatcggcctggaagagcagaaccgcgccgtggtcgagctcttgtcgcagttcatggggcgctag

SEQ ID NO: 40649 - DNA, 1215 bp, Caulobacter crescentus
atgcgcgcgttttgcgtaggaggcgggcccgtggccgagaacccgaaggactgggacgtcgcgacgaaattgatccgtggcgggatcgcgcgctctcagttcatggagaccgccgaggcgctctatctgacccagggcttcacctacgacagcgccgagggcgccgaccgccgtttcgccggcgaagatcccgggttcgtctattcgcggttcaacaatccgaccgtgaagatgttcgaggatcgcctcgccctgctggaaggcgccgaggtctgccgcgcccaggccaccggcatggcctcgattcacgccgccctgatgggcctggttcgcgccggcgaccatgtcgtggccggtcgcgcgctctttggctcgtgccgctggatcgtcagcgagtggctgccgcgcttcggtgtggagaccacctttgtcgacgccaccgatcccaaggcctgggaagcggcgatgcggcccaacaccaaggcggttctggtcgaaacgccctcgaacccggtgctggagatcaccgacatccgcgcggtgtcggaactggcccacgcggtcggggccaaggtcatcgtcgacaacgtgttcgccaccccgatcttccagaagccgctggagctgggcgcggacgtcgtcgtctattcggccaccaagcatatcgacggccagggccgcgtgctgggcggggccatcctgaccagcgaggcgatcaacgaggagttctaccgcgacagcctgcgccacaccggcccgtcgctgtcgccgttcaacgcctgggtgatgctgaagggcctcgagaccctggatctgcgggtgcgccgccaggccgacagcgctttcgccctggcgaacaccatcgccgagcacaagaaggtgcagacggtgctctatccgttccgccccgaccaccccggccacaacgtcgccaaggcgcagatgaccggcggcggcaccgtgatcgcgctggacctgggcagccgcgaggccgccttcaagttcctgaatgcgctggagatcgtcgacatctccaacaatctgggcgacgccaagtcgatggccacgcacccgccgaccaccacccaccgctcggtccccgaagccgaacgcccgtcactgggcgtcaccgaaggcggcgtgcgcctgtcggtgggcctggagagcgtggaagatctcaagcgggatgtgatccgtgcgctcgatcaggcgtga

SEQ ID NO: 40650 - DNA, 936 bp, Caulobacter crescentus
atgactcaaccccgccacttcatcgacctgtggaagctggacggtgcgaccctgcgcctgctgctggacgacgcccacgcccgcaaggcggcccgcaagggctggccgcagggcaaggtcgacgccgatgcgccggccaaggaccgcgtgctgtcgatgatcttccagaagaactcgacccgcacccgcttctcgttcgacgcggccatgcgccagctgggcggcagcgcgatcatctcgaccgcttcggacatgcagctgggccgcggcgagaccatcgaggacaccgccaaggtgctgtcgcgcatggtcgacgcggtgatgatccgcgccaacagccacgccgacgtcgagcgcttcgcccaggtctcgaccgtgccgatcatcaacggcctgaccgacaagagccacccgtgccagatcatggccgacatcctcaccatcgaggagcatcgcggcccgatcgccggcaagaccatcgcctgggtcggcgacggcaacaatgtctgctccagcttcatccacgccgcgcctctgctgggctttgagctgaagatcgcctgcccggcggtctatcacgccgatctgcacgatctggcccgcgccgaggggctgcagggcaaggtcagcatgaccaccgatcccaaggccgccgtcagcggcgcggacgtggtcgtggccgacacctgggtctcgatgggcgacaccgaccatgacgagcgcttggcggcgctcgagccctatcaggtcgacgacaggctgatggatctggcggcgggtaacggcgtcttcctgcactgcctgccggcgcatcgcggcgaagaggtcaccgacgcggtgctggacggtccgcgctcgctggtctgggacgaggccgagaaccgcatccacgcccagaagtcggtcctggcctggtgcttcggcgcgatcggataa

SEQ ID NO: 40651 - DNA, 1218 bp, Caulobacter crescentus
ttgagcaccgcgacgtcgtccaccacctcgcagcaccacatcatgggcgtgtacaaccgcgctccgctggcgtttgagcgaggccgaggcgcgcgcctgatctcgaccgaaggcgaagagtacctggactgcgtggcgggcatcgccaccaacggcctgggtcacgcccatccggcgctggtcgaggtgctgaaagcccaggccgagaagctctggcacgtctccaatatctaccggattcctgagcaggaagagctggccgacgccctgtgcgccaactcgttcgccgacgtggtgttcttcaccaactcgggcacggaagccgtggaatgcgcgctgaagacggcccgcaagtatcactcggccaacggccagcccgagcggatcgacatctacggcttcgacggctcgttccacggccgcacctacgcggcggtcaacgcctcgggcaatcccagctatgtcgacggctttggtccgcgcttgccgggctacagccagctgaccttcggcgaccacgacgcgatcaaggccgcgatcgccagcccgaccacggcggcgatcatcgtcgagccggtgcagggcgagggcggcgcgcgctcgatcccgacccagtgcctggtcggccttcgccagctgtgcgacgagcacggcgtgctgctgatctatgacgaagttcagtgcggcatgggccggaccggcaagctcttcgcctacgagtgggcggaaggcggcgagccgcacatcatggcggtggccaaggccctgggcggcggcttcccgatcggtgcgtgcctggccaccaccgaagcagccaagggcatgacggtcgcggcgcacggctcgaccttcggcggcaacccgctggccatggccgtgggcaaggcggcgctggagatcatcaagtcgcctgagacgctggacaatgtgaagaccgtttcgggcttcttcacccaacagctgaacggcctcaaggaccgcttcccggacgtcatcgtcgacgtgcgcggcaagggcatgctgatcggcgtcaagctgatcccgaacaaccgcgacttcatggtcctggcgcgcgacgagaagcttctcatcgccggcggcggggacaactgcgtgcgcctgctgccgccgttgaacctgaccatcgaggaagccagcgaggcgatcgccaagctcgaaaaggcttgcgaggccgcgcgcgccaaggccgccgcctag

SEQ ID NO: 40652 - DNA, 981 bp, Caulobacter crescentus
atggaggaaccggcgcctctggtctcgattcccgaggccccggttcccgaccacggcaaggctgaatggttccgcggcgcggatggggcgaccctccgcgccgcgacgtttttcccggcaggccccgcccggggttcggtggtgctcagccccggacgcagcgagccgcttgagaagtatttcgaggtcgtcgacgaccttttggcgcgcgatttcgccgtcttgctgcatgactggcgagggcaggggctgtcggcccgcgccttgccggaccgcctgaagggtcacgcgcgcggcttcaagaccttcgtttccgactacgaggcgctgctcgatgcgttcgagacgcggatgcctaagccctggatcgcggtcagccattcgatgggcggttgcctgacgaccctggccctggcccagggcgagacacgtttcgccgccgccgtgttgtcggcgccgatgctgggcctcaacaccgccggcgtgccgccgtggctggcgcggcctctggctttcgtgatgtcgcgggtgggtttggccggcgagtacgtgcagacgccgtatgacccgctgacccagaccttccagggcgacggtctgacccacgatgagacgcgctatgatcgctaccaggcgcaactgcgcgcccaccccgagatcgctctggggggcatgacctggggctgggctgatttcgccatctcagcgtgcgcgtggctcaggcgcagcaagtcggtcgaagcgatcgcgattccggtgatcattctcggcgctgaactcgacaaccgcgtgctgaacgccgactccgagtcgatcgcacgacgtatcccgaaggggcgctatgtcgaggtccccggggccttccacgagattctggtcgagaccgacgcccgccgcgcgctgttctggcaggccttcgacgagacggtcgatccgatcgctgcgcgcgaaccgcttatttcgccgaacgtctcagactga

SEQ ID NO: 40653 - DNA, 714 bp, Caulobacter crescentus
atgccgacgctcgtcctgctgcgccatggccaaagccagtggaacctggaaaaccgcttcaccggttgggttgatgtggacctcaccgctgagggcgaagctcaggcccggaagggcggcgagctgatcgctgcggccggcatcgagatcgaccgcttgttcacctcggttcagacccgcgccatccgcacaggcaatctggcgctggacgccgccaagcagagcttcgtccccgtgaccaaggactggcgcctgaacgagcgccactatggcgggctgaccggcctgaacaaggctgagaccgccgaaaagcacggcgtcgagcaggtgaccatctggcgccgttcgtacgatatcccgccgccggagctggcgccgggcggcgagtacgacttcagcaaggatcgccgctacaagggcgcaagcctgcccagcacggaaagcctggcgacgacgctggttcgcgttctgccctactgggaaagcgacatcgctccgcatctcaaggcgggtgagactgtgctgatcgccgcccacggcaactcgctgcgcgccatcgtcaagcatctgttcaacgtgccggacgaccagatcgtcggtgtggagattccgaccggcaatccgctggtgatcgacctggatgctgcgttgaagccgaccggcgcgcgctacctggacgacagtcgggctgaggcgcttcccaaagttggttaa

SEQ ID NO: 40654 - DNA, 1497 bp, Caulobacter crescentus
atgttctcctcgccccgcgccgatctggttccgaatacggccgcctacgaaaacgaagccctggtcaaggcgacgggctttcgcgagtacgacgcgcgctggctgtttgggccggagatcaatctcctgggcgtgcaggccctgggcctgggtctgggaacctatatccacgaactgggccaatcgaagatcgtggtcggccatgacttccgctcgtattcgacctcgatcaagaacgccctgatcctggggctgatcagcgccggctgcgaggtgcacgacattggcctggccctgtcgcccaccgcctatttcgcccagttcgacctcgacatcccgtgcgtggccatggtcacggccagccacaacgaaaacggctggaccggcgtgaagatgggcgcccagaagccgctgaccttcggccccgacgagatgagccgcctcaaggccatcgtgctgaacgccgagttcgtcgagcgcgatggcggcaagctgatccgcgtgcagggcgaggcccagcgctatatcgacgacgtggccaagcgcgccagcgtcacccgtcccctgaaggtgatcgccgcctgcggcaacggcacggccggcgccttcgtggtcgaggccctgcagaagatgggtgtcgctgaggtcgtgccgatggacaccgacctcgacttcaccttccccaagtacaatcccaaccccgaagacgccgagatgctgcacgcgatggctgacgctgtccgtgagacgggcgcggacctggcgttcggcttcgacggcgacggcgaccgctgcggtgtggtcgatgacgagggcgaggagatcttcgccgacaagatcggcctgatgctggcgcgcgacctggccccgctacatccgggcgcgaccttcgtcgtggatgtgaagtcgacgggcctctacgccaccgatccgatcctggcccagcacggctgcaaggtgatctactggaagaccggccacagctacatcaagcgcaagagcgcggagctgggcgccctggccggcttcgaaaagagcggccacttcttcatgaacggcgagctgggctatggctacgactgcggcctgaccgccgccgcggccatcctggccatgctggaccgcaatcccggcgtgaagctgtcggacatgcgcaaggccctgccggtggccttcacctccctgaccatgagcccgcactgcggtgacgaggtgaagtacggcgtcgtcgccgacgtggtgaaggaatacgaggacctgttcgccgccggcggttcgatcctgggccgcaagatcaccgaggtgatcacggtcaacggcgtgcgggtgcacctggaggacggctcctgggtcctggtccgcgcctcgtccaacaagcccgaggtcgtcgtcgtggtcgaaagcacccagtccgaagacgacatgcgcgccctcttccgccaggaggtcaagccgcgcctgggcgaccgggtcggcaagtacaatcaggaaatctga

SEQ ID NO: 40655 - DNA, 1497 bp, Caulobacter crescentus
atgcgagacatcgcccatttcgtgaaaggccagaccctggtcggcgcctccggccgcttcggcgacgtcttcaatcccaacaccggcgaggtccaggcccgcgttcagttcgcgactgacgccgagctcgacgccgccgtccaggtcgccgccaaggcgcaggtgggctgggcccagaccaatccgcagcgccgcgcccgcgtgatgttcgagttcaagcgcctgatcgagcgcgacatgaacaccctggccgagatcctgtcgtccgagcacggcaaggtcatcgccgacagcaagggcgacatccagcgcggcctcgaagtcatcgagttcgcctgcggcatcccccacatcctgaagggcgaatacaccgaaggcgcgggccccggcatcgacgtctattcgatgcgccagccgttgggcgtctgcgcgggcatcaccccgttcaacttcccggccatgatcccgatgtggatgttcggcatcagcatcgcggtgggcaacagcttcatcctcaagccctctgagaaggatccgacggttccggtcaagctggccgagctgatgatggaagccggcgcacccgccggggtgctgaacgtcgtgcatggcgacaagagcgccgtcgacgccatcctgacccacccgctgatccgcgcggtcagcttcgtgggcagctccgacatcgcccactacgtctatcagaccggcacggcgcacgggaaacgcgtccaggccatgggcggggccaagaaccacggcatcgtcctgcccgacgccgacatggatcaggtggtcaaggacctgtccggcgcggccttcggctcggccggcgagcgctgcatggccctgccggtggtggtccccgttggtcagaagaccgccgatgagctgcgcgagcgcatggtcgccgagatcgcgtccttgaaggtcggcgtctccaccgatcccgacgctcactacggcccggtggtcagcgcccagcatcgcgacaagatcgccgactacatccgcatcggccaggaagagggcgccgagctcgtggtcgacggccgtgacttccagctccaaggcttcgagaagggcttcttcatcggcccgtcgctgttcgacggcgtcaagaagggcatgaagacctatcacgaggagatcttcggcccggtgctgcagatcgtccgcgccgagaccctggaggaggccatcgccctgccgtccgagcaccagtacggcaacggcgtcgccatcttcacccgcaacggccgcgccgcgcgcgagttcgccgccaacgtcaatgtcggcatggtcggcatcaacgtgccgatccctgtgccggtggcctatcacaccttcggcggctggaagcgcagcgcgttcggcgacaccaaccagcacggcgtcgagggcgtgaagttctacaccaaggtcaagacggtgacggcgcgttggcccgagggcgaggttgcggattcgagcttcgtcatcccgacgatgaagtag

SEQ ID NO: 40656 - DNA, 2316 bp, Caulobacter crescentus
atgcgcacgttgaaaaccttcgccctggcctcggccgcgaccctgatcgccaccgccgcccaggccgcgcctacgacctgggcctattcggccaagaccggtgtcggcgcctcctacgaggcctatgtcgacggcgcctacaaggccggcggcaagaccggggcggtgtcgaaggtctggttctcgatcgccgacggggtcctcaccgagacgatgtacggcctgatccatgaggcgcagatcaagcagatgcgcgtcgccgtcgagacggcgagcggcctggccattgagggggcggatacgacctccaagaccgagtatctgcatgtggacgccgccggccggccgctgtctccggcctacaagatcaccacgaccgatcgccaaggccggtttgtcatcgaaaagcgcatcttcaccgatcccgaccgcaatgcgctgttcgtgcgcgtgacggtgacggccctgaaaggcgcggtcacgccgaccctgctgctggagccgcacatggccaacaccggcggtggcgatgtgggcgcggcctcggcctcggcgctcaccgcccacgagggcaaggcgttcctcagcctgaaggccagcaagccctttgcgaaagcctcggccagcgttctgaaggatggcgatgctctggcggctttgaaggcgaccacgacttcggccaagggcgcgatcgtgctggccggagagctgcccaaggtcgccaagtccgagacctttgacgtggtgatcggcttcggcgctgacgccaaggccgccgaccggaccgccgccgcgacgctgaagacgggctacgccgaggtcctggcccgctacaacggcgagggcgcgcatgtgggctgggaggactatctggcctcgctgaacgaactgccgcgactgcgcgacgcgtccgaggacggcggcaagcttctccaggccagcgccctgatgctcaaggtgcaggaagaccgcacctatgccggcgccctgattgcctcgctgtccaacccctggggcgacacggtcgacgcgaccaagtcctcgaccggctacaaggccgtctggccgcgcgacttctatcagtgcgccatggccttggcggccctgggcgacaaggagacgccgctggcggccttccactatctgcccacggtccaggtcgggcccaagacgccgggcaacaagggcgacggcggctggttcctgcagaagtcgcacgtcgacggcacgcccgagtgggtcggggtccagctcgaccagacggccatgccgatcatgctgggctggaagctctggacgtggggctggctgccggacgccgagctgaaggcgttctacggcaagatgctgaagccggcggccgacttcctggtcaagggcggcaaggtcaatctggactggaacaccgcgaccatcactccgcccttcacccagcaggagcgctgggaagaacagggcggccactcgccctcgacgaccgccgccgtcattgcaggcctggtggtcgccggcgacatcgccgaggccgccggcgacgccggctcggccgaactctatcgcaagaccgccgacgactgcgccggcaagctcgaggcccggatggtcacgacgaaggggaccttcggcgacggccactattatctgcgtctcaacagcgaccaggacccgaacaacaagagcccggtcgaggcgcgtaacggccaggctccggtggccgaggacaagatgctggacgcgggcttcctggagctggtgcgctatggcgttcgccgcgccgatgatccggcgatcctggccagcctgccggagattgatgacgaggccctcgaagacctctaccgcgttcgctacagcttcacgttccctggcgtggagggcagcttccccggctggcgccgctacggcgtcgacggctacggcgaggacaccaagaccggcgccaactacggcgccgacaaccagatgcgtcccggccaaaggggccgggtgtggccgatcttcaccggcgagcgtgggcactacgagctggccgtggcgggcctctcgggcaagcccgatcccaccgccgtgcagaagatccgcgatacctacgtcaaggcgatggagttgttcgccaacgagggactgatgatccccgagcaggtctgggacggcgtcgggaccgacagcgctcatggctatgtccggggcgaggggaccgattcggccacgcccctggcctggagccacgcggagtacgtcaagctgctgcgatcggtcagcgacgggcaggtctgggatcactatgcgcccgtaaaggcgcggtacgcgcgctag

SEQ ID NO: 40657 - DNA, 1581 bp, Caulobacter crescentus
atgaacgccgaatggtggcgtggcgccgtcatctatcaggtctatccgcgcagcttcgccgactcgaacggcgacggcgtcggcgacttgccgggcatcaccgcccacctcgaccacatcgcctcgctgggcgtcgagggcgtgtggctgtcgccgtttttcacgtcgccgatgaaggacttcggttacgatgtctcgaactattgcgatgtggatccgatcttcgggaccctggccgatttcgacgcgctgatcgcgcgcgcccatgcgctgggcctgaagatcatcatcgatcttgtgttctcgcacacctcggacgagcacccgtggttcgtcgagagccggcaggaccggtccaacgcgaaggccgactggttcgtctgggccgacgccaagccggacggcagcccgcccagcaactggcagtcggtgttcggtggtcccgcctggacctgggacgcccggcgcggccagtactacatgcacaacttcctcagcagccaaccgcagctgaacctgcacaatcccgcagtccaggaagccctgctggccgtcactcagttctggatcgacaagggcgtggacggcttccgcttcgacgccatcaacttctcgatgcacgaccctgcgctgaccgataatccgcccctgccgccgggcggcaagcgcacgcggccgttcgacttccaggacaagatccacaaccagagccacgccgatattccgaagttcctcagccgcctgcgggcgctgaccgacgcggcgggcgggcgcttctcggtggcggaagtcggcggcgatcacgccgagcgcgagatgaagctgttcacggccggcgaagatcgcctgaacagcgcctatggctttctctatctctacgccgacaagctgatcggcgagatgatcccgcagggcgcggccatgtggccgggcgaggcgggcgagggctggccgtcctggaccttctccaaccacgacgcgccccgggcggtgtcgcgctgggccgaagggcgcgatcgcaaggccttcgccgagttgtgcctgctgctgctgatgggcctgcggggcaatgtgttcgtctaccagggcgaggaactgggcctgccccaggcccatgtgccgttcgagcggctgcaggaccctgaggccatcgccaactggccccagaccctgggccgcgacggggcccgcaccccgatgccgtgggtttcaggcgcattgaacgccggcttctctggcgtcgagccctggctgcccgtcgatccggaacatctgcctctggcggtcgacgcgcaggaggcagatccggcctcgacgctgaacgtcgcgcgtcgcctgatcggcctgcgtcgcgcctatccggccctgcgcaccggcgcgatcaccttcatcgacaccaacagcccgctgctgatcttccagcgcggcgaaggggcggacgcggtgctgctggcgttcaatctaggcttcgagacggtgacatggtcgctgcccgatggctggacgctgatcgacggcgtcaacctgggcggtgaggggcagatgccggtgtgcgcggggctgatcgcgcggcggggttag

SEQ ID NO: 40658 - DNA, 1743 bp, Caulobacter crescentus
atgacaacggccgccgcggcggctcccgatccctaccttcagcgcaagccccaggacgaggtgatctacttcgtcctgcccgatcgcttcgagaatggcgacgcgaccaatgatcacggcggccccgccttgggggcgctggccgatggctttgatcccgcgcgcgcgggcttctatcacggcggcgacctcaagggtgtgacgcggcgtctggactatatccagggcctgggggcgaccgccgtctggctggcgccgatcttcgtgaaccgggccgtgcaggggccgcccggccaggaatcggccgcgcatcacggctactggatcaccgacttcaccgacgtggatccgcacctgggaaccaaggccgacttcaaggccctggtcgacgcggcccatgcgcgcggcatgaaggtctatatggacatcgtcttgaaccacacggccgacgtcattcagtacaaggaatgcccggacaaccgctgcgcctatcgcggcgtctccgactatccctatgtccgccgcggcggggtcgacggggcgccgatcaatgacggcttcgacggcaaggatttcagcaagctcaagcgcccggactgggcctatacgccctatgtcccgcccggccaggaacgcgccaagacgcccgcctggctgaacgatccgatctattaccacaatcgcggtgacagcaccttcgccggcgagagctcgctgctgggcgacttcgccacgctggatggcgtctttaccgagcacccgcgcgtggtcgaaggcttcatcgaggtttatggtcggtggatcgatgacttcgggatcgacggctaccgcatcgacaccgcccgccatgtgaacccggagttctggcaggcctttgttccggctatgctggcgcgcgccaaggccaagggtatcgagaacttccacatcttcggcgaggtcttcgacgccgacgtcgccacgctggcgcggcatgtgaaggtcgataagctgccgacggtgctggacttcgccttccaggcggcggtgaccgatgtcgcgcttggccgggccggacccgaccggctggccagcgtcttcgccggcgacgtcgtctatgagggcggcgaggccacggcgcgccagctgccgaccttcctgggcaatcacgacatgggccgcatcggtcacttcgtgctgaaggcccatccgaagatcggcgatgatgcgcttctggcgcggatcaccctggctaacgccatcatgctgaccgcgcgcggcgtgccgacgatctactatggcgacgagcagggcttcaccggcgacggcgactatgccgacagccgcgaggacatgttcccgagccaggtggccagctacaacgacaaccgcctggtcggctcgagcgccaaggggccaaggaccgccttccagacggacagcgtgctctatcgccgcatcgccgcgctcgccaagctgcggggcatgacgcccgcattgcgcgaggggcgtcaggtgacgcgcatcgccgagggcaagcccggcctgctggccttctcgcggctgatggcgggaaccgaggtgctggccgtctttaacactagcgacaagccgatcaaggcgcgggttccggtcgagatgggctctgcggcttggaagagcctgcacggcgcctgcatctcgagcgccgtcgcgccgggcagctacgccgttgagttggcgccgttcgactacatgatttgcgtttccgagggacgatcgtga

SEQ ID NO: 40659 - DNA, 1908 bp, Caulobacter crescentus
ttggcgcgactctcagggcgggttcttccaagaacactgataggtttgcattgcagcacgcggcgtcttgaccggtcgcgcgggcctctccaatggttgctaccaagggagagacgaatgcgtttgcgtcagaagattaagcgggaaatccggtttctgaagggactgtcgcgcacgctgaagcgtgtaaagacgatcgccccggatagtcccaacttgatctgcgacgatctcgaggccgcagtcgacaagtgggggccacgtccggccatcacgttcgaaggcaagacgatcacctatgccgatctggacgccatggcgaaccgctatgcgcactgggccaagggcctgggcctgacgcgcggtcagaccgtcgcgctcttcatgcccaaccggatcgagtatctggcgatctggtacggcctgaccaaggtcggggtcgcaaccgccttgatcaacaaccaactgaccggcgcggcgctggcccactgcctgaccatctcccaggccatgcattgcattgtcgacgctgagacctcgccctgcttcgaggacgtgaaggggcaactcgagcggcacatgcagcaatgggtgctggggcctgttcacgatgaccagcgcgacctgctgaaggcgctcaagagctgcagccagttgcgccccgatcgtgagaccgcccgggaggggctgaccgcctccgatacggcgctctacatctacaccagcggcacgaccgggctgccgaaggccgcgcgcatcacacacatgcgcgcccagctctatatgcgcgggttcgccggttcgaccggcgccaaggacacggatcgcatctacatcaccctgccgctctatcacgccaccggagggctttgcgccttgggcgcggcgctgctcaacggcggctcggtcgttctgcgcaagaagttctcggcgacgcacttctggcccgagatcgtggccgagcagtgcaccatgttcgtctatatcggcgagctgtgccgctatctcgccaaccagcccgaacacgagctggaacgcgcccacaagctccgcatgatcttcggcaacggcctgcgcgcggacgtttgggatgacatgctggaccgcttcaaggtcggcgacgtgctggagttctatggcgcgaccgagggcaatgtctcgttcttcaacttcgacggcaagcgcggcgcgatcggtcgcatcccgagctatctgcgcaagaagttcaacattcgcatcgtcaagttcgacgtcgagaccgagacgcccatccgggggccggacggttgctgcatcgaggcggggcccgaggaggtcggcgagtgcattggccatatcggcagcgacgcgcgctcgaacttcaccggctacgccgacaaggccgcgaccgagaagaaggtgctgcacgacgtcttcgaaaagggcgacgcgtggttccgcaccggcgacctgatgaaggtcgaccatgacggctacatctatttcatcgatcgcatcggcgacaccttccgctggaagggtgagaacgtcgcgacctccgaggtggctgagcggctcgccggcttcgagggggtcctggaggtcaatgtctacggcgtgaaggtgggcgacctcgacggcaaggcgggcatggcctcgctggtgaccgaaggcgacttcgatcttgaggcgttcgccaagtacgtcgacgaggcgctgcccagctatgcccggccgctgttcgtgcggctgcaaaaggcgatcgagaccaccggcaccttcaagtaccgcaagatcgatctggtcaacgagggctttgacccgtccaagaccaaggatccgctgtacttccgcgatccggccaagggctatgtgaagatcaccaagacgatctgcgccaagatcgagggcggcggcttcaggctttag

SEQ ID NO: 40660 - DNA, 1380 bp, Caulobacter crescentus
atgaccgcccgttggacccccgccgcctggagagccaagcccgccaagcatttgcccaccgactatccggatatgggcgctgtggagcgggtcgagcaaacccttcgccagatgccgccgctggtgttcgccggtgaggcgcgccggctgaagagccagctgggcgaggtggccgaggggcgggcgttcctgttgcaaggcggcgactgcgccgagagcttcaaggagttccacgcagacaatatccgcgacaccttccgccttatcctgcagatggcggtggtcctgaccttcgccggcggcaagccggtggtgaaggtgggccgtatcgccggccagttcgccaagccgcgctcggagccgatcgaggtccagggtgacgtgaccctgccatcctatcgcggcgacatcatcaacggcatggacttcaacgaggccgagcgggttcctgatccggaccgcctgctgaaggcctacggccagtcggccgcgacgctgaacctgctgcgcgccttcgccagtggtggctacgccgacctctacaacatccaccgctggaccctgggcttcgtcggcgacagcccgcagggcgcgcgttatcgcgaactgtcggagaagatcagcgaggccctgaccttcatgtcggccgtgggcgtcacgcccgacacccagcccgacctgcgccgcgttgagttcttcaccagccacgaggccctgctgctgggcttcgaggaagccatgacccgcgtcgatagcacctcgggcgactggtacgacaccagcgcccacctgctgtggatcggcgagcgcactcgccagctggacggcgcccatgtcgagttcatgcgcggcgtgaagaatccgatcggcctgaagtgcggtccgaccatggagggcgacgaccttctgcgcctgatcgatgttctgaacccgcacaacgagccgggccgcctgaccctttatggtcgcttcggctcagacaagatcgccgaccgcctgccgcgcctgatgaaggcgaccaagtcggcgggccgttcggtcgtctgggccaccgatccgatgcacggcaacacgctgaaggcctcgaccggctacaagacccgtccgttcgaccgaatcctgtccgaggtgaagagctttgtggagatcgcccaggccgaaggcgtccaccctggcggcgtccacctggagatgacggggcagaatgtcaccgagtgcctgggcggcgcccgcgcggtgtcggagacggacctggccgaccgctaccacacccactgcgatccccgcctgaatggcgagcaggcgttggagttggccttcctcgtggctgagaagctgaaggcggcccgcgacgaccagcgccgtctggccgcaggctga

SEQ ID NO: 40661 - DNA, 759 bp, Caulobacter crescentus
atggacatcaaggacagcatcgtcctggtcaccggcggcaatcgcggaattggcgaggcctttgtgcgcgccttcctcgcggccggcgcgacgaaggtctatgtcggcgcccgcgacccggccagcgccgcgcacctcgtcgccgaggccccggaccgggtgacggccctgcggcttgacgtcagcgacgcggagacaatttcagcggcggccgcgcagtgcccggacgtgacgatcctcgtcaataacgcgggcgctttcaccatgcagaccctgatgggcgcacaggacatgagcgccgcccgccaggagatggaggtcaactattttggcccgctggcgatgagccgagccttcgcgcctatcctggccagggcgccgcggagcgcgatcgtcaacgtgctgtcggccggcggtcttgtcgccgtgcccagcatgggcggctacagtccttcgaaattcgccgcgcgcgccatgaccacctgcctgcgcgccgaactggcgccccagaacacccacgtgctggcgctgaatgtcggctcggtcgacacccgtatggccagccatgtcgagggcttcaaggaggcgccggccacgatcgcccaggccggcctgaaggcgctgaagcgcgaggcggacgaggtcgacacagacttcatggccatcgacgtccgcgcccatctggcccgcgaccccaagggcctggaactggccatgcgacgcgcgctgaccagcgaccgcgtcagcaccggccgttag

SEQ ID NO: 40662 - DNA, 1164 bp, Caulobacter crescentus
atgtccggattctggttgaccgaggagcaagaggccatccgcgaaggcgtggccaaggtttgcgccgcgtttgacgacgagtactggcgtcgaactgacgagaccggcgagttccccgaggccttcgtcgccgccatcgccgaggggggctggctgggcgtagccatgcctgaaaacgtgggcggcgcgggtcttggcctgaccgaggcggcggtgatgatgcagtcggtcgcccagtccggcgccggcttttcgggcgcctcggcgatccacctgaacatctttggcccgatgccgctggtgaagtttggctccgacgagcagcgcaaccgccttctgccgcgaatcatctcgggcgaggacaagatgtgcttcgccgtcaccgagccgaactcgggcctggatacctcgagcctggagacccgggccgagaaggtggagggcggttatcggctcaatggtcgcaagatctggacgaccggggcccagcgcgccaacaagatcctgatcatcgcgcgcacaacgcccaaggatcagtgcgccaagccgcaccagggcctgtcgctgttctataccgatcgcgagaacatcgaggccaagccgatcccgaagatggggcgcaaggctgtcgaatgtaacatgctgtttatcgaggacctgttcgttccggcgcaggatctggtcggcgaagagggcaagggcttccagtacctgctgcatggtctgaaccccgaacgggtgctgttcgccgtcgaagccatcggcctcggccgcgcggcgctggccaaggccacgacctacgccaatgagcggatcgtctttggtcgtccgatcggtcagaaccagggcgtggcccatccgctggccaagtcgtgggccgagttggaggccgccaaccttttggccttcaaggccgcctcgctctacgaccagggcaaggagtgcggggccgaggccaacgccgccaagtatctgggcgccgaggccgggttccatgcctgcgaggcgtcggtgctggcgcacggcggcatgggctacgccaaggaatacgacgtcgagcgctacttccgcgaagcgatgatcgcccgcatcgcgccggtcagccgcgaaatgatcctgaacttcatcgctgagcgcgttctgggcctgcccaagagctactga

SEQ ID NO: 40663 - DNA, 1287 bp, Caulobacter crescentus
atgcgccgcttcctgttttccgaccccgatttccagaccgccttcaaggccttccttgacgagcgtcgcggctcgccggctgatgtcgacgccgccgtcgctggcgtgctcgaggccgtccgtacgcaggggatcgaggcgctgctcgactacagccgccgcttcgacaaggtcgacctgacggccgagaccatccgcgtgaccgccgaggagatcgaggccggcgcggccgagacgccggcggacgtccgcgaggccatcgccttcgccgccgctcgcattcgcgcctatcacagccgccagcgtccggccgaccaggcctggaccgacgaggccggcgtcgagctgggatggcgctggacgccgctggaggccgtgggggtttatgtgcctggcggtcgcgcggcctatccctcgaccgtgctgatgaacgccgtcccggcccaggtcgccggtgtcgaccgcatcgccatggtcaccccgcccggcaagctgcagccggccgtgctggccgccgccaaggaagccggcgtcaccgagatctggcgcgtaggcggggcccaggccgtcgccgccctggcctatggcgcgggacccatccagccggtcgacaagatcgtcggtcccggcaacgcctatgtcaccgccgccaagcgccgcctttacggcgtggtgggcatcgacgccctggctggcccctcggagatcgtcgtggtcgccgacaacaagaacaatcccgactggatcgccgccgacctgctcagccaagccgaacacgacccggccgcccagtcgattctgatcaccgacgacgaggccttcgctgcggcggtcgaacaggccatcgccgagcgcctcaagaccctggccacaggcgaggacgccgcggcctcgtggcgcgaccacggcgcggtgatcatcgcgccgttggacgagagcccggccctggtcgacgccatcgcgcccgagcacgtcgagttcgcgctcgacaatcccgagcgcctgtccgaccgggtgcggcacgccggcgcgatcttcctgggccgtgtcacgcccgaagccatcggcgactatgtcgcgggctccaaccacgtgctgccgaccagccgcgcggcgcggttccagtcgggcctgtcgatctacgacttcatcaagcgcacctcgatcgtgaagtgcgatccagcctcgttcgccgtgctcggaccgcacacggtggccttggccaaggctgaagggctgccggcgcacgccttgtctgcgtcagtgaggttgccaagcggcgactga

SEQ ID NO: 40664 - DNA, 1290 bp, Caulobacter crescentus
atggatcgcatcgccatcatcggcggcgcgcagttgaacgggaccatcccggtcagcggcgccaagaactctgccatcaagctgatggcggccagcctgctcaccgacgagccgctgcgcctgaccaacatgccgcgtctggccgacacccgcttcctaggcaagctgctgacgcgcctgggcgtgcaggtcaccgagagcgatggctcggacggccagcagaccttgttgcacgcgccggagatcaccagcggctttgcgccctatgacctggttcgccagatgcgcgcctcattcaacgtgctggggcccctggtggcgcgctccggccaggccaaggtgtccttgcccggcggctgcaccatcggcgcgcgtccggtcgatctgcaccttcaggccattgaggcgctgggcgccaagatcgacctgcatgagggctatgtctacgcccaggccccgcgcggcctgaagggcgcggagatccgcttcccgttcgtgtcggtcggcgccaccgagcacgccatgctggccgccgtgctggccgatggcgtgtcggtgatccacaacgccgcctgcgagccggaactggtcgacctccaggagtgcctgaacgccatgggcgccaaggtcgagggcgcgggcacgccgaccgtgacgatcaccggtgttccgcgcctgcatggcgcgacgcacgcggtcattccggatcggatcgagatgggcacctacgccgtggcggccgccatggccggcggcgaggttcgcctcagcaatgcgcgtccgggccttatcgacgccctgctggacaagctcaaagaggccggcgccagcgtcgaagagacggccgatggctgtatcatccgccgtaacggccagcgcctgaccgccgtcgacatcgaaaccgcaccgttccccggtttcgccaccgacctgcaggcgcagttcatggccttgatgacgacggccaagggcgagagccggatccgcgagaccatcttcgagaaccggttcatgcacgcgccggaactgatgcgcctgggcgccgacatctcggtgtcgggcggcgaggcgcgggtgcgcggcgtcgaccagctggaaggcgcgcaagtgatggcgaccgacctgcgcgcttcggtcagcttggtgatcgcgggcctcgtcgcgcgcggtgagaccacggtcagccgcatctatcacctcgatcggggctttgagcgccttgaggagaagctgggcgcgtgcggcgcccaggtccgtcgcatcaagggcgacggcgaggcggaactgtaa

SEQ ID NO: 40665 - DNA, 1503 bp, Caulobacter crescentus
gtggcgaacgccggccccggcgctcgggtcattgatctggatctccgccgggcggcagggcccgttgatcgcttcttcgatctgtcgatcggctcggactatcctggcaccctgatccgcgaggacagccaggcgcagctgaagaccaccgtcgacgagctgggcttccgctacattcgcttccacgcgatcttccacgacgtgctgggcaccgtgaaggtccaggacggcaagatcgtctacgattggaccaagatcgaccagctgtacgacgccctgctggccaaggggatcaagcccttcatcgagctgggtttcacgcccgaggctatgaagacgtcggatcagaccattttctactggaaggggaacacctcccatccaaagcttggaccttggcgcgacctgattgacgcctttgtccaccacctgcgcgcccgctatggcgtcgaggaggtgcgaacctggttcttcgaggtctggaacgagcccaatctcgacggcttctgggagaaggcggaccaagcggcctatttcgagctctatgacgtcaccgctcgcgccatcaaggcgatcgatccgagcctgcgggtcggcgggcccgccacggccggcgcggcgtgggttccggagttcctggcccacgtgaagaagagcggctcggccgtcgattttgtcaccacccacacttacggcgtcgacggcggcttcctcgacgagaagggcgtacaggacaccaagctgtcgccgtcgcccgatgcggtcgtcggggacgtgcgccgggttcgcgagcagatcgaggcctcggccttcccgggactgccgctctacttcaccgaatggagcaccagctacaccccgcgcgacagcgtccacgacagctatgtcagcgccgcctacatcgtcgagaagctgcgacgggtgaaggggctggtccaggccatgagctactggacctattcggatctcttcgaggagccggggcctccgacggcgcccttccagggcgggtttggcctgatgaacccgcaggggatccgcaagccgtcctggttcgcctacaagtacctgaatgcgctgaaggggcgggagctggtctgcgctgacgatcaggtcttcgccgcgcgcgacggtgatcgcgtcgcgatcgtggcctatgcttggcgtcaacccgatcagaaggtcagcaaccggccgttctatacgaagcttcaccccgcatcggacgtcgaaccgctcaaggttcggctgacgagcctcaagccgggacgctacaagcttcgtgtccgccgcgtcggctaccgccgcaacgacgcctacagcgcctatatcgatatgggctcgcccacgactctgacggagtcgcagctgcaatcgctgcaggctctgaccgaagaccggccggagatcgaaaaggcattgaaggtgtccggagaaaccgtcgtcgatctgcccatgcgggccaacgacgtcgttctcattgagctcgagccgctggcctag

SEQ ID NO: 40666 - DNA, 975 bp, Caulobacter crescentus
atgagcaaggcgcccatcatcgtcacgggcgcggccggcttcgtgggctaccacgtggccgagcgcctgctcgatcgcggcgagaccgtgatcggcgtcgatgtcttcaacgcctactacgacccggccctcaaggaggcccgcgcggcgcgcctggacggccgcgacggctttacgatgctccgtatggacatcgccgaccatgaggccttggccgacctggtgaaggcctccggcgcccagaaggtgatccacctggccgcccaggccggcgttcgctactcgatcgaaaacccgttcgcctatgagcgcagcaacctggccggccatctgtcggtgctggaggcctgccgccacgccggcgtcgagcatctggtctatgcgagctcgtcaagcgtctatggtgatcgcccgctgaacggcgacggcttcagggagagcgaccccgccgagaccccggtgtcgctgtacgccgccaccaagcgctcgtgcgagttactcagccagagctacgcaaagctctacggcttcccgcaatcaggcctgcggttcttcaccgtctatggcccgtggggtcgcccggacatggcctatttcagcttcaccgagaagatgctgaagggcgagacgatcgaggtctatggcgagggcaagatggcccgcgacttcacctatatcgacgacatcgtcgatgggatcctcggcgtcctcgacaacccgccggccaagggcgggcacgaggtctacaacatcggcgacaacgaccctgtcggcctgatggacatgatcaacacgctggaagcggcgctggggatcgaagccaacaaggtcttccgtcctatgcagccgggcgacgtcaccgccacctatgccaatatcgacaaactgcacgccctctgcggctacaagcccaaggtcaagctcgctgaagggttggcgcggtttgtggactggcggaggggcgctagagtttag

SEQ ID NO: 40667 - DNA, 1308 bp, Caulobacter crescentus
atgcgcgtagcgatgattggcacgggttatgtgggcctggtgtctggggcgtgcttcgccgactttggtcacgtggtgacgtgcatcgacaaggatccgagcaagatcgagcggctggagcgcggcgagattccgatcttcgagccgggcctggatgacctggtggcgcgcaatgtgcgcgaaggccgcctgttctttacgctcgagggcgcccaggcgatcaaggacgccgatgcggtgttcatcgccgtgggcacgccgacccgtcgcggcgatggtcacgcggacctctcgtacgtctacgccgcggccgaggagattgccggtcttatcgacggtttcaccgtggtggtcaccaagtcgaccgtgccggtcggcaccggcgacgaggtcgaggcgatcatcaggaagaccaatccgaacgcccagttcgcggtggtctccaacccggagttcctgcgcgaaggcgcggcgatcgaggacttcaagcgccccgaccgcgtggtcgtcggcaccgacgatgagcgtgcccaggcggtgatgcgcgacctctatcgtccgctcagcctgaacgagacgccgatcgtcttcaccggccgccggaccagcgagctgatcaagtatgcggccaacgcgttcctggcgatgaagatcaccttcatcaacgagatggccgacctctgcgaaaaggtcggggccgacgtccagtcggtggccaagggcatcggcctggacaagcggatcggggctaagttcctgaacgccggccccggctatggcggcagctgcttcccgaaggacacgatcgcgctcgtcaagaccgcccagcagtacggtgcgccgacccggctgatcgagaccacggtcgaggtcaacaccgcccgcaagaaggccatggccgagaaggtcgctgaggccatgggcacccgcgagctgaccggcaagaccatcggcgtgctgggcgtgaccttcaagcccaacaccgacgatatgcgcgacgcgcccagcctcgacatcctgccggccctgcaggccatgggcgccaaggtccaggccttcgaccccgaaggcgccaaggaagccgcgcacatgctggccggcgtcgagttcaagtcgggcgcctatgacgccgccgagggcgccgacgctctggtgatcctgaccgagtgggaccagttccgcgcgctcgaccttgatcgcctcaagagcctgctcaagaccccggtcgtggtcgacctgcgcaacgtctacaagcccgccgagatggagcgccacggctttacctacgcctccatcgggcgcggctga

SEQ ID NO: 40668 - DNA, 1308 bp, Caulobacter crescentus
atgcgcgtagcgatgattggcacgggttatgtgggcctggtgtctggggcgtgcttcgccgactttggtcacgtggtgacgtgcatcgacaaggatccgagcaagatcgagcggctggagcgcggcgagattccgatcttcgagccgggcctggatgacctggtggcgcgcaatgtgcgcgaaggccgcctgttctttacgctcgagggcgcccaggcgatcaaggacgccgatgcggtgttcatcgccgtgggcacgccgacccgtcgcggcgatggtcacgcggacctctcgtacgtctacgccgcggccgaggagattgccggtcttatcgacggtttcaccgtggtggtcaccaagtcgaccgtgccagtgggcaccggcgacgaggtcgaggcgatcatcaggaaggtgcgccccgacgcccagttcgcggtggtctccaacccggagttcctgcgcgaaggcgcggcgatcgaggacttcaagcgccccgaccgcgtggtggtcgggaccgacgatgagcgcgcccaggcggtgatgcgcgacctctatcgtccgctcagcctgaacgagacgccgatcgtcttcaccggccgccgcaccagcgagctgatcaagtacgcggccaacgcgttcctggcgatgaagatcaccttcatcaacgagatggccgacctctgcgagaaggtcggcgccgatgtgcagtcggtggctaagggcattggcctggacaagcggatcggggctaagttcctcaacgccggccccggttatggcggcagctgcttcccgaaggacaccatcgctctggtcaagaccgcccagcagtacggtgcgccgacccggctgatcgagaccacggtcgaggtcaacaccgcccgcaagaaggccatggccgagaaggtcgccgaggccatgggaacccgcgagctgaccggcaagaccatcggcgtgctgggcgtgaccttcaagcccaacaccgacgatatgcgcgacgcgcccagcctcgacatcctgccggccctgcagaccatgggcgccaaggtccaggccttcgaccccgaaggcgccaaggaagccgcgcacatgctggccggcgtcgagttcaaggcgggcgcctatgacgccgccgagggcgccgacgctctggtgatcctgaccgagtgggaccagttccgcgcgctcgaccttgatcgcctcaagagcctgctcaaggccccggtcgtcgtcgacctgcgcaacgtctacaagcccgcggaaatggtccgtcacggcttcacctacgcctccatcgggcgaagctga

SEQ ID NO: 40669 - DNA, 984 bp, Caulobacter crescentus
atgcaaactgttttggtggctggcggcgccggctatgttggctcgcactgttgcctagcgctggctgcggcgggctttcggcccgtggtgtacgacgacctctccaatggtcatcgtgagcatgtacagtggggcccgctggaagtgggcgatatccgcgacggcgcgcggttggacgcggtgttcgccgcccatgccccggtggcggttttgcacttcgccgcccgcatcgaggtgggcgagtccgtcaagaaccccggcgcgttcttcgacaacaatgtcggcggaacgataacgctgatcgaagcagcacgccgtgcaggcgtaaacgctatggtgttctcgtccacctgcgcgaccttcggggaccccgtgcatctcccgatggccgaggatcatccgcaggcccctctcaacccctatggccgcagcaagctgatggtcgagcaggccctggccgactacgatcgctatgtcgggttcaagagcgcggtgatgcgctatttcaacgccgccggcgcggacccggaaggacgcatcggcgagtggcacgagcctgagactcacgccatcccgctggcgattcaagtggcgcttggccagcgttcgcacttcacgattttcggtgacgattacgacacgcgggatgggaccgctgttcgcgactatatccacgtcttggaccttgccgacgcccacgtctcggctcttcgccgattgctggccggcggatcatcggactcctacaatctcgggacgggcacgggcactacggtgcgcgagttggtggacggcgttggccgagtaacgggtaagccgctgccagtccagatggcgccgcgccgcgcaggcgatgcgcctgttctggttggcgacaataccagggcgcgcgaacatctcggttggaaaccatcgagagatctcgacgccacactttcaagcgcctggcgctggcatcaggcccaagcgctggtcggacgatag

SEQ ID NO: 40670 - DNA, 1464 bp, Caulobacter crescentus
atgagcgagcccttgctgtcggccgatgcgtggaccgatcgcctgttctccgacggctgggtcaagcccagcggcggggttatcgcggtccaggaaccggcgacggagacggtgctgacccaggtcggccgcgctgaccgctccgatgtggcgcgcgccgccgcctcggccaaggcggctcaaccggcctgggcggcgctgaccgccgacgcgcggcaggccattctgctgcgcgccgccgacctcctggtcgaacacgctcctgacctggcgccgtggatcatgcgcgaaagcgggtcggtcgcggccaaggccgccgtcgaactggagcacgccgccggcttcgtgcgccaggccggcgctatggcgaccgaggccgccgggctggtcttgccctcctccccgggcaagaccagcatcgcccggcgggttccgctgggcgtcgtggcggtgatctcgccattcaacttcccgctggtcttgtcgatccgcgcggtcgcgcccgccctggcgaccggcaacgctgtggtgctcaagcccgatccgcgcacgccgatcagcggcggcttcctgatcgcccgggtcttcgaggccgccggcttgcccgccgggctgctgcacgtcctgcccggcgacgctgaggcgggcgatgcgctgtgccgcgatcccaatatcgccatggtcgccttcaccggctcgacgggcgcaggccgcaaggtaggcgaggtcgcgggcgctcacctcaagaaggtggcgctggagctgggcgggaagaacccgctgatcatccttgatgacgccgatccggatgtcgcggcctcgaacgcggcgtggggcgcctggctgcaccaggggcaggtttgcatgaccgccggccgtcttctggtccagcgcgggatccatgacgccgtggtcgagcgcttggcggccaaggccgggcacctgccggtgggcgacccgatgcgcggcgacgtggccctagggccgttgatcagccgcggacaactggaccgcgttcacgccatcgtctccgacacggtcgcggacggcgcgcgcctggtggccggcgggacccataagggcctctgctatgcgccgaccgtgctgaccggcgtcgcgccgggcatgcgggccttcgaggaagagatcttcggtcccatcgccgcagtcaccgtctttgacgatctggacgaggccgcgcgtctggccaacgatggaccctacggcttgtcggcggggatcatcagcggttcggtgggccgcgccatgaccctgggcgccaaactggaggtcggccacctgcacatcaatgatcagacggtggacgccggaccgcattcgccgttcggcggcatgaaggcctccggcaacggcacccgtatcagcgggccggccaatctcgacgaattcaccacctggcggtgggagaccgtcaaggccgccgcaacggcctatcccttctag

SEQ ID NO: 40671 - DNA, 1491 bp, Caulobacter crescentus
atgaccccgatcgatcatgtcgccttccaggcccgcctccagccgggtggcctggcggccgtcgaactggctaacggccgccgctggacctatgccgagctggacgccgacatcgcccgcgcggtgggcgtgctgcgtcggcgtggggtgggcgagggcgatcgcttggcggtgctggccaagaaccaggtcctgctggtgatcttgcacctggcctgcgcccgccttggggcgatgttcgcgccgttgaactggcgactgagcgccagcgagcttcacgccctgatcgaagacgccgatccggccatgatcgtcggcgacgatcagctggccgccgcgggcctggatggcgtcgacctggatgtcctgcgggccgagatcgactgcgccgaccccgatacgcgggcgcgcgccgaccgcgagcgcccgtcgctgatcctctacacctccgggacctcgggccgccccaagggcgcgctgctgtccgagcgcaatctcgaccagacggcgatcaactttggacgcctgggcaaggtcacgcacgagagcgtctttctggtcgatgcgccgatgttccatatcatcggcctgatcacgtctatccgaccggtgctgatgcacggcggggcgatcctggtgtcggacggcttcgagcccgcccgcacccttggtcgtcttggagacccgacgcttgggatcacccactatttctgtgtgccgcagatggccgccatgctgcgccggcagcccgccttcgacgcttcggcgctgagacgactgaccgcgatcttcacgggcggagcgccccatcccgccccggacatccgcgcctggctggcggaaggcatcccgatggtcgacggctatggcatgagcgaggccgggaccgtgtttggcatgccggccgacgcgaccttgatcgacgcccgagccggctcggcgggtctgtgcatgccgccggtgttcacccgcatcgtcgatgagcaggaccgcgactgcccgccgggcgttcccggcgagttgctgctgaagggcgacaatgtctttcgcggttactggcgtcggcctgaagacaccgcgcgcgccttcaccgaggacggctggttccggaccggcgatatcgccctggccgacgccgagggctatcactggctggtcgaccgcaagaaggacatgttcatctcgggcggcgagaacgtctatccggccgagatcgaggcggccctggccgatcatccggccatcctcgaatgcgcggtcgtcggcgtgcccgacccgcgctggggcgaggtcggccatctggtcgtgacctgccgcgaaggggcggtcctcgatctggcgctgatcctgagccatctcgaagatcggctggcccggtataagctgcccaaggctctgaccctggtcgccgcgctgccgcgcacggcttcaggtaagatccagaagacggtcctgcgcgagcgtttgctcgccggggatccaagaacctga

SEQ ID NO: 40672 - DNA, 1413 bp, Caulobacter crescentus
atgagctctccccaggccgtcttcgaacgccgtgaccccgttaccggcgcggtcgccaccacctccatcgccatgaccgcggaccaagcgcgcgtggctgttgacgccgcccaggccgccttgccgacctggagcgcgctggggccgaacgcgcgccgcgctctgttgtccaaggcggccgcagcgctggaggcgcgggccgacgacttcgttgcagcgatgatgggcgagatcggcgccaccgagggctgggcccggttcaatctgatgctggccgcctcgatggtccgcgaagccgccgcgctgaccacgcaggtgagcggcgaggtcattccatctgacaagccgggctgcctggccatggctgtgcgtgagccggtcggtgtgatcttgggcatcgccccttggaacgcgccgatcatcctgggcgtccgcgcggtggccacgccgctggcctgtggcaacaccgtggtgctcaaggcctcggagagctgcccgcgcacgcatgaactgatcgccgaggctttcgcggccgccggcctgcccgagggcgcgctgtcgatcgtcaccaacgcgccggccgacgcggccgaggtggtgggggcgctgatcgaccatcccgcagtgcggcggatcaacttcaccggctcgaccgccgtgggcaagatcatcgccaagcgggcggccgagcatctcaagcccgtgctgctggagctgggcggcaaggccccgctgatcgtgcttgaggacgccgacctggacgaggccgtcaaggccgccgccttcggcgccttcatgaaccaggggcagatctgcatgtcgaccgagcggatcattgtcgtcgacgcgatcgctgacgccttcgtcgcgaagtttgcagccaaggcctccagcctcgcggtcggcgacccgcgcgagggcaagacgccgctcggcgcggtggtggatctcaagaccgtgacccacgtccagggtctggtcgccgacgccctggccgatggcgccgtccaggttagcggcgggccggcgaatggcgtgctgatgcccgccacggtcgtcgacaaggtcaccccagccatgcgcctcttccgcgaggaaagctttggcccggtggtcgctgtgatccgcgcccgggacgaggagcacgccatcgccctggccaacgacaccgagtatggcctgtcggcctcggtcttcacccgagacatcgcccgcggcctgaaggttgcgcggcggatccagtcgggcatctgccatgtcaacggcccgaccgtgcacgacgaggctcagatgccgttcggtggcgtcaaggcctccggctacggccgcttcggcggcaaggccggcgtcgacgccttcaccgagctgcgctggatcacggtcgagacccagcccggccatttcccgatctga

SEQ ID NO: 40673 - DNA, 1200 bp, Caulobacter crescentus
atgaccgccgcctatatctgtgacgggatccgcaccccgatcggtcgctatggtgggtcgctctcaaaggtgcgcgccgacgatctggcggcgatcccgctgaaggccttggtcgcgcggaacccgagtctggacctggctgcgatcgacgagatcgtcctgggcagcgccaaccaggcgggcgaggacaaccgcaacgtcgcccgcatggccctgctgctggccggctatcccgtgtcggttccgggcgtgaccgtgaaccgcctctgcgcctcgggtctggaggccgtgggctacgccgcccgcgccatcgcctcgggccacaacgacctcgtcatcgccggcggcgtcgagagcatgagccgcgcgccgttcgtgatgggcaaggccgacagcgccttctcccgcagcgccgagatcttcgacaccaccatcggctggcgcttcgtgaacccggccatgcgcaagctgtacggcgtcgactccatgcccgagacggccgagaacgtcgccacggactatggcgtcaaccgcgaagaccaggacgctttcgccctgcgtagccaagcccgcaccgccgccgcccaggccaacggcttcctggccggtgagatcacgcctgtcgagatccccggcaaggcgggtccgacgatcgtcgaccgcgacgagcacccgcgcgaaaccaccatggaggccctggccaagctgaagccgatcgtccgcgagggcggcacggtcacggccggcaacgcctcgggcgtcaatgacggcgcggtggccctggttatcgcctccgaggacgcggtgaagcgccacggcctgacgccacgcgcccggatcaccggctacgccagcgccggggtcgagccgcgcgtgatggggatcgggccggttcccgccgtccgcaagctgatggccaagacgggtctcgccatcggcgacttcgacgtcgtcgagttgaacgaggccttcgccgcccaggggctggccgttctgcgccagctgggcctgcccgacgatggcgcgcatgtgaacgccaacggcggcgccatcgcgctgggccatccgctcggcgcgtccggcgcgcgcctggtcctcaccgccctgcgccagttggaagccagcggcggccagcgcggcctggccaccctctgcatcggcgtcggccagggcgcggccctggccttcgaacgcgtctag

SEQ ID NO: 40674 - DNA, 726 bp, Caulobacter crescentus
atgagccgtccgatcgaactgcactattggcccacgcccaacggctggaagatctccatcgccctggaggaaatgggcctgccctacgagatggttccggtgaacatcggcgtcggcgagcagttcaagccggagttcctggccataagccccaacaaccgcatgccggcgatcgtcgaccccgatgggccggacggtcagccgatctcgatcttcgaatccggcgcgatcctgcagtatctggcccgcaagtccggccagttctacggcgccaatgagcgtgagcgggtcgatatcgaccagtgggtgatgtggcagatgggcgggctcggacccatggccggccagacgcatcacttccgccagtatgcgccggcgatcatcgccgaccagcgccagatcgcctatggcgtgatccgctacaccaacgagacccaccgcctgtacggcgtcttgaacaagcgtcttgaggggcgtgagttcgtctgcggccaattgtccatcgccgacttcatgatctggccctggattgtgccgtggaaaaatcagggcatcattctggaagagtttccgcacctgaaggcgtggttcgagcgcgtcggcgcgcgcgaggccgtccagaagggcttcaagctgggcgcggaacttcgctccggcggcctgcaagcctctggaaaagctgcggaagacgctcgcagagtcctgttcggtcagcgcgcccgttaa

SEQ ID NO: 40675 - DNA, 999 bp, Caulobacter crescentus
atgacggcttccgcccatgaccccgcccgcgaggcgatcgagacgatccgcgcccgcgtcttcgcctttcccaagcgccatttcctgtcggccggcgatctgaacgcgcctcaggcggccgatctgctggatctggccgacgcgttcgtggccctgaaccggcaaacgtccaagaccctggatattctcaagggccggacgctgatgaacctgttcttcgagaacagcacccgcacccagagctcgttcgagctggcgggcaagcgtctgggcgccgacgtcgtcaacatgaaccccaagacctcgtcggtcgccaagggcgagaccctgatcgacacggccgtcaccctgaacgccatgcggcccgacctcttggtcgtccgccacgcctcgtccggcgcggccagcctactgagccaaaaggtcagcggccacgtcgtcaacgccggcgacggccagcacgagcacccgacccaggccctcctggacgccctgtcgatccgacgcgcctttggccgcgtgtcgggcctgactgtggcgatctgcggcgacgtgctgcacagccgcgtggcgcgttcgaacgtcgccttgctgcacaccctgggcgccagcgtgcgtctggtgggaccgcccaccctgatgccggcccaggccgagcgctggggcgtggccgtgcaccacgacatgaagtcgggcctggccggcgccgacgtcgtcatgatgctgcgcctgcagctggagcgcatgcagggcgccttcgtgccttcgacccgtgaatacttccgcttttacggccttgaccgggagaagctctcccgcgctgcgcctggcgccaaggtcatgcacccaggcccgatgaaccggggcgtcgagatcgactccgacgtcgccgacgatccggccgtaagcctgatccaggaccaggtcgagatgggcgtcgccgcccggatggcggtgctggcgagcctggcggccaggatcgagggggctggtcgatga

SEQ ID NO: 40676 - DNA, 1146 bp, Caulobacter crescentus
atgcgcgccgagatcgaacccttccacgccatcgccatcagccgtctggcccaccagctgaagatggaggggcgctcgatcatccatatggagtttggccagccctcgaccggcgcgccgagcaaggccctggccaaggcgcatgacattctcgacgccgaagccatgggctattgggaaagcccgctgctgcgcgagaagatcgcccagcgctatcagaccctgtacggcgtcaccgtcgagcccgagcggatcatcctgacctgcggcgcctcaccggccctggtgctggcgctgtccagcctgttcaagcccggcgaccgcatcgccctggcccgccctggctatgtcgcctatcgcaacacgctgaaggccctgcacctggagccggtcgagatcgcctgcggccccgaagaccgtttccagctgacggccaagcacctggccgacctagaacccgctcccgtcggcgtcatcgtcgccagtccggccaatccgaccggcacgatcatcgaacccgccgaactggaagccatcgccaaggtctgcgccgcgcgcggcatccggatcatcagcgacgagatctatcacgggctgtcgtacgcgggccgcacgccctcgatgctggagttcgcccccgacgccctgatcgtcaacagcttctccaagtacttcagcatggccggctggcgcctgggctggctgctgaccccgccgggcgaggatcttgaccgggcgcgcgcctatgtcggcaacctgtttctgaccgcgccttcgctggcccagcacgcgggcctggcggccatggactgcatcgatgagctggaaggccatatcgacgtctatcgcgccaaccgccagttgatgctcgacgccctgccggccctgggccttaaggagatcgcgccgccggacggggccttctacatctgggccaatatcgcccacctgaccgacgactcgctgggcttctgcgaggacctgctgcgcgacacgggcgttgcgaccgccccgggcgtcgacttcgacccggtcgagggtaagcgcttcatccgcttcagcttcgcggtctcgacgcccgaggtcgaagaggccctgcggcggatcacgccgtggttcgaggcgcgtacggctagcgcagcataa

SEQ ID NO: 40677 - DNA, 2331 bp, Caulobacter crescentus
ttgccctctttttcgcgccccctggaagagtccctgcaccgcgccgtcgcgtacgccaaccagcgtaagcacgagtacgccacgctggagcaccttctgctttccctgaccgacgacgaggacgccgccggagttatgcgcgcgtgcgacgtcgatctcgccgcgctgaagaagagcctgtcgaactatctcgacgtcgaactgacctcgctggtcgtcgacgacgaggaggacgccaagccgaccgccggcttccagcgcgtgatccagcgcgcggtgatccacgtccagtcgtccggccgcgaggaagtgaccggcgccaatgtgctggtggccatcttttcggaacgcgaaagccacgccgcctacttcctgcaggaacaggacatgacgcggtatgacgcggtgaacttcatcgctcacggcatcgccaagaaggccggcgcctccgagcccaagagcgtcaagggcgcgagcacgggctccaacgccaccgaggaggacggcgacaagtcgaccaccaagaccggcggcgaggcgctcgaagcctactgcgtcgacctcaacgagaaggcccgccagggcaaggtcgacccgctgatcgggcgcgccaacgaggtcgagcgcgcaatccagatcctgtgccgccgcaccaagaacaacccgctgctggtcggtgatccgggcgtgggcaagaccgccatcgccgagggcctggcgcgcaagatcgtcacccatcaggtccccgaggtgctggaaggcgccaccatctactcgctcgacatgggcgcgctgctggccggcacccgctatcgcggcgacttcgaggaacgcctgaagcaggtggtcaaggagctggagaaccacccgaacgcggtgctgttcatcgacgagatccacaccgtgatcggcgccggcgccaccagcggcggggcgatggacgccagcaacctgctgaagccggctctagcctcgggcacgctgcgctgcatgggctcgaccacctacaaggagttccgtcagcacttcgagaaggatcgggcgctggtccgtcgcttccagaagatcgacgtcaacgagccgacggtggaagacaccatcaagatcctcaagggtctgaagacctattacgaggacttccacaagctgaagtacacggccgacgccctgaaggtcgccgtcgagctgtcggctaagtacatcaccgaccgcaagctgcccgacaaggcgatcgacgtgatcgacgaggccggggcttcgcagatgctgctgcccgagagccgccgcaagaagaccatcggcgtcaaggagatcgaaagcgtcgtcgccaagatcgcccgcatcccgcccaagtcggtcagcaagtcggacaccgaggcgctgaaggagctggaaagcgacctcaagcgcgccgtgttcggtcaggacgaagccctgagccagctggccgccgccatgaagctggcgcgggccggcctgcgtgaacccaacaagccgatcggctcgtacctgttcagcggcccgaccggcgtcggcaagaccgaagccgccaagcagctggcccagacgctgggcatcgagatgctgcgcttcgacatgtcggaatacatggagcgccacaccgtgagccgcctcatcggcgcgcctcccggctatgtcggcttcgaccagggcggtcagctgaccgacgcggtcgaccagcacccgcacgccgtcgtcctgctcgacgaaatcgagaaggcgcacggggatgtctacaacatcctgctgcaggtgatggacaacggcaccctgaccgacagcaacggcaagaaggtcgacttccgcaacgtggtcctgatcatgaccaccaatgcgggggcctcggacgctcagcgcaactcgatcggttttggccgcagcaaggtcgaaggcgaggaagaggccgccctcaagcgcctgttcacgccggagttccgcaaccgcctggacgccgtcgtggccttcaagccgctgagcgccgacatcatccgtcaggtcgtgcagaagttcgtcatgcagctggaggcccaactggccgaccgcaacatcaccatcgagctttccgacgacgccgccgactggctggccaagaacggcttcgacgagctctatggcgcccgtccgctggcccgggtcatccaggagcacatcaagaagcccctggccgacgacatcctgtttggacgtctggtgcgcggcggccacgtcaaggtcgtgctcaaggacagcaagatcgacttcgagatcgactcctcgaccgcgcccaaggccggcaagaccgacgagaccgaaccggccatggccgaatag

SEQ ID NO: 40678 - DNA, 1224 bp, Caulobacter crescentus
atggatttcaacgattccaccgaagaagccgcctatcgtgaaaaggcgcgcgcctggctcgccgagaacgccgccgcgcaccgcgccaagtggggcgaactgaagccgaacacgcccgagcacatggccgccgccaaggaatggcaggccaccaaggccagcgctggctatgcctgcatcacctggcccgccgcgattggcggcggcggcggcacgccgatccagtcggtgatctttggccaggaagagaccaaggccgggctcggctacggctacttcacgatcggcctgggcatgtgcgtgcccacggtgatggccttctccgacggcgagaccaagaagcgtttcgtcagccccgccgtgcgcggcgaggagatctggtgccagctgttctcggaaccggcgggcggctctgacgtcgccgccctgcgcacccgcgccgtcaaggacggcgacgagtgggtcatcaacggccagaaggtctggaccaccggcgcgcactattgcgactacggcatcctgctgacccggaccgaccccgacgtgcccaagcacaagggcctgaccatgttctggatcgacatgaaggatccggcggtcgagtgccggccgatccaccagatgtcgggcgggcgcgagttcaacgaggtctattttaccgatctgcgcgtcaaggacagtcagcgcctgggtgaggtcggcgacggctggaaggtcgccctggtcacgctgatgaacgaacgcctcgccgtcggcggttcggcgggtcccaactatcgcgagatcatgaaactggcccgcgagctggcggggcccaccggcccctcgctcaaggatcagtcgttccgcgaaaagctggccgactggtacgtgcagtccgaggggctgaagttcacgcgcttccgcaccatgaccgcactgtcgcgaggccagacgccgggaccggaaagctcgatcggcaagatcatctcggccaatcagctgcaggagctggccaatacggcggtcgagatggaggaccagtacggcatcctctccgatcctgaggtcgcgcccgccgaggcggccttccagcaaagcctgatgtgggctccgggcctgcggatcgccggcggcaccgacgaaatcctgaagaacatcatcgccgaacgggtccttggtctgccgggtgatgttcgcgtggacaaggacgtcgctttcaaggacatgccgaccggacgttga

SEQ ID NO: 40679 - DNA, 1035 bp, Caulobacter crescentus
gtggttcgcggtgtgctcgacaacgccgaccgctcgttcgacgaaaagctctggaagggcgtcaccgagcagggctggctgggcgcctgcatccccgaagaacatggcggcctgggtctgggccgcgtcgaactgtgcgcgatcgccgaagagcttggacgcgccgtggcgccgatccccttcgcctccactgtttatgtgctcgccgaaggtttgatggcctacgggtccgacgcgcagaaggcgtcgatcctgccgcgcatcgccgccggtgaggtcatcggctgcctggcgacgtctgaaggccccggcgtcgtcggcccggcgacgctgcagtgccgcgtcgagggcggcaagctcagcgggacgaagatcccggtcaccgacggcgatgtcgccgatatcgcgctggtgctggcctcggaaggcggccgcccgggcctcttcctggtcgacctgaagggcgccggcgtgtcgcgcgagaccctcaagagcctggagcccacgcgcggcgtcgccaagatcgcgttcgacggcgcgcccgctgagcgtgtcggtgacgccggtgcgggcttcgaggtcgtgcaggggattctcgaccgcgcggccgtgctgctggcgttcgagcaactgggcggcgccgaccgttgcctggagatggccaaggagtacgccctggggcgctacgcctttggccgtgtcatcgcgggctatcaggccatcaagcacaagctggccgacatgtacgtcaagaacgaggtcgcccgctccaacgcctactacggcgcctgggccctgaacgacggtgcgccggaactgccggtcgccgcctcggccgcgcgcatcgccgcctcggaagccttctggttcgccagcaaggagaacatccaggtccatggcggcatgggcttcacctgggatgtcgattgccacctctattaccgccgttcgcgccaactgagcctcgtggctggggcgccgaaggtctggaaagagcggctggtggctgaactcgaaaagaaaaacgcggcttaa

SEQ ID NO: 40680 - DNA, 1311 bp, Caulobacter crescentus
atgatcagccgctacgcccgccccgaagccgccgccatctggtccagccagaccaagtacaagatctggttcgagatcgaggcccacgccgccgacgccatggccgagctgggagtcatccccaagctcgccgccgagacgatctgggaaaagggccgcgacgcggtctgggacagcgaccgcatcgatgagatcgagcgcgtcactaagcacgacgtcatcgccttcctgacccacgtctccgagatcgtcggtcccgaagcccgcttcctgcaccagggcatgaccagcagcgacgtgctggacacctgcttcgccgtgcagctgtcgcgcgccaccgacctgctgctggaagacgtcgatctggtgctggccgcgctgaagcgccgggccctggaacacaagatgaccgtctgcgtcggccgcagccacggcatccacgctgagccgatcacctttggcctgaagctcgcaggctactacgccgagttccagcgcgccaaggagcgcctggcgatggccaagttcgagatcgccacctgcgcgatctcgggcgcggtgggcaccttcgccaatgtcgatccgcgcgtcgaacagcacgtggccgacaagatgggcctggctgtcgagccggtctcgacccaggtgatcccgcgcgaccgccacgcggcctatttcgcggccctgggcgtggtggcctcgtcggtcgagcgcctggccaccgagatccgccacctgcagcgcaccgaggtgctggaagccgaagagccgttcgatccgggccagaagggctcgtcggccatgccgcacaagcgcaacccgatcctgaccgaaaacctcaccggcctggcgcgcttggtccgttcggccgtggtgccggcgatggagaacgtcgccctctggcacgagcgcgacatcagccactcgtcggtcgagcgcggcatcggccccgacgccaccatccacctcgacttcgccctgcgccgtctggccggcgtgatcgagcgcttcaacatctatcccgacaacatggccaagaacctggacaagttggggggtctcgttttctcccagcgcgtcatgctggccctgacccacaaggacgtctcccgcgaggacgcctatgcggccgtgcagggcaacgccatgaaggtctggcgcggcgaaggccggttcctcgacttcctgaaggccgatccggtcgtgtccaaggccctgaccgagaccgaactcgaagagctgttcgaccttggctaccacaccaagaatgtcgacgtgatctttcagcgcgtcttcggcgaacagggctga

SEQ ID NO: 40681 - DNA, 1914 bp, Caulobacter crescentus
ttggccgcgacggattgtctccgctctggctggggggggcatctgtccctactcttggggcgtcatcgtgattccgacgacctcaggagccccgcgatcaacccggccgccatcagagtccggatcctcagagccgttcccgcggtctgcctcattgtgggcgtcgccatggcgatggactacatcgtcacgatcctgctgctgaacgagcctgcggcctatgttccgatagccacgctggttatctcgaccatcatcgctgtgcctctggcgtactggctggcaggccagcgcttgcgcctcgaaaccatgcacgcagagctcaaggccagtctcgacgccaagcaggacgccatcgaggacgctgaggtcgcgctcgccaagtatcgcgaggtcgatcgcctctaccgcctgctgggcgacaatctgaccgaccatgtcgccctttggtcccccctgggcgagcggctctacagctcgcccagcatcgagcgcatcacgggttatacgcttgaggagttcatggccctgcctcccgcggccttggtgggcgaggctgacttcaggcgggtgcagggcatcatccgcagccttgaaccgggcggtgagccggtcagcgccgactacgagagcctgtgtaaggatggctcgcggatctgggtcgaaagcacctactctctgctgggcgacggatcgggcattctgctggtcacctcgcgcgatatcaccgagcgtaagcgccttgaactggacatcgccaaggccctgcaaatggccgaggcggcgtcggcggccaagtccgatttcctggccaatatgacccacgagctgcgcaccccgctgacggcgatcatcggctttgccgaggtgctgcgtcgctcgcgcaatctcaacaagaccgccgcccgtcaggtcggccatatcctggacgccagcaacaccctgctcagcgtggtcaacgatgtgctggacttctcccgccttgaggcgggggggctggagctggatcctgcgccgttcgatcccgccgccatggcgtcgtcctgcgcgggccttgtggctgaacgcgccgaggccaagggtctggcggtcgaggtgcgcgcccctcggggcctcaagccgatgaacctcgatgggccacggttaagccaagtgctgctgaacttcctgtccaatgcggtgaagttcacgtcgcacggcgccatcacggtcgccctgcgccaaacgatcgacggcgatcaggccgtgctgcgtggcgaggtcaccgacacgggcatcggtattgcgccagagcatcgcgagaacatcttcgaccggttctcccaggctgacgccgccgtctcgcgacgttttggcggcacgggtctgggtctcgccatctcgcggcggatcatcgagcggatggacgggcgtatcggcgtcgacagcgtcgagggccagggctcgaccttctggttcgaggtgcgcggcccgttggctgacctgccgacccaggaggctgtggaaacctcgccccttgacgccgacgcgggcgtacggctgctgctggtcgaggacaatgcggtcaatcgcgagctgatctgcgccattctggagcccttcggcgtcgccattgagaccgctaatgacggcgtcgcgggtgtggaggccatgcgccaggggcattacgatctggtgctgatggacgtgcagatgccgatgatggatggcctgaccgccacccgcgagatccgcgccatggaaggcgcccgcggcgcctcgacgccgatcatcgccatgaccgccaatgtcctgcctgaacaggtcgccaactgtatggccgccggcatggacgaccacctgggcaagccgatcagccccgccaagctgctggaggcggtcgcgcgatggtcaggaaggtcgcacgcggcctga

SEQ ID NO: 40682 - DNA, 1110 bp, Caulobacter crescentus
atgaagacccgcgccgctgttgcgttcgaagccaagaagccgctggagatcgtcgaggtcgacctggaaggccccaaggccggcgaggtgatggtcgagatcaaggccaccggcgtctgtcacaccgacgcctacactctggacggcttcgacagcgagggcatcttcccctcgatcctgggccacgagggcgcgggcgtggtggtcgaggtcggggcgggcgtgaccagcgtggcggtcggcgatcacgtgatcccgctctacacgcccgaatgccgccagtgcaaaagctgcctgtcgggcaagaccaacctgtgcacggcgatccgcgccacccagggcaagggcctgatgccggacggcaccagccgcttctcctacaagggtcagccgatctatcactatatgggctgctcgaccttctcgaactacacggtgctgcccgagatcgcggtggccaagatccgccgcgacgcgccgttcaagaccgcctgctactgcgggtgcggcgtgaccacgggcgtgggcgcggtgaccaacaccgccaaggtcgagccgggcgccaacgccatcgtctttggcctgggcggcatcggcctgaacgtcatccagggcctgaagctggtcggcgccaacatgatcgtcggtgtcgacatcaatcctgaccgcgaagaatggggccgcaagttcggcatgacccacttcgtcaacccaaaggacgtccagggcgatctcgtcgcgcacctggtggccctgaccgacggcggcgctgactacaccttcgacgccaccggcaatacgggcgtcatgcgcacggcgctggaagcctgccaccgcggctggggcgagagcatcatcatcggcgtggccgaggcggggaaggaaatctcgacccgtccgttccagctggtcaccggccgggtctggaagggcacggccttcggcggcgcgcgcggccgcaccgacacgcccaagatcgtcgactggtacatggacgggaagattcagatcgacccgatgatcacccacgtcctgccgctggaagagatcaacaaggcgtttgatctgatgcacgcgggcgagagcatccggaccgtggtgacgttctag

SEQ ID NO: 40683 - DNA, 1212 bp, Caulobacter crescentus
atggccaagatcaaagtcgccaatcccgtcgtcgacatggacggcgatgaaatgacccgcatcatctggaagctcatcaaggacaagctgatcttcccgtacttggacctggaactggactattacgacctctcggtcgagaaccgcgatgcgaccgacgaccaggtgaccatcgacgcggccaacgcgaccaagaagcacggcgtggccgtcaagtgcgcgaccatcacgcccgatgagcagcgcgtcgaagagttcaagctcaagaagatgtggaagtcgccgaacggcacgatccgcaacatcctgggcggcgtcatcttccgcgagccgatcatctgccagaacgtgccgcgcctggtgccgggctggacccagccgatcatcgtcggccgtcacgccttcggcgaccagtatcgcgcgaccgacttcaagttccccggcaagggcaccctgtcgatcaagttcgtcggcgaagacggccagaccatcgagcacgaagtgttcaaggctccggacgccggcgtcgccatggcgatgtacaatctcgacgagtcgatccgcgatttcgcccacgcctcgttcgcctacggtctgaaccgcggttacccggtctatctctccacgaagaacacgatcctcaaggcctatgacggccgcttcaaggacatcttccaggagatctacgacgccgaatacgccgagaagttcaaggcggccggcatccactacgagcaccgtctgatcgacgacatggtcgcctcggccctgaagtggtcgggcggctacgtctgggcctgtaagaactacgacggcgacgtccagtcggacatcgtcgcccagggcttcgggtcgctgggcctgatgacctcggtgctgatgacgccggacggcaagacggtggaagccgaagccgcccacggcacggtgacccgtcactatcgccagcatcagaagggcgagagcacctcgaccaactcgatcgcctcgatcttcgcctggacgcgtggcctggcccaccgcgccaagctggacgacaaccaggatctggccaacttcgccgccaccctggagaaggtctgcatcgataccgtcgagagcggctacatgaccaaggacctggctctgctggtcggcgacaagcaaggctggctgaccaccgaaggcttcctcgacaagatcgacgagaacctgaagaaggccatggcctaa

SEQ ID NO: 40684 - DNA, 1278 bp, Caulobacter crescentus
atggacctccgctaccaaaccggcttcggctcctatttcgaaaccgaggcgcatcccggcgctctgccggtcgggcgcaactcgccgcagaaggttccgttcggcctctatgccgagcagttgtcgggctcggccttcaccgcgccgcgtcacgagaaccgtcgcacctggctctaccgcctgcggcccagcgccggccacgaggcctatcagccctatgcgcaggacaagctggtctcggcctttccgggtccggccacgcccaaccgcctgcgctggagcccgctggagattcccgccgcgccgaccgacttcgtcgacggcctggtgagcctggcgggcaacgccgacgccgccacgctgggcggcatcgccgcgcacgtctatctggtcaacgtctcgatgaagaaccgggtgttctacaacgccgacggcgagatgctgatcgtgccgcagatgggcgagctgaccctggtcaccgagatgggcgtgctgaaggccggccccggccacatcgcggtgatcccgcgcggcgtgcgtttccgggtcgaggtcgaagggcccgcgcgcggctatgtctgcgagaactacggcgcggccttccgcctgcccgagctggggcccatcggcgccaacggcctggccaatccgcgtgacttcgaagcgccggtggcggccttcgaggacatcgatacgcccacgcaggtgatccagaagttccagggcgcgctgtgggccgcgacctgggatcacagccccctggacgtggtggcctggcacggcaatctgacgccgtatcgctatgacctgtcgcggttcaacacgatcaacacggtcagctatgaccaccctgatccgtcgatctttacggtcctgacctcgcccagcgacacgccggggacggccaactgcgacttcgtgatcttcccgccgcgctggatggtggccgaggacacgttccggccgccgtggttccaccgcaacgtgatgagcgagttcatgggcctgatccacggcgcctatgacgccaaggcgggtggcttcgtccccggcggcgcgtctttgcacaactgcatgagcgatcacggccccgacgtcgccagccacaagaaggcgaccgaggtggtcctggccccgcacaagatcgacggcaccatggcctttatgttcgagagccgctgggtgttccgcccgacgcatctcgccttggagtccgcagccctgcagtccgactacgacgcctgctggaccggcttccccaaggcccgcctgtcctga

SEQ ID NO: 40685 - DNA, 1074 bp, Caulobacter crescentus
atgaccctcgtcaccgaccagaaccccctgggcctcgacggcttcgagttcgtcgagttcaccagccccgatccggcggccatgaaggccctgatcgagcaactgggcttcgtcgccgccagcaagcacccgaccaaggccgcgacccgctacaagcagggccgcgtgaacctgatcgtcaatgaagagacgaccggtcaggtcgccgacttccgcgccgaccacggcccgtcggccaacggcatggcgttccgcgtcgagaacgccgagcaagcctatgcggacgccgtcaagcgcggcgccaagccggccgacgcctcgcgctcgctgctgggcgcggacgccaaggtgctggaaggcatcggcgggtccttgctctatctcgtcgaccgctatggcgatgcgggcacgatctatgacgcctgggagcaggtcccgggcgcggccctggccgaagccaagaacaatgtcggcctcgatctgctcgaccacctgacccacaacgtcaagcgtggccagatgcgcacctggtcgaccttctacaaccagatcttcggcttcgaagagcagaagtacttcgacatcaagggccaggcgacgggtctgttcagccaggcgatgatcgcgcccgacaaggccatccgcatcccgctgaacgagagccaggacgacaagagccagatcgaggagttcatccgccagtacaacggcgagggcatccagcacctggccatgacgacggacaatatctacgacaccgtcgagaagctgcgcgcgcggggcgtgaagctgcaggacaccatcgagacctattacgagctggtcgacaagcgcgtccccggccacggcgaggacctggagcgcctgcgcaagaaccgcatcctgatcgacggcgccgtcggcgaggaagggctcttgctgcagatcttcaccgagaacctgtttggtccgatcttcttcgagatcatccagcgcaagggcaatgaaggcttcggcaacggcaacttccaggccctgttcgagagcatcgaactggaccagatccgccgcggcgtgatcacggtggatgcgtaa

SEQ ID NO: 40686 - DNA, 1137 bp, Caulobacter crescentus
ttggagcgcggccgcatgctggttctcgatcgcaagcccctgacgcccgcctgggcctcgccgatgcgccaggcgctggaaggcgtgcaaggctacaaggccggcatgaccctggccgaggccgcccgtcgcacgggcctgagcgccttctccaagctggccagcaacgagaacctcctgggccccagccccaaggtcgccgaggcggtgatggccgcgatggccgagccgcacatctatcccgatccgcacagcgacgtgctgcgcgcggcgatcggcgcgcgtctcggcgtctcgccggcgcgcgtggtggtttcgcccggctccgaggcgctgatcgactatgtgttccgcgcggtgctgcacccgggcgactcgatcctgctgtccagtccgaccttcccgacctatgagatcttcggtcgctgcgccgaggcgcggatcatcgacgtgccgcgtctggcgaatttcgacatcgacgtcccggccgtctgcgccgctgcggcgctgggccccaagctcctggtgctgtgcacgccgaacaatccgacgggcaatgcgctgaaggcggccgatttccaggcgatcctcgccgcgacgccgcgctcgaccgtggtgttcgtcgacgaggcctatcgcgagtatcacgaggccttcgacaccttcgccatgctggacgcctggggcggcccgtgggtgtcggcccgcaccttctccaaggcctatggcctggctggcctgcgcatgggctatggcgtcgcgtcttcgcccgagctggtcgactatctggaccgcatccgcccccccttcaacgtcaccgccgtcagccaggccgccgccctggccgcctgggaagaccaggactatctgaagcgcaccgtcgacctgaccatcgccgaacgtggccgggtcgaggcggtgctggacgacatgggcgtcgagcacaccgaaagccacgccaacttcgtgttcctgcgctcgccggcgggtcccgaagccaccgccgcgcatttgttgcaccaggggctcatcatccggccgacgcccgtcgccggcggctgggtccggatcaccatcggccgcccggccgacaacgacgccctgatcgccgccctgccggcggccctttcgctctaa

SEQ ID NO: 40687 - DNA, 798 bp, Caulobacter crescentus
ttgtctctgatcctcaccgaaaagcgcggtcacatcgctatccttactctgaatcggccagatgcaatgaacgctttgggcgcgccgggggatggcgatcaggtggcggcggcctgcgaggcgatcaatgacgaccaggacatccgctgcgtgatcctgaccggcgcgggaaaagccttctcggccggcggcgacgtcaaggcgatgaaggcccgcgaaggcgcgttcggcggcaacggcgtcaaggtgcgcgacggctaccgcaagaacatccaccgcatcgtccgcgccatctatggcctggaagttccgtcgatcgcggccgtgaacggcgcagccatcggcctgggctgcgatgtggcctgcatgaccgacatccgcatcgccgccgataccgcccgcttcggcgtcaccttcctgaagctgggcctgatccccggcgacggcggcgcctggctgatgccgcgcacgatcggcatgagccgcgcggccgagcttctgttcaccggcgacgtcatcgatgcggccaaggccgccgagtggggcctgatcagcaaggccgtcccggccggcgacctgatgggcgaggccctggccctggccgagcggatcgcccagcaaccgccgcacgccctgcgcatggccaagagcctgctcaagcacggccagaccgccagctatgacaccctgatggagatgagcgcggcggcccaggccatcgcccaccacaccgaggaccacatggaaggcgtcgacgcgatcctcgagaagcgcagccctgtgttcaagggcgcctga

SEQ ID NO: 40688 - DNA, 2082 bp, Caulobacter crescentus
atggcgcagcgtatagcgtctcacgaggaacggcggcagacagcgcttctgttagcgctatcgttcgcggtcgccgccgcgatcgtgttcagcgagaacctcacccgcacgacgctgggcgtcgccgccttctggcccgccaacgcctttctggccgccggcctgctcaccctgacaagcgttcgccgcctggttctgatcgcggtgttcgtcttcttccatgtggcggtgtgcctgcaggcaggcgacgggccgctcaaggctctggttttcgccacggtggacggactggaggccggcgcggtctgggcggcgttccgcaggttctggaacggcgcgcctcgggtgcgaacccttcgcgctctggcccagctgcccgcgatcacaacgcccatcgcggccggttcggcgctgatctgcgcgaccgtcctgcatttcggttacggcgcgcccttcgccgagagcctggtggattggctcctgcgcagcgccttgggcctggctgtcgcgcttccggccacgctggtgctgatcgacgccgaacatcggcgttcgttccagcgcccctggtcagagaaactgctgctgatgttcagcgtcgtgacggtggccctgctctgcgcgcatccggccgcgggcgcgccccccgtcttgatgtttccggtgaccctggccgccgcctacaggcttggcgcacgcggcgcggccctcgcggcgtttctgacgatcgggatcatcatgccgatggtcatatcggtgggctcttcctccttcaactcgacccaggacaccgtcatccaggcccggacgatccaggtgttcatgggcgtcctgttctacacctgcctcgccgccgggctggcgttcggccagcagaaccggctcaagcgcctgctgttgcgccgcgagcagttgacccgcgccgcgcgcggccgcgctctggccgccacagaggccaagaccgagttcctggccaccatgagccacgaaatccgcacgccgctgaacagcgtgctgggctttgcccagttgcttgcggcgcgcgaggacttgcccccggacgctcggcgccaggtcaatctgatcgacagcgccggcgcggcgctgctgaccgtggtcgacgacatcctggacttctcgcgcgtcgaggcgggccagatcgagctattgccggggcccacatcggccgccgcgctgctgcgcgacacggtcgcgatcatggcccccgaggcgcgcgccaagggcttgtcgatggatgtggagatcatcgaccccatcggggtcttgcacgatctcgacgccgaccgcctgaggcaggttctgatcaacctgctgaacaatgcggtgaagttcaccgaagagggccgcatcgacgcgcggctgatcatcgaaccgggcgatatcgaggacaggctgcgcttcgaggttctcgacacgggtgtcgggatcgagctcgacaagcagggtctgctgtttcagcgcttctcgcagacggacagctcacccagccgcctgcacggcggcccgggccttggactggcgatcgccaaggcgctgatcgacgttatgggcggcaagatcggcgtggacagcgtgcccggtcgcgggtcgtgcttctgggtggagctcagcgccccggtcgccgagccggccccggcgcctgagcccgcgaaaccgccggccccgggcgcggcgcggatcctgatcgtcgacgaccatcccatcaacctcgagatcggcgcagccttactcacgctggtcggatacgaggtcgatctggcggagaacggcaagcaggccgtggagaaggcggaagccggcgcctacgacctgatcctgatggacatccacatgccgttgatggacgggctgcaggcgacacgcgcgatcaaggccctgcgcacgtccaccggaaaggcgccgatcatcgccatgagcgccgacgccctgccccgccaggtggagcgctgctacgccgccggcatggtcgatcacgtcgccaagcccatccaacgcgaggtgctttacgccaagatcgagcgttggctgcatccgctccgcgatggcgacaagcccgcctag

SEQ ID NO: 40689 - DNA, 1668 bp, Caulobacter crescentus
atggccagcgagcgctttgattacatcgtcatcggggccggctcggccggttgcgtcctggccgcgcgcctgaccgaggatccgaacatcaaggtcctgctgctggaggccggcggcaagaacaagtcgatcctggtgaagatgccggccggggttggtcagctgatcaaggacaagggcgagcagaactggggcttctggacggaagccgaacctcacctggacaaccgcaagctctggtggccgcgcggcaagggcctgggcggcagctcggccatcaacggcatgatctatatccgcggccatgcgcgcgactatgaccagtggcgccagatgggcctgaccggctggtcgtactcggaggtcttgccctacttcaagcgctcggaaacccaccacgccggcggcgacgcctatcacggcggttcggggccgctgcatgtgtcgaagggcgagtccgacagcccgttctacagcaccctcgtcgaggccggccgccaggcgggtcacaagaccaccaaggacttcaacggctaccagcaggagggctttgggccctacgacctgaccatccgcgatggccagcgctggagcgccgccatggcctatctcaaccaggccctgtcgcgcccgaacctgacctgcgtcaccgaggcctgcaccacgcggatcatcctggacaagcgccgggccgtcggcgtcgagtacgtggtcggcaagtcgcgcgagaagcaggtcgcctatgccgacgccgaggtgctgctgagcgcgggcgcggtgcagtcgccgcagatcctgcaactgtcgggcatcggcgcggcggaagacctggcgccgcacggcatcgcggtggcccacgagtccaagggcgtcggcgccaatctgcaggatcacctggacgtctgcgtctcctggaccgccaagaacctcaagaccgcctattcggccaacaaggggctgaacaagctgggcgtgggcatgaactacatgttcttcggcaaggggctgggccggcagcagttcctggaaagcggcgccttcctgaagtcgcgccccgaccttgaccgccccgacctgcagatccacggcgtgctggcgatcatgcaggaccacggcaaggtcgtggtcgagaaggacggctttaccctgcacgtctgccagcttcgcccggaaagccggggcaaggttggtttgcgctcggccgatccgttcgatgatccgaccatcctgggcaactatctggccaccgaagaggaccgccgcgccatccgcgagggggtgcgtatcgcccgcgagaccgtcgcccaggccgctttcgatccctatcgcgacgccgagtatgcgccaggggcggacgtgaagtcggacgctgatctcgacgcctggatccggtccaaggccgagacgatctaccaccctgtcggcacctgccgcatgggcgtggcgggcgacccgatggccgtggtcgacgaccagctccgggttcagggcgtccaggggctgcgcgtgatcgacgcctcggttatgccgaccctgatcggcggcaacaccaacgccccgaccatcatgatcgccgaacgcgccgccgacctgatccgcggcaagacgccggccgcgccgctggacgtgccggtgtacgaggacggccgcgcggtggcggccgagtag

SEQ ID NO: 40690 - DNA, 804 bp, Caulobacter crescentus
atgttgggacgggacttcgaagggttcaccgtggtggtcaccggcggctccacggggctgggtcgggcgatcgccgtggagaccgcccggcgcggcgcgggccttgtcgtgatcaacttcgcccgcagcgccgaggaagccgaagagaccgcaaggctcgtccaggccgagggcgccaaggcggttttggcgcagggcgacgtgtccagcgacgaggattgccgcaggatcgcggccgccgccgacgcctcgggccgcatcgatgcgctgttcaacaacgccggcatgaccaagttcgcgccgaaccacgctgatctcgacgccgtcaacgccgaggatttcctgcggctctattcggtgaacgtcgtcggcgccttccagatggtccgcgccgcccgcacgctgctggaggccgcgccgtcacccggcgccgtggtcaacacctcttcgatcgcgggcgtggtcggcaacggctcatcggtgccctacgccgcctccaagggcgcgatgaccacgatgacgttgtcgctggcccgcgcgcttgcgccgcgcattcgcgtcaacgccgtctgcccgggcttcatcgacacaccgtggttcgaaaaggccatggacgccgagcgaatcgatcgtcttcgcgccggcgcggctgcggcgacaccgttgaaggtcgcctccaccgccgaagacatcgccggcgcggccgtctttctggcgtcccctgcgtcgcggcatgtcaccggcgagaccctgttggtcgacggggggctccacctcggcggcgcaagcctttccatgcggtaa

SEQ ID NO: 40691 - DNA, 2073 bp, Caulobacter crescentus
atgagaagaacgaccgcccaccgcgcctttcggcggacgatgaatctcatcgccggtggcaagcccctcgcgtcggccctgaaggctatcgtgcaggccgtggaggccgaggatcccacgatcctctgcggcatcctactgctcgacgctgatcgccgtcgtctgctcatgggcgcggcgcccagtctgccgaccttctacaatcaggcgatcgaaggcgtggagatcggcccctcggtcggctcctgcggcacggcggcctatctggggcggcgcgtgatggtcgatgacatccagtcgagcccgctctgggtcggctatcaggagttggcggcgcaagcgggcctggccgcctgctggtccgagccgatcaagacgtccgacggtgcggtggccgggaccttcgcgatctatcaccgcgaggtcagcaagccgaacaaggaagacatcgccttcatcgaggccgctgcgcaactggccgcgttcgcgatcgatcggcggcgcgcggaggaggagctggcggccagcgaggcgcgggcgcggctcttggccgaacaggcgctcgagacatcgcggaacctatcgaactttttcgatgtttcggcggacctgctgagtatcagcaacatgcagggccggttcgtgaaggtgaaccgagcctgggagacggcgctgggctatccgatcgaggccttggagggcgtaccgttcctgccgttgctgcacccggaagatcagcagagcacacgcgtccagatcaaccggatcgaagtcgacgatgaggtcaatggctttgtgaaccgctatcgacgcgcggacggctcgtactgccagctggaatggcgcgcccgtcgctgcgacgacctggtgttcggtgtcgcccgcgacgtcaccgagcggctgcgaatccaggccgagatggccgaggcccgcgacgccgccgaggcggccaaccgggccaagaatgacttcctggccaatatgagccacgagatccgcacgcctttgaacggcgtcatcgccctggccgccgcgctggacgaaacgccgctgacgagcaaacaggctgagatggtcgccatgatccgccgctcgggcgagaccctggagcggctggtgtcggatatcctggatgtctccaagatcgaggcgggccagatgaccctccagccgcaggccttcgacctgggcgccttggtggacgggctcctggatgtcacgcggctgcgggccaaggaaaagggcgtggcggttcgtcttgagcgcagcccaaccgcggcgggcggcttcctaggcgacagcgtgcggatcggccaggtgctgagcaatctgttctccaacgccgtgaagttcaccgaccagggcgaggtgatcgttcgcgtcgacgtggaagaggccggcaatggccaggcggcgcgccttttcgtcgaggtcgaggatacgggggtcggtttcgacgccgagaaggccgagatgatcttccagcgctttaaccaggccgacagcaccattacgcgccggttcggcggctcgggtctgggcctgtcgatcagcaagaccctggtcgagatgatgggcggcgagatcacggcccagtccagtcccggcgcgggcagcctgttcagggtgaccctgccgttgagccgtacgcagatgggtccggacgccgagatcgacgcgccccgttccgcggcgccgggcgaagggctcaaggtgctgctggccgaggatcacccgatcaaccagcgcgtggtccagctgatcctcgagccgtgcggcgccgccgtgacggtggttgagaacggcgcccaggccgttgaggccatggcgtccggagccttcgacgtggtgctgatggacatgcagatgccggtgatggacggcttggccgcaacccgcgcgatccgggcgcgggaaggggagggccagcgcacaccgatcatcatgctcagcgccaacgccatggacgtccatcgcagggaggcgctgcaggccggggccgatctgcatgtgcccaagccgatcacaatcgcggcgcttctggacagcatcggccaggtgatggcgcgctga

SEQ ID NO: 40692 - DNA, 1131 bp, Caulobacter crescentus
atgaccctgtcccgtcgcgaccttctcgccgccggcgccgccggcgccctggcgggccccgccctggccgccgaaggaccctcgttgcgtgagttggccaaggccaaggggatcgtgttcggcagcgccgtcggcgcgggccccaaggggtcgatcaccggctccttcgaggacgcccgctatcgcgagatcctggcccgcgagtgcggcgtgctggtccatgagaacgagctgaaatggtacgtcctgcgcgcgcgcggcccccagggcttcgacttcgagcgcgccgaccgcatcgccgacttcgccaaggccaacggccaggccctgcgcgggcacaccctgctgtggcaccatccgcagtggttcccgaactgggtgaagggccacgactttggggccaagcccgccgaggccgccgccaagatggtcaccgagcacatccaggccctgtgccggcgctatccccagatgatctcgtgggacgtcgtcaacgagacggtcgatccggctgacggctcgatccgctcgaccttcctgtccgacgccatgggcaaggaagaggtgctggacctgtcgttccacgtggcccgcgaggccgcgcccaaggcccgcctcgtctataacgactatatgagccaggaggccggcaacgagaagcaccgctacggcgtgctcaagctgctggaaggcttcaggaagcgcgggacgccggtcgacgccctgggggtgcagagccacatcggcgccgaaaacgccgacagcttcaccggcttcggcaagccgcaggaaaaggcgtggaccgcgttcctgaacgacgtcaccggtatgggctatgacctgatggtcaccgagttcgacgtccacgacaaagggctgccctacgactttggcccgcgcgacgcggcggtggcggcttacgccaaggcctatctggaccagatgctgagctatcgtcagaccaaggagatcctggcctggggtctggtcgacaagtactcgtggctgcaaggccgctggccgcgccaggacggccagcccaagcggccgaccctctatgacgacacctatcagcccaagcccctgcgcgaggcggtggccgcggcgctgaaggccgcgccggcgcggtag

SEQ ID NO: 40693 - DNA, 1167 bp, Caulobacter crescentus
atgtcccaagaccttctccccggcgtcactggcgttctggccctggccgatggcgccatcctgcaaggcgtgggctgcggcgcggtcggcgacgcggtcggcgaggtgtgcttcaacaccgccatgaccggctatcaggagatcctgaccgacccgtcctacatggcccagatcgtggccttcaccttcccgcacgtcggcaatgtcggggtgaacggcgaagacgtcgagcagatcaccggcgtggccgagacggccgcccgcggcgccctgttccgcgacgtgcccaccgtccaggccaactggcgcgccgatggcgacttcgacgcctggatgaaggcgcgcggcgtggtgggtctggcgggtgtcgacacccgcgccctgacccgcaagatccgcgaaaccggcatgccgcacggcgtcatcgcccattcgcccgacggccagttcgacctcgccgccctggtcgccaaggccaaggcctgggcgggcctcgaaggcctcgacctggccaaggacgcctcgacgacccagaccttcacctgggacgagggtctgtggtcgtggccggaaggctacgccaagctggacaagcccaagtacgaggtcgtggtcatcgactacggcgtcaagcgcaacatcctgcgcgccctggcccatgtcggcgcccgcgccacggtggtgccggcctcgaccagcgccgaagacatcctggcccgcaaccctgacggtgtgatgctgagcaacggcccgggcgacccggccgccaccggccagtacgccgtgcccgagatccagaagctggtcgccagcggcaagccggtgttcggcatttgcctgggccaccagatgctggccctggcgctgggcgccaagaccgtgaagatggaacagggccaccacggcgccaaccacccggtcaaggacctgaccaccggcaaggtcgagatcgtctcgatgaaccacggcttcaccgtcgacaccgcctccctgcccgccccggtcaaggagacccacgtctcgctgttcgacggcaccaacgccggcatcgccctggacggcaagccggtgttctcggtgcagcaccaccccgaagcgtctccggggccgacggacagcctgtacctgttcgagcggttcgcgggcctgatggacgcggcgaagtaa

SEQ ID NO: 40694 - DNA, 1041 bp, Caulobacter crescentus
atgaaagccctgcgctatcacggcgcccgcgacgtccggtacgagagcatggacgatcccacgccccagtcggaccgcgacgcgatcgtccaggtcaccgcctgctcgatctgcggctcggacctgcacatctatcacggccatggcttctcggaggacctcgggttctgcgtcggccacgaggcggtcggcgaggtggtcgaggtcgggcgcggcgtccagcggctgaaggtcggcgacaaggtcatgctgccggccgccgtaggctgcgggcgttgccgctcgtgcctgtcgggcgtgatccagacctgcgagaacggccaaggcgcctgctatggcctgtcggcgcggctgcagggctcgcaggcggaagccgtgcgcgtgccggccgccgacatgaacgccgtgcccgtgcccgacggcgtctcgatggaccaggcgctgatgatgaccgacgccctggccacggcctggttcggggctcgcaacgccgaggtgcggccgggcgccagcgtggcggtgatcggccttggccccatcggcctgatggcggtcgagagcgcctatgtgatgggcgcgcacgtcgtctacgccatcgatcccctgcccgctcgccgagctttggcggaggaggccggcgccatcgccctgcatcccgacgaggccctggcgcgcgtgcgcgaggacaccaaggggcgcggcctggactgcgtgatcgaggcggtcggcggcgaggccacggtggatgcggccctgcgcctggtgcggccgcgcggcgtggtgtcggtgatcggggtgcagcaggccaagcgcttcgcgttcccgctagagcgcgccttcggggcgggcctgaccttccgggtgggaacctgctcggtgcccgaggaactgccggcgctgtttccgctggtgcggtcgggacgcctgcggcccgagaaatacatcagccaccgcctgccgctcagcgacgggcctgaggcctaccgcctgttcgaaagccgcgaggccggcgcgctgaagatggtgctgacgccggggtga

SEQ ID NO: 40695 - DNA, 1962 bp, Caulobacter crescentus
atgaacgccgctactcttgtggacacacacgccgtcgacaccgcgctgcaagaggcgttcgaagccgcgccggaaggctttgcgctgttcgacgccgaggatcgctgcgttatctggaacgcccggtacggcgaactgtggtccaagtggggcgtcaccctggcggtgggggccacgttcgagagcctgctgctggcgggcctggcggcggggcgctttcccgaggccaatggcgatcgcgcggcctggctggcccaccagctgggccggcgcaagctggaccgcatcgaagagatccgcgaagagttcggcgaatatctacggttcgagagccggcgcacgcccgccggcgggctcatcaccacctgcgccaacctcaccaacctgcgtcgccgcgaggcccaggccctggcggcccgcagctttctggacaccattgtcgagaacacgccggccatgctgttcgtcaaggacggcgatacgggcgccttcctgttggtcaatcgggccgccgagaatcagctgggcgtgccgcgcgccgagctcctgggcaagagcgactacgacttctttcccaaggagcaggccgacgccttcgccgccgacgaccgccgggtgatcgcaagcgggaagctggtcaccatcgacgaagagccgctggatacgccccacaatggtcgccgctggttgcagacccgcaagatcgccatcccgggcgaggacggccgccgccacctgctggtgatctgcgaggacatcaccgagcgcaaggccggcgccgcggccctggccgaggccctgcagaaggccgaggcgggcagcgtcgccaagagcgagttcctggccaatatgagccacgaaatccgcacgcccctgaacggggtgatcggcatggccgaggtgctgagccgcaccgccctggacgacgcccagcgcgagatgatggaggtgatcctcaattccggccgggcgctgaacctgctgctcagcgacattctcgacctgtccaagatcgaagccggcgggcttgagctgtcgcgcgacccgctggacctgcgcgaggcgatcaccgcggcggtcgccgtgttcaaggccgtcgccgagagcaaggggctggtcttccggctgaccttcgccgacgacttccacgaccatgtcctgggcgacgccctgcgggtgcgccagatcgtggccaacctgaccagcaacgccgtcaagttcacgaccgccggctcggtgatcatcgaggcccggacccttgtcgccgaagacgggcggatcgacctgaccgtcagcgtccaggacaccggcgaggggtttgacgaggacagcgccgaccgattgttcgagcgcttccagcaggccgatggttcggtgacgcgcaaggtcggcggcaccgggcttggcctgccgatcgcccggcgcctggctcggctgatggacggcgagatctcctgcgtggcccatccgggcgagggggccaccttcgtcttcgaggccctcttcctggccgatggtcagcgcacgccggcggcgtccgccgatccggccggcgagctggccctggatcgtcgcctgcgggtgctgctggccgaggaccatcccaccaaccagaaggtgatcggcctgatgctggcggacgccgccgacgtcacggtggccgaggacggccaggccgccgtcgaagccttcgagaagcacgcctatgacgtggtgctgatggacacccagatgccggtcatggacggcctggccgccatcgccgaaatccgccggcgcgaacgcgaggcgcaggcgcgccgcacgccgatcatctcgctgaccgccaacgccatgccccatcaggtgcgcgcctgcctggaggccggcgcggatctgcacctggccaagcccgtcagcatccagggcctcttcgccacgctcggcgccgcgctggagacccgtccgggcggtgagggctag

SEQ ID NO: 40696 - DNA, 792 bp, Caulobacter crescentus
atggcgcaagacatgacctacgcgcgatacctcgcgctcgatgaactgctctcggcccagaagccgctgagcgaccggcacgacgaactgttgttcatcgtcatccaccagaccaaggagctgtggctcaaggagatcctccacgaggtcgccctggccctgaagctgatcgccggcggcgatgtcgagccggcctacaaggccctggcgcgggtctcgcggatccagacggtgatgaccctgtcgtgggacatcctggccaccatgacgccggccgattacctgagcttccgcgatgatctgggcacgagctcgggcttccagtcgcaccagttccgggccctggaatacctgctgggcctgaaggaccagagcttcctgaagttccacaccgagcggcccgaggccctggccatgctgaagagcgccctggagtcgcccagcctgtacgacgtggccatcgcccagttgccgcgccatggcctgaccgtgcccgacgccgccttgcaccgcgacttcagccagacctatgttccctcacccgaggtcgaggccgcgtggctggaggtctatcgcgaccccaagcgttactgggagctctatcaattggccgagaagctcgttgatctggacgacgccctggtcacctggcgccacaagcacgtgctgaccgtcgagcggatcatcggcgggcgtccgggcaccggcggcaccgacggggtcggctatctggccagcacgcttcgccgccgcgccttccccgagctgtggtcgctgaggaccaagctctga

SEQ ID NO: 40697 - DNA, 3300 bp, Caulobacter crescentus
atgcccaaaagaacagacatctcctcgatcctgatcatcggcgcggggccgatcgtcatcggtcaggcctgcgagttcgactattcgggcgttcaggcctgtaaggcgctgcgggccgagggctaccggatcatcctggtcaactctaaccccgccacgatcatgactgatccggacgtggccgatgcgacctatatcgagccgatcacgccggagatggtcgccaagatcatcgagaaggagcgccccgacgcccttctgccgaccatgggcggccagaccgctctgaacacggcgctggccctggaagccgacggcaccctggccaagttcggtgtcgagatgatcggggccaaggccgaggtcatcgacaaggccgaagaccgtcagaagttccgcgacgccatggacaagctgggcctggaatcgccccgctcgcgcgcctgccacacgctggacgaggccatggaaggccttgagttcgtcggcctgccggcgatcatccgcccgtccttcaccctggccgggaccggcggcggcatcgcctacaatgtcgaggaattcaaagagatcgtcgagcgcggcctcgacctctcgccgaccaccgaggtgctggtcgaagagagcgtcctaggctggaaggagtacgagatggaggtcgtccgcgacaaggcggacaactgcatcatcgtctgctcgatcgagaacatcgacccgatgggcgtgcacaccggcgactcgatcaccgtcgccccggccctgaccctgacggacaaggaatatcagtggatgcgcgcggcctcgatcgccgtgctgcgcgagatcggcgtggagaccggcggctcgaacgtgcagttcgccgtcaatccggccgacggccgcatggtcgtcattgagatgaacccgcgcgtgtcgcgctcctcggccctggcgtcgaaggccaccggcttcccgatcgccaaggtcgccgcgcgcctggccgtcggctacaccctcgatgagctgaagaacgacatcaccggcggcgcgaccccggcctcgttcgagcccagcatcgactatgtcgtcaccaagatcccgcgcttcgccttcgagaagtatccgggttcggagcccctgctgaccacggccatgaagtcggtcggcgaggtcatggccatcggccgcaccttcaaggaaagcgtccagaaggccctgcgcggtctggaaaccggcctgtcgggctttgacgaggtcgagatcgccggcgccgatgatcccgacaacggcaaggaagcggtgatccgcgccctgggcgtgcccacccccgaccgcctgcgcgtcatcgcccaggccttccgccacggcctgaccgtggacgaggtcaacgccgcctgttcgtatgagccctggttcctgcgccagatcgccgagatcgtccgccaggaaggctgggtgaaggccggcggcctgccgcagaccgcccaaggcttccgcgagctgaaggcgcaaggcttctcggacgcccgtctggccaagctgaccgcatcgaccgaaaaggccgtgcgcgccgcgcgtcaggccctgaacgtgcgcccggtgttcaagcgtatcgacagctgcgccggcgagttcctggcctccacgccctacatgtactcgacctacgagttcggcgccctgggccagatcccccagtgcgaaagcgacccgtcggccgccaagaaggcggtgatcctgggcggtggtcccaaccggatcggccagggtatcgagttcgactactgctgctgccacgcggcgttcgcgctggaccagatcggcgtggagtcgatcatggtcaactgcaaccccgagaccgtctcgaccgactacgacacctccgaccgcctgtacttcgagccgctgacggccgaggacgtgctggagctgctgcacgttgaaatgagcaagggcacgttggccggtgtcatcgtgcagttcggcggccagaccccgctgaagctggcccacgccctggaagaggccggcgtgccgatcctgggcaccagccccgacgccatcgacctggccgaagaccgcgagcgcttccagcaattgctgaacggtctgaacatcgcccagccggaaaacgccatcgcccgcagctgggacgaagcgcgcgccgaaggcgacaagatcggcttcccgttcgtgatgcgtccgtcctacgtgctgggcggccggggcatggagatcatccgcgatcacgaggccatggagcgctacatcgccggcgccggcgagatctcgctcgagcacccgatcctgctggaccactatctgagccgcgccaccgaggtcgatgtcgacgccctgtgcgacggcaaggacgtgttcgtggccggcgtgctggagcacatcgaggaagccggcgtccactcgggcgactcggcgtgctcgatgccgcccttctcgctgaaggccgagaccgtcgaggagctgaagcgccagacggtgcagatggctctggcgctcaacgtccgcggcctgatgaacgtgcagttcgccatcgaggagccgcacagcgacaacccgcgcatctatgtgctggaagtgaacccgcgcgcctcgcgcaccgtgccgttcgtggccaagacgatcggccagcccgtggccgccatcgccgccaagatcatggccggcgagagcttggccagctttggcctgaaggacgttccctacgaccacatcgcggtcaaggaagcggtcttcccgttcgcccgcttcgccggcgtcgacacggtgctgggcccggaaatgcgctcgaccggcgaggtcatgggcctggactggaagcgcgacggcgagaccggcatgggcccggccttcgcccgcgccttcgccaagagccagctgggcggcggcgtcaagctgccgaccaagggcacggccttcgtctcggtcaaggaaagcgacaagccctggatcgtcgagccggtgaagctgttgcaggcggccggtttcaaggttctgtcgaccgagggcacgcaagcctatctggccgcccagggcgtccaggtcgagcatgtgaagaaggtcctcgagggccgtccgcatatcgtcgacgtgatgaagaacggcggcgtgcagctggtcttcaacaccaccgaaggcaagcaggccctggaagacagcttcgagatccgccgcacggccctgatgatgaaggtgccgtactacacgacgtcggccggcgccctggccgccgcccaggccatcgccggcgccccggccgaggccctggacgtgcgtccgctgcaaagctacgcggcggagtag

SEQ ID NO: 40698 - DNA, 1536 bp, Caulobacter crescentus
ttgacccagtatcgcatcaccttcgaaggccccgtcatcctcggcgcaggcttggccggtctcaccgccgcgctttccgcgacgacgggggccgccaagacggcgctggtcttgtcgccgacgccgctggcgagcggctgttccagcgcctgggcgcagggcggcatggccgcggccctgtcgggcgacgactcccccgcactgcacgccgccgacaccatcgccgccggcgcgggcctgtgcgatccgcaggccgtcgacctcctgacccgcgaaggcccgcaggccgtgcgtgacctcgcagccctcggcgcgccgttcgatcgcaaggcggacgatggcttcgtgctgagcctcgaggccgctcactcggccgcccgtgtcgcccgggtcggcggcgacggggccggcgcggcgatcatggccgccgtcatcgcggcggtccgcgcgacgccgggcatcgaggtccgcgaaaacgctcgcgcccgtcgcctgctacaggacgcgaacggccgtgtggtcggcgtgctggccgatgtcgacggcgccctggtcgagatccgctcgaccgccgtgatcctggccaccggcggcgtcggcggcctctacgccgtgaccaccacgcccgcccaggtgcgcggcgaaggtttgggcctggcggctctggccggcgcgatgatcgccgatcccgagttcgtccagttccaccccaccgccatcgacatcggtcgcgaccccgccccgctggccaccgaggccctgcgcggcgagggtgcgatcctgcgcaatgccgacggtaaggccttcatggccgactaccacccggccaaggagctggcgccgcgcgacgtggtcgcccgcgcccttcacgctgaacgcgcggccggtcgcggcgcgttcctggacgccacggctgccgtcggcgcccacttcccgcacgaattcccggccgtgttcgaggcctgcatgagcgcggggatcgacccacgtcggcagatgatcccggtcacgcccgccgtgcactaccacatgggcggggtcgccaccgaccttgacggccgcgccagcctgccgggcctctacgccgccggcgagtgcgcctcgaccggcgtgcagggcgccaaccgcctggcctccaacagcctgctggaagccgccgtgttcggcgcccgcgccggccgcgcggcggcggccgagggcgcgacgggcggcccgccggtcagcctcgagcccctgcccgacctgcccgacgccgcccttcaaggcctgcgcaaggcgatgagccgcgatgcgggcgtgatccgcgacgccgacggcctgacccgactgctgggcgagatcgagacgctggaagccggccatggccagggcccgatcctggtcgccgcccgactgatcgtcaccgccgccctggctcgcgaggaaagccgaggaggccactgccgcatcgacttcccggccacggatcccgtcggcgtccggactttcgtcaccctcgacggacgcgagcccggcttgcgatacgcggcggagtag

SEQ ID NO: 40699 - DNA, 813 bp, Caulobacter crescentus
atgatacgggaggggtccatgccggcgaacgggcgcaagagcatcttcattacgggcgcggccagcggcatcggcctggcctgcgccaagcggttcgcgcaggagggctggttcgtcggcctgtcggacatcgacaaggtggggctcaaggccgccctgctggccgtcggcccggagaacggctccatccatcccctggacgtgcgcgaccgcgaggcctgggagaacgccatcggcgagttcggccgcgagacgggcggtaaggcgaacgccctgctgaacaacgccggcgtcgcgcgctttggcatgctcaacgagatgtccgacgccgattgcgacatccagatcgacatcaatctcaagggcgtgatcaacggcgcccgcgcgggcttaccgctgctgaaggcggccggcgggcggctgatcaatgtggcctcgtgcgcgggcctttatggctcgccgaagctggcggtctattcggccaccaagttcgcggtgcggggtctgtcagaggcgctggacgtcgagtacgcggcttacggcgtcagcgtcgcctgcgtcatgccgtggttcgtcgaaacgccgatactgaacgcggcctcggacggctccaacaagtcgatgtcggagtcgctgaaggccggcgggctggaggtctatcccgtcgaggacgccgcccaggtggtctgggaggccgcccacggcaaggccctgcactatctggtgggcaagcgggccaagcagatgcgcttcgccgccagccacatgccgggcagccttaggaagcagctccgctcgcggcccctactgtag

SEQ ID NO: 40700 - DNA, 603 bp, Caulobacter crescentus
atgaccgagaccgatcaaacgcccgacaccgccccagaggccgccccagaggtcgcgcccatcgtctccgacgacctggcgccgctgcgcgccaagaccatcgtgctggtgggcctgatgggcgtgggcaagtccagcgtcgggcggcggctggccaatgtgctgggcctgccgttccgcgacgccgacaatgaggtcgaggccgccgccggacgctcgatctccgagatcttcgccgagctgggtgagccggccttccgcgacggcgagcgccgggtgatcgcccggctgctggacgagccgccgcacgtgctggccaccggcggcggcgcgttcgtcaacgccgagacccgcgccctgatcaacgagaaggccgtgtcggtctggctgaaggccgatgtcgagctcctggcccgccgcgtctcgcgcaaggacaaccgcccgctggtgcgcggcaaggacccggtgaaggtgctgaccgagctcgccgaagcccgctatccggcctatgccgaggcgcaagtccatgtcgagaccggcgacaccccccacatggtggcggtcgaggccattctgacggcgctgcgtcaggcccacgcttaa

SEQ ID NO: 40701 - DNA, 1113 bp, Caulobacter crescentus
atgatccgcaccgtccccgtgggcctgggcgagcgcgcctatgacgtcgtcatcgggcctggcctgctggatcaggccggcgagcgtgtcgccgccgtgctgggcaagcgcaagcgcgtcgccgtcgtcaccgacgcccatgtcggcgcccatcacggcgagcgtctctccgccgcgctgcaaggcgccgggatcaccgtcgacctcatcaccatcgcgcccggcgaggagagcaagagcttcgagggcctggccgatctctccgaccgcctgctggccttgaacctggagcgcggcgaccagatcgtggccctgggcggcggcgtcgtgggcgacctcgccggctttgcggcggcgatctacaagcgcggcatcgacttcgtgcaggtcccgaccaccctgctggcccaggtcgacagctcggtgggcggcaagaccgccatcgacaccccgcgcggcaagaacctgatcggggccttccaccagccgcgcctggttctggccgacctcgatgtgctggccaccctgcccgcccgcgagctggcctgcggctatgccgagatcatcaagtacggcctcctgggggacttcgccttcttcgaatggctggagaccaacgtccaggcggtgctggaccgcgacgtcgacgctctggtgcgcgccgtcggccgcagcgtcgagatgaaggccgagatcgtcgccgaggacgaaaaggaagccggacgccgcgcgctcttgaatctcggccataccttcggtcacgccatcgaggccgagatgggctttggcgaggcgctcaagcacggcgaggccgtcggggtgggcatggcccaggcgttccgcttctcggccaggctcggcctctgccccagccaggacgcggtgcgcgcgcaggcggccatcaaggccgccggcctgccgaccacgctggccgatgtgcgccccgagcccttcagcgccgacgccctgatcgctcactgcggccaggacaagaaggcgcaaggcggcaagctgaccttcgtgctggcgcgcggcatcggcgatgcgttcgtcgccaaggacgtcgatcgcgcggcgctgaaggcgttcctggttgaggaaggcgcggtctag

SEQ ID NO: 40702 - DNA, 1101 bp, Caulobacter crescentus
atgaaggccgctgttctgcgcgaggtgggcaaacccctccagatcgagaccgtggccatcggcaagcccggcccgcgcgaggtgctgatccgcaccaaggccgccggcgtctgccactccgacctgcacttcgtcgaaggctcctatacccacgccctgcccgccgtgctgggccacgagagcgccgggatcgtcgaggcggtcggcagcgaggttcgcaccgtcaaggtcggcgaccacgtcatcacctgcctcaacccctattgcggccactgcgaggtctgcctgaccgggcatatgaacctctgcatcagccccgagacgcgccgcagcaagagcgacgccccgcgcctcttcaaggaagacctgaacggcgccaccggcccgatggcccagttcctgaacctgtcgtccttcgccgagatgatgctggtccacgagcacgcgtgcgtggccatccgcaaggacatgccgttcgaccgcgccgccctgatcggctgctcggtgatgaccggcgtgggcgcggtgatgcacacctccaacgtccgccccggcgagaccgtggccgtgatcggctgcggcggcgtgggtctcgccaccatcaacggcgcggccatcgcgggcgcgggccggatcatcgccatcgaccgcctggccgggaagctggagctggccaagaccttcggcgccaccgacgtggtcgacgcctcgcaggtcgacgacatcgccaaggccgtggtcgaactgaccggcggcggggtgcaccacagcttcgaggccatcggcctgaaggccacggcggaggcctcgttcaagatgctgcgccggggcggcacggccaatgtcatcggcatgatcccggtcggcaccaagatcgagctgcacggcgtcgacttcctgggcgagcgccgcatccagggcagctatatgggctccaaccgcttcccggtcgacatgccgcgcctggtggacttctacatgtcgggcaagctgaagctggacgaactgatctcgcgccgcatcaagctggaggacgtcaactcggccttcgacgagctcaagcgcggcgagctggcgcgatcggtgatcgtgtttgactga

SEQ ID NO: 40703 - DNA, 2061 bp, Caulobacter crescentus
atgccccatctcgaccgccgcagcctgctggccgccctcggcgccctggccctgccgccggcgctggcgcgggccgccgcgatcgacgccgatgtgcgcagcggaacgatccaggacgtcgagcacgtggtgatcctgatgcaggagaaccgcagcttcgatcactatttcggaacgctgaacggcgtgcgcggctttggcgaccggttcccgatcccggtgcgcgacgcggcgggacgcaaggaaagctcggtcttcgtccaggcctggagcaaggacaagctcttggcgccgttcccgctgaacagcgcccagaccttcgcccacatgcgcgtcgagggcacgccgcacagctggaccgacgcccaggacgcctgggaccagggccgcatggaccgctggcccgacgccaagaagccctggtcgatgggctatttccagcgcgccgacatcccgttccagttcgccctggccgacgccttcacgctctgcgacgcctatcactgctcgacccagaccggcaccaacaccaaccgcctgttcctgtggaccgggaccaatgacggcctggggaaggccggcggtccgtcgatctccaacagccatgacaacttcgccgaaaagggcggggccaaggagtcctacacctggaccacctatcccgagcggctgctgcaggccggcgtctcctggcgcatctaccaggacatggccgacaacttcaccgacaacccgctggcggggttcaaggcctatcgcgacgcctacaaggacctgccgggctcgaacccgcgcctgaagcagctgggcctgtcgacctggcacctggacaagctgcgcgaggacgtcgtgaacggccgcctgccgcaggtctcgtggatcatcgccccggccgccgactccgagcatccgaacccctccagccctgcccagggcgcggactacaccgcccgcgtcatcgacgccctgaccgccgatcccaaggtctgggcgcgcacggtgttcctggtgatgttcgacgagaacgacggcttcttcgaccacgtcccgccgcccgccccgccgtcgtacgacgcctcgggcaagctgctcggcgcttcgacggtggatctgacggccgagcaccaccgagtgcgcaatcccaccgaggcgaggtccgagcgcgacgacctgatgggccgcccctatggcctgggtccgcgcgtgccgctgtacgtgatctcgccctggagccgaggcggatgggtcaacagccaggtgttcgatcacacctcggtgctgcggttcctggagcagcgtttcggcgtgatggagcccaatatctcgccctggcgccgggcggtgtgcggcgacctgacgacctgcttcgacttcaagacgcccaacaccaaccccttccccgccctgcccgccacgcgcgaaccggcgggccgcgccgccaggctgggccgcgccaagccgccgacgccggcctcggtggtcgcgccgccccaggccaagggccctcgcccctcgcgcgccctgccctacgccctggcggtggacggacgctacgccgacggcgccctcgccctgacgttcagcaacgctggccaggcggcgggcgtgctgcacgtctatgatcgccttcgcctggaccaggtccctcgccgctacacggtggggccgcaaacgcagctgaccgatgtctggccggccggggcctatgatctgtgggttctgggtccgaacggcttccaccgtcgattggccggcgagaatgtcggcgtcgagatcgccgcccgcccgtcgcccgaaggcctcttgctaacgatcagcaacgtgcgcccgtcgccacgcaaagtgcgcgtggagatcctgggccaggagccctggcaggtggacttcacgggcgtcgacaccgtggcccggaccttcgccacccagcagggctggtacgacctcaccgcgcgtctcgagggcgagccgacctggctgcgtcgtctggccggacggatcgagaccggcgcggactcgatcagcgatccctgggtgggcggcgaggcggtcttgaaggtctaa

SEQ ID NO: 40704 - DNA, 1335 bp, Caulobacter crescentus
ttgcgtagcctcatcgccgccgtcgaacgtatcgatccgctgaccatctatggtcgggtggccgcggtgaacgggctgctgatcgaggtgcgcggcggcctgacccgcctggcggtcggcgcgcgggtcgagatcgagcgcttcggtcagaaacctctgcccgccgaggtggtcggcttccgcgagacccgcgccctgctcatgcccttcggccccgtcgagggcgtgggtccgggcgcggagatccgtatcgttcccgaaggcgccgtggtccgtccgaccaaggcgtggctgggccggatcatcaacgccttcggcgagccgatcgacggcctgggtcccctgccgcagggcgaggttccctatccgctgaagacgcccccgccgccggcccacgcgcgcggccgagtgggcgagcgcctggacctgggcgtgcgctcgatgaacgtcttcaccaccacctgccggggccagcgcctgggcatcttcgccggctcgggcgtcggcaagtcggtgctgctgtcgatgctggccaaggaggcgacctgcgacgccgtcgtcgtcggcctgatcggcgagcggggccgcgaggtccgcgagttcgtcgaggagaccctgggcgaggaaggcctgcgccgcgccgtcgtggtggtcgccacctcggacgagccggccctgacccgccgccaggccgcctacatgaccctggcgatcagcgagttcatgcgcgaccaggatcaagaagtgctgtgcctgatggactcggtcacccgcttcgccatggcccagcgcgagatcggtctggccgccggcgagccgccgaccaccaagggctatacgcccacggtcttcaccgagctgcccaagctgctggagcgcgcggggccggggcctatccgtcccgacgggaccaccgccgccccgatcacggccctgttcaccgtgctggtcgacggcgacgaccacaatgagccgatcgccgacgccacgcgcggtatcctggacggccacatcgtcatggagcgggccatcgccgagcgcggccgtttcccggccatcaatgttttgaagtcgatcagccggaccatgccgggctgccagcacccgcatgagcgcgacatcgtcaagggcgcgcgccaggtgatgtcggcctattcgaacatggaagaactgatccgcatcggcgcctatcgcgccggggccgaccccgtggtcgaccgcgccatccgcctgaacccggcgatcgaggctttcctcagccaggataaggaagaagcaaccagtctcgatgactctttcgggatgctgggccagatcctgcagagtgagtactga

SEQ ID NO: 40705 - DNA, 993 bp, Caulobacter crescentus
gtgcagagccagcccgtcgccgacacgcctctgaagtcgatcgcctcgaccccggtcggcgcctgcctgcagcgccaccagctggacgatcccgccttcgccgccctgctcacccgccactacagccagatcacggccgagtgggaaatgaagatggagtacatcctccaggacgacgggcggttccggttcgaccggcccgacgccatcgccgacttcgcccgccgccacggcctgcggctgcatggccacgccctgatctggtacagtcaggtgatgcccgccttccgcgccctggacggccagggcaagcggttcgccgacgcctatcgcaactacatcctggcggtcgcgggccgctatcgcgggctggcggccagctgggacgtcattaacgaggcggtcgacgacaacggcgtcgacctgcgacgctcggcctggaccgacaatctgggcgtcgatgagcacatgatcctggcgtttcaccacgccaaggaggccgaccccgacgcggtcctgttcatcaacgactacaatctcgagaacaatccgaccaagcgggcgaccttcctgcggatggtcgaacggctgctgaaggccggcgcgccgatcggcggcatcggcacccagagccatctgggtctggacttcaccccgccggggatgtgccggatcgccctgcgcgatctggccagccttggcctgccgatccatgtctccgagctggacatctccttcggcgacaagccagaaaccgcccccttgccgaagctgctgagccgccaggccgacctcgcccgcgagctggcgcaggcctatatggacctgccgcgcgcgcagcggttcgccttcaccgtctggggcgtgcgcgaccgggactcctggctgcgcggcgcgaacggcgagcgcccctgggagcaccccttgcccctcgatgacgccggccagcccaagccgatgttccaggccctggctgaggtgctgtcggggtag

SEQ ID NO: 40706 - DNA, 2214 bp, Caulobacter crescentus
atggaaacacctgcgcggaggaacacgccaatggacgccaaggtcgaagacaatatcgcgggcaaatgccccatgggccacggtcgtggtcccgccaaccgggactggtggccccagagcctgcgcctggagggcctgaaccagcacgccccgcgctccaatccgatgggcgaggcgttcgactacgccgaggcgttcaagagcctcgacctggacgcggtcgtcagcgacctgcacgccctgatgaccgacagccaggagtggtggccggctgacttcggccactatggcggcctgttcattcgcctggcttggcacgcggccggcacctatcgcatcaccgacggccgcggcggcgcgggcggcgggcagcagcgcttcgcccccctgaacagctggccggacaacaccaatctcgacaaggcccgccgcctgctgtggccgatcaagcagaagtacggcgccaagctgtcgtgggccgacctctatgtgctggtcggcaacgtcgccctggagtcgatgggcttcaagaccttcggcttcgccggcggccgcgccgaccagtgggagcccgaagagctgtactggggtcccgaaagcacgtggctggacgacaagcgctacagcggcgagcgtgagctggactcgcccctgggcgcggtccagatgggcctgatctacgtcaatcccgaaggcccgaacggcaaccccgacccgctggcttcggcgcgcgacattcgcgagaccttcgcccggatggccatgaatgacgaggagaccgtcgccctgatcgccggcggccacaccttcggcaaggctcacggcgcgggcgacgcctccctcgtgggcgttgagccggaaggcggcgcgatcgaggcccagggctttgggtgggcgagcaagcacggcacgggcaagggccccgacgccatcaccggcggcccggaagtgatctggacccagacgcccacgcgctggagcaaccacttcttcgacaacctgttcaagtacgagtgggagctgacccaaagccccgccggcgccaagcagtggcaggccaagaacgccccggccgacattccggacgccttcgatccgaacaagacgcacgttccgcgcatgctcacgtcggacctcgccctgcgctttgacccggcctacgagaagatctcgcgccggttctacgagaacccggaccagttcgccgacgccttcgcccgcgcctggttcaagctgacccaccgcgacatgggcccgatcggccgctatctgggcccgctggtcccgaaggaggagctgatctggcaggacccgatccccgccgttgaccacccgctggccgacgacaaggacatcgcggccctgaaggccaagatcctggccaccggcctgtcggcgtcggacctcgtctcgaccgcctgggcctcggcctcgacctatcgccagtcggacaagcgcggcggcgccaatggcgcgcggatccgtctggccccgcagaaggactgggcggtcaacaacccgccggtcctggccaaggtgctggcggccctcgaaggcgtccagaaggacttcaacgcttcggccggtggcggcaagaagatctcgctggccgacttgatcgtgctgggcggcgcggcggccatcgaaaaggcggccaaggacgccggaaccagcgtcacggtgccgttcgcgccgggccgcatggacgcctcggccgaacagaccgacgctcactccttcgaggccctggagccccgctcagacggcttccgcaactatcgcgggccgggcaagcactacatggccccggaagaggccctcgtggaccgcgcccagctgctgggcctgtcgggtccggaactgacggtgctggtcggcggcctgcgcgtgctgggcgccaatgccgacggctccaaggacggggtgttcaccaaccgccccggcgcgctgagcaatgacttcttcgtcaacctgctcagcatggaaaccacctggagcccgacggcggccaacgccttcgccggccatgaccgcaagtccagcgagccgcgttggaccgcaacccgcgtcgacctgatcttcggctcccacgccgaactgcgggccttcgccgaggtctatgcctgcgcggactcgcaggagaagttcgtctgcgacttcgtcaccgcctggaacaaggtgatgaacgccgaccgcctggatctggcggcttag

SEQ ID NO: 40707 - DNA, 1212 bp, Caulobacter crescentus
gtgccgttcccgaccattccgccgatcgccggcgtcgagatcgccacgggccgggccggcttctacaagcatgagcgcgaagacctgctgttaatgcgcttcgccgagggcacctcggcggccggtgtcttcacccgccacggcgtcggctctgctccggtggactggtgcaagcgccagctggcggcgacgggcggcgcggacgtccgcgccctggtggtcaacgccggctgcgccaacagcttcaccggcaagcccggcgccgatgcggtgcgccgcgtggccacggccgtgggcaagcgctttgactgccgccagcgcgacgtgatgatggcctcgaccggcgtcatcggcgtcatcctggacgacagcaagatcaccgcccgcctgcccgaggtggaaagccgcctgaaggccgacgcctgggccgaggccggccgggcgatcatgaccaccgacaccttcccgaagggcgcctacgccacggcggtgatcgatgggcatgaggtcaagatcgccggcatcgccaagggctcgggcatgatcgcgcccgacatggccaccatgctggccttcgtcgccaccgacgcggcgatcgctccggcggccctgcagaccctggtcagcctctatacccgcaccaccttcaactgcgtaacggtggacggcgaccgctcgaccaacgacacgctgctgctgttcgccaccgggcagtcgggcgcgcccaagatccaccgcgcgggcgacaagcgcctggccgacttccgcgaaaagctggaaggggtgctgctggacctggccctgcagctcgtgaaggacggcgagggggcgaccaagttcgtcaagatcaccgtcaacggcgccgaaagcccggccagcgcccgcaagatcgcccgcaccatcgccgagagcccgctggtcaagaccgccttcgccggcgaggacgccaactggggccgcatcgtcatggccgtgggccgcgccgacgagccggtcgcccgcgagaagatcagcgtcaagttcggcgacctctacgccgcccgcgacggcctgatctcggccgaatacgacgaggccaagatgagcgcctacgtcaagaaccaggccttcgaggtctcggtggacgtcggggtgggccgcggctcggccacggtctggacctgcgacctgaccaagcagtacgtggcgatcaacggggattaccggagctag

SEQ ID NO: 40708 - DNA, 765 bp, Caulobacter crescentus
atgagcctcttcgacctgaccggcaaggtggcgatcatcaccgggtcctcgcgcgggatcggcaaggcgatcgccgagcggatggccgagcacggcgccaaggtggtgatctcgtcgcgcaaggccggcccctgcgaggaggtcgcctcagagctcaacgccaagcacggcgcggggaccgccatcgccgtgccggccaatatcgcctccaaggacgagcttcagaatctggtcgacgagacccgcaaggcgttcggcaagatcgacatctgcgtctgcaacgccgccagcaatccctattacggcccgctggccgggatcgccgacgaccagttccgcaagatcctggacaacaacatcatcagcaatcactggctgatcggcatggtcgcgcccgagatgcaggcccgcaaggacggctcgatcatcatcatcagctcgatcggcggcctgcgcggcaacgccatcatcggcgcctacaacatctccaaggccgccgacttccagctggctcgcaacctggcccacgagttcggccccgacaatgtgcgggtcaactgcatcgcgccgggcctgatcaagaccgacttcgccaaggcgctgtgggacaatcccgagaccctcaagcgctcgacgacggccgtgccgctgcgccgcatcggcgagccggacgagatcgccggcgcggcggtctatctggcctcgaaggcgggcagcttcatgaccggtcaggccatggtcgtggacggcggcgcgaccatctag

SEQ ID NO: 40709 - DNA, 1275 bp, Caulobacter crescentus
atgacgattcagacgcttgagaccaccgcgctgaaggacctgtacgagatcggtgagatcccgccggccttccacgtgccgaaaaccatgtacgcctggagcatccgcaaggagcgccacggcaagccgacccaggccatgcaggtcgaggtggtgcccacctgggagatcggcgaggacgaggtgctggtgctcgtgatggccgccggcgtcaattacaacggggtctgggccgctctgggcgagccgatcagcccgctggacggccacaagcagcctttccacatcgccgggtccgacgcctcgggcatcgtctggaaggtcggcgccaaggtgaagcggtggaagctgggcgacgaggtcgtcatccactgtaaccaggacgacggcgacgacgaggagtgcaacggcggcgacccgatgttctcgtccagccagcgcatctggggctacgagacgccggacggcagcttcgcccagttctgccgggtgcagtcgcgccagctgctgccgcgccccaagcacctgacctgggaagagagcgcctgctacaccctgaccctggccaccgcctaccgcatgctgttcggccacaagccgcatgagctgaagcccggccagaacgtgctggtctggggcgcctcgggcggtcttggcgtcttcgccacccagctggccgccgtggccggcgccaacgccatcggcgtggtgtcctccgaggataagcgcgagttcgtgctgtcgatgggcgccaaggcggtgctgaaccggggcgagttcaactgctggggccagctgccgaaggtcaacggccccgagttcaacgactacatgaaggagagccgcaagttcggcaaagccatctggcagatcaccggaaacaaggacgtcgacatggtgttcgagcaccctggcgagcagaccttcccggtgtcggtgttcctggtcaagcgcggcggcatggtggtgatctgcgccggcacgacgggcttcaacctgaccatggacgcccgcttcctgtggatgcgccagaagcgcgtgcaagggtcgcacttcgccaacctgatgcaggccagcgccgccaaccagctggtcatcgaccgccgcgtcgatccctgcctgtcggaagtcttcccctgggaccagatcccggcggcccacgagaagatgctggccaaccagcacctgccggggaacatggccgtgctggtctgcgcccagcgccccggcctgcgcaccttcgaggaagtgcaggagctgagcggggcgccatag

SEQ ID NO: 40710 - DNA, 1695 bp, Caulobacter crescentus
atgaccgacacggtctccgagaacaccaacgaaaccctgatcctgccgggcctgacgggcctgttgcgcgaggccgccgatgcggtcgcgctgttcgtcgccgaggccaagccggccgtcctggcccatatcgcgcctcaaggtggcaaggtcgaccgcaagctcgccgacgtccaccagcaccgcgttcacggctatggctggtacgcatcctacgccgaactgatgaaccaggtcgccggctgggcccagcgcctggaggctgaagggcgctttggcgagatcgaggccctgctggcccagctgttgttctccgagtacagcgcccagctggtcggcggcgtgccgatgaaccagggcgagatcgtccgtccccagcatctggtcgaagaccgcgccgtgctgaaccgcctgacctccgaggccatgaccagactggcggccgagggcggctcgcaagccgtcaaggcccgcatcgcccagcgcctagccgaggcgcggggtcgcccgaccctggagcagaccggtctcgacgagacgttcgagatgatccgcgaccagttccacgccttcgccgaggagaaggtcacccccttcgcccacgaatggcacctgaaggacgagctgatcccgctggagctggtgcaagaactgggcgaactgggtgtcttcggcctgaccatccccgaagagttcggcggcagcggcatgggcaagaccgccatgtgcgtggtctccgaggagctgtcgcgcgcctggatcggcgtcggctcgctggccacccgctcggagatcgccggcgagctgatcctgaccggcggcaccgacgcccagaaggaatactggctgcccaggatcgccagcgccgagatcctgccgaccgccgtcttcaccgagccgaacacgggcagcgacctcggcgccctgcgcacgcgggccgagctgaagggcgacagttacgtcgtgaccgggaacaagacctggatcacccatgccgcccgcgccgacgtgatgaccctcctggttcgcaccgatccggccaccaccgactatcgcggcctctcgatgctgctggcccccaagccgcgcggcacggacgaggcgccgttccccgccgagggcatgagcggcggcgagatcggcgtgatcggctatcgcggcatgaaggagtacgagctcggcttcgacggcttcaccgttccggccgagaacctcttgggcggcgtcaccggccagggcttcaagcagctgatggccaccttcgagagcgcccgcatccagaccgccgcgcgcgccgtgggcgtggcccaggcggcgctcgaggtcgggctttcctatgctctcgaccgcaagcagtttggccagccgatcttcgacttcccgcgcgtgcacaacaagctggccatgatggccgccgagatcatgggcgtgcgccagctgacctatttcgccgcccaccagaaggacgagggcaagcgctgcgacctcgaggccggcatggccaagctgatcgccgcccgcgtcgcctgggccgccgccgacaacgccctgcagatccacggcggcaacggctttgcgatggaatacgccgccagccgcctgctggccgacgcccgcatcctcaacatcttcgagggggcgggggaaatccaggcccaggtcatcgcgcggcgtttgctggacggcgggaactaa

SEQ ID NO: 40711 - DNA, 627 bp, Caulobacter crescentus
atgatcaaggttcaccacctcaacgagtcgcgctcgcagcggatcctctggctgctggaggagctttccctcccctacgagatcgtccagcacacgcgcgacgccaagacgcgcctggcgccgccgtcgctgaccgacgtccacccgctgggcaagtcgccggtgatccaggacggcgcgctggtggtcatcgagtccggcgcgatcatcgactacatcatccgtcgccacggcggcggacgcctggccccggatgcggccagcgccgactatgaccgctaccagcagtggctgcactatgccgagggctcggccatgctgccgttgatgctcaacatgtatgtcggacgcctgggcgaggccggcgcgccgctgcatccgcgcatccagtccgagatcgccaaccacctggcgttcgtgaacgacagcctagccggccgtgactacttcgtcggcgacagtctgaccggcgccgacatccagatgagcttcgtgcccgaggtcgccaaggccatgggcaagctggccgactatccgcacatggccgcctggatcggccgcatgcacgcccgcccggcgtggaagaccgcgctcgacaagggcgggccttacgcgctgggggcttaa

SEQ ID NO: 40712 - DNA, 1683 bp, Caulobacter crescentus
atgctcgtagtcacgcgacgtagccgcgcggctcggctgatcgcgaccgccatggtcggcggcctgctgtttttctatcttggctggaccgccctgatcgtctggctggtcgccaacaccatctgcgaactttgggtcgtctatctggagcgcgcctacaggccccattggggacagggcgtaattcgcttcatgcggatcggaccgccctcggccttcgccatggtctggtcgttcatgtcggcctactgcgtcctcaacgggcccatggcgatgcggtacgcggcgctgctgatcctgttcggcatcgtcgtggagggcgttcgctatgcgatgaacagcctggcggcgatgctgtccctgacggtctggccgttcctgatgctggccgctttgcccctgctggccaagcgcttcgatctcttggacaggctcgcggcgttcgcgatcctgctgggcctcatcggctacgtcgccgacgcggtccgcaccatgcgcgcctcggccaaggcgcgggaggaggccgaagcccaggcgctggaggccagccgcgccaagtcggccttcctggcgatgatgagccatgagctgcgcacgccgatgaacggcgttttgggcctggcccatgccttgcgcggcaccaagctggacgcccagcagtccgagtacctggagatgatcgagcagtcgggccatggcctgatgacgatcctcaacgacattctggacctgtccaagatcgaggccggaaagctcaatctggaggtcgcgccgttcgatctgcgcaagctggccctgcagacccgcgcggtctggagcgagagcgcgcggttgaagggactggacctcatcctggaggtcagccccagcgccccgccgtgggtcagcggcgacgcgacccgcgtgcgtcagatcctgatgaatctggtctccaacgccctgaagttcaccgagagcggccgtgtcgtcatccgtcttggcggcgaggcgggcggggtggtcaccttgtcggtcaccgacaccggggttgggatgaccgccgagcagatcggccgcctgttcacgccctttgctcagggcgacgcctcgatcgcgcgccgctttggcggcaccggcctggggctctcgatctgccggcaactggccgagctgatggcgggcgagatcatcgtctccagcgagccgggcgtcggctcgaccttcaccgtgcgtctcggcctgccggcggcggcgccgctggtggcggcgccggctcgcgccgccgtgacccaactcgacggcgcgcgggtgctcgtcgtcgacgacaacctggtgaaccagacggtcgcgcgcacgatccttgaagccgtcggcgccgccgtcgccgtggccggtgacggtcacgccgccctcgcccggctgcgcatcgaggacttcgacgtcgtgctgatggacgtccatatgccggggatggatggggtcgaagcggtgcgccgcattcgcgcgggcgaggccggacgcactgaccttcccgtcgtggccctgaccgccgacgccatggtgggcgacgccgagcgcctgctggctcaaggctttgatgacgcccatcccaagccggtgcagcccgccgggctgctcgccaccgtcgccagccttcgcaaggcgcccacagaactgcagcggctacgcgcggtggggatgtag

SEQ ID NO: 40713 - DNA, 1287 bp, Caulobacter crescentus
atggctaacgtgaccgttgtcggcgcccagtggggcgacgagggcaagggcaagatcgtcgactggctcagcaaccgcgccgatgtcgtggtgcgcttccagggcggccacaacgccggccatacgctggtggtggacggcaaggtctacaagctggccctgctgccctcgggcgtggtgcaaggcaagctctccgtcatcggcaatggcgtcgtggtcgatccctggcacctgctcagcgagatcgacaagatcgccgaccagggcgtggccatcacgcccgacctgctgatcctggccgacaacgcctgcctgatcctgccgctgcaccgtgacctggaccaggcgcgcgaagccgcctcgacccagaagatcggcaccaccggccggggcatcggcccggcctatgaggacaaggtcggccgtcgcgccatccgcgtcgcggatctcgccgaccccgaggccctgaagccgaagatcgagcgcctgctggcccaccacggcgccctgcgccgcggccttggcctgcccgaggccaatgcgcaggaactgttcgacgccctgatggaactggcgccgcgcatcctgtcctacgcccagccggcctggcgggtgctggaccaggcctacaaggccggccgccgcatcctgttcgagggcgcgcaaggttcgctgctggacgtcgaccacggcacctatccgttcgtcacctcgtccaacaccgccgccggccaggcctcggccggttcgggcatgggcccgtcggcgaccggcttcgtgctgggcatcgtcaaggcctacaccacccgggtcggcgagggtccgttcccggctgaactgttcgacgaggtcggcaagcacctgtcgacggtcggccgcgaggtcggcgtcaacaccggccgcgcccgccgctgtggctggttcgactcggtgctggtgcgccagtcggtggccatcaacggcatccacggcgtggccctgaccaagctggacgtgctggacggcctgaagaccctgaagatctgcgtcggctacaagatcggcgacaaggtcgtcgactacctgcctgccggtcttcgcgatcaggccgccgccacgccggtctatgaggagatcgagggctggacggaaagcaccgccggggcccggtccttcaaggatctcaacgccaacgccatcaagtacgtgcgccgcgtcgaagagctgatcggcgcaccggtggcgttgctttcgaccagccctgagcgtgacgacaccatcttgatgcgcgatccgttccaaggctga

SEQ ID NO: 40714 - DNA, 1224 bp, Caulobacter crescentus
atggtctacgtactgggcggctggcagagcgatttcgccgccaactggagccgcgaaggccgcgagctggccgacgccttcgccgaagcggtgggcgagggcctggccgctgtcgaccttgatcccgaggacgtcgagaccggccatgtcggcaacttcgccgccgagctgttcgccggccaggggcacctgggcggcatgttcggcctcgtgcatccggcgttcgacggcctgccgaccgcgcgccacgaggcggcctgcgcctcgggcagcgtcgccatcctcgccgcggccgccgagatcgaggccgggcgctatgatctggcctgcgtggtcggcgtcgagcagatgcgcaacgtccctggccagaaggcggccgagaacctgggcagcgcggcctgggtcggacacgagttccaggacgcccgcttcctgtggccgcgcgccttctccgacctcgccgacgagtatgaccgccgctatggcctcaagtacgagcacctgatgggcatcgccgaggtcaacttcgccaacggcaagcgcaatcccaacgcccagacgcgcggctggaacttcgggcccgacgccttcaccgccgatgaagtcgccaatccggtcgtcgagggccgcacgcgcaagcaggactgtggccaggtcaccgacggctcggccgtcatcttcctggcctcggaaaagcgcgcccgggcctatgccgacaagcgcgggatcgcgcttgagagccttccccgcatcaagggctggggtcatcgctcggcgccgctcagctatgcgcggaagatcgaagccagccgggaccaggactacatcttcccgcaggtgcgccgcgccattctcgacgcccgcgcccgggcagggatcgcgcccgatgtctcgggcctagacgcggtcgagacccacgactgcttcaccgccaccgaatacatggccatcgaccacctgggcctgaccgcccccggcgagagctggaaggcggtcgagaacggcgacatcgccatcggcggcaagctgccgatcaacccttcgggcggcctgatcggcacgggccatccggtcggcgccaccggcgtgcgcatggtgctggacgcctggaagcagaccaccggccaggccggcgactatcaggtcgagggggccaagacggtccagaccctgaacatcgggggatcgaccacgacgacggtgagttttgtcgtggggacgtag

SEQ ID NO: 40715 - DNA, 1302 bp, Caulobacter crescentus
atgacggcggtaaggtccaagcctttgggcgtatggatgtgcgcggccctggtcgtcggcaacatgatcggctcgggcgtgttcatgctgccggcgtccctggcgccgtacggctggaacgccgtcatcgcgtggatactgaccatcggcggttcgctgtgcctggcctatgtcttcgccaagctggcgggggcgtttccgcgcgcgggaggaccgttcgcctataccgaggaggctttcggccgcgcgccggggttcctcgtggcctggtcgtactggatctctgtgtgggtcgccaacgcggccatcgccatcgccgcgatcagctatctgagcgtctttctgccggtgatcgccaaggtcccggcgctgccggccctgctcaccgtcgcggtggtctggacggcgaccgcgatcaactgcgccggggcgcgctcggccggctggacccaggtggtgaccacggtgctgaagctggttcccctgatcgcggtggcgggtctggccgtcagcgtcctgcttcggaaagggcccgcggcgatcaccccgttcgagccctcggcgctttccggggcgtccatcaccgccgccgcggcgctgaccctgtgggccctgctgggggtggagacggcgaccattcccgccgacaaggtcaaggacccggcccggacgatcccgcgcgcaaccctggccggcaccgccttcgcgggtctggtctatctcgtggtctcgtcgggcgtgctgctgctgacgccgaccgccgtgctgcaaggctccaacgcgccgtttgtcgacttcgtcagctatcatggcggcggggatttccgcctggcgctggcggccttcgcaacgatcagcgcgctgggcgccctgaacggctggtcgctgatccagggcgagttgccggccgccatggcgcgcgagggcgtgttccccgcctggttcgccaagacctcggccaacggcacgcccgtgcgcgcgcacttggtgtcgagcgtcctggtgacgatcctggtgctgatgaactacgccaagtcgatggccgacgccttcaccttcatggccctgttgtcgacgacctcgaccctgttcgcctacctgttctgctctctggcggtgctgcgattgcaggggcagggacgcatggaccgctccaaggccctgaccctcgtcgcagcgttgggggcgctctattcggtgtggaccttctccggcgcgggatggtcggtcaccctgtggggcctggtgctgctggctgtcggcgcgccgatctactggctgatgcggagagccgcccgatga

SEQ ID NO: 40716 - DNA, 1404 bp, Caulobacter crescentus
atgaacgcccccatccgcaaccacgacgtcgccgagctcaagcgcctggacctggcgcaccacctgccggcccaggccgaccacaaggtcatcgccgagctgggcggcagccgcatcgtgacccgcgccgacggctgctacatcactgacggcgacggccatcgcatcctggacggcatggcgggcctgtggtgcgtgaatgtcgggtacggccgtaaggaactggccgacgcggcctacgagcagatgctggagctgccctactacaacaccttcttcaagaccgcgacgccgccgaccgtgaagctggcggccaagattgccgagaagatgggcggccacctgacccacgtgttcttcaactcttcggggtcggaggccaatgacacggtcttccgtctggtccgccactattggaagctgaaggggcagcccaaccgcacggtcttcatcagccgctggaacgcctatcacggctcgacggtggcgggcgtgtcgttaggcggcatgaagcacatgcatgtgcagggcgacctgccgatcccgggcgtcgagcatgtgatgcagccctacccattcggcgagggcttcggcgaggatccggccgccttccgcgatcgcgccgtgaaagagatcgaggacaagatcctcgaagtcgggcctgaaaacgtcgcggccttcatcggcgagccggtgcagggcgcgggcggggtgatcattccgccggatggctactggcccgccgtcgaggccgtatgccgcaagtacgggatcctcttggtctgcgacgaggtgatctgcggcttcgggcgcctcggccaatggtttggccaccagcactatgggatcaagccggacctgatcgccatggccaaggggctgtcgtcgggctacctgccgatttcggccgtgggcgtggccgaccacatcgtcgccgaactgcgcgagaagggcggcgacttcatccacggcttcacctattcgggccacccgacctgcgcggccgtggcgctgaagaacatcgagatcatcgagcgtgaggacctgatcacgcgcacccgcgaggataccgggccctatctggccaaggctctcgcccgcctgaacgaccacccgctggtcggcgagacccggtcactgggtctgatcggcgcggtcgagatcgtccgcgagaaggggaccaatcatcgcttcctcgacaaggaaggcgaggccgggccgatcgtccgtgacatctgcatccggaacggcctgatggttcgcgccatccgcgacagcatcgtctgctgtccgccgctgatcgtcagccacgccgagatcgacgagctggtcgggatcatcgaaaagtcgctgaccgaagccgagcccatcctccgcgcgctgaagccggaggctgtgtcatga

SEQ ID NO: 40717 - DNA, 1401 bp, Caulobacter crescentus
atgggtcccgcgcatgaagcgcgggatgacggtggtggaggcggtgggatgatcgctgagctcgccaaatccctctccgatctgctgaccgccgagcgcgctcgcttcacggtcgagcacccgcgctcggtcgccatggccaaggcggcgggcgcccactggcggggcggtgcgccgatgcactggatgaacgactgggccagcccgtcgccgatcttcgcggcccagggcgtcggggctcagatcaccgatgtcgacggcaagctctatgacgacttctgcttaggcgacacgccctcgatgttcgggcatggcgatccgtcggtggcggcggctgtctccgaccagatcaagcgcggcgcggggttcatgctgccgaccgcctcggcggcgattgtcggcaagctgctctccgagcgtttcggcctgccgctgtggcaggcggcgaccacggccagcgacgccaaccgtgcggccattcgctgggcgcgggcggtcaccggccgcccggtgatcctggtcttcgacggctgctaccacggcatggtcgacgacgccttcgtggtgctgaaggacggcgccccggtgatgaagccgggtctcttgggccaggtccatgacctgaccgccaccacccgcgtcgtcgcgttcaacgatctggccgccctggaagccgctctggcgccgggcgatgtcgccgccgtcctggccgagccggtgatgaccaactgcggcatgatcctgcccgagcccggcttccttgaggcgctgcgtcggctgacgcgcgaggccggaacgctgctggtcatcgacgagacccacacgatttcgaccggccccggcggctacacccgcgcccacggcctggagcccgacgtcttcgtcttgggcaaggcggtcgcgggcggcgtgccggcggcggtctggggcgtcacggccgagctctcagcgcggatggacgcggctcagcaaaggatcggtcctggccagtcgggcatcgggaccaccttgtcgggcaacgccctggccatggccgccatgcgggccatgctgagcgaggtcatgaccgaggcggcctatggcaagatgctggccggcgccgagcggctggtggcggggctgaacgcggtgatcgccgcccgcaggctcccctggtcggtggtccatgtcggggcccgggtggagctggtcttcgccgatccgccgccgaaaaacgccgcccaaatgcggaaagtgctggaccacgaggcggtggaagcgctgcatttgtggctgataaaccggggcgtcctgatcgcgcccttccacaacatgatgctggtctcgcccgttaccgaagacgcggcgatcgaccgactggtcgcggccgtcgacggtttcgcggcggcgatgggggaatga

SEQ ID NO: 40718 - DNA, 1449 bp, Caulobacter crescentus
atgaccgccctgaaccttgtcgaaaccgcagccttgatcgacggacaatgggtccggggcgaggcgagctttgacgtgctcaatcccgccgacgggacgctgatcgccgccgtcgccgacctcggtgcggccgagacgacgctggccatcgacgcggctcatcgcgccctcccggcctgggccgcccggaccgccaaggagcgcggcgcgatcctgcgccggtggagcgacctgatcctcgcccacgccgacgatctggcgcggctgatgaccgacgagcagggcaagccgctggccgaggcgaagggcgaagtcgtctatggcgcgtcgttcatcgactggttcgccgaggaggccaagcgcgcctacggccacacgatcccgacgcccatgccgggcaagcgtctggcctcgatcaagcagccggtgggggtttgcgccgccatcgcgccatggaacttcccgatcgccatgatcacccgcaaggtcggcccggccctggcggccggctgcacggtggtggtcaagccggcggccgagacgccgctcagcgccctggccatcgcgcgtctcgccaccgaggcgggcgtaccggcgggcgtgctcaacatcgtcaccaccacccgctcgagcgaggtcggcaaggtgctgtgcgacgacagccgggtgcgcaagctgtcgttcaccggctccacgccgatcggcaaggtgctgtatcagcagtgcgccggcacgatgaagaagctttccctggagctgggcggcaacgcgccctttatcgtctttgacgacgccgatctggaagccgccgtcgatggcgcgatcgccagcaagtaccgcaacgccggccagacctgcgtttgcgccaatcgcctcatcgtgcagtccggcatccatgacgccttcgccgcgcgcctggccgaaaaggtcgccgcgctgaaggtgggtcccggcacgggcgagggcgtgcagatcggtccgctgatcaatgagaaggccctgaccaaggtggtgggtctggtcagcggcgccgtgcaggccggagccgaggtgctgaccggcggcgacgtccacggtctgggcgggcacttctaccagccgactgtgctggtcggggcgacgccggagatgcggatcttccaggaggagatcttcggccccgtcgccccgatcgtgaagttcgagaccgaggccgaggcggtcgagctggccaacgccacgccctttggcctggcggcctatttctacagccgcgatgtcggccgctgctggcgcgtggccgagcagatcgaggccggcatggtcgggatcaacgagggcctgatctccaccgaggtcgcgccgttcggcggagtcaaggagtcgggcctgggccgcgaaggcgcctccgaggggctcgatgagtatctggagaccaagtacctgtgctttggcggggtggctggatga

SEQ ID NO: 40719 - DNA, 1491 bp, Caulobacter crescentus
gtgacccttcccgccgacatgaccgagcgcctcgccaagcttgcgccgcccagccaggcggtgatcgacggcgacttggtcgaagcggcgtcgggcgcgaccttccataatgtctcgccgcgtgacggccaggtgctgaacctggtcacggcctgccaagccgacgacgtcgagcgcgcggtcgccggcgcgcgcgccgcgttcgaggacggccgctggcgcgatcaggggccgcgccagaagaaggcggtgctgttccgtctggccgaactgatggaacgcgacgccgacgagctggcgctgctggaaagcctggatgtgggcaagccgatcagcgacgcgcgcaacgtcgacatcccgctcgcgatcaacacctgccgctggtacgccgaggcgctggacaaggtttatggcgaggtcgggacctcgcccgctgatcggctgagctatgcggtccatgaaccgctgggcgtgatcggcgccatcgtgccgtggaacttcccgctgcacatggcgatgtggaaggtggcgcccgccctggccatgggcaattcggtcgtgctgaaacccgccgagcagtcgccgctgaccgcgctgaagcttggggcgctggcgctggaggcggggttgccgccaggcgtgctgaacgtcattccggggctgggcggcgtggccggcgaggcgctggccctgtcgatggacgtcgatatgatcgccttcaccggttctgggcccgtggggcgccggctgatggagtattcggcgcgttcgaacctcaagcgcgtgtccctggagttgggcggcaagtcgcctcagatcgtcttcgccgactgtccggacctagaggccgccgcccaggccgccgcctggggcgtgttctataaccagggcgaggtctgcaccgccgcctcgcgcctgctggtcgaggccccgatcaaggacgctttcctggcgcgggtgatcgaggtcgccaagggcatgaaggtcggtgatccgctggatccgtcgacccagttcggggccatggtcagcgagcggcagatgaacaccgcgctcgactatatcgccaccgccgacagccagggcgcgcggcgcgtgctgggcggtcagagggtgcgccaggaggccggcggtttctatgtcgagccgacgatcttcgaccaggtgcggcccgaccagaccctggcgcgggaagaggtgttcggccccgtgctgggcgtgatgaccttctcgtccgaagacgaggcgatgcggctggccaatgacacggtctatggcctggctgcaggtctgtggacggccgacgtcagcaaggctctgcgcggcgcacggcgtttgaaagcagggctcgtctgggtcaacggctgggacgcctgcgacatcaccatgccgttcggaggcttcaagcagtcgggttttggccgcgaccgcagccttcatgcgttgcacaagtacgccgacctgaagtcggtgtccgtgacgctgaggtga

SEQ ID NO: 40720 - DNA, 1320 bp, Caulobacter crescentus
atgcccgatttcggcgccaacgacctcgacgccttctggatgccgttcacgccgaaccggcggttcaagcgccatccgcgcatgctctcctcagccagcggcatgtggtaccgcacgcccgagagccgcgaggtgctggacgcgacctcgggcctctggtgcgtcaacgccggccatgatcgccccaagatccgcgaggccatccagaagcaggcggccgaaatggactacgcgccctgcttcaacatgggccatccgctagccttccagttcgcctcgcgtctggcgcagatcacgccgaagggcctggaccggatcttcttcaccaattcgggttcggagtcggtcgacacggcgctgaagatcgccctggcctatcatcgcgcgcgcggcaaggggaccaagacccggctgatcgggcgcgagcgcggctatcacggcgtcggctttggcggcatctcggtggggggcattcccaagaaccggatgtatttcggcagcttgctgaccggcgtcgaccacctgccccacacccatggcctgccgggcaacacctgcgctaagggccaacccgagaacggcgcgcacctggccgatgatctggaacggatcgtcgccttgcacgacgcctccaacatcgccgccgtcatcgtcgagccggtcgccggttcaacgggcgtgctgattccgccgaagggttatctggaacgcctgcgagcgatctgcgacaagcacgacatcctgctgatcttcgacgaggtgatcaccggctttggacgggtcggcgcgccgttcgccgccgaacgcttcggcgtcacgcccgacctgatctgcatggccaagggcctgaccaacgccgccgtgccctgcggcgccgtggcggcctcgggtaagatctatgatgcgatgatggacggcgccgacgcgcccatcgagctcttccacggctacacctattcggcccacccgctggcctgcgccgccggtctcgcgacgctggagacctatcgcgaggacgacctcttcgcgcgcgccgccgggctggagggctattggcaggacgcgatgcacagcctggccgacgcccgccacgtcgtggatgtccgcaatctcgggctcgtcgccgggatcgagcttgaaccccgtcccggcgcccccaccgcgcgggcgatggaggtcttcgagacctgcttcgacgagggtctgctgatccgtgtgaccggcgacatcatcgccctgtcgccgccgctgatcctggagaaggatcacatcgaccggatggtcgagacgatccgcagggtgctgggtcaggtcgattag

SEQ ID NO: 40721 - DNA, 1119 bp, Caulobacter crescentus
atgtcgcacaacacctttggtcacctgttccgcgtcaccacctggggcgagagccacggcccggcgctcggctgcgtcgtcgacggctgccctcccgggatcgccctgacggcggagatgatccaggtgttcctcgacaagcgccgcccgggcaacggcaagttcgtcacccagcgccaggagccggacgccgtgcgcatcctgtcgggcgtgttcgaggacgcgcgctcgaacggccagcgcaccacgggcacgccgatcagcctgatgatcgagaacaccgaccagcgcagcaaggactattcggagatcgcccaggccttccggcccggccacgccgactacgcctatttcgccaagtacggcgtgcgcgactatcgcggcggcgggcgcagctcggcccgcgaaaccgccgcgcgggtggccgccggcgccgtcgcgcgcctgatcattccgggcgtgacggtgcgcgccgccctcgtgcagatcggcccgcataagatcgaccggtccaactgggactgggcccagaccgagcagaacccctactggtctcccgacgcggccattgtgccggtctgggaggagcacctcgaaaagatccgcaaggccggctcctccaccggcgccgtcgtcgaggtcgaggctaccggtgttccagccggctggggcgcgccgctctatgccaagctggacgccgagttggccgccgccctgatgtcgatcaatgcggccaagggggtcgagatcggcgacggcttcgacagcgccgccctcacgggcgaggataacgccgacacgatgcgcatgggcgatgacgggcagccggtgttccaatccaatcacgcgggtgggattctgggcggcatctcctcgggccaaccgattgtcgcgcgtgtggcgttcaagccgacctcgtcgatcctgatcccgcgcgagacggtcaatgaggccggcgaggagatcgagcttcgcaccaagggtcgccatgacccgtgcgtcggcatccggggcgtgccggtggttgaggccatgaccgcgtgcgtgctggccgacgccttcctgcgccatcgcgggcaaaccggccgggagcacttcccgcttggcgcgagcgcataa

SEQ ID NO: 40722 - DNA, 1206 bp, Caulobacter crescentus
atgcgcgacgaccagaccggcttttccacgcgggcgatccatgcgggctacgatcccgccgacgagcacggcgccctgaccccgccgctgcacctgacctcgaccttcgcgttcgagagcgccgaggcgggtggcgagatgttcgccggaacccgcgaggggcacttctactcgcgcatttccaaccccacgaccgacctcctggagcgtcgtctggccagcctggagggcgccgaggcggcggtcgccacggcctcgggcatgggcgcgatcaccgccaccctgtggagcttcctgcgggccggtgacgaggtgatcaccgaccagaccctgtatggctgcacctttgcgttcctgcgcgatggcctgacccggttcggcgtgacggtgaagcaggtcgacatgacccggcccgaaaccctggcggccgccatctcggaccagacgcggatcgtctattttgagaccccggccaatccgaacatgcgtctggtcgacatcgccgcgatcacccggatcgcgcacgctgcgggcgccaaggtggtggtcgacaacacctacgccacgccctgcctgacccggcctctggccctgggcgccgacatcgtcgtgcactcggcgaccaagtatctgggcggccacggcgacctggtgggcgggatcgccgccggcgggatcgaagacatggcgcgcgtgcgcctgtgcggggtaaaggacatgaccggtgcggtgatgtcgcccttcacggcctttctcgtcctgcgcgggctcaagaccctgtcgctgcgcatggcccgccacagccagagcgcccaggcggtggcccgctggctggaggatcaccccgccgtcgagcaggtgttctatcctggcctgcagagcttcccgcagcgcgatctggcggcgcgccagatggcggcgggcggcggcatgatggcgttcgagctgaagggcggccacgccgctggcgtggcgatgatgaaccggctggcgctgatccgccgcgccgtgtcgctgggcgacgccgagaccctgatccagcatccggccagcatgacccattcgccctacacgcctgaggagcgggccgccgccggaatcggcgagggcatggtgcgcctctccgtgggtctggaggacgtggccgatatcctggctgatcttgcgatggcgctggagcctctcaaggtcgcgcaaccggcttga

SEQ ID NO: 40723 - DNA, 837 bp, Caulobacter crescentus
atggcgaaaaatccttttcaggacaaggtttgtattgtcacgggcgcggcgtcgggcctaggccgggcgctgagcgcgcagctggcggaagccggcgccaccctgatcattgcggacatcaatttcccggccgccgaggaactggcgcatcgcatgaaccagctgggcgtcacagccaagccggtccgcaccgacgtgacactaagcgaatctgtccggcaactgatcgaaggaacggcggcggagttcggccgcatcgactacctgttcaacaatgccggcatcgccgtgttcggcgagatccgcgatctcagcctcgaccattggcggcgggtcatcgacatcaatctgatgggtgagatctacgggatccactacgcctatccgcagatgatcaagcagggcttcggccatatcgtgaatgtggcctcgggtttcggcatggcgcccggaccggtgaacagcccctatgtcgcctcgaagtttgccgtgtttggcctgtcacatgcgctggccaccgaggcgcgggcctttggcgtccatgtcaccgtcgcctgcccgggcttcatcaagaccccgctggtcgacaacatccattgcgtcaatgcggcgccggccgatgtccttgccaacatacccgtcgccatggtgccggtggaccgcgcggcgaacatcatcctgaccggcgtggccaagcgtaagatggtcatcgccttccctggatatgtcggcgttctggccttcatccatcgcttcctgccggccgtttgggacagcatgggcaagggtgaaatcgcccgcttccggaagatccgaaaggaccctgccgtcagctga

SEQ ID NO: 40724 - DNA, 1554 bp, Caulobacter crescentus
atgaccctcgccgccatgatcgccgccgactatgggaccatcggtgacatcctgcgcgagcgggcccgggaaaatcccgatcgtctggcggtggtcatggagacgggcgaggccgtcacctacgcccagttcgacgcgctggtcgaccgggtggccgccgccctgcagcgcgacggcgtggcgccgggcgaggccgttgcggtctgcgccctgtcgtccatcccctatgcggcgctgttcctgggcgccttgcgggccggggtcgcggtggcgccgatcgcgccgtcatcgacgccggagtcgatcgccggcatggtcgccgactgcggcgccaagctgttctttctggacgccggcgtcgccgaggcccagaagcccgcgcccgttcccgtccgcccgatcgccctggacggctcttccgccggccaagccttcgacgcctggctggcgcccgaggacgcgacgcccacgccggtcgagatcggccccaagcacccgttcaacatcatctattccagcggcacgaccggcacgcccaagggcatcatccagtcgcacggcatgcgctggaagcacatctttgtgggcgacgcgatcggctatggccacacgccggtcagcctgttgtcgacaccgctctattcgaacaccacgctggtctgcttcttcccgaccctggcgggcggcgggaccgtggtgctgatgaagaagttcgacgtggtgcgctatctggagttggccgccaagcaccgcatcacccacaccatgctggtgccggtgcagtaccgccggctgatggagcacccggacttcgaccgctacgatctctcatccacgcggatgaagttctgcaccagcgccccgttcgccgccgacctcaaggctcaggttctcaagcgctggcccggcggcttggtcgaatatttcggcatgaccgagggcggcggcacctgcatcctgatggcccacgagcatccggacaaactgcacacggtcggccgtccggcgcccggccacgacatccggctggtggacgaggacggccggcaggtcgggcccggcgtggtcggcgagatcgtcggccgttcggcgagcatgatgaacggctaccacggccgtcccgacaagaccgccgaggcgacctgggtctcgcccgagggctggaccttcatccgcaccggcgatgtcggccggttcgacgaggaaggcttcctcaccctgatggatcgcaagaaggacatgatcatcagcggcgggttcaatatctatccgtccgacctggaggccgtgctggtccagcacccggcggtgtttgaggcggcggtggtcggcgtgccctccgacgcgtggggcgagacgccggtggcctttgtcgcgctgaagagcagccaggtcgccgaggccgacgccatcaagaccttcgtcaacggtcaggtcggcaagacccagagactcgccgaggtcgtcgtcgtggacagtttgccgcgcagccacatcggtaaggtcctgaagcgcgaactgcgcgactcatggcaaaactcgcccagtcagtaa

SEQ ID NO: 40725 - DNA, 1929 bp, Caulobacter crescentus
atgggcaagcgcttggatacaaaggccggcgccagaatcgaagccgctgcggctgactggttcttccagaacagcctcgacatgttcgttgtgctgcgcgacagccggatcatccgcgccaatcccgcctggagccaactgacaggctgggccgccgaggacacgctgggccgcgagatccgcgacttctttcatctgcatgacaccgaggttctgaccgccgccggtcacacgctgaagaccgtgggtcacgcccacagcgaaaatcgcctggcgcgaaagggcggcggctggctgtgggttcgaacccagtcgaccatcctggaaggcggcggccagttgatcgtctttcaggacatcagcgaggaccgggcccgcgaggccgcccgcctgcaggccgagcgttccaacgaacttctgcgcaacgccgccggcgtctatgtctggcggttcaatccccgcaggggcgtctatgcgttcgatcaggacatcccgacgcccagcgccccggagggcggcgcgcggaccatgaccgtcgccgagatgacccagtcgatccatcccgaggacagcgcccgggtttggcaggcgttctcgcgaaccctgcagaccggcgagcatgtggagatcgactaccgctatctcgaccccggcgccgacgactggatccacctgcacgtggcctggcgcggcgtgcgcggatccagccccgacacctatgacgtcatcggcatcacgcagaacgtcaccgagctggtcgccgcacgcgacgccgccctggccgccgccgagaccaagtcccagttcctggccaatatgagccacgagatccggacgcccatgaacggcgtgctgggcgtgctgcacctgctgaagaccgagaagctctcggacgacggacgacgcctgctgacagaggcgctgagctgcggtgagatgttgtccgcgcttctcaacgacatcatcgacttctccaagatcgaggccggcaagctcgagctgtccgccgagcccgtctgtcccgccgagctgcttcggggcgtggccgacatgctgcgcgcccaggctgagaccaaggggctttatctgcgggtggaggcctcggacgacctcggctgggtggcgaccgacccgctgcggctgcgccaggcgctgttcaatctgatcggcaatgcggtgaagttcaccctggagggcggcgtcgtcgcgcggctttcagggcggcggatcgacagtcctgatggcgcgcgcttgcgcctgcgcttcgagatcgacgacaccggcgtgggcatcggcgaggaagccggagcgcgcctgttcgagcgcttccgtcagggcgacggttcgacgacccgccgcttcggcggctcgggtctgggcctggccatctgccgtcggctcgccgagttaatgggcggcgaggtcggcttcgagagccaactgggcaagggttcgaccttctggctggaggttgagacccaggcctgtgcgcgcccggacacgcaggagacgctggccgacggccctctgttcgacgggctgcacgtcctgctggtcgaggacaacgcgaccaaccggctgatcgccacacgcatgctcgaggccttgggcgcccgcgtgaccaccgccgaggatggcgcacagggcgttgcggcggcgcgacagggcttcgacctgatcctcatggacatccagatgccggtcatggacggcgtcgaggccacccaccgcatccgtgcgttcaacagccccgcaggcgccgcaccgatcctggccatgaccgcaaacgccatggcgcatcagcaggcgagctacctcgctgcggggatggatggggcgatcgccaagccgctttcgcccttggccctgacccaggccatcgccgccgccctgaccctggacccttcgcgccagcgcaaggcctcctaa

SEQ ID NO: 40726 - DNA, 3237 bp, Caulobacter crescentus
atgtccctctcccgcgttctgatcgccaaccggggcgagatcgccgtccggatcgcccgcacggcggccgaggcggggctcgagagcgtggccatctacgccgccgacgacgcgcaaagcccgcatgtcagcgccgctgatcacgccgtcgccctgccgggcgcgggggcgcgggcctatctcgacatcgccgccgttgtcgccgccgccaaggcgcagggctgcgacgccctgcatcccggctatggctttctgtcggagaacccccatctcgcccgcgcttgcgccgaggccgggattgtcttcatcggcccttcgcccgagcacctgacgacgttcggcgacaaggccgccgcccgcgccctggccgccgagcgcggcctgccgctgatcccgggaaccggcgcgatcacgctggaggccgcccgcgccttccaggccgagcacggcgcgatcatgctgaaggcccgggccggcggcggcggacgcggcatgcggatggtgctcgaccccggcgaactggacgccgccttcgccgcctgcgaacgcgaagccctggccgcgttcggcgacggcggtctctatgcggaaaagctgatcgagcgcgcccgccacatcgaggtgcagatcgtcggcgacggcgatcaggtgctggccctgggcgatcgcgactgctcgctgcagcggcgcaaccagaagctggtcgagatcgcgccggccgccctccccgacaatctacgcgccgccctggccggctggtccgagcgcctgtgcgccggctatcgcggcctggcgaccgtcgagtttctggtcgacgccgatccgcattcgccctcggggggcgaggccttcttcatcgaggtcaacccgcgcctgcaggtcgagcacacggtcaccgaggaggtcacgggcctggatctggtgcgcctgcagttcgatctcgcggcgggcaagcgcctgggcgagctggagctgaccaacaccccgccgccgttcggcgtggccatccaggcgcggatcaacgccgagaccctgacacctgagggtcaggtgcgcccgtcgaccgggaccttgagcgcctggacgccgccgggcggccccggcgtgcgcgtcgatgcgggcgtcgcggcggggctcaccattggcgcggcctatgacagcctgctggccaaggtgatcgtccggggtcggacgcccagcgaagcggccagccggctggaccgcgccttgaccgagctgaaggtcgccggcgtggcgaccaccgcgccgctggtccgcgccatcctggcccatccgaccgccgtgaccggtgaggcgacgaccaccttcatcgcccagcacgccgagaccctggccgccgaggctcagcgcctgacgcccgagaccacggcgagcgtcacgcgcttcgaggtcctggcgggcgccgagcctgtcgttgcgcctctggcggccacggtcggcgccatcacgatccgcgaaggcgacctcgtccgtccgggtcaggccctggcggtgctggaggcgatgaagatggagcacctggtcagcgccagcgccggcggccgggtggtcaagatcgtcgtccagggcggagcgaccgtcgccgagggccagccgctggtcttcctggagccggcggaggtggagagcgcactcgacggggagaccgtcgaacaagacctggacgcccttcgcccggaccttgccgaggtggtcgcccgccatcgccacaccctggacgaggcccgccccgaggcggtcgccaagcggcgcaagaccggccaccgcaccgcgcgcgagaacatcgacgatctggtcgatccgggcagcttcctggaatacggcgccctggctatcgccgcccagaaacgacggcgctcgaccgaggacctgatcgccaatacgcccgccgacgggctgatcaccggcatcggaaccgtcaacggcgcgctgttcccacccgacaaggcgcggacggcggcgctggcctacgacttcacggtgctggccgggacccagggggcgatgaaccatcgcaagtccgaccggctgatggcgctgatcgctgaccagaagctgcccgtggtctggttcgccgagggcggcggcgggcggcccggcgacaccgacaccacggccgtggcgggcctggacgtgccgaccttccgcagcttcgcccagctgtcgggcctggttcccaagatcgccatcgtcgcaggccgctgcttcgccggcaacgccgccatcgcgggcctttcggagatcatcatcgccacccgcgacagcaacctcggcatgggcggcccggcgatgatcgaaggcggcgggctgggcgtcttccgtccggaagagatcgggccgtcggctcatcagtggaagaacggcgtcatcgacatcctggccgacgacgaggcccatgccacgcggctggccaagcaggcgctgtcctacttccaaggaacgctatcgacctggaccgcacccgaccagcggcgcttgcgccacgcgatcccggagaaccgcctgcgcgtctatgacgtgcgcggcctgatcaaccacctcgtcgacgaaggctcgttcctggagctgcgcggcggcttcgcggcggggatggtcaccggcctgatccggatcgagggccgccccatgggtctgatcgccaatgatccgcgccatctgggcggggccatcgactgcgagggcgccgaaaaggccgcccgcttcctgcaactgtgcgacgccttcgccctgccggtcttgagcctctgcgacacgccgggattcatggtcgggccagacagcgaggacgccgccgccgtgcgccgggtcagccgccagttcatcgccggcgccaagctgcgctcgccgctgttcacgatcgtgacgcgcaagggctatggcctgggggctcaggccatggccggcggcagcttccacagccccgcctttatcgccgcctggcccacgggggagttcggcggcatgggcctcgaaggggcggtcaagttgggctaccgcaaggagctggaagccgagaccgatccggtcaaacagaaggcgctctacgaccagctggtcgcgcggctctacgcggcgggcaaggccaccagcatggcggcggcgctggagatcgacgcggtcattgatcctgccgacacgcggcgctgggtgatcggcggcctggacgcggcggcgggcgtgagccggccgtgggaagtgcgggtggacagcttctga

SEQ ID NO: 40727 - DNA, 1191 bp, Caulobacter crescentus
atgaccacgaccctcgccaagccggcgatccgcccggctcgccccgagttctcttccggcccctgcgccaagcgcccaggctggacccccgaaaatctcagaaacgccgttctgggtcgctcgcaccgctccaagctgggcaaggcgcgcctgaaggccgccatcgaccagacgcgcgaagtgctggaagttccggccgacttcctgatcggcatcgtcgccggctcggacaccggcgccgtcgagatggcgatgtggtcgatgctgggcgcgcgcccggtgcagctgctggccttcgagtccttcggcaaggactgggtcacggacgtcaccaagcaactgaagctgcccgacgtcgaggtgctgagcgccccgtacggccagctgcccgacacgtccaaggtcgatccggccaaggatctggttttcacctggaacggcacgacctcgggcgtgcgcgtgcccaacgccgacttcatctcggctgaccgtgaaggcatcaccatctgcgacgccacctcggcggccttcgcccaggatctggactggaccaagctcgatgtcgtgaccttctcctggcagaaggcgctgggcggcgaaggcgcgcacggcgtgctgatcctgtcgccgcgcgctgtggcccgcctggaaagctacacgccggcctggccgatgccgaagctgttccgcatgaccaaggccaataaggatgggggcaacaaggtcagcctcgacatcttcgagggcgcgacgatcaacaccccgtcgatgctctgcgtggaagacgccctggacgccctgaagtgggcttcgtccatcggcggtctgcaagccatgcaggcccgcgccgaccagaacctgaaggtgctggctgactgggtcgccaagaccccttgggtcgacttcctggccgccacgccggagatccgctccaacacctcggtgtgcctgaaggtcgtcgatcccgcgatctgcgccctaccggaagacgcccaggccgacttcgccaagaagctggccagcctgcttgagaaggagggcgcggccctcgacatcggcggctatcgcgacgccccggccggcctgcgcatctggtgcggcgccacggtcgaggcttcggacctcgaggccctgacgccctggctcgactgggccttcgccaccgtctccgccgaactggccgccgcttaa

SEQ ID NO: 40728 - DNA, 1974 bp, Caulobacter crescentus
ttgttttgtcgcgcaactctcctttcggatggaagcgaagcgttaggaacattcaggcatactctcgccaagagtgaagtgctgggtgcgatgtccgaaaaccgcaaccataacgtgtcaagccacgcgccgctgcaggcgcgaatcgccggtgtggccctggccacgacggtgcttgcgctcgtggccgcctgcctttgcttcatgcttcaacaatggagcgtggcgcgccaggaggcgcgcgccaaccacgaggtgctggtgcagatggccgccgccggagccgcggccccgctggcggaccacaacatggtcggcgtctatcgagccctggaagccgtggccaaggcgccgggcgtcgccggggtccgcatcatcgacgccaagggacgcgccgtcgctcagctgggcgaggccaatccttctaacgccgacacactgcagcgcccgatcaagctctcgtcgcaaacggtcggcacgctggtgctcgtggccaagcgccctggcctcgcccagactctggcgcgtgatctggcgctgacgggcgcgctgtttttcggcgcggcgggcatggcgatccttctggccaacagtctggcccgacgcctggcccagcctatggagcggctctccgaagccatgcacgaaaccgccgtcggcggacgcttcaaggctcttgaggagaccgctgacgacgacgtcttccgcagcctcatcgcaagcttcaaccacctagtggcgcgcctggaatgcaatgatcaggatctgcgcggcgccatggccgagctggtcaaagcgcgtgacgacgccaacgccgccaacgtcctgaagtcgcacttcctggccaatatgagccacgagatccgcacgccgctcaacggcgtgttggcgatggccgacgtcatggccatggaccagctcagcgacatccagcgcgagcgcctggcggtgatccgcgagtcaggcgcggtgcttctgggcgttctgaacgacgtgctggacctgtccaagatcgaggccggccggctggagatccaggatcggcccttcgacatcgcgcagctggcgcagtcgatccgcgaaacctttgtgccccaggcccgggccaagggcctggccttcgaggtcggtgtcgcgccggaagctcagggcctgtggcgcggcgacgccgatcgcctgcgccaaatcctgggcaacctgatttcaaacgcgctcaagttcaccctggacggcgcggtcgccgtgcgcttcgcctcggccgaggacggctcgggcctgcggatcgatgtcgctgacaccggtatcgggatctcgccagagattctgccgcgcctgttcgacaagttcgtccaggctgacagcacgaccacgcgccgctttggaggctcgggactgggcctggccatctgccgcgagctggcggcgatgatgaacggttcgatcaaggtgcaaagccgcgaaggccgaggctcgaccttcaccgtgctggtggggctaccgcgcgaggagaccctgaccgacgtccactatatcgatgacggcgatccgatcatggcgccgcccgccgccgaaccgcctcgcctccgggtcctggcggccgacgacaacccgaccaatcagaaggtggtggcggcggtcttggccccgctgaacgccgatgtcaccctggtcgatgacggcgcggcgtgtgtggaggcctggaagaccggcgactttgacgtcgtgctgatggatatccacatgccggtgatggacggcctcgaggccgcccgcagcatccgtgcgacggaacaagcagagatgcgtcggcgcaccccgatcatcgcggtcacggcgaacgccctgactcaccagatcgaggagtatctgtccgtgggcatggacggccacgtcgccaagcctatcgaggtcagcaaactctacgacgccatcgaggcggcgatggctggtacgcggctttcgcgcgccgcgtga

SEQ ID NO: 40729 - DNA, 1881 bp, Caulobacter crescentus
atgaatttcagaaacctggccatctggctggtgatcgtggcggtgctgggcggcgtgtttgtcgtcagccagaactcgcgtacgaaaagcagcagcgagatcagctattcgcagctcctcaaggacgttgacgcgggcaagatcaagtcggccgagatcgccggccaaacggtgctggccaagaccgccgacaacaagaccctgacggtcaacgcgccgatgaactccgaggaactggtcaaccgcatggtggccaagaacgcggacgtgaagttcaagagcggctcgatcagcttcctggccatcctcgtgcagctgctgccgatccttctggtcgtcggcgtctggctgtttctgatgcgtcagatgcagggcggcgcgaagggcgccatgggctttggcaagtccaaggcgcggctgctgaccgagaacaagaaccgcatcaccttcgaggacgtcgcgggcgtcgacgaggccaaggaagaactgcaggaggtcgtcgacttcctgaaggacccggccaagttccagcgcctgggcggcaagatcccgaagggcgccctgctggtgggtcctccgggtacgggtaagaccctgatcgcccgcgcggtcgcgggcgaagccggcgtgccgttcttcaccatctcgggttcggacttcgtcgaaatgttcgtcggcgtcggcgccagccgcgtgcgcgacatgttcgagcaggccaagaaaaacgcgccctgcatcatcttcatcgacgaaatcgacgccgtgggtcgccatcgtggcgcgggcctgggcggcggcaacgacgagcgtgagcagacgctgaaccagctgctggtcgagatggacggctttgaggccaatgaaggcatcatcctgatcgccgccaccaaccgtccggacgttctggaccccgcgctgctgcgtccgggccgcttcgaccgtcaggtcgtggtgcccaaccccgacgtcgccggccgcgagaagatcatccgcgtgcacatgaagaacgtgccgctggccgccgatgtcgacgtcaagacgctggcgcgcggcaccccgggcttctcgggcgcggatctggccaacctcgtcaacgaagccgccctgatggccgcccgcaagaaccgccgcatggtcaccatgcaggacttcgagcaggccaaggacaaggtcatgatgggcgccgagcgccgctcgatggccatgaacgaggaagaaaagaagctgacggcctatcacgagggcggtcacgccatcgtggccctgaacgtgccgctggccgaccctgtccacaaggccaccatcgtgccgcgcggccgggctctgggcatggtcatgcagctgccggaaggcgaccgctactcgatgaagtaccagcagatgaccagccgtctggccatcatgatgggcggccgcgtggccgaggagatcatcttcggcaaggagaacatcacctcgggcgcgtccagcgacatcaaggcggccacggatctggcccgtaacatggtcacccgctggggctattccgacatcctgggcacggtggcctatggcgacaaccaggacgaggtcttcctgggccactcggtcgcccggacccagaacgtctcggaagagacggcgcgtctgatcgacagcgaggtcaagcgtctggtgcagtacggcctggacgaggctcgccgcattctgaccgacaagatcgacgacctgcacaccctgggtaaggccctgcttgagtacgagaccctgtccggcgaggagatcgccgacatcctcaagggcatcccccccaagcgcgaagaggaagaggcggccacggcggtcattgcgccgtccctggtgccgctgtcgccgggcgcgggcgccagcgtcaccgcctga

SEQ ID NO: 40730 - DNA, 1008 bp, Caulobacter crescentus
atggctgttcgcgtcgccatcaacggcttcggccgcatcggacgtctggtcctgcgctccatcgccgagcatggccgtcgcgatatcgaggtcgtcgctatcaacgacctgggcccggtcgagaccaacgcccacctgctgcgctatgacagcgtgcatggccgcttccccggcgtcgtcacctcgggcgaggactggatcgacgtcggcatgggcaagatcaaggtcacggccatccgtaacccggccgagctgccgcacaaggacctgggcgtcgacatcgcgttcgagtgcaccggcatcttcaccagcaaggaaaaggccgccgcgcacctggaagccggcgccaagcgcgtgctggtcagcgccccgtgcgacggcgccgacaagaccatcgtcttcaaggtcaacgacgacaccctgtcggctgacgacctggttgtctcgaacggctcgtgcaccaccaactgcctggccccgatcgccaaggtcatccacgacctggtcggcatcgagcgcggctacatgacgaccatccacagctacaccggcgaccagccgacgctggatacgatgcacaaggacctctaccgcggccgcgcggcggccctgtcgatgatcccgacctcgaccggcgcggccaaggccctgggcctcgtcttgccggccctgaagggcaagctggacggctcgtcgatccgcgtcccgaccccgaacgtctcggtggtcgacctgaagttcgtccccggtcgcgaaaccactgtcgccgagctgaacgacgccctgaaggccgccgccgccggcccgctgaagggcgtgctgggcgtcaccgacgaggccctggtctcgacggacttcaaccacatcgccgaaagctcgacggcggccctggcccagacccaggtcatcgaaggcaagctgggccgcgtgctcagctggtacgacaacgaatggggcttcgcgacccgcatgagcgacaccgcgctcgtgatggcgaagttcctgtaa

SEQ ID NO: 40731 - DNA, 1191 bp, Caulobacter crescentus
atgaccttccgcaccctcgacaccgccgatctcgccggcaagcgcgctctggtccgcgtggacttcaacgtcccggtcgacggtggcaaggtcgccgacgacacccggctgaaggcggccctgccgaccatccgcttcctggccgacaagggcgccaaggtcgtgctgctggcccacttcgaccgtcccaagggcaaggtcgtgccggagatgagtctcgccttcgtggccgagccgctggcggccctgctgggcgcgccggtcgccttcgtcggtgactgcgtcggcccggccgccgctgaggtcgtgaacggcctcgccgatggcggcgtcgccttgctggagaacgtccgcttccacgccggcgaagagaagaacgacgccgagttcgccaaggccctggccgccaatggcgacgtttatgtcaacgacgccttcagcgccgcccaccgcgcccacgcctcgaccgaaggcctggccaagctgctgcccgcctatccgggcgtgtcgatgcagcgcgagctggaagccctggacgcggcgctgggcaatccgaagaagccggtgatcggcatcgtcggcggctccaaggtctcgaccaagctcgacctcttgaacaacctggtcgccaagctggatcgcctggcgatcggcggcggcatggccaacaccttcctgttcgcccagggccacgatgtcggcggctcgctgtgcgaaaaggacctggccgacaccgcccgcgagatcatggaaaaggccaaggccgccggctgcgaactgctgctgccggtcgacgtcgtggtcgccaagaaggtcgcgccgggcgttgagacggcggttcgttcgctgagcgaagtccaggctgacgacctgatcctggacgcgggcccggaaagcgccaagcgtctgctggccgccatggaccagagcctgaccttgatctggaacggccctctgggtgttttcgaggtgcctccgttcgatgaagcgaccgtttccgcagcgaaacatgccgcttcgctcgccaaatcgggtaaaatcgtagccgtggccggtggtggtgatacagtcgccgctctgaaccacgcaggcgtgtcggccgacttcaccttcgtttcgacggcgggcggcgcgttcctggaatggatggagggcaagacgctcccgggcgtcgcggcgctcgaatcctga

SEQ ID NO: 40732 - DNA, 1092 bp, Caulobacter crescentus
gtggctcgcatcacgctgcgccagctgttggaccatgccgccgagcatgagtacgggctgcccgcctttaatatcaacaacatggaacagggcctggcgatcatggaggccgcagatgcggtcaactcgccggtcatcatccaggcctcgcgcggcgcgcggaactacgccaacgacatcatgctggccaagatgatcgacgccctggtcgacatctacccgcacatcccggtctgcatgcaccaggaccacggcaacggcccggcgacctgcgccacggcgatccagtatggcttcacctcggtgatgatggacggctcgctgatggaggacgccaagacccccgccagctacgagtacaacgtcgaagtgacccgcaaggtcgtgcagatggcgcacagctgcggcgtttccgtcgagggcgagctgggcgtgctgggctcgctggagaccggcatgggcgaggctgaggacggccacggcttcgaaggcaagctgtcgcacgacgagctgctgaccgatccggaccaggcggtcgacttcgtcgcccagaccggcgtcgacgccctggccatcgccatgggcaccagccacggcgcctacaagttcacgcgcaagccggacggcgacgttctggccatgaacgtgatcgaggaaatccaccgccgcctgcccaacacccacctggtgatgcacggctcctcgtcggtccctcaggacctgcaggacatcatcaaccagtacggcggcgagatgccccagacctggggcgtgccggtcgaagagatccagcgcggtatcaagcacggcgtgcgcaagatcaatgtcgacaccgacaatcggatggccatcaccggcgcgatccgcaaactgttggtcgagaagccgggcgagtttgatccccgcgcctatctgaagcccgccaaggaagccatgcgcaaggtctgtcaggcccgcttcgtcgagttcggttctgccggtcacgccgacaaaatcaagccgatgtcgaccgcgaccatggccaagcgctacgcgtccggcgaactgcacgccaagttcggcgccagcgccgccaaggccgccgccgagtaa

SEQ ID NO: 40733 - DNA, 1851 bp, Caulobacter crescentus
atgactgacgcgaacagcggcgaccagaaggtcgaaggtcgccccggcgcgggagccgaactggtccagggcatgaccgaggccggggcccgtcggccgcgccgtaaggacattcgtcccctagcccacctgttgccgttcgtcatcgcccacaagggtgatggactggcggccggcttcttcctgctgttctcgacggccgcgaccctgggcctgacctacgcgttcaagaacgtgatcgaccacggcttttccaagggacaggacgcggcgatcaacagcgcctttgtcggcttgggcgcggtcgccctggtgctggccttggccacggcgctgcggtttttcttcatcacccggctgggcgagcgcgtggtggccgaccttcgacgcaagctctatggccatacgctgagcctggatcagccctatttcctgaagacgcggacgggcgaggttctgtcgcggctgacgacggacgtggcgctggtcgagcagctggtcggggcgtcgatctcgatcgccctgcgcaacatcctcaacctgatcggcgggttgaccgccatggcggtggtctcgcccaagctggcgggcttcatcgtgctgatggtgccggtgatcctggcgccgatgttcctggtcggccgccgcgtgcgcaagctgacggtgacggctcaggacaggttcgccgatgcggtgggctatgccggcgagagcctggacgcgctggagaccgtgcaggccttcgggcgcgagtcggcctcgtcggggcggttcggcgcggcggtggaggcggcctacaaggcctcggtccgccggatcaccacgcgggccaccatgaccgcgatggtcattaccctggcctttggcgggatcaccctgctcctgtggaccggcgcgcgtctggtgctggccggcgagatgactggcggcaccctggcccagttcgccatgctggcggtgatggccgccggctcgataggcgctctgggcgaggtctggggcgacgtccagaaggcctcgggcgccatggatcgcatctccgaactcctcaacgccaagccagacatcgccgcgccgccgcagcccaagaccctgccggttccggggcagggcgagatcgccttcgagaacgtcgtcttcgcctatccgggacggcccgatctgcctgctctgaacggctttgatcttcgggtgaagcccggtgagaccgtggccctggtcggtccctcaggcgcgggcaagagcaccgtcctgcggcttctcctgcgcttctatgatccccagagcggttgcatccttctggacggcgtgaacctgcgcgacgccgaacccgccgaggtccgcgcccgcatggctctggtcgcccaggactcgccgctgttctcgggctcggcgatggacaacatccgctttggccgccccgacgcgaccgacgagcaggtgcgcgccgccgccgacgcggcccaggccaccggcttcctctcggccctgcccgagggcttcgacaccccggtcggcgagcgcgccaagaccctgtcgggcggccagcgccagcgcctggccatcgcccgcgccctggtgcgcgaggccccgatcctcttgctggacgaggccaccagcgccctcgacgccgagagcgaacagctggtgcaacaggccctggccacggccatggaaggccgcaccaccctggtcatcgcccaccgcctggccaccgtgctcaaggccgaccgcatcgtggtcatggaggaaggccgcgtcgtcgaacagggcgcgcatgccgaactcttcgccaagggcggcctgtacgcccgcctggcccgcctgcagttcggggtcgaggcggcgtag

SEQ ID NO: 40734 - DNA, 1866 bp, Caulobacter crescentus
atgacgccgcccgatggcgcgtcgcctccgcgcgacgtctccagcgctccgttcaagccgctggccatgaaaggccccgaggtgtcggtcgaccgccgaccggacggctcgatcgtgatcacctccaatcatgcgcctggcgaagggccgcgctcgatcgcccacctgatcgccgccaaggccgccgaacatcccgaccggccttacctgaagcagcgcgaaccgaaccacggtccctggcgcggcgtcacctatggcgaggcgcatcgcgcggtcgagggcgtcgcccagtggctgatcgatcagaagcttcagccccacgacagcgtgatgatcctgtcgggcaattcgatcgagcacgccctgatgacgctgggcgcctatacggccggcgtgccggcggcgccgatcagcccggcctacagcctgatctcgaccgaccacgccaagctcaagcactgcttcgaaaaggtcgcgccccgcgtcgtcttcgcccagagcggagcgatgttcgccggggccctggccaccctgaaggccctggacccgagcctcctggtgatcaccgccgatggggcgggcgagggggcgatcaccttcgccgaggtcgccgcgaccacgccgaccgccgccgtggcggccgcgcgggatgcggtgggccccgcgacggtggccaagtatctcttcacctccggctcaacgggtctgcccaaggccgtgccccagacccacggcatgatggcgggcgtcatcgccggccaggagggcctgcgcaccgacgttccgaccgacgaggttccccagagcctggaatggatgccctggagccacatctcggcgggcaacatcggcttcaacgccgtgatctggggcggcggcaccctgcacatcgacgagggcaagccgctgccgggcatgttcgagaccacgatcaagaacctctacgaggtctcgccgatcgtgttcgggtcggccccgatcgcgttctcgatgctggccgaagcgatggagaacgaccctgtgctgcggcgctcgttcttcaagaacctgcgctacatgggctatggcggcgccaccctgagcaatgacgtctatgagcgcatccaggccctggccgtggccgagaccgggcatcgcattccgctgaccacgatgtacggcgcgaccgagacgcaaggcatcaccgtcacccactggatcaccgagcgggtcgggctggtcgggctgccgctgccgggcatccagctgaagctggcgcccagcgggtcgaagtacgaggtccgcgtgaagggcccgaccgtggcggccggctatcacaaggaccccgagcgcacggcggcggccttcgacgaggagggcttctataagctgggcgacgcggcgcggttcgtcgatccggacgacccggccaaggggctggttttcgacggccgggtgaccgaggacttcaagctcgacagcggtacctgggtcagcgtcggggtgctgcgccccgatctggtggccgcctgcagcccctacatccacgacgcggtgatcaccggccaggacaaggccttcatcggcgcgatgctctggccctcgccggccgggctggcggccctagtggccgatcctgggcccggaacgccgctggagaagctggtcgcgatcctcaaggaccgtctggccgcgtttaacgccgccgccgggggctcttcgcggcgggtggcccggtttacgatcctgaccgagccgccgtcgatcgacgccggcgagatcaccgacaagggctatatcaaccagcgctgcgtgctggagcgccgcgcggatcgtgtcgaggcgctctacgccaagacgccgggcgagggggtcttcgcagtctag

SEQ ID NO: 40735 - DNA, 366 bp, Caulobacter crescentus
atgcgtttcaccaaggatcacgagtgggtcatcgtcgagggcgatgtggccacggtcggcatcaccgcctacgccgccgagcagctgggcgacgtcgtgttcgtcgagaccccggaagcgggcaaggtcgtcaagcagggcgaaggcctggccgtcgtcgagagcgtcaaggccgcctcggacgtctacgccccggtgtcgggcgaggtgatcgagggcaacggcgagctggccggcgccccggagaccgtcaacgccctgccggaaagcggcggctggttcgccaagatcaagctcgccaacccggccgagctcgacgccctgatggaccgcgacgcctacgaagccttcctgggcactctgtag

SEQ ID NO: 40736 - DNA, 945 bp, Caulobacter crescentus
gtggtgaggggagacggcgtgacgtccatcatttcggtacagggtctgaccaagacctatgcgtcgggccatcaggccctcaagcggatcgacctcgacatccggcagggcgagatcttcgcgctcctagggccgaacggggcgggcaagaccaccctgatcagcatcatctgcggcatcgtcaatccgagccagggcgtgatcctggccgacggccatgacgtggtccgcgactatcgcgccgcccgcaccaagatcggcctggtgccgcaggagctgcataccgacgccttcgagacggtgtgggccacggtcagcttctcgcgcggcctgttcggcaagccgcgcaacgacgcgctgatcgagcagatccttcgcgacctctccttgtgggacaagaaggacagcaagatcatggcgctgtcgggcggcatgaagcgccgggtgatgatcgccaaggcgctgagccacgagccgaccatcctgttcctggacgagcccaccgccggcgtcgacgtcgagctgcgccgcgacatgtgggagatggtccgcaagctgcgcgaaagcggcgtcaccatcatcctgaccacccactatatcgaggaggccgaggagatggccgaccggatcggggtgatcaacaagggcgagatcatcctcgtggaggacaagaccgtcctgatgcggaagctcggcaagaagcagctcaccgtgcatctgaaggcgccgctggcggccctgcccgccgctctggccgacgcttcgctcagcctggccaatgacggcgcagacctcgtctacaccttcgacgcccaggccgacgacaccggcatcgccgatctgctgaagcgcctctccgagcaggggatcgaattcaaggacctgaagaccgaccagagctcgctggaagacatcttcgtcagcctggtgagggccccgcaatga

SEQ ID NO: 40737 - DNA, 783 bp, Caulobacter crescentus
atggcctatgcgccgttcaacctgtcgggaaaggtcgctctggtcaccggcggcaatcggggcatcgggcttggcatggccaaggccatggcgcaggcaggcgccgacatcgtcatctggggctccaaccccgagcgtaacctggccgccgaacagaccctgaccgccctgggcgtgcgggtgaaggcccagaccgtcgacgtctcggatgaagcccaggtccgcgagggcatggaagaggctgtcgccgccatgggccgggtcgacagcgtcttcgccaacgccggcatcggctatggctcgccgtcgttcgtcgacatgagcaccgaggtctatcgcaaggtgctggcggtcaatctggacggggtgttcttcaccctgcgcgaggcctgccgccacatggtcgagcgcgccaaggccggggatccgggcggctcgctggtcggcgtcgcctcgctggcggccatcgagggcgcggctcgcaacgaggcctacgccgccaccaagggcgcggtgatctcgatgatcaagtcggtcgccgttgagcacgcccgctacggcgtgcgcgccaacgccatcctgcccggctggatcgccaccgacatgaccgccggggcccagggcaacgccgccttcgccgagaaggtgatcccgcgcgttccggcccgccgctggggcgagcccgaggacttcggcggcatggccgtctatctggcctcggacgcctccagctatcactcgggcacgaccctggtgatcgacggcggctattcgatcttctag

SEQ ID NO: 40738 - DNA, 798 bp, Caulobacter crescentus
atggccgtcgatttcggtttgcaggggcaggtcgccatcgtcaccggctcgaccagcggcatcggccacgccatggccgacgcgctcgccgcccagggctgcaacatcgtcatgaacggtcttggtgaaatgaacgccatcgagcgcgcccgcgccgagatggccgagacacacggcgtggaggtgctctaccacggcgccgacatgaccaggccgatcgagatcgccgacatggtccgcgcggccaaggccgagttcggcgagctggacatcctcgtcaacaacgccggcgtccagcatgtggccccggtcgaggacttcccggaagacaagtgggacctgatcatcgctgtgaacctgtcctcggccttccacgccaccaaggcggccgtgccgatcatgaaggagcagggccgggggcggatcgtcaacatcgcctcggcgcacggcttggtggcctcgccgttcaagagcgcctatgtcgccgccaagcacgggatcatgggcctgaccaagacggtcgccctcgaggtcgcccagcatgggatcacctgcaacgccatctgcccgggctttgtgaagacgccgctggtcgaggctcagatcgccgaccaggccaaggcgcgcggcatttcggaagaggcggtgatgagggacgtgatcctggccagccagccgaccaagcagttcgtcaccttcgaccagctgaacggcatgcttctgtatctggtctcggacctgggcgcctcggccaatggcgcggcctatcagatcgacggcggctgggtcgcccaatag

SEQ ID NO: 40739 - DNA, 1383 bp, Caulobacter crescentus
gtgtcccgcctgaaagccgtgctcggcgaaggcggttggagccaggatcgcgacgtgattgcgcccaagctcgtggagtggcgcggtcgctggcagggcgagacgccgctgctggtcacgccgcgctcgaccgccgaggtcgccgccgtggtcgggatctgcgcggccgagggcgtggcgatcaccccccagggcggcaataccggcctcgtcgccggtcagattccgcgcggcgagatcctgctgtcgacccagaagctgacggcgattcgcgacgttgatccgatcgacgacgccatggtgctggaggccggtgtcacgctttacgaagctcaccagcaggccgccaaggttgggcgacggttcacggtgggcgtcgcttccgaaggctcgtgcacgatcggcgggctgatctcgaccaacgccggcggtacggcggttctgcgctacggcatgatgcgcgagcaggtgctgggcatcgaggcggtgctgcccaacggcgagatctggaacggcctcaagcgcctgcgcaaggacaacaccggctatgacctcaagcagctgctgatcggcgccgaaggcaccttggggatcgtcaccgccgcgtcgctgaagctgcaggcgttgctggcctcgcgagccgtggcgatcgtgggtttggcctcgccggcgaacgccatccagctcctggcgcgggcgaaggacgagacgggcggggcggtcgaggcctttgagctgatgggccgcctgggctttgagctgaccgtccgcaacgtgccgggcctgcgcgatccgctgcccgaggcgcacccctggtacgtgctcatcgagatcgccagcggcgagccgggcgcggccgaggcggcgctggagcggctgctggccggcgccctggagcgcggcctgatcgccgacgcggcggtcgcgcagacggagacgcaaatgaaggcgttctggcacatccgcgagggccactccgccggccagaagccggaaggggcggtgtggaaacacgatgtgtctgtgccggtctccaaaatccctgatttcatcggccaggcgaacgccgcgatcgagaagagctttcccggaacccgcatcgtcgccttcggccatgtcggcgacggcaatgtccactacgacgtgctgcagcccgtcggcggcgacggcgacgcccacggggcccagcgcgaggccggggccaagatcgtccacgacatcaccgccggcttcggcggctcgatcagcgccgagcatggcctgggcgcgatgaagacggccgaggccctgacctacaaggacccgatcgaggtcgcggccctgcgggcgatccggggggcgctggacccgcagcggatcatgaaccctcgggtgttgttctag

SEQ ID NO: 40740 - DNA, 1812 bp, Caulobacter crescentus
ttggcgaccctcggcgccccgcttaaagacggcgcacgacctggagtttctcccatgactttccgcgcgcctgttcgcgatcttgccttctctctgcgccatgtcgccggcttcgagcgtctggccgacgcctttcccgaggccgacgccgacacggttgcggcggtgctggaagcggcgggcgcgttcgccagcgacatcctggcgccgctgaaccgccagggcgatctggtcggcgcaagactcgagaacggcgtggttcgcaccgcgcccggcttcgccgacgcctaccagcagttcgcgcaaggcggctggaccagcctggccgcaccggccgagcatggcggtcagggcctgcccaagacgctggaggtggccgtcctcgaaatggtccaggcggccaacatggcgtttggcctctgcccgatgctgagcctgggcgccatcgaggccctggagctgtgcggctcgcccgaacagaaggccaagtatctgggaaagctggtgtcgggcgaatggaccggcaccatgaacctgaccgagccccaggccggctcggacctagcggccctgaccacgatggccacgccggatggcgacggcggttggcggatcaccggccagaagatctacatcacctggggcgaccacgacgccgccgacaacatcgtccacctcgttctggcgcgcacgcctgacgctccgcctggggtgaagggcatctcgctgttcctggcccccaaggtgctggtcggcgatgacggcaagctggggccagccaacgccctgcgggccggtagcctggagcacaagctgggcatccacggctcgcccacctgcgtgatgctgttcgagggcgccaaggccgagctggtcggcggtctggggcaaggcctgcccaacatgttcgtgatgatgaacgccgcccgcctgcaggtcgggacccagggcgtggcgatcgccgagcgggcctatcagcaggccctcgccttcagccaggaccgcgcccagggccgctcggcctggaccggcgcctatccttcgcgcctattcgatcatccggacgtgcggcgcacgctggtgttgatgaaggcccacatcgaggccgcgcggggcatatgtctgtcgaccgccgtcgccgccgatctggcccgcgccgcgccggacgcggcgacccgcacggccgccaagttgcgcgaggaactgctgacccccatcgccaaggcctggtcgaccgacatcggcgtctgggtcgcctcgcaaggcgtgcagatccacggcggcatgggctttatcgaggaaaccggcgcggcccagcactatcgcgacgcccgcatcgccccgatctacgagggcacaaacggcatccaggccatcgacctggtcggccgcaagctgatgctgggcgaaggccaagccgtcggcgacctgatggacgacatccgcgacaccatcgacctcttgaaggcttcggacctgaagagcgtcggcctgcgtctggaggccgcgctcgacgccgccgcctcggcgaccgcctggctgatcgaacgccgcgccaaggccatgccggacgcgctggcgggcgccacggcctatcagacgttgctgggcgatgtggtcggcggctggatgctggccaagggggccctggcggccgacggcgaggccgacgcggcctgggccgaaagcaagcgcgccctggcccgcgtgttcgccgaagccgttctggcccaggtccccggcgcggcggccggggtcatgatcggggcggcggatttcgaggcgatgacccccgaggtgctgggggcttaa

SEQ ID NO: 40741 - DNA, 1272 bp, Caulobacter crescentus
atgaccgcttccttgcgcaccctgaagaacggcgtccgcgtcgtctgcgacccgatgcccggcctcgaaaccctggccctgtccgtcgtggcgggccggggcgcggcctatgaggacccggcgcgctcgggctggtcgcaccttctggaacacatggtgttcaagggcgccggctcacgttcggcccgtgacatcgtcgaggtgatcgagaaccagggcgggtcgatcaacgccgccacgggctatgagcgcaccagcttccaggtccgggcgctgaagggcggcctggaccttggcatggacgtcatcgccgacctggtgcggcgcccgacgctggatcccgccgatctgacccgcgagaagcaggtcgtcgcccaggagatcgccgaggccgccgacgcgcccgacgactatgttttcgacctgatccagcgggccagctggggcgaccatcccgtcggccgcccgatcctcggaagcgacgagaccgtcaacgccgccagcgtcgaggcgctgtcggactggcgcggcgatctctacgcggccgatcgcctggtgatcgccgccaccggcgcggtcgaggaggccgagctgatggccgccgccgagcgggcgttcggcgatctgccggcgacgccgggcgtcgggcttgcgcagtccgccgcctttgtcggcggcccgcaggccgaggcgcgcaagctcgaacaggcgcatctggtcttcatgctgcccgcctgcggcgcgcgggaggacgactatttcgccctgcggatcttcgccgaatgcctgggcggcggcatgtcctcgcgcctcttccaggaggcccgcgagaaacgcggtctggcctacaacatcgacgcctatgccgacacctatgccgaccacggcgcgctggggatctatgcgggctgcgcggcgagcgacgcggtcgagaccgccaaggtctgcgccgacgaactgatcaagctggccgaccggatcgaagaggcggaattggcccgcgccaaggcgcagctgaaggcgcacatgttcatggcccgcgagcagccgctgtcgcgtgctgagcagggggctgggcaggtgctgctgtttgaccgtctctatccgcccgccgaactggcgcgggaagtcgacgccgtgacgccacaggacgtcgcccgtctgggtcagcgcctattggcggccggccgcgccgcgacggccgtgctgggcgcgaagtcggcgctcaaggccggcgaagtcttcgacaaggcgttgttctcggcggcctga

SEQ ID NO: 40742 - DNA, 2499 bp, Caulobacter crescentus
ttggatttattagtccctcggcgcgaaggtcttggcgtaaccccgaggagttctcgccatgaccctgtcacccctttccggcgccgtgctccgcatcctggcctggagcctgctgctggccggcggcgtggccgggatcgttctgccgcatccggtgaccacagccctgtggacggccgcgacccggctgttcgcgaaggccggagacgcggggatggtcgcccgcctgacctcggcgaccaagttcgggccgcgcatccggctgcgtctcgccaaagcgcctcgccaggcggccctccgtctccgcctcgcttaagggctccaggtcttgcgagccgctctcaattttctcgacagcggggtttcggggcgcgaggatcggcgcatggctttcgccgtccaggaccgccgttcgcgccgccgccgcctcacccgcgtcgagcgctgggtgctggacgggatgggcggggtgctgctggccaccggcgcggtcggggcggtggtgccgggcatgccgaccacggtgttctggatcggcgcggtgctgtgcttcctgaagacccgtccccacgccgtgcgcccgatgctgcgggtgccggtggtgggccccgcgatccgctggttcctgcgctggcgaccgtttggcggcgggcgaaagcgcgggcggggctgacgcgcgggcgggaaagtcctatctcccgcgccatgaccgacatgatcgaggacgaagacgagaccggcgccaggaagcgcgcgctgtccaaccgccaggtgctgggctttgtcgcccggttctggaagcggcgcccggtgctgttcggcctgggcgtgggtctgaccctggtggccgtcgccttcgatctggcgctgccctacgccgcaggacacctggtcgacaccgtcgccacccagccgcgcggcgacgctcaggcctggtcggcgctggcgatctttgtcggcgtctatttcgccttcgcggtggtgcgcaacatcgcccaccggttctggatccccctggcggcccggaacatggaggagatgaccaacgagagcttcgccaaggtgcaggccttctcgtcggactggcacgccgacagcttcgccggcgcgacagtgcgcaaactgacccgcgccatgtggggctatgacagcgtcaccgacgcggtgaccatctggctggggccgggcgtgatcgtgctgatcggtctctccatcgccatgctggtgcgccagccgttggcggggatcatctcgctggtcgtggtggcggcctatctgacggtgaacctcgtcatcaccgagcgctatgtgcggccgtcgaacctcaagtccaacgcgctggactccaagatcggcggggccctggccgacgcggtgacctccaaccccaccgtcaagagcttcggcgccgagacgcgcgaggccgagcgcctggccaaggtgacggcgcaatggcgcgaggcggtgatggtcacctggaaccgtttcaccgacgtgtggctgggccagaacctgctgctcgtggtgctgcaggcgggcctgaccggggccatggtctggggctggacgcagggcacggccacgcccggcgatgtggccttcgcgatcaccgccttcatgctgatgagcggctacctgcggaatctgggcgaaaacatccgcatgctgcagaagggtctggacgacaccgaggacgtcgccgcctggacccgcctggcgccgcagatcgccgatgacccgaacgctccggagttccagcccggttccggcgcgatcgaattccaggacgtgaccttccgctacaaggcggccggcgcgccgctgtacgatcggttcagcctgaagatcgcccccggcgagcgggtggcgctggtcgggccgacgggctcgggcaagtcgaccttcgtcaagctgatccagcgcctgcatgacctgcaggacggggcggtggtcatcgacggccaggacgtctcgacggtgaagcaggcgtctttgcgccgcgccatcgcggtggtgccgcaggacccggccctgttccaccgcacgctgtttgagaacatcgcctacggcaagccggacgccacccgcgaagaggtcgaggacgcggccatcaaggcccgcgcccacgagttcatcctgcgcctgcccaagggctacgacaccctggtcggcgagcggggcgtcaagctgtcgggcggcgagcgccagcgggtggccatcgcccgcgccttcctggccgacgcgccgatcctggttctcgacgaggcgacctcgtcgctggacgtcgagaccgaaggccacgtccaagaggccgccgaggcgctgatggagggccgcacgacgatcgtcatcgcccaccgcctgtcgacggtgcgcggcgccgaccggatcctggtgttccagggcggtcgcgtggtcgaggaaggccggcacgccgagctgaccgccaaaggcggggtctatgcgcgcctcaacgcgatcagcgcgggggtggtgtaa

SEQ ID NO: 40743 - DNA, 840 bp, Caulobacter crescentus
atgtccaagcttgttcccgccgtccgctcgggcgatgtcctgatgcccgccctgggctttggcacctggcagctggagaacggaaccgccgttccgctggtcgaaaaggccctggagatcggctaccgccacatcgacaccgcccagatctacggcaacgagcgcgatgtcggcgcggcgatcaggaacagcggggtcaagcgcgacgagatcttcctgaccaccaaggtctggatcgaccagttcgcggacggcgacttgcagcgctcggccgagaagagcctggagaagctgggcgtcgaccaggtcgacctcctcttgctgcactggcccaagcccgaggtcccgctggccgagaccctgaaggccctgaacgcggttcgcgccaagggctggacccgcgccatcggcctgtcgaacttcccatccgcccagctggaggaggccgccaagctgtcggaggcccccatcgccaccgatcaggtcgagtatcacccctacctgtcgctgaagaccctgaaggccaaggccgaccagctgggcgtgtcgatcaccgcctggtcgccactggcccagggcaaggtcgcgcaggatccggtgctgatcgagatcggccgcgcccacggcaagacgcccggccaggtcaccctgcgctggatcatccagcaggggatcatcgccatcccgcgcaccagcaatcccaagcgcatcgaggagaacttcgacatcctcgacttcgagctgtcggagaaggagatggcgcagatccacggcctggcgcgcccggacgggcggatcggggattggatcgatcgggcgtatgcctgggacgctgagtag

SEQ ID NO: 40744 - DNA, 1242 bp, Caulobacter crescentus
atggcggggatgggccggacggcccgcgagggcgcgcgcgcgcttcgcctcgccacgccagagcagcgcacggccgccatccaggccatggccgtcgccatccgcgaggacgccgacgcgatcctcaccgccaacgccaaggatttggcgcgcgcagaggccaacggcgtctcgggcccgatgctggaccggctggcactggacgctgcgcgtctggaaggcgtcgccgcaggcgtagaggccgtagccgccgttcctgatcccgtcggcgtcgccacctcgcgctggacccggcccaacggcctcgatatcgcccgcgtgcgcacgccgatcggcgtgatcgccatgatctatgagagccgccccaatgtgaccgccgacgccgcagcgctgtgcgtgcgctcgggcaatgcggtgatcctgcgcggcgggtcggagtgcatccactccaacctcgccatccacgccgcgatcgcgcgcggtctccagaaggccggcctgcccaccgccgccgtccaggcggtgaagacgcccgaccgcgccgccgtgggcatgatcctggccgggctggacaggaccatcgacctgatcattccgcgcggcggcaagagcctggtggcccgcgtccaggccgaggcccgcgccccggtgctgggccacctggaaggcctgaaccacgtcttcgtccacgccgccgccgacctgaagaaggccgtcgaggtggtggtgaacgccaagctgcgccgcgtttcggtctgcggctctgccgagaccctgctgatcgaccaggcggccgccgacaagcttctgccgccgatcgccgacgccctgatcaaggccggttgcgagctgcgcggcgacgccgccgcccgcgccatcgagccgacgatgaagaaggccacggtcgaggactggaccaccgaatacttggccccgatcctgtcggtggccgtggtcgacggcgtggccggcgcggcgcggcatatcgcctcgtacggctcgggccacaccgacgcgatcatcaccgaggacgccgccgccgccgaggccttcatcgccgaggtcgacagcgccatcgttctggtcaacgcctcaacccagttcgccgatggcggcgagttcggcttcggggccgagatcggcatcgccaccgacaagcttcatgcccgcggcccggttggggccgagcaactgacgacgttcaagtatgtggttcgcgggaccggccagactcgtccctga

SEQ ID NO: 40745 - DNA, 1620 bp, Caulobacter crescentus
atggccaagacccccgctgaaaagccggcgaccgccgccaagaagcccgccgcccccaaggccgccgctgctccgaaggccgccgccgccaaggcccccgccgccgccaaggctccggccgccaagaagccggccgctccgaaggccgccgccgcgccgaaggctcccgccgccggcctggaaggcgccaccggccgcctcgtccagatcatcggcgccgtcgtcgatatcgagttcgacggcgctctgccggcgatcctgaacgccgtcgagaccgtcaacaccgccacgggccagcgcctggtgttcgaagtcgcccagcacctgggtcagagcaccgtccgcgccatcgccatggacgccaccgaaggcctggttcgtggccagcccgtgcgcgacaccggcgagccgatccgcgtgccggtcggtccgggcaccctgggccgcatcatgaacgtcatcggcgagccgatcgacgaacagggcccgatccgttcggacatcagccgcacgatccaccgtgacgccccgtccttcgccgagcagaccaacaccgctgaagtgctggtcacgggcatcaaggtcatcgacctgatgtgcccctacaccaagggcggcaagatcggcctgttcggcggcgccggcgtcggcaagaccgtgacgatgcaggaactgatcaacaacatcgccaaggcttacggcggttactcggttctggccggcgtgggtgagcgcacccgcgaaggcaacgacctgtatcacgagatgatcgagtcgaacgtgaacgtcgacccgaaggctaacaacggctcgaccgaaggctcgcgctgcgccctcgtttacggccagatgaacgaacccccgggcgcccgcgcccgcgtcgccctgaccggcctctccatcgcggaatacttccgtgacgaagaaggcaaggacgtgctgctgttcgtcgacaacatcttccgcttcacccaggccggcgccgaagtgtcggctctgctgggccgtatcccgtcggccgtgggttaccagcccaccctggccaccgagatgggcaacctgcaggagcgcatcacctcgacgaacaagggttcgatcacctcggtccaggccatctacgtgcccgccgacgacttgaccgacccggctccggccacctcgttcgcccacttggacgccaccaccgttctgtcgcgtgacatcgcggcccaggccatcttcccggccgtggacccgctggactcgacctcgcggatcatggacccgctggtcatcggcgaagagcactacacggtggcgcgccgcgtccaggaagtgctgcagcagtacaaggccctgaaggacatcatcgccatcctgggcatggacgaactgtcggaagaggacaagctggtcgtggctcgcgcccgcaagatccagcgcttcctgtcgcagccgttccacgtcgccgagcagttcaccaacacgccgggcgccttcgtccagctgaaggacacgatccgctcgttcaagggcatcgtcgacggcgagtacgatcacctgccggaaggcgccttctacatggtcggtccgatcgaagaagccgtggccaaggccgaaaagatggcggctgaagcctaa

SEQ ID NO: 40746 - DNA, 876 bp, Caulobacter crescentus
atggccagcttgaaggaaatgcgcaatcggatctcgagcgtcaaagcgacgcaaaagatcacgaaagcgatgcagatggtggcggctgccaagctgcgccggagccaggacgcggcggaatccgcccgtccttacgcccggcgtctggccagcgtcatcgccaacctcgccgccggcgtgtccggcgacggcgccccgaagctcctggccggtacgggccgcgatgaccgccacctggtggtggtcgccgccgctgatcgtggcctggcgggcggcttcacctcgtcgatcgtccgcgccgcgcgcgcccacatcgacgggctgatcgcccagggcaaggatgtccgcgtggtctgcgtcggcaagaaggtgacggcgcagctcgccaagccctatgccggccggatcgtcgagacctttgacctgtcgtcctatcgccagctgacgctgtcggtggcccagccgatcgccgacgtcatcacccgcgaatacgaagcgggcgagaccgacgtcgtcaccctgttctacagccgcttcaagtcggtggtgcagcagatcccgacgggcctgcagctgatcccggccgtggtcgagaccggcgaagccgcctcgggcccgacggcggtctacgagtacgagccctcggaagaggccatcctcgagaccctgctgccgcgcaacctgacggtccagatcctctcggccctgctggacaacatggccggcttctacgccagccagatgaccgccatggacaacgccacgcgcaacgccggcgacatgatcaagcgctacaccctcgagtacaaccgttcccgccaggctcagatcaccaaggagctgatcgagatcatctccggcgccgaagccgtctga

SEQ ID NO: 40747 - DNA, 1533 bp, Caulobacter crescentus
atggacatccgcgccgccgagatttcggccatcctcaagtcgcagatcgccaacttcggcgaagaggccgccgtctcggacgtcggccaggtgctgtccgtcggtgacggcatcgcccgcatctacggtctggacaacgtccaggccggcgaaatgctggagttcccgaaggccggcgtgaagggcatggccctgaacctcgagcgcgacaatgtcggcgccgtgatcttcggccaggaccaggaaatcaaggaaggcgacgaagtccgtcgcctcggcgagatcgtggacgtgccggtcggccgtggcctgctgggccgcgtcgtcaacccgctgggcgagccgatcgacggcaagggcccgatccagtacaccgagcgtcgccgcgtcgacgtcaaggcgccgggcatcatcccgcgcaagtcggtgcacgagcccgtgcagaccggcctgaagtcgatcgacaccctgatcccggtcggccgtggccagcgcgagctgatcatcggtgaccgtcagaccggcaagaccgccgtcgccatcgacaccatcctgaaccagaaggccgtgaacgccggcaaggacgagagcgccaagctctactgcgtctacgtcgccatcggccagaagcgctcgaccgtcgcccagatcgtcaagaccctggaagagcacggcgccctggaatacacgaccgtcgtcgtggcctcggcctcggagccggctccgctgcagtacctggccccgttcgccggctgcgccatgggcgagtggttccgcgacaacggcctgcacggcctgatcatctatgacgacctgtccaagcaggccgtcgcctaccgtcagatgtcgctgctgctgcgccgcccgccgggccgcgaagcctatccgggcgacgtcttctatctgcactcgcgcctgctggaacgcgccgcgaagctgaacgaagacaacggttcgggctcgctgacggctctgccgatcatcgaaacccaggccaacgacgtgtcggcctacatcccgaccaacgtgatctcgatcaccgacggccagatcttcctggaaaccgacctgttctaccaaggcatccgtccggccgtgaacgtcggtatctcggtgtcgcgcgtgggttcgtcggcccagatcaaggccatgaagcaggtcgccggcccgattaagggcgagctggcccagtatcgtgaaatggccgccttcgcgaagttcggctcggacctggacgcctcgacccagaagatgctggcccgcggcgagcgcctgaccgagctgctgaagcagccgcaatacgcgccgctgtcggtcgaagagcaggtctgcgtgatctacgccggcacccgcggttacctcgacggcatcccgacctcgtcggtgcgtcgcttcgaagctgagttcctggcgcgtctgcacagccagcacgccgacctgctggaaggcatccgcaccaagaaggcgctcgacaaggatctggagaacacgctgaagagcgcgctcgacagcttctcgtcgaccttcgcctaa

SEQ ID NO: 40748 - DNA, 555 bp, Caulobacter crescentus
gtggcggacgaaaccaaggcgacggatgcgggtcagcgttatgcgcagtccctcttcgaattgacgatcgagaacggctccctgcaaaaggtcgaagccgacctgaagagcttgaaggccatggtcgccgacagcgccgacctgcgccgcctgatcgcctcgcccgccttctcggccgaggataagggcaagggcctgaccgccgtggccaagaaggccggcttccagccgctgaccaccaagtttctgggcctcgtcgcggccaacggtcgcaccggcgacctgctcggcgcgatctcggcctttgtcgagctgtcggccaagcatcgcggcgtggtgacggcggaagtcgtctcggccgccgccctgtcgccggcccagctgaagggcgtgcaaaccgccctggcccaggccctgggcaagacccccgaagtttccacgcgcgtcgatccgtccctcctgggcggtctgaaggtgcgcgtcggttcgcgtctcttcgacgcttcgctccgttcgaagctcgattccctgaaattcgccctgaagcgcgcttaa

SEQ ID NO: 40749 - DNA, 1308 bp, Caulobacter crescentus
ttgaccatggacttccgactgtcaccggaactttcggcctatctcgaagagctcgacgccttcatcgcgaaggagatcgccccgctccaggcgaaggacgacaaccagcgcttcttcgaccaccgccgcgaatgggcccgcaccgactgggacgccggcggcctgccgcgccacgaatgggaggaactgctcgccaaggcccgcaagttggccgacaaggcgggccactatcgctatgcgctccccaaggcctatggcggccaggacggcaccaatcttggcatggcggtgatccgcgagcacctggcgtccaagggcctgggcctgttcaacgacctgcagaacgagcactcgatcgtcggcaacaatccgttcgtgctgatgatccgcgacttcggccggcccgaccagcagcacctgatcgaggacatgctggatcgcggcgccttccgcccgacctttggcctgaccgaacccgaccacggctcggacgccacccacatggagacccaggcggtccgcgaggaacgccatggccaggccggctggcggatcgacggcgagaagatgtggaccacgggcatgcacgtggccacgcactgctgcctgttcgcccgcaccagcggccaggacggcgacgcgcgcggcatcaccgcctaccttgtcccggcccacgcgcccggcgtgaagatcgaggagtatctctggaccttcaacatgccgaccgaccacccgcgcgtcagcttcaccgacgtgtgggttcccgacagcgcgatgttcggtccggaaggcgggggcctggccctagcccagcacttcgtgcacgagaaccgcatccgccaggcggcctcgagcctcggcgcagccgcctactgcatcgaggagagcatcaagtacgcccgcgcccgcaagccgttcggcaaggcgctgtcggaaaatcaggccatccagttcccgatcgtcgaactctcgacccaggtcgagatgctgcgcctgttgatccgcaagacggcctgggagatggaccagatgtccaagcccgaggtcgaaaagcgcctctcggacaaggtctcgatgtgtaactactgggccaaccgcctgtgctgcgaggccgccgaccgggccatgcagatccacggcggcatcggctattcgcgccacaagccgttcgagcacatctaccgccaccaccgccgctaccggatcaccgagggcgccgaggagatccagatgcgcaaggtcgccgcctggctgttcggctatatgggtccgcgcaagcaggcgtttgcggagatggataaggtttaa

SEQ ID NO: 40750 - DNA, 1188 bp, Caulobacter crescentus
atgcgcgaagcggtcatcgtctcttacgcccgcaccggtctggccaagtcggtccgtggcggcttcaacaacacccatggcgcggcgatggccggccacgccatccagcacgccgtgtcgcgcgccggactggaaggggctgaggtcgaggacgtggtcctgggctgcggcggtcctgaaggcgccaccggcatgaacgtcgcgcgcaacgccgccatgtgggccggcctgccggtcaccacctcgggccagaccatcaaccgcttctgctcgtcgggcctgcaagccatcgccacggcggccaactatgtgcgcaatgacggggccaatgtcgccatcggcggcggcgtcgagtcgatctcgctggtcaatgcgggcggtcatatgaaccgcttccacatcaccgaagagaaactgatgcagacccatccggcgctgtggatggcgatgatcgacaccgccgacatcgtggccaagcgctacaatgtcagccgcgagtaccaggacgaatacgccctgcgcagccagcagcgcatcgccgccgctcaggccgccggcctgttcaaggacgagatcgttccgatggccaccaagatgaaggtggtcaacaaggaaaccaaggaagagtccttcgttgactacgtggtcgacaaggacgaatgcaaccgcgccgacaccaccctggaaggcctagccagcctcaagcccgtcatgggcgagggcaagttcatcaccgccggcaacgccagccagctgtctgacggcgccgccgccgtggtggtgatggaggccaaggaagccgaaaagcgcggcctgaccccgctgggcgccttccgcggtttcgccgtcgccggttgcgagcctgacgagatgggcatcggcccggtcttcgccgtgccgcgcctgctggaacgtcacggcctgaaggtcgacgacatcgacatctgggaactgaacgaagccttcgcctcgcagtgcctgtacagccgcgatcgcctgggcatcgacccggagaagtacaacgtcaacggcggctcgatcgccatcggtcaccccttcggcatgaccggcgcccgctgcgccggccacctcttgctggaaggcaagcgccgcaaggccaagctgggcgtggtgacgatgtgcatcggcggtggcatgggcgccgccggcctgttcgaaatcttctga

SEQ ID NO: 40751 - DNA, 1047 bp, Caulobacter crescentus
atgagcttcaagttttcccgagccaatccgccccatgtcggcgtcgtcggcgccaccggcctggtcggcggcatgatgcgcgagctgctggtcgagcgcgacttcccggtcgcctccctgcgcctgttcgcctcggcccgttcggcgggcggcaagatcgacttcaacggccagcagatcgtcgtcgaggacgccgccaccgccgacttctcagggctcgacatcgtgttcttctcggccggcggctctacctcgcgcgagctggcccccaaggccgccgccgccggcgccgtggtgatcgacaacagctcggcctggcgctcggaccccgaggtgccgctggtggtggcggaggtcaatccgcacgccctccagaacatccccaagggcatcgtcgccaaccccaactgcaccaccatggccgccatgccggtgctcaagcccctacacgacaaggcgggtctgaagcgcctgacggtcagcacctaccaagccgcctcgggcggcggcatggagggcatcgaggtgctgtccgagcagctgcgcgccggcgcggccggggatctggacggcctggcccgttcgccggacgccgcccccctgcccgcgccgcgcaagtgggccgtgccgctggcctataacgtggtgccgctgaactacgtgctgggcgaggacggctataccgaggaagagctgaagctgcgcgacgagagccgcaagatcctcgagatccccggcctgccggtcagcggcacctgcgtgcgggtgccggtcttcaccggtcacgccctgtcgatcaacgccgagttcgacggcccggtctcggtggccgaggcgctggacctgctggccgccgcgccgggcgtggtcatcgacgacgtccccaacccgctggccgccaccggccaggacccggtctttgtcggccgcgtgcgccccgacccgaccgttccgcacggcctggcgctgttcgtcgtcggcgacaacctgcgcaagggcgcggccctcaacgccgtccagatcgccgaggtgatgctgggggcctaa

SEQ ID NO: 40752 - DNA, 1860 bp, Caulobacter crescentus
gtgaagtcgagcgtccgaaatgaggcccgtctggcggcgatcaagcccgccaagcgcccgcagctggcgctggtgcgcaaggtcgaggtcgaccgctcgcgcgacgccctgctgaccgatttcggcaagaccacgctggaagaccgctacctgctgccgggcgaaagctatcaggacatgttcgcgcgcgtgtcgacggccttcgccgacgacgccgaccacgcccagcgcgtctatgactatatgagccgtctgtggttcatgccggccacgccggtgctgtcaaacggcggcgcggatcgcggcctgccgatcagctgcttcctgaacgcggtcaatgacagcctggacggcatcctgggcgtctggaacgagaacgtctggctggcggccaatggtggcggcatcggcacctattggggcggcgtgcgctcgatcggcgagaaggtcaagggccagggccagacctcgggcatcatccccttcatccgcgtgatggactccctgaccctggcgatcagccaaggcagcctgcgccgcggctcggccgccgtctatctggacatccatcacccggaaatcgaggagttcctcgaaatccgtaagccgtcgggcgacttcaaccgcaagtccctgaacctgcaccacggcctgtcgatcaccgacgagttcatgcacgccgtgcgcgacgggaccaagtttggcctgcgctcgcccaagaccaatgaggtcctgcgcgaggtcgacgcccgcgccctgtggcagaaggtcctggagctgcgcctgcagaccggcgagccctatctgatcttctccgacaccgtgaaccgcgccatgccctcgttccagcgcgagctgggcctgaaggtgcgccagtcgaacctgtgcagcgagatcatgctgcacaccgggaccgaccatctgggtcaggagcgcaccgccgtctgctgcctgtcgagcgtcaacgccgagacctatctggagtggcgcgaccacccgacgttcatcgaggacgtcatgcgcttcctcgacaacgtgctgcaggacttcatcgaccgcgcgccggacgccgcgtccgccgccgcctacgccgccatgcgcgagcgttcggtgggcctcggtttgatgggtttccacagcttcctgcagagccagaacgtgccgttcgaaagcgccctggccaagagctggaacatgcggatgttcaagcacctgcgccgcgaggccgacaaggcgtcgatcaagctgggcgaggagaagggcccgtgccccgacgccgccgaccgcggctcgatggagcgcttctcgcacaagctggccatcgccccgaccgcctcgatctcgatcatctgcggcggcacctcggcgggcatcgagccgatcccggccaatatctacacccacaagaccctgtcgggctcgttcgcggtgaagaacccctatctggagaagctgctcgaggagaagggccagaacaccgacgcggtgtggggctcgatcctggagaacgaaggctcggtccagcacctcgacttcctgagccaggacgagaaggacgtctacaagaccgccttcgaactggatcagcgctgggtgatcgaactggccgccgaccgcacgcccgaaatctgccagagccagtcggtcaacgtcttcctgcccggcgacgtcgacaagtgggacctgcacatgctgcactggatggcctgggagcggggcgtgaagagcctgtactatctgcgctccaagtcggtgcagcgggcggcctatgccggcgccgaggacaaggccgaggcggccgccggcggcttcgacgttcccgagaagaccgactacgacgagtgcctggcctgccagtaa

SEQ ID NO: 40753 - DNA, 2121 bp, Caulobacter crescentus
atgaaaaaagtctggttcggcgctgcggcgatcgcggccctgtccctctcggcgttcggggcgcaagcccacgagaaacacgcctgcatcgatgacgcttgcgtcatgcaatcgctgctcccctccatcaccgccggcggcgccgcggccgatgtcgcctcgctggagtccccgcgtttcgggacctggggctttgacctgtcgggcatggacaccacggtgaagccgggcgaggacttctacaagttcgccaacggcgcctgggacgcgcgcacgcagatcccgtcggaccgcacccgctacggcaatttcgacaagctggccgagctgtcggaagcccgcaccaaggcgatcatcgaagccgccgccgccaacaaggccgccacgggcgacaccgccaaggtcggcgcggcctatcgcgccttcatggacgaggccggcatcgagaagctcgacgccaagccgatcgcgccctacctggccgagatccgcaaggtgaagtccaaggacgagttcaccaccctgatgggcaagagctcgaccaccccgttcaccagcctgctgggcctgggcatctcgaccgacgccaagaaccccaaggcctacgcggtctatgccggcgccggcggcctgtcgctgcccgaccgcgactactatctggacgccaagttcgccgacaagaaggccgcctatctggcctatgtcgagaagctgctgaccatggccggctgggacaagcccgccgagcacgccaaggccgtcgtcgatttcgagaccaagctggccgaggtcacctggacccgcgccgagcgccgcgaccgcgacaagacctacaatcccgccaccctggccgagctgcaggcgatgtcgccgggctatgactggaaccgctatatcgccgcctcgggcctgcccaaggtcgaccggttcgtggtgaccaccaacaccaccttcccgaagtacgccaagatctacgccgagacgccgctcgacaccctgaaggcctggcaggcgttcaaggtgaccgacaacgccgcgccgctgctgtccaagcgcttcgtcgacgccggcttcgagttccgcaacaagaccctggccggccagcccgaacagcgtccgcgctggaagcggggcgtcggcgccgtcaacggcctgctgggcgaggcggtcggcaaggactatgtggcggcctacttcccgcccgagtccaaggccaagatgctggagctggtggccaatgtccgcggcgccatgaaggtccgcatcgacaatctcgactggatgagcgccgagaccaaggtcaaggcccaagagaagctggccaagttcaccgtcaagatcggctatcccgacgtctgggaggactattccaagctcgagatcaaggacaacgacgcctatggcaacgtccagcgcgccggcgcttgggccttcgccaaggacgtcgagcgtctgttcaagccggtggacaagaccgagtggggcatgaccccgcagacggtcaacgcctactataactcggtcaacaacgagatcgtgttcccggccgccatcctgcaggcgccgttcttccaccccgacgctgacccggctatcaactatggcggcatcggcggcgtgatcggtcacgagatcggccacggcttcgacgaccagggccgcaagtccgacggcgacggcgtgctgcgtgactggtggacggcggaagacgccgccaagttcaaggcgcaggccgaccgtctcggcgcccagtacggcgccttcgagcccctgccgggcatgaagctgaacggcgccctgaccatgggcgagaacatcggcgacatgggcggcctggccttcgcgctggacgcctaccgcgcctcgctgaagggccagcccgccccggtgctggacggcttcaccggcgaccagcgcgtctatctgggctgggcccaggtgtggcgtggcaagcagcgcgacgaggccctcaagcagcagatcatcgccggtccgcactcgccgggctactaccgtgtcaacggcaccatccggaacatggagggctggtactcggcctatgacgtcaagccgggcgacaagctgtacatcgcgccggaaaaccgcgtgaagatctggtag

SEQ ID NO: 40754 - DNA, 783 bp, Caulobacter crescentus
atggtcgaactcgcactccccaagaactcgcaggtcaagtcgggcaagcactggcccgccccggccggcgccaagaaggtcaagaccttcaagatctaccgctacgacccggaatcgggcggcaacccgcgctgggacacctacgacgtcgatgtcgacgccgtcggcccgatggtcctggacgccctgctctatatcaagaacaccatcgacccgaccctggccttccgccggtcgtgccgggagggtgtctgcggttcttgctcgatgaacatcggcggtcgcaatacgctggcctgtacgcacggctgggccgaggtcccgggcaaggccgtccagatcagcccgctgccgcacatgccggtggtcaaggacctgattccggacctcaccctgttctacgcccagtacgcctcgatcgagccctggctgcacaccgacacgcctgagccgcagaccgagtggaagcaaagccccgaggaccgcgaaaagctcgacggtctttatgagtgcatcctctgcgcctgctgctcgacctcgtgccccagctactggtggaacggcgacaagtatctgggcccggcggcgctgctgcacgcctatcgctggctgatcgacagccgtgacgaagccaccggcgaccgtctcgatgcgcttgaggatcccttcaagctctatcgctgccatacgatcatgaactgcgcccaggtttgccccaaggggctgaacccggccaaggccatcgccgaaatcaagaagatgatggtcgagcgcgtcgtctga

SEQ ID NO: 40755 - DNA, 1791 bp, Caulobacter crescentus
ttgatgtcggcctacaagttcatcgatcacaagtttgacgtcgtcgtcgtcggcgccggcggttctggccttcgcgctgcgctgggcgccgcccaggccggccttaagaccgcctgcatcaccaaggtgttcccgacccgcagccacaccgtggcggcgcagggcggcatttccgcttcgctgggcaatatgggccaggacgactggcgctggcacatgttcgacaccgtcaaggggtcggactggctgggcgaccaggacgccatcgagtacctgacccgcaacgccccggcggcggtctatgagctcgagcactggggcgtgcccttctcgcggacgcccgacggcaagatctatcagcgcgccttcggcggcatgaccaagaacttcggtgaaggcccgatccagcgcacctgcgcggcggccgaccggaccggtcacgccatgctgcacacgatgtacggccagtcgctggcccacgacaccgagttcttcatcgagtacttcgctctcgacctgatcatggacgacggcgtctgccgcggcgtgacggcgtggaagctcgacgacggcaccctgcatcgcttccaggcccagatggtgatcctggccaccggcggttacggtcgcgcctatttctcggcgacctctgcccacacctgcacgggcgacggcaacgccatggcgctgcgcgccggcctgccgctgcaggacatggaattcgtgcagttccaccccaccggcatctacggcgccggctgcctgatcaccgaaggcgcccgcggcgaaggcggctacctgaccaactcggaaggcgagcgcttcatggagcgctatgcgccgaccgtgaaggacctggcgccgcgtgacatggtcagccgcgcgatgaccatcgagatccgtgaaggtcgcggggtgggtcccaacaaggaccacatcttcctgcacctggaccacctggatcccaagatcctggccgagcgtctgccgggtatctcggaaaccgccaaggtgttcgccggcgtcgacgtgaccaaggccccgatcccggtgctgccgaccgtccactacaacatgggcggcatcccgacgaactatcacggcgaggtcgtcaccaagtcgggcgataatcccgaccaggtgatcccgggcctgatggccgtgggcgaggccgcctgcgtgtcggtgcacggcgccaaccgcctgggctccaactcgctgatcgacctcgtcgtgttcggtcgcgccgcagccctgcgctgcgccgagattctcaagccgggcgccaagcaaccggaactgaaggacgttcagaccgacgcgcacctggcgcgcttcgatcgcttccgtaacgcctcgggctcgaccggcaccgccgaactgcgcctcgaaatgcagaaggcgatgcaggaagacgccgccgtgttccgcacgggcgagagcctggacagcggcgttgcgcgcctgcaggccgtctgggacaagaaggccgacctcaaggtcagcgatcgcggtctggtgtggaacaccgacctgatggagacgctggagttcgacaacctgatcggtcaggcggtcgtgacggtgaacggcgcggctaaccgcactgagagccgcggcgctcacgcccgcgaggatttctcggaccgcaacgacgccgaatggatgaagcacaccctggcgtggctcgacctcgacaccggcaaggtgaagatcgattaccgcccggtccacagctacaccatgtcggacgacatcgcttacatcccgccgaagcaacgggtctactga

SEQ ID NO: 40756 - DNA, 660 bp, Caulobacter crescentus
atgagcatttccgcccatggggccaagatctgcggactgtcgacgcccgagacggtcaaggccgcctttgacggcgccgccgcgttcctgggctttgtcttcttcgacaagagcccgcgcaatgtcgcgcccgaagtcgccgcgcgccttgtggagccggttcgcggccggggcgtacagacggtcgccgtcaccgtcgatccggacgacgccctgatcgaccgcctgatggcgacgatgcggcccgacctgatccaggtgcacggcaaggagacgccctcgcgggttcgcgagatcgccgcccgcgccggcgtcggggtgatcaaggccttttccgtctcctcatcggcggatgtcgatcaggccgcggcctttgacggcgtggcccaacacctgatgttcgacgccaggcccgtggaaggttcggtcctgcccggcggcactggcgcccgcttcgactggggcctgctggccgggcgacgtttttcgcggccgcatttcctggccggggggcttgatccgtggaacgtcggtgaggccatcaagacctccggaacgcccctggtggacgtttcttctggcgtggagcgtggtcccggcctaaaggacccggctctgatctcggcgtttctcgacgccgtcaaacgcgccaaagactga

SEQ ID NO: 40757 - DNA, 774 bp, Caulobacter crescentus
ttgtcccagcccgtgaagatcgcgatcgccggcgccaatggccgcatgggccgcgccgtcgcccaggcgctggaaggtcggagcgacgccgtggtcgccgcccgcttcgagcgtcccggcgacgcgggcgaaggccttgtcgcgcgcgagaccgccctggccgccgccgaggcggtgatcgacttcaccctgcccgaggcctcggtcgccctggccgaagaggccgccgcgaacggcggtccggcgctggtcatcggctccaccgggttctcggacgagcagctggaccgcatcgacgcggccgccacgaagatcgtcatcgtccgctcgggcaactattcgctgggcgtcaacatgctgatgggcctggtgcgtcaggccgccgccgccctgccggctcaggattgggatatcgaagtcttcgaggcccaccacaagcgcaagatcgacgccccgtcgggcacggccctgatgctgggcgaagcggccgccgaaggacgaggcatcaacctcgccaaggtctcggaccgcggccgcgacggcgtcaccggtccccgcaaggatggcgacatcggcttttcggtggtgcgcggcggcgggatcatcggcgagcacagcgtgatcttcgccggcgagagcgagagcctgaccctgtcacactcggccatcgaccggggcctgttcgcgcgcggcgccatcgccgccgccgtctgggtcaagggcaagccgccaggcctctacgacatgcaggacgtgctgggcttcaagaaatag

SEQ ID NO: 40758 - DNA, 885 bp, Caulobacter crescentus
atgctgatcatcgagaatctgacccacgtctatggcaacggcacccgcgccctggatgaggtcagcctgacgatcccgcgcggcatgtacggccttctgggccccaacggcgccggcaagtcgaccctgatgcgcaccatcgccaccctgcaggctccgacctcgggccatatccggttcggcgacatagacgtgctcaagcaccccgaggagctgcgcaagacgctcggttatctgcctcaggacttcggcgtctatccgcgggtgtcggcctacgacatgctcgaccacatggccgtgctcaaggggatttccggcggcaaggaacgcaaggcgacggtcgagcacctgctgaatcaggtgaacctgtgggacgtacgcaagaaggccatcgccggcttctccggcggcatgcgccagcgcttcggcatcgcccaggctctgatcggcgatccgcgcctgatcatcgtcgacgagccgaccgccggcctcgaccccgaagagcgcaaccgcttcctgaacctcctggccgagatcggcgagaacgtggtggtgatcctctcgacccacatcgtcgaggacgtctccgacctctgcccggccatggcgatcatctgcaacggcgccatcgtgcgcgagggcgctcccgccgacctagtggcccagctgaagggccggatctggaagaagatcatcgacaaggccgagctggaggccgccaaggcccgctacaaggtcatctccacccgcctgctggccggccgcaccgtgatccacatcgagtccgagactgatccgggcgacggcttcaccgccgtcgagggcgggctggaggacgtctacttctccaccctgtcgtccacccgctcgcgccaagccgcgtaa

SEQ ID NO: 40759 - DNA, 1521 bp, Caulobacter crescentus
atgaccaagcccgaattcatcgagtccctgtcgcgcccgccgttcaaggcccgctacgacaacttcatcggcggccagtgggtcgccccggccgacggccgctacttcgacaacagctcgccgatccacggccggaagatctgcgagatcgcgcgttcgcaggcgatcgacatcgagcgcgcgctcgacgccgcccacgccgccaaggccggctgggcgaggaccagcgccgccgaccgctcgcgcatcctgctgcgcatcgccgaccgcatggaggagaacctcgcggccctggccaccgccgagacctgggacaacggcaagccgatccgcgagaccctggccgccgacattcccctggccatcgaccacttcagatacttcgccggctgcctgcgcagccaggaaggctcgatctccgagatcgaccacgacaccatcgcctatcacttccacgagccgttgggcgtggtcggccagatcattccctggaatttcccgctcctgatggcctgctggaagctggccccggccctggccgccggcaactgcgtggtgctgaaacccgccgagcagaccccggcctcgatcatggtctgggccgagatgatcggcgacctgctgcccgccggcgtgctcaacatcgtcaacggcttcggccttgaggccggcaagccgctggcctccagcccgcgcatcgccaagatcgccttcaccggcgagacctcgaccggtcggctgatcatgcagtacgccgcccagaacctgatccccgtgaccctggagctgggcggcaagtccccgaacatcttcttcgacgacgtggcgcgcgaggacgacgactatctcgacaaggccctggagggcttcaccatgttcgccctgaaccagggcgaggtctgcacctgtcccagccgcgcgctggtgcaggagtcgatctatgagaagttcatggagcgcgccctcaagcgggtgaacgccgtggtccagggcagcccgctcgatcccgccaccatgatcggcgcccaggcgtccgaagagcagctgaacaagatcctcggctacatggacatcggccgcaacgagggcgccaagctgctggcgggcggccagcgcaagatcctgccgggccagctggccgacggctactatgtcgagccgacggtcttcgaaggccacaacaagatgcggatcttccaggaggagatcttcggtccggtcctggcggtgacaaccttcaagaccgaggaagaagccctggagatcgccaacgacaccgccttcggtctgggcgcgggcgtctggagccgcgacgccaaccgttgctaccgcttcgggcgcggcatcgaggccggccgggtctggaccaactgctaccatgcctatccggcccacgcggcgtttggcggctacaagcagtcgggcgtcgggcgtgagacccacaagatgatgctggaccactatcagcagaccaagaacatgctggtcagctacagccccaaggcgctcggcttcttctga

SEQ ID NO: 40760 - DNA, 1944 bp, Caulobacter crescentus
gtggtgagcgacggacaggttttcccggttcctgcggatctggcgcgagacgcccatatcgatgcggccgcctatgacgcggcgctggctcgcgtcgaagccgaccccgaaggctattggcgcgacatcgccgcccggctcgactggatcacgccgcccaccaagatcaaggacgtctcctacgccaaggaagacttccgcatccgctggtacgaggacggcgttctcaacgtctcggccaactgcatcgatcgccacctgccggccaagaaagacgacgtggccctggtgttcgagggcgacgagcccgggacctccagcacgctgacctacggccagctgcacgaggaggtttgccgcatggccaacgtcctcaaggcgcagggcgtcaagaagggcgaccgggtcaccatctatctgccgatggtgccgctggcggccgtggccatgctggcctgcgcgcgcatcggagcggttcactcggtggtgttcggcggcttctcgcccgacagcatcgccggccgcatccaggactgcgcctcgcacttcgtgatcaccgccgacgagggccgccgcggcggccgccgcgtgccgctgaaggccaatatcgacgaagcgctgaagcactgcccatgggtcggcaaggtgctgatgatccgctggaccggcgccgatgtgccgctgaaggcgggccgcgacatcgtctggcaggacgtccgcgacaccgtctcggccgactgcccgcccgagcctatgaacgccgaggacccgctgttcatcctctacacctcgggctcgacggggaagcccaagggcgtgctgcacaccaccggcggctatctggcctgggcgtcgtggaccttctgggcggtgttcgactacaagccgggcgaggtgttctggtgcaccgccgacgtcggctgggtcaccggtcacagctatgtcgtctacggcccgctggccaatggcgggaccagcctgatcttcgagggtgtgcccaactatcccacccccagccgcttctgggaggtgatcgacaagcaccaggtgtcgatcttctacaccgcccccaccgctctgcgcgccctgatgcgcgaaggcgacgcgcatgtgaccaagaacgacctttcgtccctgcgcctgctgggcagcgtcggcgagccgatcaatccggaggcctggctctggtaccaccgcgtggtcggcaaggagaaactgccgatcgtcgacacctggtggcagaccgagaccggcggcatgctgatcaccccgctgcccggcgccaccgccctgaagccgggctcggcctccaagccgctgccgggcgtcaagccgcagctcgtggacgccgagggcaagtttctggacggcgccaccgagggaaatctggtcatcaccgacagctggccgggccagatgcggaccgtctatggcgaccaccagcggttcttcgagacctatttctcgacctatcccggcaagtacttcaccggcgacggctgccgccgcgacgccgatggctactactggatcaccggccgggtggacgatgtgatcaacgtctcgggccaccgcctgggcaccgccgagatcgagagcgccctcgtcgcgcacgagaccgtcgccgaggcggccgtggtcggctatccgcacgacatcaagggccagggcgtctatgcctatgtcactctgaaggcggggatcgaggctacggacgcgctgcgcaaggacctcgtcctgtgggtgcgccacgagatcggccctttcgccgcgccggacgtcatccagtgggccccgggcctgcccaagacccgctcgggcaagatcatgcgccgcatcctgcgcaagatcgccgagaacgagctcggcagcctgggcgacacctcgaccctggctgatccatcggtggtcgatgatctggtgaagaaccgcgcggggacctga

SEQ ID NO: 40761 - DNA, 1332 bp, Caulobacter crescentus
atgtcgctggctggattgaagagcgctcccggaggcgctctgcgagggatcgtgcgcgctccgggagacaagtccatttctcaccgttcgatgatcctgggcgcgctggcgaccgggacgacgacggtcgaaggtctcctggaaggggacgacgtcctggccaccgcccgggccatgcaggcctttggcgcgcggatcgaacgcgagggcgtcgggcgctggcggatcgagggcaagggcggctttgaagagcccgtcgacgtcatcgactgcggcaacgccggcaccggcgtgcgcctgatcatgggcgcggcggcgggctttgcgatgtgcgccaccttcacgggcgaccagtcgctgcgcggacgcccgatgggccgggtgctggatccgctggcccgcatgggcgcgacctggctgggtcgcgacaagggccgcctgcccttgaccctgaagggcggaaacctgcgcggcctcaactacaccctgcccatggcctcggcccaggtgaagtcggccgtgctgctggcgggcctgcacgccgagggcggcgtcgaggtcatcgagcctgaagccacgcgcgaccacaccgagcggatgctgcgcgccttcggggctgaggtgatcgtcgaggaccgcaaggccggcgacaagaccttccgccatgtgcgcctgcctgaggggcagaaactgaccggaacccacgtggccgtgccgggcgacccctcgtcggccgcgttcccgctggtggcggccctgatcgttcccggctcggaagtgacggtcgagggcgtgatgctcaacgaactgcgcacgggtctcttcaccaccctgcaggagatgggcgcggatctcgtgatctcgaacgtgcgcgtcgccagcggcgaggaggtcggcgacatcaccgcgcgctactcccagctcaagggcgtcgtcgtgccgcccgagcgcgcgccgtcgatgatcgacgagtatccgatcctggccgtggccgcggcttttgcgtccggcgagacggtgatgcgcggcgtcggcgagatgcgcgtcaaggaaagcgaccgcatcagcctgaccgccaatggcctgaaggcgtgcggggtccaggtggtcgaggagcctgaaggcttcatcgtcaccgggaccggccagccgccgaagggcggggcgaccgtcgtcacccacggcgaccaccgcatcgccatgagccacctgatcctgggcatggccgcccaggcggaggtcgccgtcgacgagccgggcatgatcgccaccagcttcccaggcttcgccgacctgatgcgcggcctgggcgcgacgctggcggaggcctga

SEQ ID NO: 40762 - DNA, 654 bp, Caulobacter crescentus
atgcagatcttcctcgacagcaccgacaccaaggtcatcgcggatctggcctcgaccggcctgatcgacggcgtgaccactaacccgaccctgatcgccaagtcgggccggccgatgctggaggtgatcgccgagatctgcgacatcgtcccgggcccgatcagcgccgaggtggccgccaccacggctgacgccatgatcgccgaaggtcagaagctggccaagatcgcgccgaacgtcgtggtcaagatcccgctgacccgcgatggcctgatcgcctgcgccgccttcgctgacgaagagatcaagaccaacgtcaccctgtgcttctcgccgacccaggctctcttggccgccaaggccggcgcgacctacatctcgccgttcatcggccgcctggatgactacggattcgacggcatggacctgatccgcgacatccgcgcgatctatgacaactatggctacgagaccgagatcctggccgcctcggtgcgcaacgccgcccacgtcaaagaggccgcgatcgtcggcgccgacgtcgtcaccatcccgccggcggtgttcagcgacctctacaagcacccgctgaccgacaagggcctcgagcagttcctgaaggactgggcctcgaccggtcagtcgatcctgtaa

SEQ ID NO: 40763 - DNA, 1788 bp, Caulobacter crescentus
ttgggggggggcggagcgcccatgagcgctgagacgaaggatattgacctggaacgcgctgtcgcctcgcgacgcgtcaatacctatctgcgcctcagctcgacctttgcgatctgcgcgaccctgcacctcgtcgttggcttgcgctgggtttggatctggggagcgctctacaccgcgatccagttcctggagacctggctggcgcttcagctcatcaagcgaccgcagagcagccctgatcgctggcgccgcttctccgtcatcgccctgccctttctaacctccgccgtcttcggattcctggcgattcccctgttcgcgtccgacgcccggttcgcgccgaccttgggcggcatgctgctggccggggcgctgatgaacgtcgtcatcgtccacggcggccttcgctcagcgaccatcgccgcagcgacgccgtacgtcggctatctcctggtcatccccatcgtggcccggcaggccaatcccgatgcacccctggccaacgccctgtggtttggcgcgctcctgctcatcgcggcggtggcggtcgcctcgcgcacgcttcacgccgcgctgaaagcggaggcggacgccaagaccgaggcggagcgtcgccgccacgaggccgaggaagccgtcgcggcgaaatcggccttcgtcgccatgatcagtcacgaacttcgcacgccgatcagcgccattctcgcgggggccggccgcctgcacagcgaagcgcccgaagccagctccaaggtgcacgcccagctgatcgccgacgcgggcgggctgatgcgcacgctgctcaacgaccttctggacttttcgcggctcgaggcgggccggatgtcggtggagaaatcgccgttcaacctccgccagagcctgtcggatacgctgcgcttctggcggccggagcttgcccgcaagggactgaagctgcgcgttgtcggcgcctcgacgatcccgcagtggacgctcggcgacgccatgcgcctgaagcaggtgctcaacaacctattgtccaacgccgccaagttcacccgaagcggcggcgtgtcggtgacgctgagggccgagatcgtcggcgatcaggtgcggctggttgtcgacgtggtcgataccggtccaggcattcccgaagccgcgcttccgcgcctgttcacgcctttcgatcaactcaatgagtcggtggctcgcctgcacggcgggtccgggcttggtctggccatcagccgcgagctcgcgcgcctgatgggcggtgatctgacggcgtccaatgcgctaggccagggcgcgcactttcggttttcggcattgctggaggccgccgaagcgcctgtggttccgacgctgggcccatcgatcagcggcctgcgcgtgctggtcgtcgacgatcacgtcgtgaaccggcgggccgtcgaactggtcctgcagcccttcggcgtggaagccaccctcgccgaatccggggaagaggccctcgaacttcttcgctccgaggtcttcgacgctattctgatggatgtctacatgccgggtatggacgggcgcgagacgacccgcacgctccgcgccggccagggccccaatcgcgatgcgccggtcgttgcggtcaccgcctcggccacgatcaaggattgggaggcctgcgcggcggccggcatgaacgcccatgtcgccaagcccatcgatccggccgaactgttctcggcgctcgctcaagtcatggcggcgcgcgacgctgtcggacctttcagaaccgacgtcgccgcgagcagcgcctga

SEQ ID NO: 40764 - DNA, 1071 bp, Caulobacter crescentus
atgtcgcagcaaaatcttcgcgtgatggtgaccggcgggtcaggcttcatcggctcggccgtgtgccgtcatctggccggccagaacaatgtcgcgatcctcaactacgacaagctgacctacgccgcctcgcaggccagcctggccatgctggagggcaaggccgactatcagttcgtgcagggcgacgtcgccgacgcggcgagggtttgcgccaccatcaaggcgttccgccccgacgtcgtgatgcatctggccgccgagagccatgtcgaccgctcgatcaccggcccgggcgatttcattcagaccaacatcgtcggcacctatgtgatgctgcaggccgctctggagcactggcgcggtttggaaggcgaggcgaagggccgcttccgcttccaccatatctcgaccgacgaggtgttcggcagcctgggcgccgagggcctgttcagcgagacaacgccctatgatccgcgctcgccctattcggcgtcgaaggcttcatcggaccacctggcgcgggcctggcagcacacctatggcctgccggtcgtggtctccaactgctcgaacaactacgggccctatcacttccccgagaagctgatcccgctggtcacgctgaacgccctggagggcaagccgctgccggtctacggcaagggcgacaatgtccgcgactggctgcatgtcgaggatcacgcccgcgcgctgcatctgatcgcgacgaagggcgtgcccggcgagagctacaatgtcggcggccgcaacgagcggaccaaccttcaggtggtcgaagccatctgcgacatcctcgatgagctgcgcccgattcccggccagagccgccgcgacctgatcaccttcgtcgccgaccgaccgggccatgacgcccgctacgccatcgacgccaccaagctggagaccgagctcggctggacggcgcaggagacgttcgacacgggcctgcgcaagaccatccagtggtacctcgacaacgaggcctggtgggcgccgctgcgcgaacgctatgcgggccagcgcctgggcctgtcgaagcaggcttaa

SEQ ID NO: 40765 - DNA, 876 bp, Caulobacter crescentus
atgaaacccgttcgcaaagctgttcttccggtcgccggtctcggtacgcgtgtcctgccgggcaccaagaccacgccaaaggaactgctgaacgtcgtcgatcgaccaattctttcctacattgtcgaggaaggtcgcaaggcgggcatcgaacacttcgtcttcgtcaccggccgctcgaagggcgcgatcgaggactatttcgatcatcagatcgagcttgaggcgcagctggaagccaagggcaagatcgagatccttgaacagctgcgcgccgagttgcccaagcccggcgagatgagcttcgtgcgccagatggcccccctgggcctgggccacgccgtctggtgcgcccgtgacatcatcggcgacgagcccttcgcggtcatgctgccggacgtcatcgtcgacgccgagcgcgcctgcctcggccaactgatcgacctctacaacaaggtcggcggcggcaatgtcatcggcgtcgaggaagtgccggaaagcgagacccacaagtacggcgtcgttgcgcccggcaaggtcgatggccgcatggcgaccatgaccggcatggtcgagaagccggcgaagggcacggcgccgtccaactgggcgatcgccggccgctatatcctgcagcccgagatcttcgccctgctggccgctcaggagaagggcgccggcaacgagatccagctgaccgattcgatggccaagctgatgcaggaccaggccttccacgcctatgtctatgagggcgtcacccacgactgcggcgacaagatcggcctgctacgcgccaatgtggccctggccttgaagcgcgccgacctgggcgccgccgcccgcgcggcggtcgaggcggcgctgaaggcctaa

SEQ ID NO: 40766 - DNA, 963 bp, Caulobacter crescentus
atggctcgcgcgaagatcgcccttatcggcgccggcatgatcggcggcaccctggcccacatcgccgctcgcgaagagctgggcgacgtgatcctgttcgacatcgccgaaggcaccccgcaggggaaggccctcgacatcgccgaagcctcggccgtgttcggcaaggacgtggccctgaagggcgccaacgactacgccgacatcgccggcgctgacgtctgcatcgtcaccgccggcgtgccgcgcaagccgggcatgagccgcgacgacctgctgggcatcaacctgaaggtcatgaaggccgtcggcgaaggcatcaaggctcacgcccccaacgccttcgtcatctgcatcaccaacccgctggacgcgatggtctgggccctgcagcagttctcgggcctgccgaaggaaaaggtcatcggcatggccggcgtcctcgactcggcccgcttcgcctacttcctggctgaagccaccggcgtctcggtggaagacatccacgcctggaccctgggcggccacggcgacgacatggtgccgatggtccgtcactcgaccgtcggcggcctgccgctgccggaactggtcaagcaaggctggctgtcgcaggacaagctggacgccatcgtcgagcgcacccgcaagggcggcggcgagatcgtcgccctcctgaagaccggctcggccttctacgccccggccgagagcgcgatcgccatggcgacctcgtacctgaaggacaagaagcgcgtcctgccgtgcgccacctacctgaccggccagtacggcctgaacgacctctatgtcggcgtgccggtggtcatcggcgccggcggcgccgagaagatcgtcgagttcgaaaccaacgacgacgagaaggcgatgttcgccaagtcggtcgagtcggtgaagggcctgatggaagcctgcaaggccatcgacagctcgctggtctaa

SEQ ID NO: 40767 - DNA, 2712 bp, Caulobacter crescentus
gtggacagagaaggatccttgaaaatggcgtctgtggacagcctcaaagcccgccgcgagctcaaggtcggcaaacagtcttacgtctattacagccttcgcgccgccgaggaagccggtcttgccgacgtttcctcgctgccggtctcgatgaaggtgctcctcgagaacctcctgcgtaacgaggacggcgtctcggtcaatgaagacgacctgaaggcggtcgccgcctggctcaacaacaagggctcggtcgagcacgagatcagcttccgccccgcgcgcgtgctgatgcaggacttcaccggcgttcccgccgtcgtcgacctggccgccatgcgcgacgccatggtcgccctgggcgccgacccggccaagatcaacccgctgaaccccgtcgatctggtgatcgaccactcggtgatggtcgacaacttcggcaacccgaaggcctatgacgacaacgtcaagcgcgagtacgagcgcaacatcgagcgttaccgcttcctgcgctggggctcgtcggccttcaacaacttccgcgttgtgccgcccggcaccggcatctgccaccaggtgaaccttgagtacctggcccagaccgtgtggaccaacacggtcgacggcgctgaagtcgcctatcccgacaccgtcgtcggcaccgacagccacactaccatggtcaacggcctggccgtgctgggctggggcgtgggcggcatcgaggccgaggccgccatgctgggccagccgatcccgatgctgatccccgaggtcatcggcttcaagctgaccggcgccatgccggaaggcgcgaccgccaccgacctggtgctcaccgtgacccagatgctgcgcaagaagggcgtggtcggcaagttcgtcgaattctacggcgacgccctggccaacctgaccctggaagaccaggcgaccatcgccaacatggctccggaatacggcgccacctgcggcttcttcccgatctcggccgccaccatcgcctatctgaagggcaccggccgcgccgccgagcgcgtcgcgctggttgaagcctacgccaaggagcagggcctgtggtgggagcccggcgtcgccgagccgaccttcaccgacaccctggaactcgacctgtcgactgtcctgccgtcgctggccggccccaagcgtccgcaggaccgcgtgctgctgtcggacgccgccgccaagttcgccgagtcgctggccggtgagttcggcaaggccgaaaaccccgagctgcgcgccccggtggaaggcgaggacttcgacgtcggccacggcgacgtggttatcgcggccatcacctcgtgcaccaacaccagcaatccctcggtgctgatcgccgccggcctcctggccaagaacgcggtcgccaagggtctgaaggccaagccgtgggtgaagacctcgctggcccccggctcgcaggtggtcaccgactacctggccaaggccggcctgaccaagcatctcgatgcgctcggctttaacctcgtgggttacggctgcacgacctgcatcggcaactccggcccgctgccggaagccatcagcaagacgatcaacgacaacgatctggtcgcctgctcggtgctgtcgggcaaccgcaacttcgaaggccgcgtgaacccggacgtgcgcgccaactacctggcctcgccgccgctggtggtggcctacgccctggccggtagcctgaagatcgacctggccacccagccgatcggccaggacaagaagggcaacgacgtcttcctgaaggacatctggccttcgaacgaggacatcgccgccctgcagcgcaaggcgatcaacgagaagatgttcgccactcgctacggcgacgtcttcaagggcgacaagaactggcagggcatcaaggtgaccggcggccagacttacgcctgggaagccgactcgacctacgttcagaacccgccgtacttccccaacatgtcgatgacgccggctccggtgaccgacatcgtggaagcccggatcctggccgtgttcggcgactcgatcaccaccgaccacatcagcccggccggttcgatcaaggcctccagcccggcgggtaagttcctgatcgacaacggcgtcgagccggtggacttcaacggctacggcgcgcgtcgcggcaaccaccaggtgatgatgcgcggcacgttcgcgaacatccgcatccgcaaccgcatcaccccggacatcgaaggcggcgtgaccaagcacttcccgaccggcgaagtgatgtcgatctacgacgcggccatgaagtaccaggaagaaggccgcccggcggtcgtcttcggcggcaaggaatacggcaccggttcgtcgcgtgactgggccgccaagggcaccaagctcctgggcgtccgcgcggtgatctgcgaaagcttcgagcgcattcaccgctcgaacctggtcggcatgggcgtgctgccgctgcagttcgtccaggacggctggcagaagctggagctgaccggcgaggagatcgtctcgatccgcggcctgaccgacctggcgccgcgcaagcagctgatcgtcgagctctaccgcccgaccgacggccgcatcgcccgcttcccggtccgctgccgcatcgataccccgaccgagcttgagtacttcaagaacggcggcgtgctgaactacgtgctgcggaacctggccaaggccgactaa

SEQ ID NO: 40768 - DNA, 867 bp, Caulobacter crescentus
atgagccgcaccttcctgaagatgaacggcctgggaaacgacttcgtcgtcatccagaccctcaccgaagccttcgatccgacccctgagcagatccgtgcgatcgccaagcggcccggtgtcgatggcaaaggcgggatcggctgcgaccaggtgatcgccatcgatccgcccagggccgagggcgcgtcggcctatgtccggttctggaactcggacggggaagtcgccggcgcctgcggcaacggcacgcgctgcgtcgcctggctcctgatgcagtcggccggcaaggacgcggtggccttcgacaccgtggccgggcgcctgtcgggtgttgcggccggcgacaagctggtcacggtcgacatgggtccgcccggtctcgactggacccagatccctctggctgaggagatgaacaccgagcgcgtggagctgcaggtcggtccgatcgacgcgccgctggtccacacgcccgtctgcgtctcgatgggcaatccgcacgtggtgttcttcgtcgacgcgccggtcaccgacgacttcgcgcgcggcacgggcagcctcgtcgagcatcacccgctgttccccgagggcgtcaatgtcggcttcgcgcacatcgccagccgcgaccatatccggctgaaggtctgggagcgcggggcgggcctcacccaggcctgcggcaccggcgcctgcgcggcccaggtcgccgccgtgcgtcgcgggctgaccgatcgcaaggcgcgggttgagttcgacacgggctccctgaccatcgaatggcgcgaaagcgacggccacgtgatcatgacgggcccgatcaccatggaatacgccggcaagctgccggagctggtcgccgcatga

SEQ ID NO: 40769 - DNA, 2034 bp, Caulobacter crescentus
atgacccagaaatgggtcggacccttcggcggcgtgcccgccttcgacaaggtcaaggtcgctgacttcaagtcggccctggaagcggccatggccaagaacctggccgagatcgacgccatcaccgccggcaaggccgcgccgaccttcgagaacacgatcgcggcgctggaagacgcgggccgcatgctcaatgacgtccagacctactattacatctggggctcgaacatgagcacgccggagttccagaaggtcgaggcggagatggatcccaagctctcggcccactacgataagatcaaccagaacgccgcgctcttcgcccgtatcgaggccgtctacaattcgcccgacaaggccaagctgacgcccgagcagcagcgggtgctgtggatctactacaccaacttcgtgcggtcaggcgccaagctcagccccgaggccaaggcccgggtcggcgcgatcaacaccgagctggccggcctctacaccaagttcagccagaaccagctggccgacgagaacacctggatcgaactgtccgacgccgatctggccggcctgcctgagggcctcaaggccgccgccgcctcgaacgccacggcgcgcaagcttccgggcaagcatgtgatcgtcaacacccgctccagcgtcgatccgttcctgaccgagtcgccggtgcgcgcggcgcgcgagaaggtctggcgcgccttcgtcaatcgcggcgacaacggcggggcgaccgacaacaacgccatcatcagcaagatcctgaagctgcgcgtcgagcgggccaagctcttgggctacaagacccacgcccactggcgcctcgagaacgccatggccaagacgcctgaaaacgccatggcgctgatggaggccgtctggaagccggccatcgcccaggtggccatcgacgtcgccgacatgcaggcgatcatcgacaaggagggcggcgttttcacgctggagccctgggactatcgcttctatgccgagaaggtgcgcaaggcgaagtacgacctcgatatgaacgaggtgaagccgtacctgcagctggacaagctgcgcgagggcatgttctgggcctcgggccagctctacggctttgagttcaagaagctggaaggcatccctgtcttccacgaggacgtcacggtttacgaggtgacgcgcggcggcaagcatgtgggcctgtggtacttcgacccctatgcccgtcccggcaagcgctcgggcgcgtggatgaacgcctaccgcacccaggagcggttcaagcgcgagaccaccacgatcgtctcgaacaactccaacttcatcaagggcaagcccggcgagccggtgctgatctcgtgggatgacgcggtcacgctgttccacgagttcggccacgccatccatggcctgaacgccaatgcgacctatccgtcggtgtcgggcacggccgtggcgcgtgactatgtcgagttccctagccagctgaacgagcactggctgtcgaccccgcaggtgctgaaccagtttgctctgcactatcagaccggcaagccgatcccggccgagctggtcaagaagatcgaggccgccggcaagttcggtcagggcttcggcacgaccgagtatctggccagcgccctcatcgacatgaagctgcacctggccggcgatgtggacatcgatccggacaagttcgagcgcgaggaactggccaagctgaacatgcccaaggagatcgtgatgcggcaccgcacgccgcagttcggccacgtgttctcgggcgatggctattcggccggctactacagctatctgtggtccgacaccctgaccgccgacgctgccgaggccttcgccgaggcgccgggcggcttctacgacaaggccgtcgccaagcggctctacgaggacatcatgtcggcgggcaacacgatcgatccggtcgagcagttccgcgccttccggggccgtgacgtcaagatcggcgccctgatgcgcaagcgcggcttcccggttccgccgggggcctga

SEQ ID NO: 40770 - DNA, 807 bp, Caulobacter crescentus
atgcgcctccgtatcgccacctggaacgtcaattccgtccgcctccgcgccgaacaggccgcacgcttcgtcgacgagcaagctccggacgtcctctgcatgcaggagatcaagtgccaggagggcgagtttccgcgtgaggccttcgaggccatgggcctgccgcatctgaagatcgccggccagaaaggctggcacggggtggccatcgcctcgcgcctgccgatcgaagacgttcccaccctgatgacctgccgcgagggccacgcccgctgtgtggcggtcaaggtggccggggtcgagatccagaacttctacattccggccggcggggacactcccgatcggatcggcaatccgaagttcgaccacaagctcgatttctacgagaccctgaccgccgccctgaagaagcgtgaccccaaggccccgctgatcgtcaccggcgacctcaatatcgcgccgggcgagaacgacgtctggagccaccgccagatgctgaaagtggtcagccatacgccgccggagctggaagccttcgacgcgctgatcaagtcgatggacctcttggacctgccgcgcctggcgacgccggagccgcagaagctgttttcctggtggagctatcgcgccgctgatttccgcaagtccaaccgcggcctgcgcctggaccacatcctggccagccccggcctgcgcgacgccgcgagcctggacggcaaggtctcctcgcgagtccacgacgacgtgcgcgaatgggagcgccccagcgaccacgcgccggtcacggccgacctgaaggtctga

SEQ ID NO: 40771 - DNA, 1509 bp, Caulobacter crescentus
gtggccacgctcgaagccttctggcgcctgaccggcgcgggctgggccttggtccgggccgacgctctgatcccgcgtgaactggaacccctgcttccccccagcgcgaagctggctgggcgcgtcctgcgcctcttcgcaggcccggccgcccgcaagggacggccgggggaacgcctggcggcggtgctcgaacgtcaagggccggccgcaatcaagatgggccagttcctgtcgacccgcgccgatatcttcggcgcggccttcgccgatgacctgtcgcgcctgaaggaccggctgccggcctttccactgagcgtcgccaaggccgagatcgcccgcaacctcggcaagccgctggatgagatcttcgccgagatcggtgaaccggtggccgccgcctctctggcccaggcccaccccgcaacgctggtcgacggccaaaaggtcgcggtcaaggtcctgcgcccgggcgtcgagcggcaggtcgcccgagacaccgccgtcctgcgcctggccgcgcgtctcgccgagaccctcgtcccagtctcgcgacgtctgcgtccgaccgagttcgtcgaggtcgtgatccgcgcactcgagcttgagatggacctgcgcttcgaggccgccggctgcgccgagctgggcgaggccatggccaaagacccctatatgcgcgcgcccgccgtctgctgggagggcgtcggcaaacgcgtcctgaccctgagctgggcggaaggcgcacccttatccgaccccgccgcactggatctgccaggcctggaccgcaaggcgctggccgagaacgtcacgcgcggtttcctcgcccaagcgctggatcacggcctgttccacgccgacctccacgagggcaatctgttcatcgccgcgccggcggcgatcacggcggtggactatggcattgtcggtcgcctggggcccggcgagcgccgctacctcgccgagatcctctacggctttctcaatcgtgactatgcgcgcgtggccaagatccatttcgacgccggttatgtgcccgcccaccaggatatggacgccttcgcccaagccctgcgcgctgtcggcgagccggtgtttggccgcaacgcgcgcgaggtctcgatgggccgactgctggcgcagctgttcgagattaccgccctgttcgatatggcgctgcgcccagagctcgttctgcttcagaagaccatggtcaccgttgaaggcgtcgctcgccggatcgatcccacccacgacctttgggcggccgcagatccggtcgtacggcggtggatcggccgtgaactctcccccgccgccaaggcgcgagacttcgccgaagaggcgatacgggcgatcaaggctctcgcgcggctggcggagacccccaccacacccccgcccgtcgccgccgaacgccttcacacttggcccctgctctggtttctggtcggcgcggccacggcgggagcggcctttgtgaccggtgtgctcctggcccgctag

SEQ ID NO: 40772 - DNA, 837 bp, Caulobacter crescentus
ttgcgaaagagggccccacacatggccgacgattacgcgttccccaagggcgagctgatgcgaggcaagaagggcctcgtcatgggcgtggccaaccacaactcgatcgcctggggcatcgccagccagctggccgcccagggcgccgagatggccttcacctaccagggtgaggaactggagcgccgcgtgcgcccgctggccgaaagcatcggtgtcaagaccatgatcccctgcgacgtcactgacgacgcctcgatggatgcggccttcgccgagatcgagaaggcgttcgggacgatcgatttcgtggtgcactcggtggccttcgccaacaagaacgagctgaagggctcgttcgtcgacaacaccacgcgggaaggcttcctgctggccatgaacatctcggccttcagcttcgtggacgtcgccaagcgcgcttccaagctgatgccgaacggcggctcgctgatcaccatgacctatctggggtcggagcggaccatcccgaactacaacaccatgggcgtggccaaggccgcgctcgaggcctcgacccgctacatcgcccgggatctgggtcccaagggtatccgctgcaacgccatctcggccggcgccatgcgcaccctggccctggcgggcatcgccggcggtcggggcatgatcgcccagggccgcgccttctcggcgatgaaggaagacacctcgatggaaggcgtcgccggctgcgccctgtggctggcctcggaccttggcaagtcgaccaccggcgaggtcgtccacgtcgacgctggcttccacatgatgggcatgcctgacgccgaggaggcttaa

SEQ ID NO: 40773 - DNA, 1212 bp, Caulobacter crescentus
atgcgtcgcgtcgtcgtcacaggactggggatcgtctcgtccatcggcaacaacgcccatgaggtattggcctcgctgcgggaagccaaatccggcgtgatcgccgcgccggagtacgccgagctcggcttccgctgccaggtccacgccgcgccccagatcgactgggaagcgatggtcgaccgccgcgccgcgcgtttcttggcgcccggcacggcctacgcccacatcgccatggaacaggcgatcgccgattccggcctctcggagaccgagctctcccacgagcgcaccggcctgatcgtcggttcgggcggtccctcgacccgcgtcatcatcgatgcggcggcgatcacccgggaaaagggccccaagcggatcggcccgttcgcggtgcccaaggccatgagctcgggcccgtctgcggtgctgtcgacctggttcaagatccgcgggatcaactattcgatcagctcggcctgcgcgaccagcgcccactgcatcggcgcggccgccgaacagatccagatgggcaagcaggacgtcgtcttcgcgggcggctgcgaggagctggactggagcctgtcgaacctgttcgacgccatgggcgccatgagcagcaacttcaacgaccgtccggccgtggccagccgcgcctatgacaagaaccgtgacggctttgtcatcgccggcggcgccggcatcgtggttctggaagagtacgaacgcgccaaggcccgcggggccaagatctatggcgaggtcgtgggctatgcggccaactcggacggctacgacatggtggccccgtcgggcgaaggcgcggcgcgctgcatgcgcctggccatggccgaggcgggtaaccgcgctatcgactatctgaacccgcacggcacctcgacgccggtcggcgacagcaaggagatgggcgcggtgcgcgaggtgttcggcgacaaggcgccgatgatctcgtcgaccaagtcgctcactgggcacagcctgggcgccgccggcgcgcaggaagcgatctactcgatcctgatgctcaacaacgacttcgcggccgagagcgccaatatcgaggagctcgaccccgagttcgccgacctgccgatcctgcgccagcgcgtcgacaagccgcttgagacggtgatgtccaacagcttcggctttggcggcaccaacggcacgctgatcttcagccgcgtctag

SEQ ID NO: 40774 - DNA, 1098 bp, Caulobacter crescentus
atgtcgcagggcgatgggcaaccctcgcgttgccatggccggtcacatcctttaatcgcaacgctgcttggaccttcggtcctgttctttcaaaggtttttccgtctcatgaccgcgctctacgacgtcgccgccatcggcaacgccatcgtcgacgtcatcgctcagtgcgacgacgccttcctcgagcgcgagggcctggtcaagggctcgatggccctgatcgatccggcgcgcgccgccagcctgtacgacgtgatgtctgccgcgatcgaagcctcgggcggcagcgccgccaacacggtggcgggcgtggccagcttcggcggcaaggcggcgtttctgggcaaggtcgcggacgaccagctgggccgcgttttccgccacgacatgaacgcgatcggctgcgtgttcacgaccccgccgctcgccgaaggcccggcgacggcccagagcctgatcaacgtcacgcccgacgctcagcgcaccatgtcgacctatctgggcgcctgcgtcgaactgaaccccgccgacgtcgacccggacatcatcgaggccgcgcagatctcgtatctggaaggctatctgttcgatccgcccgaagcgcgccgcgccttcgccaaggccgccgccctcgcacacggctcggaccgcaagatcgccctgaccctgtccgacagcttcgtcgtcgatcgccaccgcggcgccctgctgggcttcgtcgagacccagtgcgacatcgtcttcgccaacgccgccgaggtctgcgccctgttcgagaccgacgatttcgacgcggcggtgaaggccctggccgaacgctgcgagatcgccgccgtgacccgcagcgaaaagggctcggtggtcgcagcaaacgggcagttgcacgaaatctcggcctaccccgtggaaaaagtcgtggacacgaccggcgcgggcgaccaatacgcggcgggtttcctctttggcctttcccagggccgcccgctgcctatctgtggccagctgggcagcctggcggccgccgaggtgatcgaccactacggtccgcgtccgcaggtgtccctgcgcgagctggctgaaaagaacggactttag

SEQ ID NO: 40775 - DNA, 591 bp, Caulobacter crescentus
atggcccgcaccgctgaagtggtccgcgagacgaaggagacccagatccgggtctggatcgatctcgacgggaccggcgtctcgacgatctccaccggcattggtttctacgaccatatgctggagagcttcgcgcgccatggcggcttcgacctgaaggtcgagaccaagggcgatctgcacatcgacatgcaccatacggtcgaggacaccggcatcgtgctgggccaggcgatccacaaagcgctggacggcttcaagggcatccgacgcttcggctcggcctatatcccgatggacgagaccctgacgcgctgcgccatcgacctgtcgaaccggccgtatctgatctggaaggtcgagttcaagcggcccaaggtcggcgagatggacaccgagctcttcaaggagttccaccacgcgttcgcgatgaacagcggggcgtgcatccatctggaaacgctctacggcgacaacacccaccacgtcgccgaaagcggcttcaaggccctggcccgggcgctgcgtcaggcggtcgagatcgaccccaagaccggcggccaggctccgtccaccaagggcgtgctgtag

SEQ ID NO: 40776 - DNA, 783 bp, Caulobacter crescentus
atgctgaagacccggatcattccctgcctcgacgtgaaggacgggcgggtggtcaagggggtcaacttcgtctccctgcgcgacgccggcgacccggtggagcaggcgcgggcctatgacgccgccggcgccgacgagctgatgttcctggacatcaccgcttccagcgaaggacgcggcctgatcctggacgtcatctcgcgcaccgccgaggtctgcttcatgcccgtctcggtgggcggcggggtgcggcaggtctcagacatgcgccgcctgttgctggccggcgccgacaaggtctcggtcaacaccgccgccgtcgagaaccccgacctgatcgccggcggcgccgacgccttcgggtcccagtgcgtggtcgtggccatcgacgctaaggcgcgcgaggacggctcgggctggaacgtctggacctatggcggccgcaaggacaccgggatcgacgtggtcgaatgggccgccaaggtcgtggaacgcggcgcgggcgagatcctgctgacctcgatggaccgcgacggcgccaagatcggctacgatatcccgctgctgcaggcggtgacgggcgcggtcaatgtgccggtgatcgcctcgggcggcgcgggcaagaccgaacatctgatcgaagccgcccgcgaaggccacgccgccgccgtgctggccgcctcgatcttccacttcggcgagatttcgatcggcgaggccaagcaggccatggccgacgccggcatccccgtgcgcctagacgcgctgaagggagccgcatga

SEQ ID NO: 40777 - DNA, 324 bp, Caulobacter crescentus
atgagccagcgcctgaccgatgtcctgcagcggctggccgcgaccatcgaagcccgcaagggcggcgatccgtcggtgtcctatacggccaagctgttgaacgacccggccctcgccgccaagaagctcggcgaagaagccgtcgagacggtgatcgccgccgtggcgcagggttcggacgcgttggcggcggaaagcgccgacctgctctaccactggctggccctgatggcggcctcgggcgtctcgctggacgccgtggccgagaagctggaagcccgcgagggaacgtcgggcattgctgagaaggcgtcgcgcgcttaa

SEQ ID NO: 40778 - DNA, 696 bp, Caulobacter crescentus
atgagcgagaccctcacgatcaacaccccggatggcgccttctcggcctatgtggcgcgcccgaaggcggcaagcgccccggccattgtcgtgatccaagagatcttcggcgtgaacaaggtgatgcgcgacatctgtgacggcctggccgcccagggcttcgtcgccatatgccccgatctcttctggcggatcgagcccggcatcgacatcaccgaccagagcgaagccgaatggaagaaagcgttcgagctgttcaacgcgtttgacgtggacgcgggggtcacggacatcgccgcgaccatcgccgccgcccgtaagctggacggcgtcaacggcaaggtcggcgcggtcggctactgcctcggcggcctgctggccttcctcaccgcgacccgcaccgacatcgacgcggccgtctcctactacggcgtagggatcgagaagcatgtcggcgaggccgagaagctgaaccatccgttgctgatgcatattgccgagaaggaccagttcgtgccgcctgaggcgcagcagctgatcctcagcgcgctcaaggatcatccccagatcgagatccatatctacgaaggccgagaccacgccttcgcccgcgagggtggcgcgcactacgacgcggccgacgccgccaaggccaacggccgcagcctgaccttcttccagcaggccctggcctga

SEQ ID NO: 40779 - DNA, 1044 bp, Caulobacter crescentus
atgacccagaagctcgccgtcgttctcttcaatctcggcgggccagatggtccggacgcggttcggccgtttctgttcaacctgttccgcgatcccgcgatcatcggcgccccggcgctgatccgctatccgctggcggcgctgatctcgaccacgcgcgagaagtcggccaaggccaactatgcgatcatgggcggcggctcgcccttgttgccggaaacagaaaagcaggctcgcgcgctagaggccgccttggccctggccatgcccggcgtcgaagccaagtgcttcatcgccatgcgctactggcatccgttgacggacgagacggcgcgccaggtcgcggccttcgcgcccgaccaggtggtgctgctgccgctctatccgcagttttccaccaccacgacgggctcgtcgttgaaggcctggaagaagacctacaagggctcgggtgtgcagacgacggtcggctgctaccccactgaaggcgggctcatcgaagctcacgcccggatgatccgcgagtcctgggagaaagccggctcgccgacgaacatccgcttgctgttctcggcccatggtctgccggagaaggtgatcctggccggcgacccctatcagaagcaggtcgaggccacggccgccgccgtcgccgcgcatcttccgccgcagatcgaatggaccgtctgttaccagagccgtgtcgggccgctgaagtggatcggaccgtcgaccgatgacgagatccgccgcgccggcggcgaagacaagggggtgatgatcaccccgatcgcctttgtctcggaacacgtcgagaccctggtcgagctggatcacgaatatgccgagctggccgaagaggtcggcgccgcgccctatctgcgtgtgtcggccctgggcacagcgccggagttcatcgacggcctcgccaaggccgtgcgtgactcagtgggcaaggcgccggggacggtgtcttccgcctgcggctggcggtgtggcgcagattggtccaagtgcccgtgccgcgaaggagcctccgcgtga

SEQ ID NO: 40780 - DNA, 1056 bp, Caulobacter crescentus
atgacgtcttcctctccgatcctaaagcagacaccgaagtttctctccgcgctggaaggccagtcgcatgcgaaccctccggtgtggttcatgcgccaggcaggccggtatctgccggagtatcgcgcggtgcgtgcgacagcgccggacttcatcagcttctgctttgatcccgagaaggccgcagaggttacgctgcagcccatgcggcggtttccgttcgacgcctcgatcgtctttgcagacatcctgctgatcccgggggctctgggccagaaggtctggttcgaagccggcgagggtcccaagctcggcgacatgccgtccgtggagtccatggctgagaaggccggggaagcgggcaaggccctttcgcttgtcggggaaacgctgacccgggttcgttcggcgcttgatccggacaaggccctgatcggctttgccggcgcgccctggaccgtcgcgacctatatgatcgagaagggctccagcgaccgcagcggcgcgcggaccttcgcctatcagaacccagagacgctggacgccctgatccaggttctggtcgatgcgacgatcgactatctggccatgcaggtcgacgccggcgctcaggcgctgaaactgttcgagagctgggccgagggtctgtcggagccgttgttcgaccggctggtcacccagccgcacattcggatcatcgaaggcctgcgtgcgcggggcgtcaccgtgccgatcatcggcttcccccgcggcgccgggaccctcgtcgaggactacgccgccagaacccccgtgcagggcgtggcgctggacacctcggcctcggccaagcttggccagacgatccagaagaccaagaccattcagggcgcgctggatccgctgttgctccgcgccggcggcgatgcgctgttgaagcgcgtcgatgagatgctcgagcagtggaaccagggtccctatatcttcaacctgggtcacggcatcctgcctgacacgccgatcgctcatgtcgaggcggtgctcgaacgcgtgaccggtcagaaggtgggccaatga

SEQ ID NO: 40781 - DNA, 1926 bp, Bacillus halodurans
atgaaaaaagcaatactctcacttatctcattttttcttgtccttacatgctttcaaacgccttttgctgaagctaagggaaaacctcatgtgacaaaagaggagtatctcatcacccttcttgatgaattagaacttgaggttgctatgtacgaaggggccgatgtgccattttccgatgtctccaaagaagccattccttacatagaagcagctattcggatggatattcttgacgacacgttaggagcagagtttggcgccacacggccgattagtaaagaggaagcatatgttttactgattcgggcattacagcttgaaccctctaacttagatgtgctaaaaaaagttcgtgatcagcggcaaatcacctatccagcagaggtagcggctactcttgaatatggccttgttgtgctcgaaaaaaacaacaagcttcggccaaaaacgaaattgactcgaacagagcttaccgacatgtttgagaggctagatgaaaactttgagcgcctctccattgtacacacgaacgatcttcacggccgaattcttcccaatgaaagcaatggtgaaatgggattagcgaaaatcgcctccatcgccaattccgtgcgtgaatcaaactcagaaagcttgctgcttgaccttggggatacgttccacggcacaaactatgtgaacttcaacgaaggggaagctgctgccgaagcgatgaaccttatgggctatgatgcgatggtggcagggaatcacgattttaactttggctatgagcggcttgttcaaatagctgaggagactttagcattcccactcctaagtggtaacgtccttaagactgaaacaggggacaccctattctccacccatcagatcgttcagattcacaatcaaaaggtggcgttgatcggcttaacagcttctgacactccagtcaagacacatcccgataacattaaaggcttaacgtttaccgatgaggtggaggctgcccaatcgctcgtcgatcaaattgcaccgaccgtcgatcatgtgtttcttctcacccacattggctatggtgtcgaccgtcagatcgctgaacaagtggaagggatcgatttaattttaggagggcacagccatacgacgctagagtcaccagtgaaagtaaacgatacgtatattacgcaagcgtatgagcacggaaaagctgtaggcgtaacctatgtcttattccatcaaggggaattcgcctctgcttacggccagcttattagagattacccaggtttaacggctgatcctgaggttgagaatttactcgatacgtataaaaaagaagtagaggacgctcttgcggaagtgattggcacggtacccgaacgactcgttggtgcgcgcgagtttgttcgcacccaagaatccaaccttgggaaccttattaccgacgccatgcgagacatgacaggcgctgacattgcctttacgaatggtggaggcatccgtgcaaacatcgaagcaggcgacgtgacaaaaggagacgtaatcgctgcattcccatttacgaatacggtgatagcccttgaaatcacaggggagcaattatttcaatcactcgagcattcggttcgtttagctccagctgaaaacggaggctttcttcaagtatctggcgttcagatgacgtatgatcaaacgaaagcaccaggagaacgtattatcgatcttacggttaacggtgaacctttggataaaaataaaacgtatacagttgccactaatgactttttagcagctggcggtgatggttactcttggttggccgatggaaccctcgttatcgacacgggtgaattgcttagcgaggcggctagtcgttacattgcttctggtcagccaatccctcctgtggaaggacgaatccaagtggttgggcaataa

SEQ ID NO: 40782 - DNA, 1449 bp, Bacillus halodurans
atgaaaaaagcctcaacattgccgctatttgaacggctcgttcagcatgatcgcgggggacctatctcgtgccatgttccaggccataagcagggggctctttttcataaggatgcctgttcatattttcaaagcattttatcccttgatgtaacggagctaaccggccttgatgatctccatgatcccagaggagttattgcagaggctcaagctttgacagcccgctacgtcggggcagaagcgacgtgttttttagtcaatggctcgacggttggtaatttggcaatgattttaggtacacttgagcctggcgatactgtttttgtacaaagggattcgcataaatcggtgatgaatgggttagcgatggcaagggtccatccaatctttctttcaccatcctacgatgagagaacgcaattaccaacaggtattaccgaacaaacgttaaaacaagcactaatagaacacccgaatgggaaagcacttattttaacatatccatcgtattatggggttgcccgctcgatccgtccgctcgtccagatggcgaaagaagctggattgtacgtacttgtggatgaggcgcacggagcacattttccggtaggtgatccatttccgaaacaagcacttgagcaaggggccgacgtagtcgttcaatctgcgcataaaaccttacccgccttaacaatgggctcctatcttcactttgctcatggactacattcgaaaatcaaggattccattcgagagcaattgcagattttgcagtcgagcagcccatcctatccgattcttgcctcattagatgcagcaagaggatttttagaggatctcacgaatgtaaaagatacgctcgattccatcgcggagatgaataggcggattgaacaggtcgagcgtttgtcggttgctacattttccccgctacccaccgatccattaaaaacggtgattacagtagaaggggcaacaggatttgccttgcaaaccgaacttgaaaaagaggggatatactcagagctggcagacgatcgtcatgttttgcttatgtgggggctaacccctttacagaaagtccgacaagaggaaatcatcgacaaaatgtgccgagcaaccaagcggcttcctgcgcttgagcaaataagtaaagggtgccccctatcgttatcgtggcaagcacacacgtcgcttgatctatcatatgatgaacaaaaacgatattcaattgaagaggttgccgtggaagaggctgtggggaaagtgagtggagcaacggttatcccttatcccccaggggtacctctcctattaaaaggggaaaaaatcacagaaccgttaattgcccaatttcagcagttgcaggaggcaggggcccgttttcaggggagaccttctgagcaacaagggttgtatgtgtttacgttggaggctatgacatga

SEQ ID NO: 40783 - DNA, 633 bp, Bacillus halodurans
atgacgaaaggttgttttattacagttgaaggtggagaaggcgcagggaaaacgtctgccctagatgcgattgaggaaatgctaagagagaacggcctatcggtcgtacggacccgtgagccagggggaatccccattgctgagcaaattcgttccatcatattggatgttgaccatacaagaatggacccgagaacagaagcattgctttatgcagcagcccgtagacagcacctggttgaaaaagtgttgccagcactggaagcagggcatgtcgtcctatgcgatcgcttcattgatagtagtttggcgtatcagggatatgcaagaggtattgggtttgaggatattttagcgataaatgaatttgccattgaaggacgttatccggacttaactttgctttttcgtgtagatccagacgtaggcttatcacgaattcatcgtgatcagtcaagagagcaaaatcgcttggaccaagaggcccttacgtttcaccaaaaagtaaaagaaggttatgaacgtatagtcgagacgtaccccgaacgagtagtggagattgatgcaaaccagtcctttgatcaagttgttgctgatgccgtccgcatgataaagcaaaggctatcactttaa

SEQ ID NO: 40784 - DNA, 864 bp, Bacillus halodurans
gtgaaacagtcagtgaaggccccagctaaaatcaacttatctctcgatgtcttacataaacgaccagacggttatcatgaagtagacatgattatgacaacagtcgaccttgccgatcggattgatttaacactccgtgaagatgggcttatttcggtcgatgtctctgaaggctttgtaccaaatgatgaaaagaacttagcgtaccaagcagcggctttgctaaaagcgcgctatcacgtaaacgaaggggtctccatttacataacaaagcgaatcccagtagcagctggcttagctggtggaagcagtgatgctgccgccacattaagggggctgaacgatctatggcagctcgggttatctttggatgaattagcggttcttggagcggaaataggctctgatgtttcgttttgtgtatatggagggacagcaagggccacaggacgtggggaaatcatagaacggattgcctcaccgccaccgtgttgggttattttagcaaagccgcccatcggtgtatccaccgctgatgtttataaacgactaaatgtatctgcgattgaccatccaacaacggaacacatgattgctgcgatcgaggggaaagattttgatggcatctgtcatcacttgcacaatgtccttgaatcggttaccctcgacctttacccagaggtaagaaacattaaagaacaaatgaagcgctttggtgctgatggggtattaatgagcggaagtggccccactgtttttggtctcgtgtcgaaggaatcgcgagttcaacggatctacaatgggctacggggtttttgccatcaagtgtatgcggttcggataattggatcggccggctcttga

SEQ ID NO: 40785 - DNA, 951 bp, Bacillus halodurans
atggcaaactacggtgaccccaacttaaaggtgtttacgctcaattcaaataaagggttggcttatgagattacagaacgaatcggtgtaccgatggggaaaagctcagtcactcgctttagcgatggagaagtgcaaatcaacattgaagaaagcattcgaggttgcgatgttttcttaattcaatcaacagctgctccggcaaacgagcatattatggagctcctgattatgattgatgcggtgaagcgtgcatcggcgaaaaccattaatgtggtgatcccttattatggatatgcgagacaggatcgcaaggcgagagctcgtgaaccaattactgcaaaattggtggctaatttactagaaacagccggagcgactcgtgttttgacacttgatttacatgcgacacaaattcaaggcttttttgacattccggttgatcagcttatgggcgttccgattttagctgagttctttgagaaaaagggcttggatgatgtcgttgtcgtttcccctgatcatggaggcgtggtgcgtgcccgcaagctagccgaccggttaaaagcaccgattgcgattattgataaacgtcgtccgaaaccaaacgtggcggaagtaatgaatatagtcggtcatattgaagggaaaacagcaattattattgatgacattatcgatacagcggggacaatcacattagcagcaaacgccctcgttgaacacggggcaaaagaagtgtacgcatgttgcacccaccctgtcttatcaggacctgcgatcgagcgaatcaaaaattcgaaaatcaaagagcttgtcgtcatgaatacaattgagcttgaagaagaaaaattaattgataagattactacgttgtctgtagcaccgctcatggcagaggccattgtccgtgttcatgaacattcttctgtaagtttattatttgactaa

SEQ ID NO: 40786 - DNA, 540 bp, Bacillus halodurans
atgagagatgagattcaagagatcttgataacagaggaagagattcaagcaaaaatcgtcgagctaggcaaacagattaccgaagaatatgaagggaaatttcccctcgtcattggcgtattaaaaggtgccatgccatttatgggtgatttaacgaaacgaattgatactcatttagaaatggatttcatggatgtctctagctacggtaaaggaacagtttcctctggagaggtgaaaattattaaggatttggatacgtctgtagaaggacgggacgtattaattgtggaagatattatagacagtggcctcacacttagctatctgattgagctgttccattatcgaaaagcgaagtcagtgaaggttgtgacactactggacaaaccggaaggacgtaaagtcgacctcgttcctgatatggcaggcttcacggtaccggatgcgtttgtagtaggatatggattagactacgccgagcgttatcgaaaccttccgtttattgggattctcaagcctgaagtttacgaaagctaa

SEQ ID NO: 40787 - DNA, 1974 bp, Bacillus halodurans
atgaatcggatattccgaaatacgatattttatttattaatattcctcgtaatcgttgggatcgttagcttttttacaggtgaccaaacgcaaaccaagcagattacgtttgaagaatttacccagcatttagaggcgggtgaaattacaagtctgtcgataaagccagaacgggatgtgtatctcgtacgtggacagcttcgcggggccgatgaagatgagtttttcgaaacttatgtactcccgactgagcagatggcagaaaccatttccgaggccgctggtcttcaggtcattccagccgatgaaacgagcggatgggtgacgttctttacagggatcattccgtttatcattatttttatcctattcttcttcttgttgagccaagcgcagggcggtggaagccgtgtcatgaacttcggtaagagcaaggcgaaaatggtaaatgaggataaaaagaaggcgaagtttaaggatgtagctggtgctgacgaagagaaacaagagcttgtggaagttgtagaatttctgaaagaccctcggaagttctcggcgattggggctcgtattcctaaaggggtacttcttgtcgggccaccaggaacagggaaaacgttgcttgctcgtgcagttgcaggggaagcaggtgtaccgttcttctcgataagtggttcagatttcgttgaaatgtttgtcggggtaggggcatcccgtgtccgcgatttgtttgaaaacgcaaagaaaaacgctccttgcattatttttatcgatgaaattgatgctgtaggtcgtcaacgtggtgctggtttaggcggtggtcacgatgagcgcgagcaaacgttgaaccaattgctcgttgaaatggacggttttagcgctaatgaaggaattattattatcgctgcgacgaaccgtgctgacattcttgacccggcgttgctccgtccaggacgcttcgatcgtcaaattacggtcggacgcccagatgtgaaaggacgggaagaagtattaaaagtgcatgctagcaataagccgcttgctgatgacgtaaatcttaaaacgattgcgactcgtacaccaggattctctggggctgaccttgagaacttattaaatgaagccgcactcgttgcagctagacaagatgaaaagaaaattagcatggttcatattgaagaagccattgaccgtgtcattgctggaccggcgaagaagagccgtgtcatttccgaaaaggaaaagaacattgtggcgtggcatgaagctgggcatacagtcgtaggggtgaagctcgaaaacgccgatatggtgcataaagtaacgatcgtacctcgtggcgttgctggtggctatgctgtaatgcttccgaaagaagaccgctattttatgacaaagccggaactcctcgataaaattgtcggacttcttggcggacgtgtagcagaggaaattcaattcggtgaagcgtctacaggagcccacaatgacttccagcgagccacaagcattgcacgtaaaatggtgaccgaatatggaatgagtgaaaagcttggaccgatgcaatttggatcaggatctggtggtcaagttttcttagggcgggatattcaaaatgagcaaaattacagtgatgcgattgcccatgagattgatctcgaagtgcaacgaattattaaagagtgctatgagcgttgtaagcaaatccttttggacaacaagaaaagcctcgaccttgtagctgaaacgcttttagatctagaaacccttgacgccgaacaaatcaaatcactgatccatgatggaaagcttccagataatcaccacttagcagagaagattgctgaaacgcgtgagaacgggcaagattcagaagttaaggtgaacattcattcgaaaaaaggtgaggaagcagagggcgaagaatcagcgcctaacactgaagatgtaaaagaagatgacgaaaagaaataa
